US011364309B2

(12) United States Patent
Cotney et al.

(10) Patent No.: US 11,364,309 B2
(45) Date of Patent: Jun. 21, 2022

(54) NEURONAL ENHANCERS

(71) Applicants: Norwegian University of Science and Technology (NTNU), Trondheim (NO); University of Connecticut, Farmington, CT (US)

(72) Inventors: Justin Cotney, Guilford, CT (US); Clifford Kentros, Malvik (NO); Stefan Blankvoort, Trondheim (NO); Rajeevkumar Raveendran Nair, Trondheim (NO)

(73) Assignees: NORWEGIAN UNIVERSITY OF SCIENCE AND TECHNOLOGY (NTNU), Trondheim (NO); UNIVERSITY OF CONNECTICUT, Farmington, CT (US)

( * ) Notice: Subject to any disclaimer, the term of this patent is extended or adjusted under 35 U.S.C. 154(b) by 345 days.

(21) Appl. No.: 16/181,723

(22) Filed: Nov. 6, 2018

(65) Prior Publication Data
US 2019/0247516 A1 Aug. 15, 2019

Related U.S. Application Data

(60) Provisional application No. 62/584,282, filed on Nov. 10, 2017.

(51) Int. Cl.
| | |
|---|---|
| *A61K 48/00* | (2006.01) |
| *C12N 7/00* | (2006.01) |
| *C12N 15/113* | (2010.01) |
| *A61P 25/28* | (2006.01) |
| *C12N 5/10* | (2006.01) |

(52) U.S. Cl.
CPC ...... *A61K 48/0041* (2013.01); *A61K 48/0058* (2013.01); *A61P 25/28* (2018.01); *C12N 5/10* (2013.01); *C12N 7/00* (2013.01); *C12N 15/113* (2013.01); *C12N 2310/122* (2013.01); *C12N 2310/3519* (2013.01); *C12N 2310/531* (2013.01); *C12N 2750/14143* (2013.01); *C12N 2750/14171* (2013.01)

(58) Field of Classification Search
CPC .................................................. A61K 48/0058
See application file for complete search history.

(56) References Cited

U.S. PATENT DOCUMENTS

| 8,524,499 B2 | 9/2013 | Goldman et al. |
| 2015/0044187 A1 | 2/2015 | Visel et al. |
| 2016/0200763 A1 | 7/2016 | Eldar-Finkelman et al. |

OTHER PUBLICATIONS

Vermunt, et al.; "Large-Scale Identification of Coregulated Enhancer Networks in the Adult Human Brain"; Cell Reports; 2014; vol. 9; pp. 767-779.
Vermunt, et al.; "Transcriptional Dynamics at Brain Enhancers: from Functional Specialization to Neurodegeneration"; Current Neurology and Neuroscience Reports; 2016; vol. 16, Issue 94; pp. 1-10.
Watakabe, et al.; "Comparative Analyses of Adeno-Associated Viral Vector Serotypes 1, 2, 5, 8 and 9 in Marmoset, Mouse and Macaque Cerebral Cortex"; Neuroscience Research; 2015; vol. 93; pp. 144-157.
Witter, et al., "Architecture of the Entorhinal Cortex A Review of Entorhinal Anatomy in Rodents with Some Comparative Notes"; Frontiers in Systems Neuroscience; 2017; vol. 11; Article 46; pp. 1-12.
Zufferey, et al.; "Woodchuck Hepatitis Virus Posttranscriptional Regulatory Element Enhances Expression of Transgenes Delivered by Retroviral Vectors"; Journal of Virology; 1999; vol. 73, Issue 4; pp. 2886-2892.
Aschauer, et al.; "Analysis of Transduction Efficiency, Tropism and Axonal Transport of AAV Serotypes 1, 2, 5, 6, 8 and 9 in the Mouse Brain"; PLOS ONE; 2013, vol. 8, Issue 9; e76310; pp. 1-16.
Axelsen, et al.; "Gene Therapy for Parkinson's Disease, An Update"; Journal of Parkinson's Disease; 2018; vol. 8, pp. 195-215.
Balazs, et al.; "Liposomes for Use in Gene Delivery"; Journal of Drug Delivery; 2011; Article ID 326497; pp. 1-12.
Blankvoort, et al.; "Enhanced Transgenics: A Novel Means to Generate Neuroanatomically-Specific Genetic Tools"; Abstracts Poster JJJ56; Neuroscience, Nov. 13, 2016; pp. 1-2.
Blankvoort, et al.; "Marked Diversity of Unique Cortical Enhancers Enables Neuron-Specific Tools by Enhancer-Driven Gene Expression (EDGE)"; Current Biology; 2018; vol. 28; pp. 2103-2114.
Blankvoort, et al.; Poster F18-3069; "The Marked Diversity of Unique Cortical Enhancers Enables Neuron-Specific Tools by Enhancer-Driven Gene Expression (EDGE)"; FENS Jul. 7-11, 2018; 1 page.
Bouard, et al.; "Viral Vectors: From Virology to Transgene Expression"; British Journal of Pharmacology; 2008; vol. 157; pp. 153-165.
Callaway, et al.; "Monosynaptic Circuit Tracing with Glycoprotein-Deleted Rabies Viruses"; Journal of Neuroscience; 2015; vol. 35, Issue 24; pp. 8985-8979.
Chan, et al.; "Engineered AAVs for Efficient Noninvasive Gene Delivery to the Central and Peripheral Nervous Systems"; Nature Neuroscience; 2017; vol. 20, No. 8; pp. 1172-1181.
Chaplot, et al.; "Dendrimers for Gene Delivery—A Potential Approach for Ocular Therapy?"; Journal of Pharmacy and Pharmacology; 2013; vol. 66; pp. 542-556.
Chen, et al.; "Ultrasensitive Fluorescent Proteins for Imaging Neuronal Activity"; Nature; 2013; vol. 499; pp. 295-302.
Chow, et al.; "An Overview of APP Processing Enzymes and Products"; Neuromolecular Medicine; 2010; vol. 12, No. 1; pp. 1-12.

(Continued)

*Primary Examiner* — Valarie E Bertoglio
(74) *Attorney, Agent, or Firm* — Cantor Colburn LLP

(57) ABSTRACT

A delivery vehicle which comprises a nucleic acid construct, wherein the nucleic acid construct comprises (i) an enhancer which specifically drives gene expression in cells of the entorhinal cortex (ii) a promoter; and (iii) a therapeutic gene, wherein said enhancer, promoter and therapeutic gene are operatively linked, said enhancer and therapeutic gene are heterologous, and said delivery vehicle is suitable for delivery of the nucleic acid construct to the brain of a mammal.

14 Claims, 17 Drawing Sheets
(14 of 17 Drawing Sheet(s) Filed in Color)
Specification includes a Sequence Listing.

(56) References Cited

OTHER PUBLICATIONS

Costa, et al.; "Viral and Non-Viral Gene Therapy for Glioblastoma: New Insights into the Treatment of Malignant Brain Tumors"; Journal of Genetic Syndromes and Gene Therapy; 2013; vol. 4, Issue 7; pp. 1-9.
Delzor, et al.; "Restricted Transgene Expression in the Brain with Cell-Type Specific Neuronal Promoters"; Human Gene Therapy Methods; 2012; vol. 23, pp. 242-254.
Deverman, et al.; "Cre-dependent Selection Yields AAV Variants for Widespread Gene Transfer to the Adult Brain"; Nature Biotechnology; 2016; vol. 34; No. 2; pp. 204-209.
Dias, et al.; "Molecular Genetics and Emerging Therapies for Retinitis Pigmentosa: Basic Research and Clinical Perspectives"; Progress in Retinal and Eye Research; 2018; vol. 63; pp. 107-131.
Dimidschstein, et al.; "A Viral Strategy for Targeting and Manipulating Interneurons Across Vertebrate Species"; Nature Neuroscience; 2016; vol. 19, Issue 12; pp. 1743-1748.
Flotte, et al.; "Expression of the Cystic Fibrosis Transmembrane Conductance Regulator from a Novel Adeno-associated Virus Promoter"; Journal of Biological Chemistry; 1993; vol. 268, Issue 5; pp. 3781-3790.
Gray, et al.; "Genomic Views of Transcriptional Enhancers: Essential Determinants of Cellular Identity and Activity-Dependent Responses in the CNS"; Journal of Neuroscience; 2015; vol. 35, Issue 41; p. 13819-13826.
Ha, et al.; "Exosomes as Therapeutic Drug Carriers and Delivery Vehicles Across Biological Membranes: Current Perspectives and Future Challenges"; Acta Pharmaceutica Sinica B; 2016; vol. 6, Issue 4; pp. 287-296.
Haberman, et al.; "Novel Transcriptional Regulatory Signals in the Adeno-Associated Virus Terminal Repeat A/D Junction Element"; Journal of Virology; 2000; vol. 74, No. 18; pp. 8732-8739.
Hauck, et al.; "Generation and Characterization of Chimeric Recombinant AAV Vectors"; Molecular Therapy; 2003; vol. 7, No. 3; pp. 420-425.
Holehonnur, et al.; "Adeno-Associated Viral Serotypes Produce Differing Titers and Differentially Transduce Neurons Within the Rat Basal and Lateral Amygdala"; BMC Neuroscience; 2014; vol. 15, Issue 28; pp. 1-14.
Holmes, et al.; "Long-Term Effects of AB42 Immunisation in Alzheimer's Disease: Follow-up of a Randomised, Placebo-Controlled Phase I Trial"; Lancet; 2008; vol. 372, pp. 216-223.
Kanter, et al.; "A Novel Mechanism for the Grid-to-Place Cell Transformation Revealed by Transgenic Depolarization of Medial Entorhinal Cortex Layer II"; Neuron; 2017; vol. 93, pp. 1480-1492.
Kitamura, et al.; "Island Cells Control Temporal Association Memory"; Science; 2014; vol. 343; pp. 896-901.
Kobro-Flatmoen, et al.; "Reelin-immunoreactive Neurons in Entorhinal Cortex Layer II Selectively Express Intracellular Amyloid in Early Alzheimer's Disease"; Neurobiology of Disease; 2016; vol. 93, pp. 172-183.
Kotterman, et al.; "Engineering Adeno-Associated Viruses for Clinical Gene Therapy"; Nature Reviews Genetics; 2014; vol. 15, pp. 445-451.
Kotterman, et al.; "Viral Vectors for Gene Therapy: Translational and Clinical Outlook"; Annual Review of Biomedical Engineering; 2015; vol. 17, pp. 63-89.

Kugler, et al.; "Human Synapsin 1 Gene Promoter Confers Highly Neuron-Specific Long-Term Transgene Expression From an Adenoviral Vector in the Adult Rat Brain Depending on the Transduced Area"; Gene Therapy; 2003; vol. 10, pp. 337-347.
Liu, et al.; "Optogenetic Stimulation of a Hippocampal Engram Activates Fear Memory Recall"; Nature; 2012; vol. 184, pp. 381-385.
Loew, et al.; "Improved Tet-Responsive Promoters With Minimized Background Expression"; BMC Biotechnology; 2010; vol. 10, Issue 81, pp. 1-13.
Luo, et al.; "Long Noncoding RNAs and Alzheimer's Disease"; Clinical Interventions on Aging; 2016; vol. 11, pp. 867-872.
Luo, et al.; "Subthalamic GAD Gene Therapy in a Parkinson's Disease Rat Model"; Science; 2002; vol. 298, pp. 425-429.
Mendell, et al.; "Single-Dose Gene-Replacement Therapy for Spinal Muscular Atrophy"; New England Journal of Medicine; 2017; vol. 377, Issue 18; pp. 1713-1722.
Miao, et al.; "Parvalbumin and Somatostatin Interneurons Control Different Space-Coding Networks in the Medial Entorhinal Cortex"; Cell; 2017; vol. 171, pp. 507-521.
Murphy, et al.; "Alzheimer's Disease and the B-Amyloid Peptide"; Journal of Alzheimer's Disease; 2010; vol. 19, Issue 1; pp. 1-17.
Nair, et al.; "Enhanced" Viral Vectors: Driving Transgene Expression Limited to Specific Neuronal Cell Types in Wildtype Animals Using Enhancers Identified by Differential Screening of Brain Regions; Abstract WW7; Neuroscience; Nov. 15, 2017; 1 page.
Nair, et al.; Poster; "Viruses Made with Entorhinal Cortex-Specific (EC) Enhancers Enable Transgene Expression Restricted to Particular EC Celltypes in Two Species of Wildtype Animals"; FENS 2018, Jul. 2018; Berlin, Germany; 1 page.
O'Brien, et al.; "Amyloid Precursor Protein Processing and Alzheimer's Disease"; Annual Review of Neuroscience 2011; vol. 34, pp. 185-204.
Pennacchio, et al.; "Predicting Tissue-Specific Enhancers in the Human Genome"; Genome Research; 2007; vol. 17, pp. 201-211.
Potter, et al.; "A Simplified Purification Protocol for Recombinant Adeno-Associated Virus Vectors"; Molecular Therapy—Methods & Clinical Development; 2014; vol. 1; 14034; pp. 1-7.
Roadmap Epigenomics Consortium; "Integrative Analysis of 111 Reference Human Epigenomes"; 2015 Nature; vol. 518, pp. 317-330.
Rosenzweig; "Vectors for Gene Therapy"; Current Protocols in Human Genetics; 2007; Chapter 12; pp. 1-4.
Roth, et al.; "DREADDs for Neuroscientists"; Neuron; 2016; vol. 89, pp. 683-694.
Rowland, et al.; "Transgenically Targeted Rabies Virus Demonstrates a Major Monosynaptic Projection from Hippocampal Area CA2 to Medial Entorhinal Layer II Neurons"; Journal of Neuroscience; 2013; vol. 33, Issue 37; pp. 14889-14898.
Shen, et al.; "A Map of the cis-Regulatory Sequences in the Mouse Genome"; Nature; 2012; vol. 488, pp. 116-120.
Shevtsova, et al.; "Promoters and Serotypes: Targeting of Adeno-Associated Virus Vectors for Gene Transfer in the Rat Central Nervous System in Vitro and in Vivo"; Experimental Physiology; 2004; vol. 90, Issue 1; pp. 53-59.
Sternson, et al.; "Chemogenetic Tools to Interrogate Brain Functions"; Annual Review of Neuroscience; 2014; vol. 33, No. 37; pp. 387-406.
Varga, et al.; "Target-Selective GABAergic Control of Entorhinal Cortex Output"; Nature Neuroscience; 2010; vol. 13; Issue 7, pp. 822-824.

A. MEC-13-48E

B. MEC-13-53A

C. MEC-13-81B

D. MEC-13-104B

E. MEC-13-79A

F. MEC-13-95H

G. MEC-13-32B

H. MEC-13-123B

A. FOUNDER A

E. FOUNDER E

B. FOUNDER B

F. FOUNDER F

C. FOUNDER C

G. FOUNDER G

D. FOUNDER D

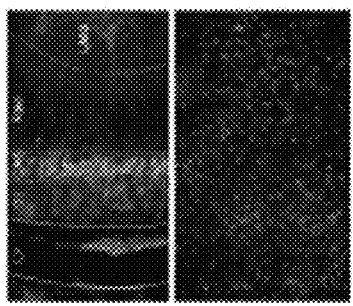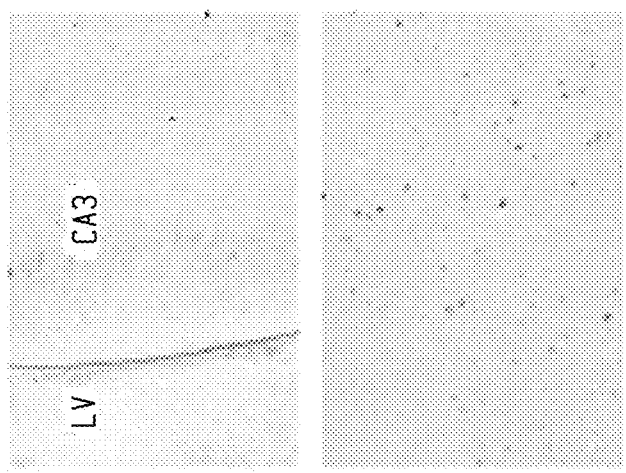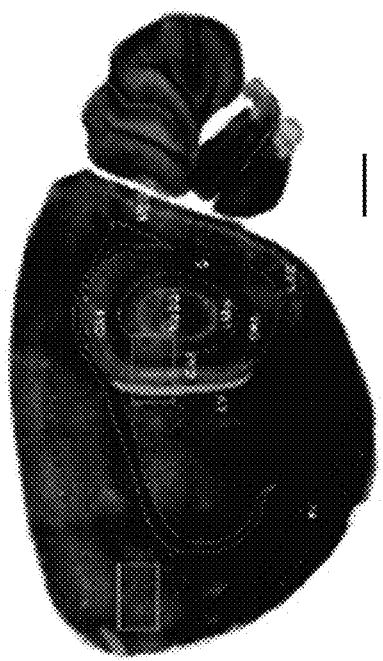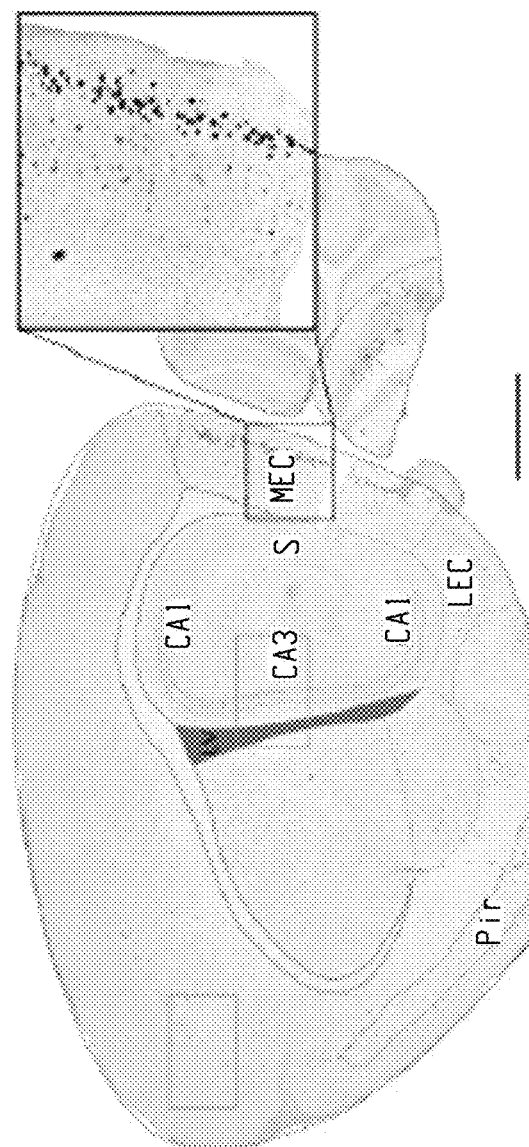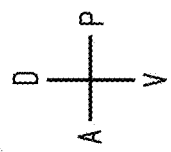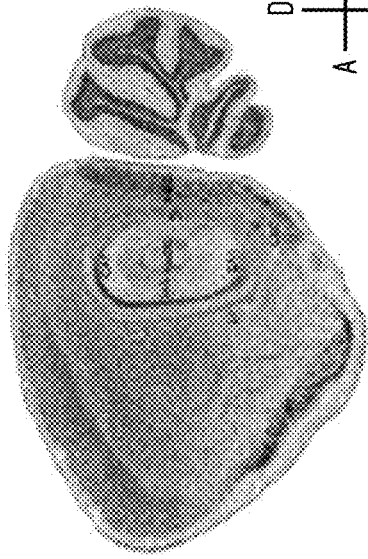
Fig. 5B
Fig. 5C
Fig. 5D

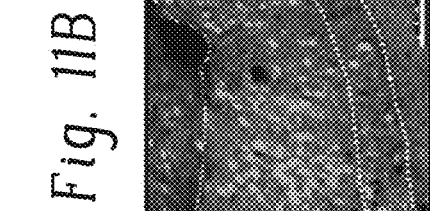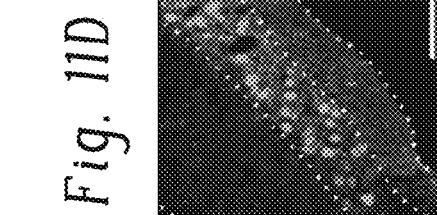
Fig. 11A  Fig. 11B
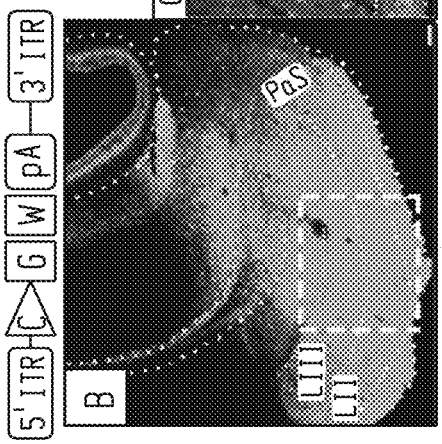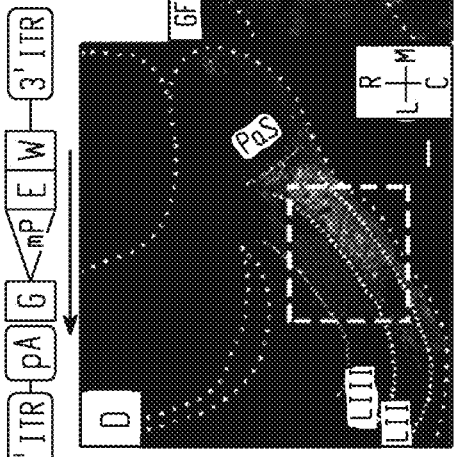
Fig. 11C  Fig. 11D
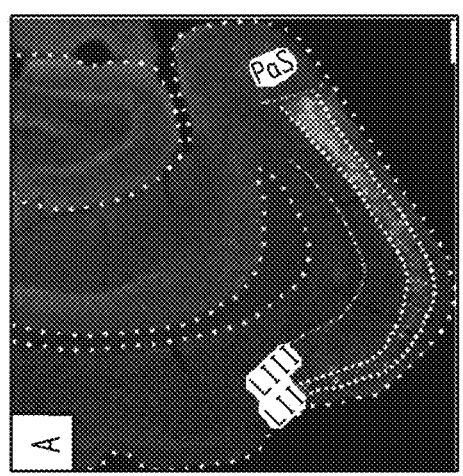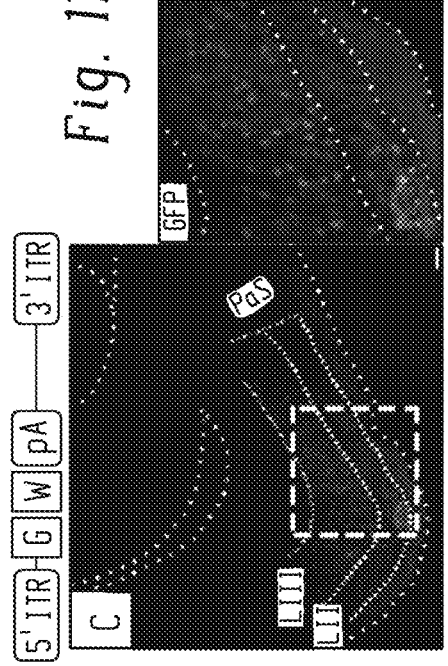
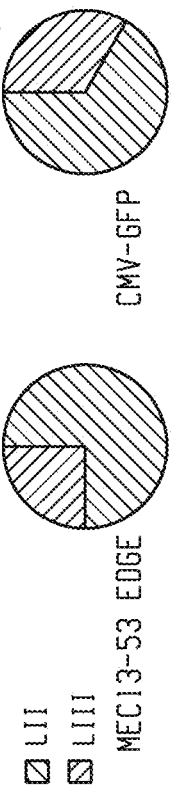
Fig. 11E

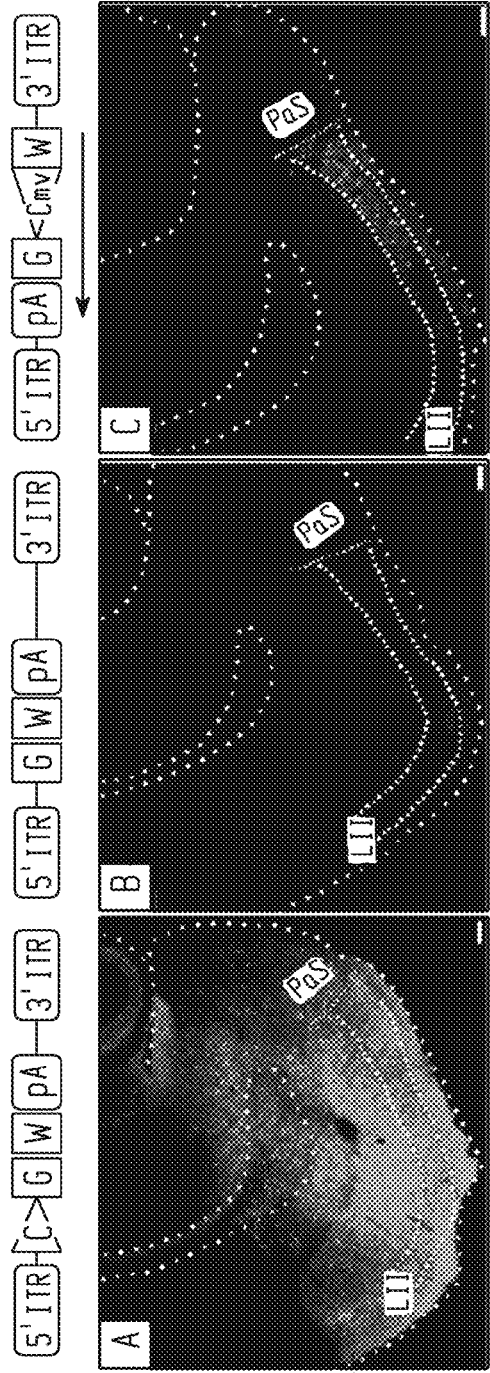
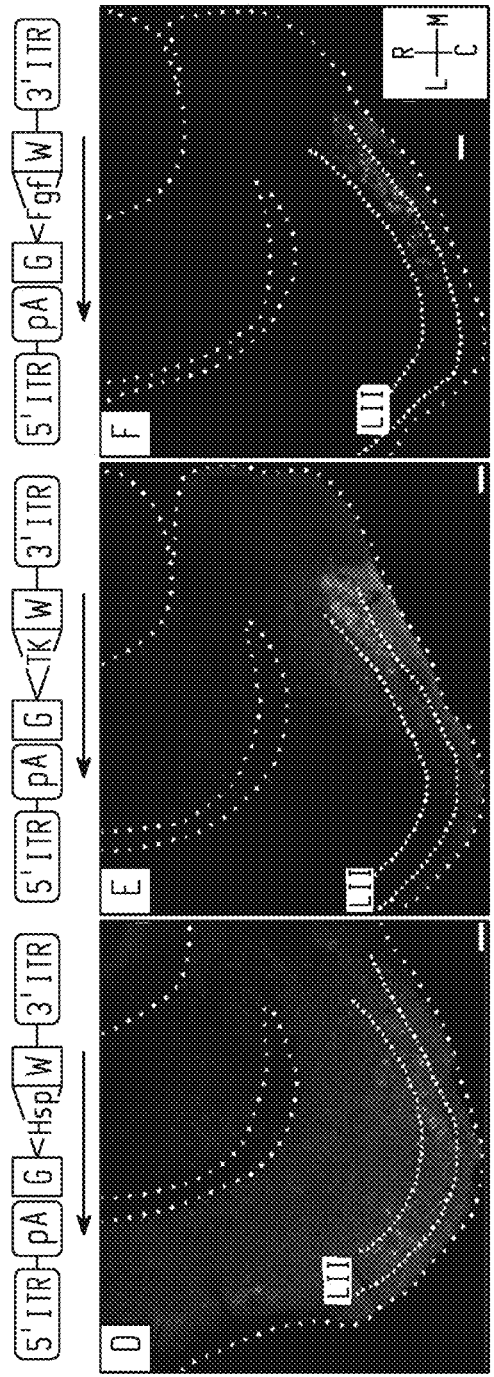
Fig. 12A  Fig. 12B  Fig. 12C
Fig. 12D  Fig. 12E  Fig. 12F

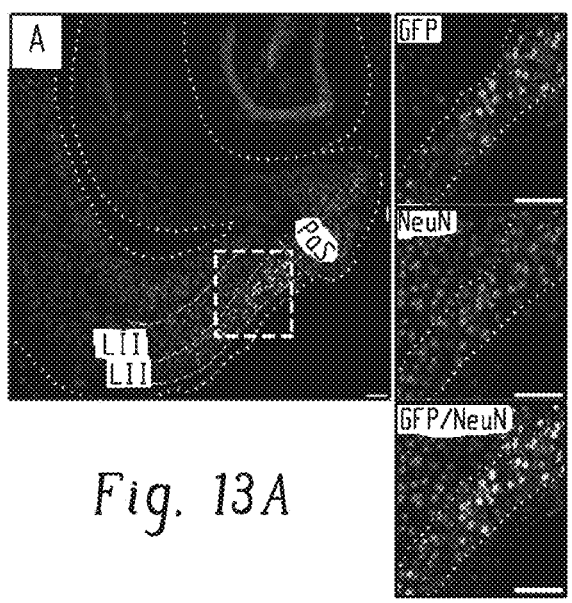 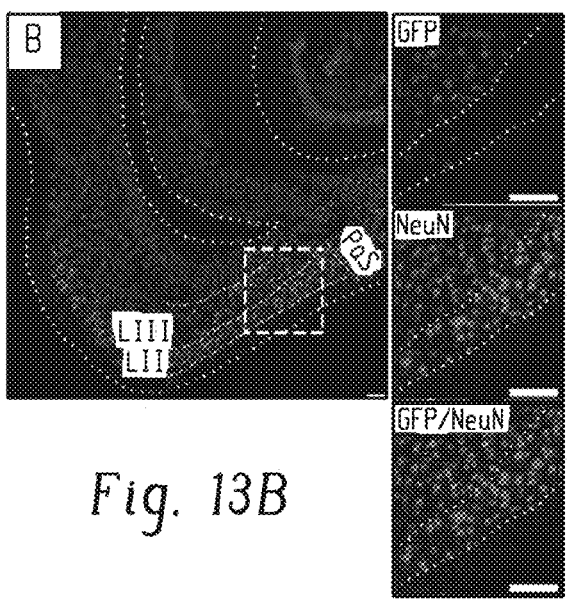
Fig. 13A  Fig. 13B
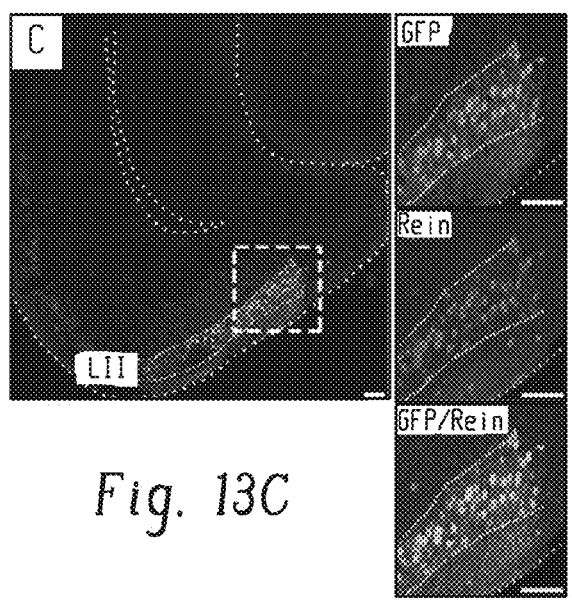 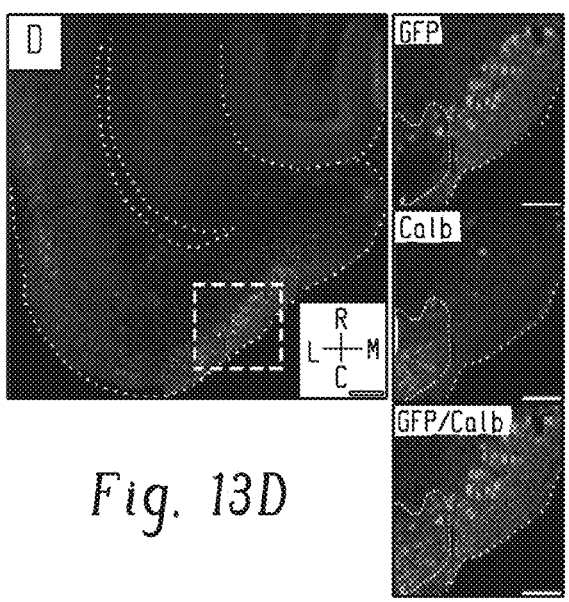
Fig. 13C  Fig. 13D
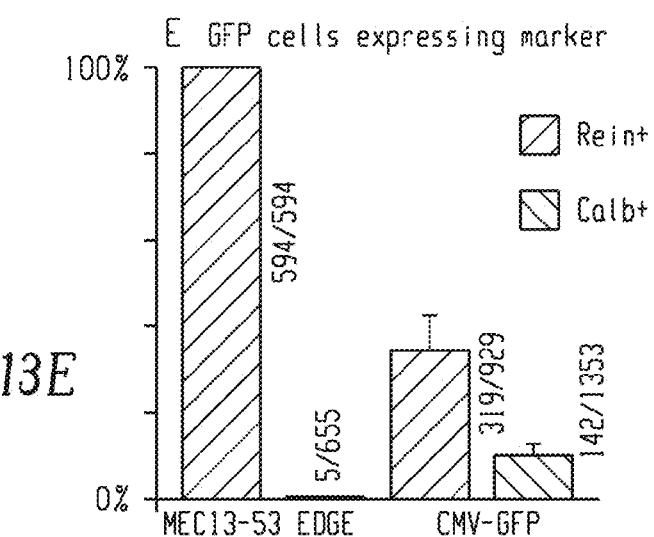
Fig. 13E

NEURONAL ENHANCERS

CROSS-REFERENCE TO RELATED APPLICATIONS

This application claims priority to U.S. Provisional Application Ser. No. 62/584,282 filed on Nov. 10, 2017, which is incorporated herein by reference in its entirety.

SEQUENCE LISTING

The Sequence listing filed as ASCII text file DN8689665 created on Oct. 30, 2018 and having a size of 5,823,203 bytes by EFS is incorporated by reference in its entirety.

FIELD OF THE DISCLOSURE

The present disclosure is in the field of gene therapy, and provides delivery vehicles which may be used in the treatment of neurological disorders, in particular Alzheimer's disease. To this end, the disclosure provides both the aforementioned delivery vehicles and methods of treatment using the delivery vehicles.

BACKGROUND

The mammalian brain is arguably the most complex biological structure known, composed of around $10^{11}$ neurons in humans. There is currently no definitive method for classifying different types of neurons, but depending on the criteria used (e.g., morphology, connectivity, gene expression and/or receptive field type) the number may be astronomical. Neuron classification is complicated by the fact that most genes are broadly expressed in the adult brain (i.e., in many different cell types) and so there are relatively few individual marker genes (indeed there are far more different cell types than there are marker genes).

Enhancer sequences which are active in specific sub-regions of the brain can be used to drive sub-region-specific or neuron-type-specific gene expression. Enhancer sequences specifically active in a number of brain regions have been identified, including the entorhinal cortex (EC). Enhancers which specifically drive gene expression in the EC may be used in gene therapy for neurological conditions which affect this region of the brain. Such conditions include, most notably, Alzheimer's disease (AD).

AD is a neurodegenerative disease which causes the majority of cases of dementia. Symptoms include disorientation, mood swings and behavioral difficulties, in addition to the characteristic memory loss. AD is progressive and invariably fatal, though death does not occur for many years after diagnosis. AD occurs predominantly in the elderly (only approximately 5% of cases are diagnosed before the age of 65), and due to increased life expectancy and the aging nature of Western society, is becoming ever more common. Not only is AD a terrible disease causing great suffering to those afflicted, and to their loved ones, it is also a significant economic burden on society, due to the requirement for continuous care for those with more advanced disease.

At present, the causes of AD are poorly understood, and though links between AD development and head injuries, depression and hypertension have been identified, the primary cause is believed to be genetic. Moreover, to date no preventative or curative therapies have been identified, despite the urgent need for such.

Brains of AD sufferers are characterized by the extracellular and intracellular build-up of aggregates of the proteins amyloid-β and tau, and a neuropathology of brain atrophy, the loss of both neurons and synapses, inflammation and cerebral amyloid angiopathy (the formation of amyloid deposits on the walls of blood vessels within the brain). Amyloid-β is generated by cleavage of the amyloid precursor protein (APP), a neuronal transmembrane protein. In healthy brains, APP appears beneficial for neuron growth and survival (O'Brien & Wong, Annu. Rev. Neurosci. Vol. 34, pp. 185-204, 2011), but in the AD brain, cleavage of APP by the β-secretase and γ-secretase generates the approximately 40 amino acid fragment known as amyloid-β (Chow et al., Neuromolecular Med. Vol. 12(1), pp. 1-12, 2010). Amyloid-β forms aggregates known as amyloid plaques. Amyloid-β appears to play a central role in AD development, though how this occurs is not entirely clear, and many hypotheses have been put forward, including the generation of reactive oxygen species which may depolarise the synaptic membrane, physical disruption of the neuronal membrane by amyloid plaques, and the disruption of calcium ion homeostasis by soluble oligomers of amyloid-β.

Tau forms insoluble aggregates following hyperphosphorylation. These aggregates are known as neurofibrillary tangles and are considered a primary marker of AD.

It is believed that the build-up of amyloid plaques and deposits in the brain causes AD (Murphy & Levine, J. Alzheimers Dis. Vol. 19(1), p. 311, 2010) but how this occurs is by no means clear. The role of neurofibrillary tangles in AD is controversial, but they may constitute an important causative factor of the disease.

It had been hoped that antibody therapy against amyloid-β would be curative for AD, but while such therapy has been found to be successful in clearing the characteristic amyloid-β plaques from the brains of AD patients, no improvement or delay in dementia has yet been seen to result (Holmes et al., Lancet Vol. 372, pp. 216-223, 2008). It may be that the dementia associated with AD, particularly in the late stages of the disease, is irreversible. To successfully treat AD it is therefore important to intervene early, and preferably to prevent the development of symptomatic disease in the first place. Early stage or preventative treatment requires therapy targeted to the brain regions where the disease begins.

AD is known to begin in the entorhinal cortex. The entorhinal cortex is located in the medial temporal lobe, and via its interactions with the hippocampus plays an essential role in memory and navigation (hence these functions are lost first in AD sufferers). AD spreads across the brain transynaptically from the entorhinal cortex to affect other regions, leading to later stage symptoms and eventually death. The entorhinal cortex comprises six layers. Layers I and IV are molecular layers, being relatively free of neurons. AD initiates in Layer II, the outermost layer of cells in the EC. Many EC Layer II cells express the protein Reelin, a regulator of neuronal migration and positioning in the developing brain. AD initiates in Reelin-positive neurons in EC Layer II (Kobro-Flatmoen et al., Neurobiol. Dis. Vol. 93, pp. 172-183, 2016), for instance pre-alpha cells.

What is needed are new compositions and methods for the treatment of Alzheimer's disease.

US 2015/0044187 discloses enhancers which drive forebrain-specific gene expression during embryonic brain development. The document teaches the use of such enhancers to generate neurons from stem cells.

SUMMARY

In a first aspect, provided herein is a delivery vehicle comprising a nucleic acid construct, wherein the nucleic acid construct comprises:
  (i) an enhancer which specifically drives gene expression in cells of the entorhinal cortex;
  (ii) a promoter; and
  (iii) a therapeutic gene,
wherein said enhancer, promoter and therapeutic gene are operatively linked, said enhancer and therapeutic gene are heterologous, and said delivery vehicle is suitable for delivery of the nucleic acid construct to the brain of a mammal.

In a particular embodiment the delivery vehicle is a viral vector.

In another aspect, a cell comprises the nucleic acid construct as defined above.

In another aspect, a composition comprises a delivery vehicle as described above and at least one physiologically-acceptable diluent, carrier or excipient.

In another aspect, a method of treating or preventing Alzheimer's disease comprises administering a delivery vehicle or a composition described above to a subject in need thereof.

In another aspect, a method of driving entorhinal cortex-specific gene expression in a mammalian subject comprises administering to said subject a delivery vehicle or a composition as described above.

BRIEF DESCRIPTION OF DRAWINGS

The patent or application file contains at least one drawing executed in color. Copies of this patent or patent application publication with color drawing(s) will be provided by the Office upon request and payment of the necessary fee.

FIG. 1A shows pie charts showing the proportions (and numbers) of distinct active genomic elements identified by H3K27ac ChIP-seq of the 4 cortical sub-regions. These numbers are roughly similar to those found by ChIP-seq of other organs.

FIG. 1B shows dendrogram (left) and correlation matrix of the H3K27ac signals (right) from replicates of the cortical sub-regions dissected in this experiment versus those from ENCODE, which were used for subtraction (all tissue data except for that in relation to the MEC, LEC, RSC and ACC is from ENCODE). Note the high correlation of replicates and clustering of signal from cortical tissues.

FIG. 1C shows heatmaps showing some of the tissue-specific putative enhancers identified in the microdissected cortical sub-regions.

FIGS. 5A-D collectively show that enhancers of non-specific genes drive region-specific transgene expression.

FIG. 5A specifically shows a genomic view of one of the 165 MEC-specific enhancers identified by ChIP-seq analysis. The specific region of the genome containing the enhancer (MEC-13-104) is blown up in the right-hand panel.

FIG. 5B specifically shows in situ hybridisation (ISH; brain-map.org) of Trpsl, the gene associated with enhancer MEC-13-104 shows expression throughout the cortex (Ctx), striatum (Str) and cerebellum (Cb).

FIG. 5C shows hGFP expression driven by enhancer MEC-13-104 is seen in the MEC as well as some other brain regions.

FIG. 5D specifically shows expression of the chemogenetic activator HM3 driven by MEC-13-104 is seen specifically in the MEC. Scalebars are 1000 µm. Sagittal plane, Dorsal-Ventral and Anterior-Posterior axis are indicated.

Figure 7:
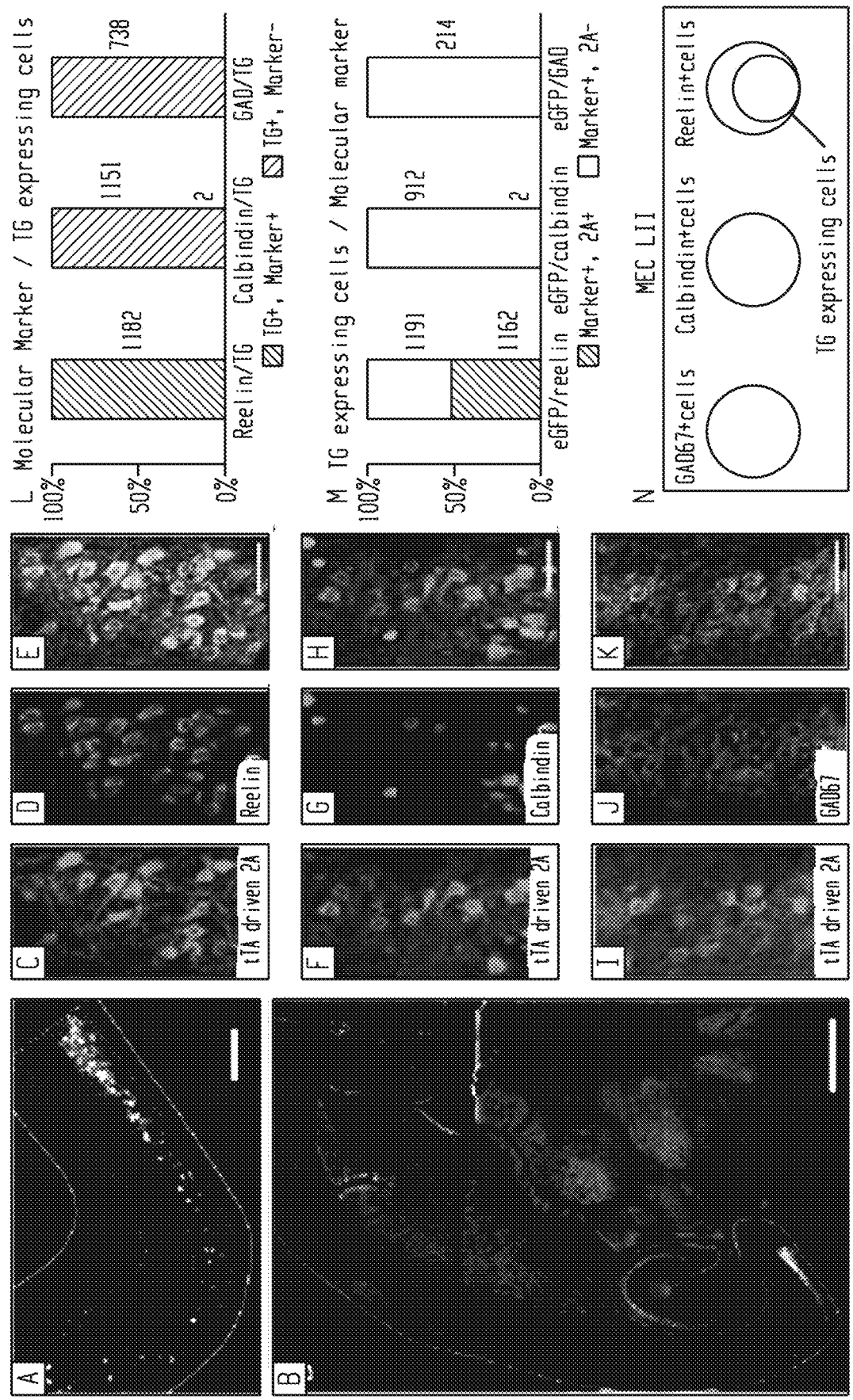
FIG. 7 shows that single enhancers can drive expression in histochemically-defined subsets of MEC Layer II cells.

Panels A and B of FIG. 7 show horizontal sections of a mouse cross between MEC-13-53A and TVAG. Immunohistochemical transgene detection with anti-2A antibody shows layer II EC-specific expression.

Panels C, F, and I of FIG. 7 show anti-2A histochemistry.
Panel D of FIG. 7 shows anti-Reelin histochemistry.
Panel G of FIG. 7 shows anti-Calbindin histochemistry.
Panel J of FIG. 7 shows anti-GAD67 histochemistry.
Panels E, H, and K of FIG. 7 show overlays of the two signals; each row is the same section.

Panel L of FIG. 7 shows 100% of transgenic cells co-localize with Reelin but there is essentially 0% with calbindin and GAD67 (TG=transgene).

Panel M of FIG. 7 shows 50% of all Reelin-positive cells were positive for the transgene, essentially none of the other cell populations had any transgene expressing cells. Total numbers of cells counted in white.

Panel N of FIG. 7 shows achematic summary of the data in FIGS. 7C to M.

Scale bars in FIG. 7 are 1000 µm in panel B, 200 µm in panel A and 50 µm in panels E, H and K. In all graphs bars show the mean+SEM.

Figure 8:
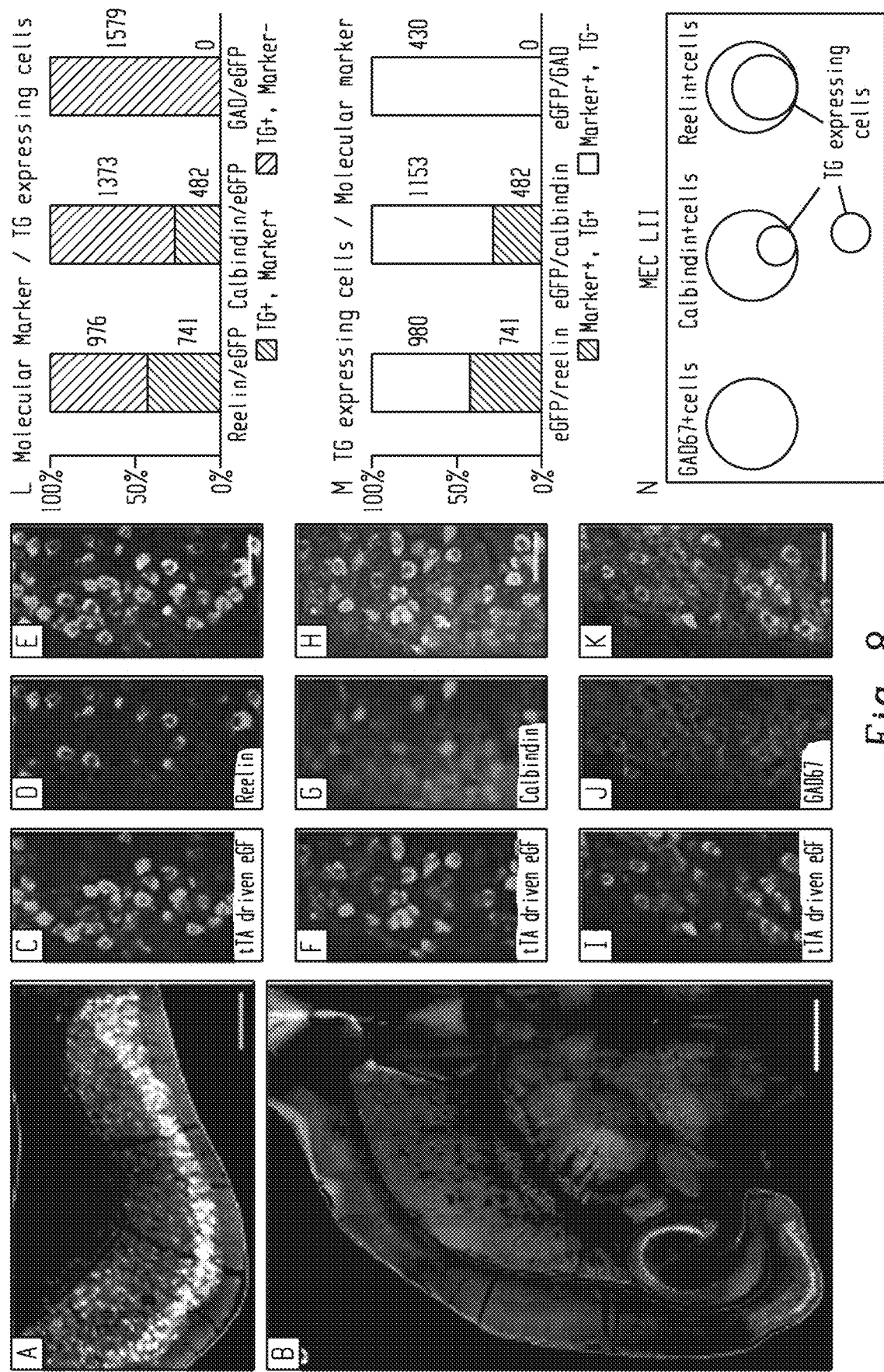

FIG. 8 shows that different single enhancers can drive expression in histochemically-distinct subsets of MEC Layer II cells.

Panels A and B of FIG. 8 show horizontal section of a mouse cross between MEC-13-104B and tetO-eGFP. Immunohistochemical transgene detection with anti-GFP Ab shows EC-specific expression.

Panels C, F, I of FIG. 8 show anti-GFP histochemistry.
Panel D of FIG. 8 shows anti-Reelin histochemistry.
Panel G of FIG. 8 shows anti-Calbindin histochemistry.
Panel 8J of FIG. 8 shows anti-GAD67 histochemistry.
Panels 8E, 8H, 8K of FIG. 8 show overlays of the two signals, each row is the same section.

Panel L of FIG. 8 shows 42.9% of transgenic cells in layer II of the EC co-localise with reelin while 26% of them co-localise with calbindin. 0% co-localise with GAD67.

Panel M of FIG. 8 shows 42.7% of all reelin-positive cells in layer II of the EC were positive for the transgene and 30% of all calbindin-positive cells in layer II of the EC were positive for the transgene, while 0% of the GAD67 positive population had any transgene expressing cells. Total numbers of cells counted in white.

Panel N of FIG. 8 shows a schematic summary of the data in panels C to M.

Scale bars in FIG. 8 are 1000 μm in panel B, 200 μm in panel A and 50 μm in panels E, H and K. In all graphs bars show the mean+SEM.

Figure 9:
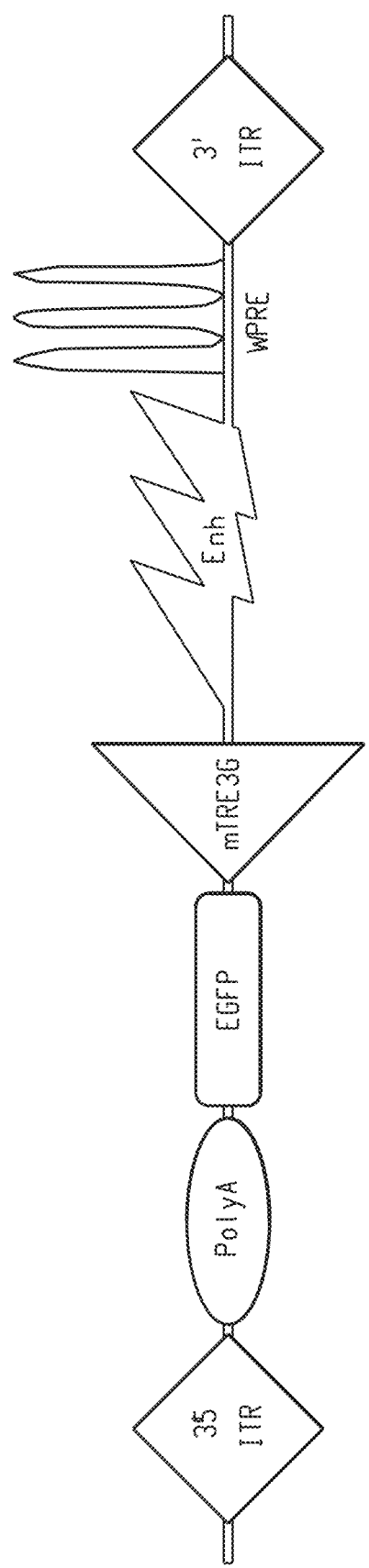

FIG. 9 is a schematic diagram of the AAV DNA construct used to specifically drive eGFP expression in at MEC. The orientation of the construct is inverted relative to the orientation of the DNA strand.

FIGS. 10A-E collectively show EC-specific expression of eGFP in a rat injected with a construct as shown in FIG. 9. The scale bars all=100 μm.

Figure 10A:
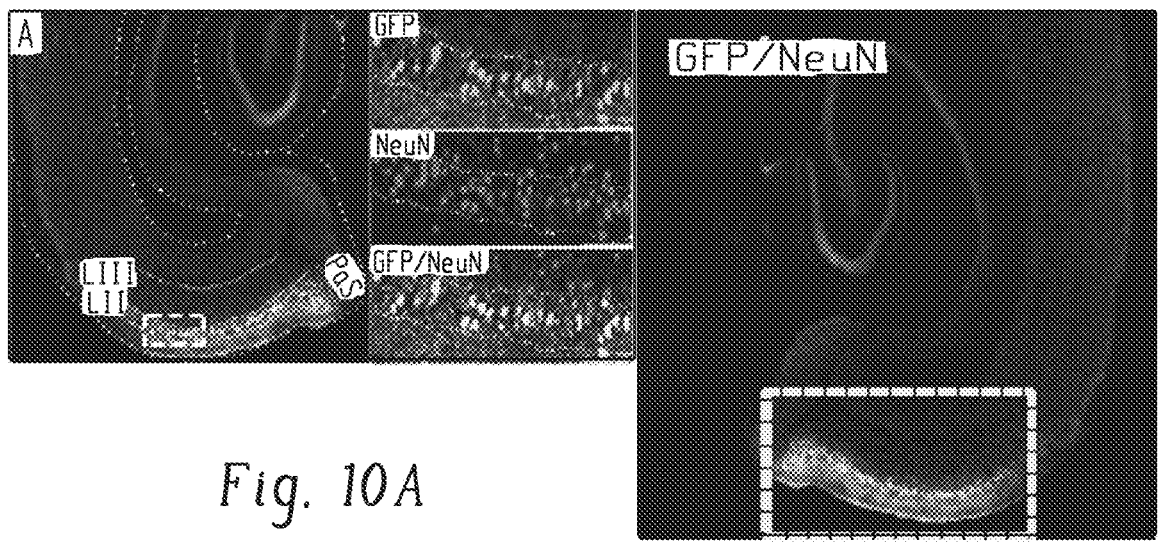

FIG. 10A shows brain section of a rat injected with an AAV carrying an experimental construct containing the MEC-13-53 enhancer. NeuN is a neuronal biomarker. eGFP expression is seen only in the MEC. Insets show GFP staining (top), NeuN staining (middle) and an overlay (bottom) of the box in the left panel.

Figure 10B:
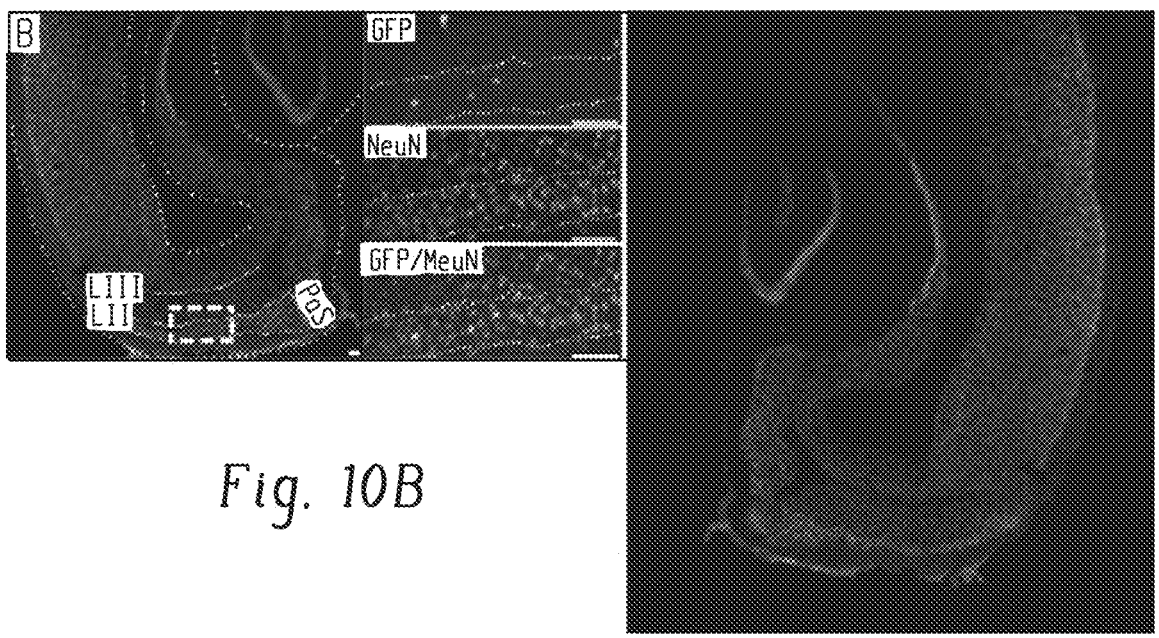

FIG. 10B shows brain section of a rat injected with an AAV carrying a control construct containing no enhancer. No eGFP expression was seen. Insets show same as in 10A.

Figure 10C:
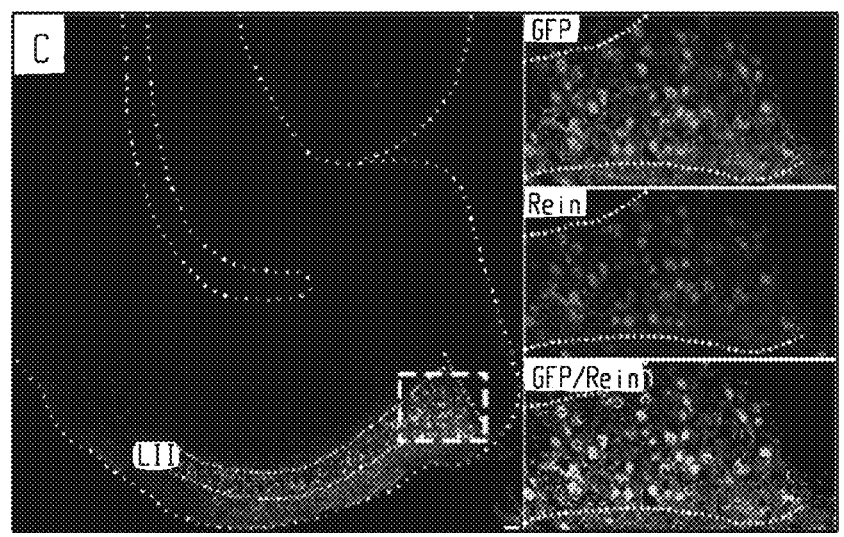

FIG. 10C shows brain section of rat corresponding to that of 10A, except counter-stained with anti-reelin antibody instead of anti-NeuN antibody. As shown, the reelin stain extensively co-localises with the GFP.

Figure 10D:
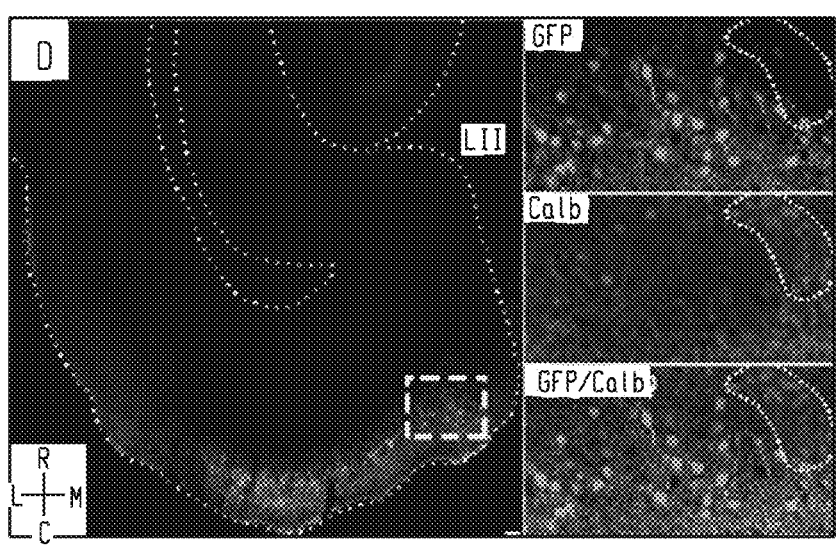

FIG. 10D shows brain section of rat corresponding to that of 10A, except counter-stained with anti-calbindin antibody instead of anti-NeuN antibody. A CB+ cell cluster is outlined in the insets. Co-localisation of CB and GFP is not seen.

Figure 10E:
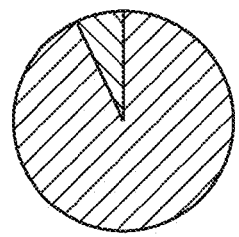

FIG. 10E shows the proportion of MEC-13-53 EDGE expressing cells in MEC layers II and III.

Figure 10F:
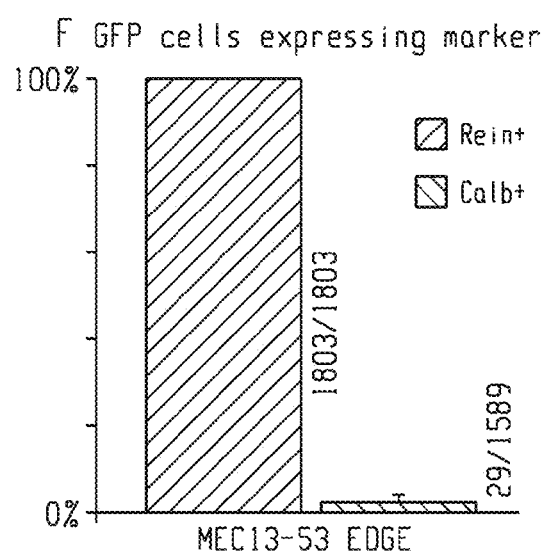

FIG. 10F shows a summary of results, showing the proportion of cells counted co-expressing GFP and the cell marker reelin (left) or calbindin (right).

FIGS. 11A-E collectively show the optimisation of viral EDGE-rAAV constructs for expression in mice. The genetic structure of the pAAV-transgene construct is shown above each of parts B-D: "C" indicates the CMV promoter, "G" indicates the eGFP gene, "W" indicates the WPRE, "pA" indicates a polyA sequence, "E" indicates an enhancer (specifically MEC-13-53) and "mp" indicates a minimal promoter (specifically the TRE3G minimal promoter). In each of A-D the scale bar=100 μm.

FIG. 11A shows expression of the TVAG transgene driven by enhancer MEC-13-53 in a transgenic cross, as visualised by anti-2A immunostaining, is restricted to reelin-positive LII projection neurons in the EC.

FIG. 11B: shows injection of a non-specific (CMV-GFP) virus into the EC shows broad labelling of the entire region.

GFP expression is under the control of the full CMV promoter (SEQ ID NO: 1673).

FIG. 11C shows the same construct without a minimal promoter shows weak nonspecific expression throughout the region.

FIG. 11D shows changing the orientation of the expression cassette relative to the viral ITRs leads to a marked reduction in non-specific expression of MEC-13-53 EDGE rAAV. For the purposes of comparison, panels B-D are of the same volume of virus injected using the same coordinates and visualised using exactly the same settings. The images in (B) and (D) are overexposed to the same settings as (C) in order to visualize the background expression in (C). FIGS. 12 A-C show the same images at settings sufficiently low to avoid overexposure of the CMV-GFP virus.

FIG. 11E shows the proportion of GFP-expressing cells in layer II and III of the MEC, comparing expression by MEC-13-53 EDGE and a non-specific virus.

FIGS. 12A-F also collectively show the optimization of viral EDGE-rAAV constructs for expression in mice. Again, the genetic structure of the pAAV-transgene construct is shown above each part of the figure. The figure shows that MEC-13-53 EDGE-rAAV exhibited essentially identical layer-II specific EDGE in combination with multiple minimal promoters. In each of A-F the scale bar=100 μm.

FIGS. 12A-C, s detailed above in the legend to FIG. 11, show expression from the same constructs as FIGS. 11B-D, respectively, but are not overexposed. At these settings one cannot detect any expression from the virus lacking a promoter virus (12B).

FIGS. 12D-F show: Expression is shown using the same construct organisation as that of 12C, except that rather than the TRE3G minimal promoter expression is driven from the HSP68 minimal promoter (12D), TK minimal promoter (12E) or FGF4 minimal promoter (12F).

FIGS. 13A-E collectively show that MEC13-53 EDGE rAAVs recapitulate the cell-type specificity seen in MEC-13-53 EDGE transgenic crosses in WT mice.

FIG. 13A shows MEC-13-53 EDGE-rAAV was injected into the MEC of WT-mice. Insets show immunostaining of GFP (top) and NeuN (middle); and an overlay of the two (bottom).

FIG. 13B shows an equal volume relative to 13A of TRE3G-rAAV (i.e. virus identical to that used in 13A except without an enhancer) was injected into the MEC of WT-mice. Insets show the same as in 13A.

FIG. 13C shows immunostaining of brain sections of the same mice as 13A, except counterstained with anti-reelin antibody instead of anti-NeuN antibody. As shown, the reelin stain extensively co-localises with the GFP.

FIG. 13D shows immunostaining of brain sections of the same mice as 13A, except counterstained with anti-calbindin (CB) antibody instead of anti-NeuN antibody. A CB+ cell cluster is outlined in the insets. No co-localisation of CB and GFP is seen.

FIG. 13E shows a summary of results: cells co-expressing GFP and marker reelin (left-hand column of each pair) or calbindin (right-hand column of each pair) with number of cells counted.

Figure 14:
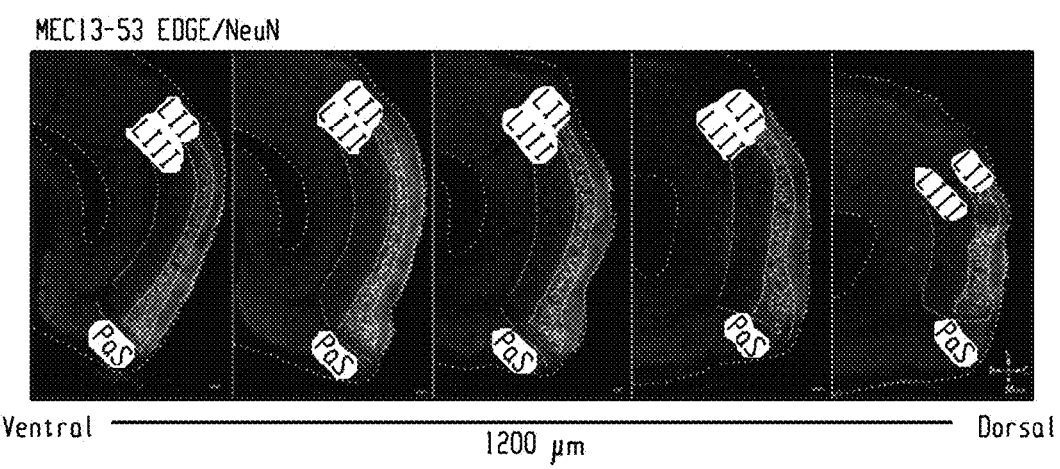

FIG. 14 shows that expression specificity is not limited to the AAV injection site. Representative images of the GFP+ and NeuN+ neurons in multiple horizontal sections in the dorso-ventral axis from a rat brain injected with MEC-13-53-EDGE rAAV. Interestingly the very few GFP+ cells not in EC L-II (e.g. Subiculum) are still Reelin+. MEC-13-53 was shown to drive expression preferentially in MEC-layer II throughout the dorso-ventral axis. Scale bar=100 μm.

FIGS. 15A-D collectively show that other EDGE rAAVs largely recapitulate the regional specificity shown by the relevant enhancers in transgenic mice. In each image the scale bar=100 μm.

Figure 15A:
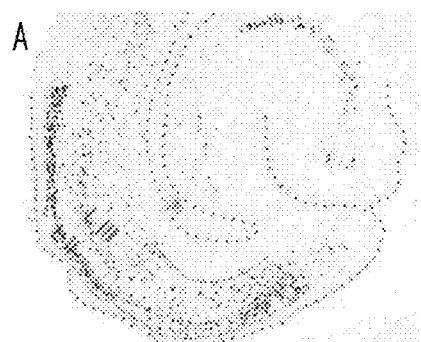

FIG. 15A shows expression of the TVAG transgene driven by the MEC-13-104 enhancer in an EDGE transgenic cross is visualised by ISH using the relevant probe.

Figure 15B:
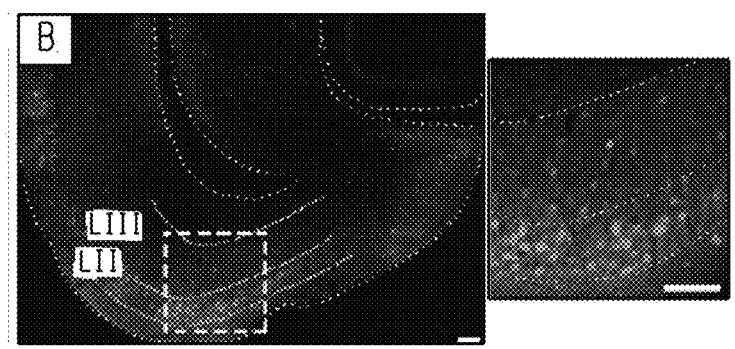

FIG. 15B shows expression of GFP in a wildtype mouse driven by MEC-13-104 in an EDGE-rAAV. As shown, the rAAV recapitulates the expression pattern driven by the enhancer in transgenic mice.

Figure 15C:
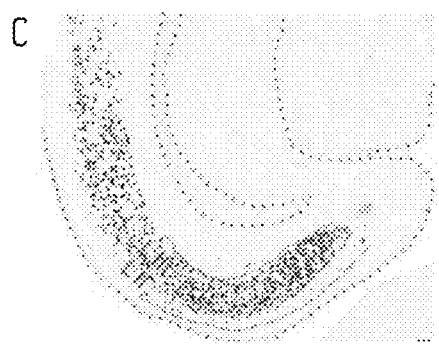

FIG. 15C shows expression of the HM3 transgene driven by the LEC-13-8 enhancer in an EDGE transgenic cross is visualised by ISH using the relevant probe.

Figure 15D:
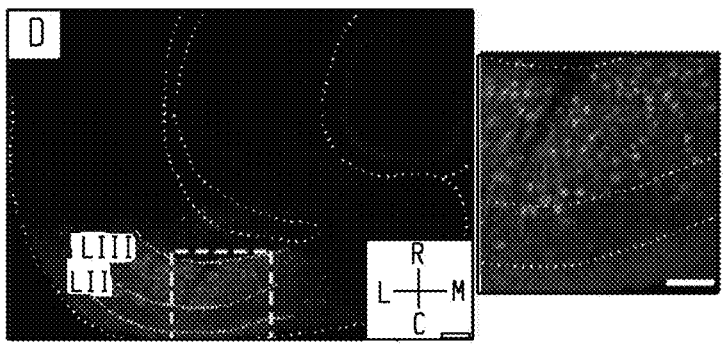

FIG. 15D shows expression of GFP in a wildtype mouse driven by LEC-13-8 in an EDGE-rAAV. As shown, the rAAV recapitulates the expression pattern driven by the enhancer in transgenic mice.

The above-described and other features will be appreciated and understood by those skilled in the art from the following detailed description, drawings, and appended claims.

DETAILED DESCRIPTION

The inventors have discovered that neuron types are characterized not by the expression of specific marker genes, but rather by the expression of distinct sets of genes. The inventors have discovered that the expression of neuron type-specific sets of genes is controlled by enhancers. These regulatory elements are active in distinct brain regions and neuronal cell types, thus determining the gene combinations expressed in each neuron.

The present application discloses enhancer sequences which specifically drive gene expression in the EC, and more particularly in certain sub-sets of EC cells, including even more particularly EC layer II neurons. These enhancer sequences can be used in gene therapy to drive expression of therapeutic genes specifically in EC layer II cells, targeting AD at its source. Use of these enhancer sequences to drive cell-type specific gene expression enables the expression of a therapeutic gene in EC layer II cells, even if the therapeutic gene is toxic if expressed more widely, since by placing the therapeutic gene under the control of an appropriate enhancer expression of the gene is limited to the desired EC layer II neurons. The delivery vehicles described herein comprise nucleic acid constructs in which a therapeutic gene is under the control of a promoter and an enhancer which drives EC-specific gene expression. The delivery vehicles can be used in gene therapy to prevent AD or to treat AD at an early stage before symptoms have appeared, thus arresting its development before brain function is irreparably damaged. The enhancers disclosed herein thus open up a wholly new avenue for AD prevention and treatment.

In the work leading up to this disclosure, the inventors identified large numbers of region and sub-region specific enhancers in the brain, and remarkably have shown that in transgenic mice based on single enhancers specific to a particular brain region (specifically the medial entorhinal cortex (MEC)) the enhancers may drive expression specifically in distinct subsets of MEC neurons. Even more surprisingly, it has now further been shown that such enhancers may be used in expression constructs which when delivered in viral vectors may be used to achieve region-specific or sub-region-specific, or even more particularly cell-type-specific expression in the brains of mice or rats. Such enhancers may thus provide the means to achieve specific gene expression of a desired transgene in a targeted manner, e.g. in a desired brain region or sub-region, or in a particular type or sub-set of cells.

As described above, disclosed herein are delivery vehicles comprising a nucleic acid construct, wherein the delivery vehicle is suitable for delivery of the nucleic acid construct to the brain of a mammal. The delivery vehicle may alternatively be referred to as a vector for gene therapy. In other words it is a nucleic acid-carrying particle which is able to deliver a nucleic acid of interest to a target cell in an organism. In the context of the present disclosure, the delivery vehicle is able to deliver a nucleic acid of interest to target cells in the brain of a mammal. Delivery vehicles (i.e. vectors) for gene therapy are well-known in the art (see e.g. Rosenzweig, A., 2007, Vectors for Gene Therapy, Current Protocols in Human Genetics).

The delivery vehicle is able to deliver a nucleic acid construct to the brain of a mammal. As such, the delivery vehicle is able to cross the blood-brain barrier; such delivery vehicles are known in the art (see e.g. Costa & Pedroso de Lima, *J. Genet Syndr Gene Ther* 2013, Vol. 4(7): 161). Lipid-soluble species are able to cross the blood brain barrier, so in some embodiments the delivery vehicle of the invention may be lipid soluble. In a particular embodiment, the delivery vehicle is able to deliver a nucleic acid construct to the brain of a human, though in other particular embodiments the delivery vehicle may also or alternatively be able to deliver a nucleic acid construct to the brain of a laboratory animal such as a mouse, rat or monkey. Delivery vehicles are further discussed below.

A delivery vehicle comprises a nucleic acid construct comprising:

(i) an enhancer which specifically drives gene expression in cells of the entorhinal cortex;
(ii) a promoter; and
(iii) a therapeutic gene, wherein said enhancer, promoter and therapeutic gene are operatively linked.

The nucleic acid construct is a recombinant construct. The nucleic acid construct is a nucleic acid molecule comprising a number of functional nucleotide sequences of interest. The nucleic acid molecule may be a DNA molecule or an RNA molecule, and may include chemical derivatives of DNA or RNA, including molecules having a radioactive isotope or a chemical adduct such as a fluorophore, chromophore or biotin ("label"). Thus the nucleic acid may comprise modified nucleotides. Said modifications include base modifications such as bromouridine, ribose modifications such as arabinoside and 2',3'-dideoxyribose and internucleotide linkage modifications such as phosphorothioate, phosphorodithioate, phosphoroselenoate, phosphorodiselenoate, phosphoroanilothioate, phoshoraniladate and phosphoroamidate. The term "nucleic acid molecule" specifically includes single and double stranded forms of both DNA and RNA.

As noted the nucleic acid construct disclosed herein comprises a therapeutic gene. When the nucleic acid construct is a single-stranded DNA molecule, it may be a sense strand or antisense strand. When the nucleic acid construct is an RNA molecule, it may be a positive-sense or negative-sense nucleic acid strand. In the case that the nucleic acid construct is an RNA molecule, the construct is such that the therapeutic gene cannot be translated without the construct first being reverse transcribed into DNA, to enable transcription of the therapeutic gene to be regulated by the operatively-linked enhancer.

The nucleic acid construct disclosed herein comprises an enhancer which specifically drives gene expression in cells of the entorhinal cortex. An enhancer sequence, as commonly known in the art, is a nucleotide sequence which regulates expression of a gene. The binding of specific transcription factors to enhancer sequences leads to the recruitment of RNA polymerase II and general transcription factors to the gene promoter, by the direct interaction of the specific transcription factors with the RNA polymerase and general transcription factors. Enhancer sequences may be identified by any method known in the art, including traditional methods such as enhancer trap, and state of the art methods including DNase-Seq, FAIRE-Seq, DNA sequence analysis to identify transcription factor binding sites (which are associated with enhancer sequences) or computational genomics to identify sequence conservation of non-coding regions (which can be indicative of enhancers). Many enhancer sequences are already known in the art and are available from databases, for instance the ENCODE Encyclopaedia which contains over 1 million putative human enhancer sequences and over 500,000 putative murine enhancer sequences. The enhancer in the nucleic acid construct may be derived from any species, in particular it may be derived from a mammal. Alternatively, the enhancer may be a synthetic sequence, for instance it may be specifically defined for the purpose of this disclosure.

An enhancer which drives gene expression of cells in the entorhinal cortex may also be referred to as an enhancer which is active in cells of the entorhinal cortex. An enhancer active in cells of the entorhinal cortex may be identified by any method known in the art, e.g. by ChIP-seq, or by analogy to a known entorhinal cortex-specific enhancer of a different species. ChIP-seq may be used to identify active enhancer sequences based on histone modifications. Modification, e.g. methylation or acetylation, of histone proteins is associated with activation or repression of the associated DNA sequence. For instance, histone modification at the location of a gene or promoter sequence may activate or repress transcription of the gene or from the promoter. Histone modification at the location of an enhancer may activate or suppress enhancer activity and thus transcription of the gene regulated by the enhancer.

Specific modifications of particular residues within histone proteins are associated with either activation or repression of the associated DNA sequence. Enhancer sequences which are associated with histones containing activatory modifications may be considered as active. Activatory histone modifications are well-known in the art and include acetylation of lysine 27 on histone H3 and methylation of lysine 4 on histone H3. Acetylated histone H3 lysine 27 is referred to as H3K27ac. Methylation of lysine 4 of H3 may be single methylation (H3K4me), dimethylation (H3K4me2) or trimethylation (H3K4me3). Enhancer sequences which are active in the entorhinal cortex may be identified by performing ChIP-seq on chromatin isolated from cells from the entorhinal cortex of a mammal. Entorhinal cortex cells may be isolated by microdissection of the brain of a mammal. Enhancer sequences which are associated with activatory histone modifications, e.g. histones containing the H3K27ac and/or H3K4me2 modifications, in entorhinal cortex tissue are enhancers which are active in cells of the entorhinal cortex.

As detailed above, the entorhinal cortex is located in the medial temporal lobe of the brain. It approximately corresponds to Brodmann areas 28 and 34. The skilled person is well able to identify the entorhinal cortex in a mammalian brain. As defined herein, the entorhinal cortex includes the transentorhinal cortex. The transentorhinal cortex forms a transition zone between the entorhinal cortex and the isocortex, and contains interdigitation of laminae of both the entorhinal cortex and the isocortex.

In rodents, the entorhinal cortex is considered to comprise two sub-regions: the lateral entorhinal cortex (LEC) and the medial entorhinal cortex (MEC). The LEC and MEC are differentiated by their morphological features, e.g. the shape, size and type of neurons located within them. The LEC and MEC are also differentiated by their input/output connectivity, e.g., the LEC is strongly connected to the perirhinal cortex, olfactory and insular cortex and the amygdala; the MEC is strongly connected to the postrhinal cortex, the presubiculum, visual association (occipital) and retrosplenial cortices. The term "entorhinal cortex" as used herein includes both the MEC and the LEC. It is currently unclear whether the human entorhinal cortex can be considered to comprise sub-regions corresponding to the LEC and the MEC.

As noted above, the nucleic acid construct disclosed herein comprises an enhancer which specifically drives gene expression in cells of the entorhinal cortex. By "specifically drives gene expression in cells of the entorhinal cortex" is meant that the enhancer drives gene expression only, or substantially only or predominantly, in cells of the entorhinal cortex, and thus does not drive gene expression in other cell types, either in other regions of the brain or in non-brain tissues, or only drives such non-entorhinal cortex expression to a minor, insignificant or negligible extent. An enhancer which specifically drives gene expression in cells of the entorhinal cortex (e.g., which is only active in cells of the entorhinal cortex) may be identified by any method known in the art. In particular, such an enhancer may be identified by comparison of enhancer activity in cells of the entorhinal cortex with the activity of the same enhancer in other tissues. For instance, the activity of an enhancer sequence identified as active in cells of the entorhinal cortex may be analysed in cells of other brain regions and other non-brain tissues, for instance in cells of the cerebellum or the immune system. An enhancer which is active in the entorhinal cortex but inactive in all other tested tissue types is an enhancer which specifically drives gene expression in cells of the entorhinal cortex.

The nucleic acid construct disclosed herein also comprises a promoter. As is well known in the art, a promoter is a region of DNA located immediately upstream of a gene, to which RNA polymerase binds and which contains the transcription start site. Eukaryotic promoters commonly include the TATA box for the binding of general transcription factors to the promoter for recruitment of RNA polymerase. Alternatively, the promoter may comprise an initiator motif and a downstream promoter element to fulfil this role. The structure of promoters is well-known in the art, as are the sequences of many promoters. The promoter used is a promoter which is functional in a mammalian cell (by functional is meant a promoter which is able to drive gene expression). In a particular embodiment the promoter used is a promoter which is functional in a human cell. The promoter may be a mammalian promoter, in particular the promoter may be derived from the species to which the delivery vehicle of the invention is intended to deliver the nucleic acid construct. The promoter may be a human promoter. The promoter may be a variant of a mammalian promoter, including a variant of a human promoter, which has been modified for enhanced or tighter gene expression. Alternatively, the promoter may be a non-mammalian promoter which is nonetheless functional in a mammalian cell, such as a promoter from a non-mammalian animal or a promoter from a virus, particularly a virus which is able to infect a mammal, e.g., a virus which is able to infect a human. In another embodiment the promoter is a synthetic promoter or a chimeric promoter containing elements derived from one or more different promoters. The skilled person is well able to identify a promoter which can be used in the current invention.

The nucleic acid construct disclosed herein also comprises a therapeutic gene. "Therapy", as defined herein, refers to the treatment or prevention of any medical condition. A therapeutic gene is a gene which is useful in therapy. In other words, a therapeutic gene is any gene which may be expressed in a cell in order to treat or prevent a medical condition, for instance a disease. The therapeutic gene of the present invention is not limited, and may be any gene useful in therapy. In particular, the therapeutic gene is a gene which may be expressed in cells of the entorhinal cortex in order to treat or prevent a medical condition. The therapeutic gene may be useful in therapy for any medical condition. The therapeutic gene may be from any source, e.g. it may be derived from a mammal, e.g. a human or the mammal to which the delivery vehicle of the invention is intended to deliver the nucleic acid construct; the therapeutic gene may be derived from a non-mammalian animal, a plant, a bacterium or an archaeon; the therapeutic gene may be any gene derived from nature, or a variant of such a gene; the therapeutic gene may be an artificial gene, e.g. a fusion gene. Any gene whose expression is useful in the treatment or prevention of any medical condition may be used in the present invention as a therapeutic gene.

In the nucleic acid construct disclosed herein, the enhancer, promoter and therapeutic gene are operably linked. The term "operably linked" refers to the association of two or more nucleic acid molecules on a single nucleic acid fragment so that the function of one is affected by the 5 other. For example, a promoter is operably linked to a gene when the promoter is capable of affecting the expression of that gene (i.e. the gene is under the transcriptional control of the promoter). Genes may be operably linked to regulatory sequences in sense or antisense orientation.

Accordingly, in the construct of the disclosure, the promoter is operatively linked to the therapeutic gene, meaning that expression of the therapeutic gene is under the control of the promoter. The enhancer and the promoter are operatively linked, meaning that the enhancer initiates binding of RNA polymerase to the promoter and thus regulates the activity of the promoter. The enhancer and the therapeutic gene are operatively linked, meaning that the enhancer drives expression of the therapeutic gene, via the enhancer's interaction with the promoter.

As detailed above, the promoter is located upstream of the therapeutic gene in the nucleic acid construct disclosed herein. The enhancer may be located upstream or downstream of the therapeutic gene. The skilled person is well able to synthesise a construct as disclosed herein, with the therapeutic gene, promoter and enhancer sequences located appropriately to one another in an appropriate order, orientation and spacing. In an embodiment the enhancer is located upstream of the promoter, for instance immediately 5' of the promoter. By immediately 5' is meant that the enhancer is 5' to the promoter and no sequence elements are present between the enhancer and the promoter. Non-functional nucleotides may nonetheless form a spacer between the enhancer and the promoter.

In the present application, a first element is upstream of a second element when the first element is 5' to the second element, and conversely a first element is downstream of a second element when the first element is 3' to the second element. When referring to elements being upstream or downstream of one another in the construct, this is in the context of the construct and its elements being in the forward orientation. If the construct is inverted, i.e. placed in the reverse orientation, upstream and downstream are reversed.

The enhancer and the therapeutic gene in the construct disclosed herein are heterologous. By "heterologous", as used herein, is meant not natively operatively linked, i.e., not operatively linked in nature, e.g., in a wild-type organism. In this instance, the enhancer does not natively drive expression of the therapeutic gene. The enhancer and the therapeutic gene may be derived from different organisms, or they may be derived from the same organism, e.g., the same species of animal, for instance the enhancer and therapeutic gene may each be human. When derived from the same organism, the enhancer and therapeutic gene may be natively located on different chromosomes, but the enhancer and therapeutic gene may be located on the same chromosome. However, the enhancer does not natively drive or affect the expression of the therapeutic gene. The skilled person is well able to identify whether an enhancer natively drives expression of any given gene.

It may be that one or both of the enhancer and the therapeutic gene is a variant of a natural enhancer or gene. By variant is meant that the sequence (e.g. enhancer) is derived from a natural sequence (e.g. a natural enhancer sequence), but is modified relative to the natural enhancer sequence. A variant, as defined herein, may be modified relative to the sequence from which it is derived by substitution, addition or deletion of one or more nucleotides. For the purposes of the present application, a variant enhancer is considered a synthetic enhancer, and a variant therapeutic gene is considered a synthetic gene. Accordingly, a variant enhancer cannot be considered to be homologous to any therapeutic gene, because the variant enhancer is not found in nature. Similarly, a variant therapeutic gene cannot be considered to be homologous to any enhancer, because the variant therapeutic gene is not found in nature.

In the construct disclosed herein, the therapeutic gene is operably linked to an enhancer which specifically drives gene expression in cells of the entorhinal cortex. Preferably, the therapeutic gene is operably linked to only one enhancer, but may be operatively linked to two or more enhancers which specifically drive gene expression in cells of the entorhinal cortex. The therapeutic gene is not operatively linked to any enhancer which is not specifically active in cells of the entorhinal cortex.

The nucleic acid construct disclosed herein may be in any suitable form for delivery to a mammalian brain cell, for instance a plasmid, a cosmid, a phagemid, a viral chromosome (which may be a DNA or RNA viral chromosome) or an artificial chromosome (e.g. a human artificial chromosome). The nucleic acid construct may be linear or circular. The nucleic acid construct may comprise any sequence elements necessary or helpful for synthesis or delivery to a target cell, for instance an antibiotic resistance gene and/or an alternative gene for positive or negative selection of the construct, an origin of replication, a centromere, telomeres, and so forth. The sequence elements necessary are dependent on the nature of the nucleic acid construct, and are well-known to the skilled person. Upon delivery to a target cell in the brain of a mammal, the nucleic acid construct disclosed herein may integrate into the target cell genome (i.e. it may integrate at a defined or undefined location within a chromosome of the target cell), or it may be retained in the target cell extra-chromosomally.

In the construct disclosed herein, the promoter is preferably a "tight" promoter, or alternatively put, the promoter is preferably not "leaky", by which is meant that in the absence of the enhancer no expression of the therapeutic gene is seen. Similarly, no or minimal expression of the therapeutic gene should be seen in cells outside of the entorhinal cortex in a subject to which the delivery vehicle of the invention has been administered. The promoter may be a minimal promoter, by which is meant a core promoter comprising only the minimal required elements for the promoter to drive transcription, and which is inactive in the absence of one or more enhancers. The promoter is preferably not a constitutive promoter.

The promoter in the construct disclosed herein may be homologous to the enhancer, by which is meant that the promoter and enhancer may be natively operatively linked, i.e. operatively linked in a wild-type organism from which they are derived. In the case that the promoter and enhancer are homologous, each is derived from the same organism and drives expression of the same gene in the organism of origin. In another embodiment, the promoter and enhancer are heterologous, i.e. the promoter and the enhancer are not natively operatively linked. When the promoter or enhancer are heterologous, the promoter and enhancer may be derived from different organisms, or the promoter and/or the enhancer may be synthetic. Alternatively, the promoter and the enhancer may both be derived from the same species, but not be operatively linked within the native species, i.e. in the native species the promoter may drive expression of one gene and the enhancer drive expression of a different gene.

As noted above, the enhancer in the nucleic acid construct disclosed herein may be a variant enhancer. Similarly, the promoter in the nucleic acid construct of the invention may be a variant promoter. For the purposes of the present application a variant promoter is considered a synthetic promoter. Accordingly, a variant promoter cannot be considered homologous to an enhancer, as no such promoter is found in nature. Similarly, a variant enhancer cannot be considered to be homologous to a promoter.

The promoter may be homologous to the therapeutic gene or heterologous to the therapeutic gene. If the promoter is a variant promoter it cannot be considered homologous to a therapeutic gene, and if a therapeutic gene is a variant therapeutic gene it cannot be considered homologous to a promoter.

In an embodiment, the promoter is an Hsp68 minimal promoter. The Hsp68 minimal promoter is the promoter which is natively operatively linked to the gene encoding heat shock protein 68. An Hsp68 minimal promoter may be derived from any animal, particularly a mammal, e.g. an Hsp68 promoter may be from a rodent or a primate. The Hsp68 promoter may be a wild-type Hsp68 promoter or a variant of a wild-type Hsp68 promoter. The promoter may be a murine Hsp68 minimal promoter, for example the promoter may be the Hsp68 promoter which has the nucleotide sequence set forth in SEQ ID NO: 1630 or a variant thereof. Thus the promoter may comprise the nucleotide sequence set forth in SEQ ID NO: 1630, or a nucleotide sequence with at least 70, 75, 80, 85, 90 or 95% sequence identity to SEQ ID NO: 1630. Alternatively, the promoter may be a human Hsp68 minimal promoter. The Hsp68 minimal promoter is well known in the art.

In another embodiment, the promoter is the Fgf4 minimal promoter, which is natively operatively linked to the gene encoding fibroblast growth factor 4. The Fgf4 minimal promoter may be obtained from any animal which has such a promoter, including for instance a rodent such as a mouse or a primate such as a human. The Fgf4 promoter may be a wild-type Fgf4 promoter or a variant of a wild-type Fgf4 promoter. In a particular embodiment the Fgf4 promoter is the murine Fgf4 promoter, which has the nucleotide sequence set forth in SEQ ID NO: 1639, or a variant thereof. Thus the promoter may comprise the nucleotide sequence set forth in SEQ ID NO: 1639 or a nucleotide sequence with at least 70, 75, 80, 85, 90 or 95% sequence identity thereto.

In another embodiment, the promoter is the TRE3G promoter. The TRE3G promoter is an artificial promoter designed by ClonTech (USA). The full TRE3G promoter is a tetracycline-regulated Tet-On promoter, which comprises seven 5' tetO sequences (the tetO sequence is set forth in SEQ ID NO: 1640). The promoter may be the full TRE3G promoter, the sequence of which is set forth in SEQ ID NO: 1641, or a variant thereof, i.e. the promoter may comprise the nucleotide sequence set forth in SEQ ID NO: 1641 or a nucleotide sequence with at least 70, 75, 80, 85, 90 or 95% sequence identity thereto. Alternatively the promoter may be the minimal TRE3G promoter, the sequence of which is set forth in SEQ ID NO: 1642, or a variant thereof, i.e. the promoter may comprise the nucleotide sequence set forth in SEQ ID NO: 1642 or a nucleotide sequence with at least 70, 75, 80, 85, 90 or 95% sequence identity thereto. The minimal TRE3G promoter lacks the tetO sequences present in the full-length promoter, but is otherwise identical. The TRE3G minimal promoter is derived from the cytomegalovirus (CMV) promoter.

In another embodiment, the promoter is a TK minimal promoter, which is natively operatively linked to the thymidine kinase gene. The TK minimal promoter may be derived from any organism, for instance it may derived from a eukaryote, such as a mammal, for instance a rodent or a primate, e.g. the TK minimal promoter may be derived from a human or a mouse. Alternatively, the TK minimal promoter may be from a prokaryote or a virus, preferably a virus which is able to infect humans. In a particular embodiment the TK promoter is the herpes simplex virus TK (HSV-TK) promoter, which has the sequence set forth in SEQ ID NO: 1643, or a variant thereof, i.e. the promoter may comprise the nucleotide sequence set forth in SEQ ID NO: 1643 or a nucleotide sequence with at least 70, 75, 80, 85, 90 or 95% sequence identity thereto.

In another embodiment, the promoter is the Odz3 minimal promoter, which is natively operatively linked to the Odz3 gene. In mouse, expression of the Odz3 gene is under control of the enhancer MEC-13-53, the sequence of which is set forth in SEQ ID NO: 2 and which is discussed further below. The Odz3 minimal promoter may be derived from any animal, particularly a mammal such as a rodent, e.g. a mouse, or a primate, e.g. a human. In a particular embodiment the Odz3 minimal promoter is the murine Odz3 minimal promoter which has the nucleotide sequence set forth in SEQ ID NO: 1644, i.e. the promoter may comprise the nucleotide sequence set forth in SEQ ID NO: 1644 or a nucleotide sequence with at least 70, 75, 80, 85, 90 or 95% sequence identity thereto.

As detailed above, the entorhinal cortex comprises six layers, of which Layer II is the outermost layer of cells. In an embodiment, the enhancer which specifically drives gene expression in cells of the entorhinal cortex more specifically drives gene expression only in cells of Layer II of the entorhinal cortex. An enhancer which specifically drives gene expression in cells of Layer II of the entorhinal cortex does not drive gene expression in cells outside of the brain, nor in brain cells located in regions other than the entorhinal cortex, nor in cells of other layers of the entorhinal cortex. Thus an enhancer which specifically drives gene expression in cells of Layer II of the entorhinal cortex does not drive gene expression in cells of any other layer of the entorhinal cortex, e.g. it does not drive gene expression in cells of Layers III, V or VI (as noted above, Layers I and IV are largely free of cells).

Enhancers which specifically drive expression in cells of Layer II of the entorhinal cortex can be identified by ChIP-seq or the like, as described above. Cells of Layer II of the entorhinal cortex may be isolated by microdissection. In rodents for example, Layer II of the entorhinal cortex can be identified based on the presence of characteristic large, spherical neurons.

An enhancer which drives specific expression in cells of Layer II of the EC may be specific to cells of Layer II in a general sense (i.e. layer-specific), or it may, more specifically, drive expression only, or substantially only, in particular sub-sets of cells in Layer II of the EC, for example particular sub-sets defined by the expression of particular neurochemical markers.

As detailed above, many cells in Layer II of the entorhinal cortex express the protein reelin. Reelin is a secreted glycoprotein which forms a part of the extracellular matrix. In addition to its role in the developing brain described above, reelin modulates synaptic plasticity in the adult brain. In an embodiment of the invention, the enhancer which specifically drives gene expression in cells of Layer II of the entorhinal cortex more specifically drives gene expression only in reelin-positive cells of Layer II of the entorhinal cortex (by a reelin-positive cell is meant a cell which expresses reelin). Cells which express reelin may be identified and isolated by any method known in the art, e.g. FACS, and enhancers which specifically drive gene expression in reelin-positive cells of Layer II of the EC may thus be identified by performing ChIP-seq on the isolated cells. Alternatively, enhancers which specifically drive expression in Layer II of the EC may be tested in vivo for their specificity of expression in reelin-positive cells, e.g. by expression of a marker gene such as a fluorescent protein.

The inventors of the present application have identified several hundred enhancers which may specifically drive gene expression in cells of the entorhinal cortex. These enhancers were identified by first microdissecting mouse brains to obtain tissue from the MEC and the LEC, followed by performing ChIP-seq on the isolated tissue. This is described in detail in the Examples. This led to the identification of 165 putative enhancer sequences specifically active in the MEC and 690 putative enhancer sequences specifically active in the LEC. These murine enhancer sequences correspond to SEQ ID NOs: 15-869. To compensate for a possible lack of precise correlation between the ChIP-seq "peaks" and the actual enhancer sequences, the enhancer sequences in SEQ ID NOs: 15-869 are "padded", meaning that 500 nucleotides have been added to both the 5' and 3' ends of the sequences obtained by ChIP-seq, to ensure that the complete enhancer sequence is included in each sequence presented herein.

Accordingly, in an embodiment, the enhancer which specifically drives gene expression in cells of the entorhinal cortex is a murine enhancer sequence, i.e., a sequence derived from the house mouse (Mus musculus), or a variant of a murine enhancer sequence. In a particular embodiment, the enhancer comprises a nucleotide sequence as set forth in any one of SEQ ID NOs: 15-869. Alternatively, the enhancer may comprise a variant of any one of SEQ ID NOs: 15-869, i.e. a nucleotide sequence having at least 70% sequence identity to any one of SEQ ID NOs: 15-869, for instance a nucleotide sequence having at least 75, 80, 85, 90 or 95% sequence identity to any one of SEQ ID NOs: 15-869. A variant of any one of SEQ ID NOs: 15-869 may be obtained by addition, deletion or substitution of one or more nucleotides relative to the unmodified, native sequence.

In light of the padding at both ends of each of SEQ ID NOs: 15-869, in another embodiment, the enhancer which specifically drives gene expression in cells of the entorhinal cortex comprises a fragment of any one of SEQ ID NOs: 15-869, wherein the fragment corresponds to a nucleotide sequence which is obtainable by the deletion of 1 to about 500 nucleotides from the 5' end and/or the deletion of 1 to about 500 nucleotides from the 3' end of any one of SEQ ID NOs: 15-869. A "fragment" of a defined nucleotide sequence, as defined herein, is a segment of the sequence in which the 5' and/or 3' end is truncated relative to the defined nucleotide sequence. The sequence of the fragment is present within the defined nucleotide sequence as a single, contiguous nucleotide sequence.

In another embodiment, the enhancer which specifically drives gene expression in cells of the entorhinal cortex comprises a variant of a fragment of any one of SEQ ID NOs: 15-869, wherein the variant of a fragment has a nucleotide sequence having at least 70, 75, 80, 85, 90 or 95% sequence identity to a fragment of any one of SEQ ID NOs: 15-869, wherein the fragment of any one of SEQ ID NOs: 15-869 is as defined above. Such a variant of a fragment may be obtained by addition, deletion or substitution of one or more nucleotides relative to the unmodified sequence.

A number of the murine enhancer sequences identified by ChIP-seq were tested in mice to identify whether they specifically drive gene expression in cells of the entorhinal cortex. The enhancer sequences identified by ChIP-seq were first filtered according to their H3K27ac signal, conservation across 30 species and the expression of two flanking genes based on visual inspection of in situ hybridisation experiments in mouse brain sections. The filtering process is described in greater detail in the Examples. The putative enhancer sequences were ranked based on the results of the filtering and the highest ranked sequences tested for specific activity in the entorhinal cortex. This was achieved by pronuclear injection into mouse oocytes of constructs comprising a reporter gene and a minimal promoter operatively linked to the enhancer of interest. The resulting mice were killed and their brains analysed for expression of the reporter gene (see Examples for details). This led to the identification of 8 murine enhancer sequences which specifically drove gene expression in the entorhinal cortex. The sequences of these 8 enhancers are set forth in SEQ ID NOs: 1-6, 9 and 10. The chromosomal locations of these enhancer sequences, their associated (i.e. operatively linked) gene(s) and their identifiers are set forth in Table 1.

Accordingly, in an embodiment, the enhancer comprises a nucleotide sequence as set forth in any one of SEQ ID NOs: 1-6, 9 and 10. Alternatively, the enhancer may comprise a variant of a nucleotide sequence as set forth in any one of SEQ ID NOs: 1-6, 9 and 10, i.e. a nucleotide sequence with at least 70% sequence identity to any one of SEQ ID NOs: 1-6, 9 and 10, for instance a nucleotide sequence having at least 75, 80, 85, 90 or 95% sequence identity to any one of SEQ ID NOs: 1-6, 9 and 10. A variant of any one of SEQ ID NOs: 1-6, 9 and 10 may be obtained by addition, deletion or substitution of one or more nucleotides relative to the unmodified, native sequence.

TABLE 1

| SEQ ID NO: | Identifier | Chromosomal Location* | Associated Gene(s) |
|---|---|---|---|
| 1 | MEC-13-32 | chr7: 65,916,198-65,918,580 | UBE3A; ATP10A |
| 2 | MEC-13-53 | chr8: 49,906,388-49,908,569 | ODZ3 |
| 3 | MEC-13-81 | chr10: 99,573,051-99,574,981 | KITL; GM4301 |
| 4 | MEC-13-95 | chr6: 138,334,728-138,335,952 | LMO3; MGST1 |
| 5 | MEC-13-104 | chr15: 50,913,896-50,916,356 | TRPS1; EIF3H |
| 6 | MEC-13-123 | chr16: 39,750,789-39,753,454 | IGSF11 |
| 9 | LEC-13-8 | chr2: 171,158,079-171,159,156 | DOK5; CBLN4 |
| 10 | LEC-13-108 | chr5: 118,194,653-118,195,333 | NOS1; KSR2 |

*chrx indicates chromosome number, e.g. chr7 indicates a location on chromosome 7. The chromosomal coordinates provided pertain to the mm9 mouse reference genome.

The enhancer sequences of SEQ ID NOs: 1-3 and 5 were found to drive MEC-localised gene expression with a particularly high level of specificity, and the enhancer sequences of SEQ ID NOs: 9 and 10 were found to drive LEC-localised gene expression with a particularly high level of specificity. Thus in a particular embodiment the enhancer comprises a nucleotide sequence as set forth in any one of SEQ ID NOs: 1-3, 5, 9 and 10. Alternatively, the enhancer may comprise a variant of a nucleotide sequence as set forth in any one of SEQ ID NOs: 1-3, 5, 9 and 10, i.e. a nucleotide sequence with at least 70% sequence identity to any one of SEQ ID NOs: 1-3, 5, 9 and 10.

The putative murine enhancer sequences set forth in SEQ ID NOs: 7-8 and 11-14 were also tested for their specificity in driving gene expression in the brains of mice. Accordingly, in an embodiment the enhancer comprises a nucleotide sequence as set forth in any one of SEQ ID NOs: 7-8 and 11-14, or a nucleotide sequence with at least 70, 75, 80, 85, 90 or 95% sequence identity to any one of the aforementioned sequences.

Where the enhancer comprises a variant or fragment of a native murine sequence as defined herein, the variant or fragment is an active variant or fragment of the native enhancer sequence. By an active variant or fragment is meant a variant or fragment of the native sequence which specifically drives gene expression in cells of the entorhinal cortex. Preferably, the variant or fragment has enhanced activity relative to the native enhancer sequence, e.g. it may drive a higher level of gene expression in cells of the entorhinal cortex, while retaining its specificity of activity such that it does not drive gene expression in cells outside of the entorhinal cortex.

Human enhancer sequences corresponding to the murine enhancer sequences identified by ChIP-seq were identified based on homology using the UCSC liftover tool (available at https://genome.ucsc.edu/cgi-bin/hgLiftOver). In total, 732 human orthologues of the putative murine enhancer sequences were identified. Human orthologues were not identified for all murine enhancer sequences, but orthologues of all the murine enhancers demonstrated to be active as predicted (and listed in Table 1) were identified. The nucleotide sequences of the 732 putative orthologous human enhancer sequences are set forth in SEQ ID NOs: 898-1629. As for SEQ ID NOs: 15-869, these sequences include padding of 500 nucleotides at the 5' and 3' ends.

Thus, in an embodiment of the invention, the enhancer which specifically drives gene expression in cells of the entorhinal cortex is a human enhancer sequence, i.e. a sequence derived from a human (*Homo sapiens*), or a variant of a human enhancer sequence.

In a particular embodiment, the enhancer which specifically drives gene expression in cells of the entorhinal cortex comprises a nucleotide sequence as set forth in any one of SEQ ID NOs: 898-1629. Alternatively the enhancer may comprise a variant of any one of SEQ ID NOs: 898-1629, i.e., a nucleotide sequence having at least 70, 75, 80, 85, 90 or 95% sequence identity to any one of SEQ ID NOs: 898-1629. A variant of any one of SEQ ID NOs: 898-1629 may be obtained by addition, deletion or substitution of one or more nucleotides relative to the unmodified, native sequence.

In light of the padding at both ends of each of SEQ ID NOs: 898-1629, in another embodiment the enhancer which specifically drives gene expression in cells of the entorhinal cortex comprises a fragment of any one of SEQ ID NOs: 898-1629, wherein the fragment corresponds to a nucleotide sequence which is obtainable by the deletion of 1 to about 500 nucleotides from the 5' end and/or the deletion of 1 to about 500 nucleotides from the 3' end of any one of SEQ ID NOs: 898-1629.

In another embodiment, the enhancer which specifically drives gene expression in cells of the entorhinal cortex comprises a variant of a fragment of any one of SEQ ID NOs: 898-1629, wherein the variant of a fragment has a nucleotide sequence having at least 70, 75, 80, 85, 90 or 95% sequence identity to a fragment of any one of SEQ ID NOs: 898-1629, wherein the fragment of any one of SEQ ID NOs: 898-1629 is as defined above. Such a variant of a fragment may be obtained by addition, deletion or substitution of one or more nucleotides relative to the unmodified sequence.

The human orthologues of the 8 murine enhancer sequences shown to specifically drove gene expression in the entorhinal cortex (i.e. those listed in Table 1) were identified. These are listed below in Table 2. Both the minimal predicted human enhancer sequences are listed as are padded versions. As shown, the minimal predicted human enhancer sequences which correspond to the murine sequences set forth in SEQ ID NOs: 1-6, 9 and 10, are set forth in SEQ ID NOs: 870, 872, 874, 876, 878, 880, 886 and 888, respectively. The padded versions of these predicted human enhancer sequences are set forth in SEQ ID NOs: 871, 873, 875, 877, 879, 881, 887 and 889, respectively. Accordingly, in a particular embodiment the enhancer comprises a nucleotide sequence as set forth in any one of SEQ ID NOs: 870-881 and 886-889. Alternatively, the enhancer may comprise a variant of any one of SEQ ID NOs: 870-881 and 886-889, i.e. a nucleotide sequence having at least 70, 75, 80, 85, 90 or 95% sequence identity to any one of SEQ ID NOs: 870-881 and 886-889. A variant of any one of SEQ ID NOs: 870-881 and 886-889 may be obtained by addition, deletion or substitution of one or more nucleotides relative to the unmodified, native sequence.

TABLE 2

| Murine Sequence | | Orthologous Human Sequence (Minimal) | | Orthologous Human Sequence (Padded) | |
|---|---|---|---|---|---|
| SEQ ID NO: | Identifier | SEQ ID NO: | Chromosomal Location* | SEQ ID NO: | Chromosomal Location |
| 1 | MEC-13-32 | 870 | chr15: 26,104,718-26,106,759 | 871 | chr15: 26,104,218-26,107,259 |
| 2 | MEC-13-53 | 872 | chr4: 183,086,572-183,090,124 | 873 | chr4: 183,086,072-183,090,624 |
| 3 | MEC-13-81 | 874 | chr12: 88,864,752-88,866,740 | 875 | chr12: 88,864,252-88,867,240 |
| 4 | MEC-13-95 | 876 | chr12: 16,723,983-16,725,337 | 877 | chr12: 16,723,483-16,725,837 |
| 5 | MEC-13-104 | 878 | chr8: 116,889,103-116,891,663 | 879 | chr8: 116,888,603-116,892,163 |
| 6 | MEC-13-123 | 880 | chr3: 117,925,034-117,927,714 | 881 | chr3: 117,924,534-117,928,214 |
| 9 | LEC-13-8 | 886 | chr20: 53,829,293-53,830,248 | 887 | chr20: 53,828,793-53,830,748 |
| 10 | LEC-13-108 | 888 | chr12: 117,924,865-117,925,650 | 889 | chr12: 117,924,365-117,926,150 |

*The chromosomal coordinates provided pertain to the hg19 human reference genome.

In light of the padding at both ends of each of SEQ ID NOs: 871, 873, 875, 877, 879, 881, 887 and 889, in another embodiment the enhancer which specifically drives gene expression in cells of the entorhinal cortex comprises a fragment of any one of SEQ ID NOs: 871, 873, 875, 877, 879, 881, 887 and 889, wherein the fragment corresponds to a nucleotide sequence which is obtainable by the deletion of 1 to about 500 nucleotides from the 5' end and/or the deletion of 1 to about 500 nucleotides from the 3' end of any one of SEQ ID NOs: 871, 873, 875, 877, 879, 881, 887 and 889. In another embodiment, the enhancer which specifically drives gene expression in cells of the entorhinal cortex comprises a variant of a fragment of any one of SEQ ID NOs: 871, 873, 875, 877, 879, 881, 887 and 889, wherein the variant of a fragment has a nucleotide sequence having at least 70, 75, 80, 85, 90 or 95% sequence identity to a fragment of any one of SEQ ID NOs: 871, 873, 875, 877, 879, 881, 887 and 889, wherein the fragment of any one of SEQ ID NOs: 871, 873, 875, 877, 879, 881, 887 and 889 is as defined above. Such a variant of a fragment may be obtained by addition, deletion or substitution of one or more nucleotides relative to the unmodified sequence.

In the various embodiments described above which comprise a fragment of a padded sequence, the fragment may correspond to a nucleotide which is obtainable by the deletion of from 1 to any integer up to 500 nucleotides from the 5' end and/or the 3' end of the padded sequence (i.e., of any one of SEQ ID NOs: 15-869, 898-1629, or 871, 873, 875, 877, 879, 881, 887 or 889). Thus, for example 1 to 10, 20, 30, 40, 50, 100, 200, 300, or 400 nucleotides may be deleted from either the 5' end or the 3' end, or both, of any of the aforesaid padded sequences.

The human orthologues of the murine enhancer sequences with the nucleotide sequences set forth in SEQ ID NOs: 7-8 and 11-14 were also identified. The human orthologues of the nucleotide sequences set forth in SEQ ID NOs: 7-8 and 11-14 are set forth in SEQ ID NOs: 882, 884, 890, 892, 894 and 896, respectively. The padded versions of these sequences are set forth in SEQ ID NOs: 883, 885, 891, 893, 895 and 897, respectively. Accordingly, in an embodiment the enhancer which specifically drives gene expression in cells of the entorhinal cortex comprises a nucleotide sequence as set forth in any one of SEQ ID NOs: 882-885 and 890-897. Alternatively, the enhancer may comprise a variant of any one of SEQ ID NOs: 882-885 and 890-897, i.e. a nucleotide sequence having at least 70, 75, 80, 85, 90 or 95% sequence identity to any one of SEQ ID NOs: 882-885 and 890-897. A variant of any one of SEQ ID NOs: 870-881 and 886-889 may be obtained by addition, deletion or substitution of one or more nucleotides relative to the unmodified, native sequence.

In light of the padding at both ends of each of SEQ ID NOs: 883, 885, 891, 893, 895 and 897, in another embodiment the enhancer which specifically drives gene expression in cells of the entorhinal cortex comprises a fragment of any one of SEQ ID NOs: 883, 885, 891, 893, 895 and 897, wherein the fragment corresponds to a nucleotide sequence which is obtainable by the deletion of 1 to about 500 nucleotides from the 5' end and/or the deletion of 1 to about 500 nucleotides from the 3' end of any one of SEQ ID NOs: 883, 885, 891, 893, 895 and 897. In another embodiment, the enhancer which specifically drives gene expression in cells of the entorhinal cortex comprises a variant of a fragment of any one of SEQ ID NOs: 883, 885, 891, 893, 895 and 897, wherein the variant of a fragment has a nucleotide sequence having at least 70, 75, 80, 85, 90 or 95% sequence identity to a fragment of any one of SEQ ID NOs: 883, 885, 891, 893, 895 and 897, wherein the fragment of any one of SEQ ID NOs: 883, 885, 891, 893, 895 and 897 is as defined above. Such a variant of a fragment may be obtained by addition, deletion or substitution of one or more nucleotides relative to the unmodified sequence.

The nucleic acid construct disclosed herein comprises a therapeutic gene. Such a gene is useful in therapy for a medical condition. Preferably it is useful for therapy of a medical condition in a human. Advantageously, it is useful for therapy of a condition which affects cells of the entorhinal cortex. By "useful in therapy for a medical condition" is meant that expression of the gene is able to treat or prevent the medical condition, due to the effect of the gene on the cell or tissue in which it is expressed. Treatment as defined herein may be curative (or intended to be curative) or palliative (i.e., designed merely to limit, relieve or improve the symptoms of a condition). Any positive or beneficial effect, or any improvement in any clinical or functional parameter of the subject of the therapy is included.

The therapeutic gene encodes a functional therapeutic agent. The functional therapeutic agent may be a functional RNA molecule or it may be a protein (i.e., the therapeutic gene may encode a functional RNA molecule or a protein). For instance, the therapeutic agent may be an RNA molecule which interferes with expression of a native protein, e.g., by RNAi. For instance, the RNA molecule may be a short hairpin RNA (shRNA) or a microRNA (miRNA). An shRNA is a short RNA molecule (typically about 80 bases long) which contains a tight hairpin, which is processed within a cell to yield a short interfering RNA (siRNA) which is functional in RNAi to knock down expression of a target protein. The RNA molecule may comprise a sequence which is the reverse complement of a target RNA, e.g. a target mRNA. In other words, the RNA molecule may be an antisense RNA complementary to a target RNA. The skilled person is well able to design an RNA molecule for use in RNAi. In another embodiment the therapeutic agent may be a long non-coding RNA (lncRNA) which has a therapeutic effect. A long non-coding RNA is generally defined as a non-coding RNA at least 200 nucleotides in length. Alternatively the therapeutic agent may be a protein with a function useful in treating or preventing a disease. A protein may have a therapeutic effect by any means.

In a particular embodiment, the therapeutic gene is a gene which is useful in the treatment or prevention of Alzheimer's disease. Such a gene may prevent Alzheimer's disease from occurring in a patient, it may cure Alzheimer's disease, slow disease progression or alleviate certain symptoms of the disease. The therapeutic gene may encode a functional RNA which knocks down expression of genes associated with Alzheimer's disease. The gene associated with Alzheimer's disease may encode a protein, e.g., the APP (specifically amyloid-β) and/or Tau, or a kinase which phosphorylates Tau or stimulates amyloid-β production, e.g., glycogen synthase kinase 3 (GSK-3). Alternatively, the gene associated with Alzheimer's disease may encode a functional RNA, in particular an lncRNA. A number of lncRNAs have been implicated in Alzheimer's disease including the BACE1-AS lncRNA, the 51A lncRNA, the 17A lncRNA, the NDM29 lncRNA and the BC200 lncRNA (lncRNAs implicated in Alzheimer's disease are discussed in Luo & Chen, *Clin. Interv. Aging* 11: 867-872, 2016). In another embodiment, the therapeutic gene encodes a protein which has a therapeutic effect against Alzheimer's disease. For instance, the therapeutic gene may encode a protein which degrades amyloid-β or neurofibrillary tangles comprising Tau. In a particular embodiment, the therapeutic gene encodes neprilysin, which is a zinc-dependent metalloprotease which is able to degrade amyloid-β.

Neprilysin cleaves natriuretic peptides and angiotensin II, which can lead to hypertension and heart failure (neprilysin inhibitors are used in treatment for these conditions). Thus expression of neprilysin must be carefully regulated. Expression of neprilysin which is limited to cells of the entorhinal cortex allows exploitation of the anti-Alzheimer's disease effect of neprilysin (i.e. amyloid-β cleavage) without risking causing heart failure in a patient. Human neprilysin has the UniProt accession number P08473; its amino acid sequence is set forth in SEQ ID NO: 1632. Thus the therapeutic gene may comprise a nucleotide sequence which encodes the amino acid sequence set forth in SEQ ID NO: 1632, or a functional variant of such an amino acid sequence. A functional variant of neprilysin has a modified amino acid sequence but retains its ability to cleave amyloid-β. Preferably, a functional variant has at least 50% of the specific activity of the native sequence in terms of cleavage of amyloid-β. More preferably, a functional variant of neprilysin has at least 60, 70, 80, 90, 100, 110 or 120% or more of the specific activity of the native sequence in terms of cleavage of amyloid-β.

In another embodiment, the therapeutic gene encodes an α-secretase. α-secretases are proteases which cleave the APP within the fragment which forms amyloid-β, and thus prevent amyloid-β generation. α-secretases are members of the ADAM family, which is a family of transmembrane metalloproteases. The therapeutic gene may in particular encode an α-secretase selected from ADAM9, ADAM10, ADAM17 and ADAM19. Human ADAM9 has the UniProt accession number Q13443 and the amino acid sequence set forth in SEQ ID NO: 1633; human ADAM10 has the UniProt accession number O14672 and the amino acid sequence set forth in SEQ ID NO: 1634; ADAM17 has the UniProt accession number P78536 and the amino acid sequence set forth in SEQ ID NO: 1635; ADAM19 has the UniProt accession number Q9H013 and the amino acid sequence set forth in SEQ ID NO: 1636.

Accordingly, in an embodiment the therapeutic gene comprises a nucleotide sequence which encodes an amino acid sequence as set forth in any one of SEQ ID NOs: 1633-1636, or a functional variant of such an amino acid sequence. As above, a functional variant of any one of SEQ ID NOs: 1633-1636 has an amino acid sequence which is modified relative to one of SEQ ID NOs: 1633-1636 but which retains at least 50%, preferably at least 60, 70, 80, 90, 100, 110 or 120% or more of the specific activity of the native enzyme sequence.

In another embodiment the therapeutic gene encodes PGC-1α (i.e., peroxisome proliferator-activated receptor gamma coactivator 1-α). PGC-1α is the master regulator of mitochondrial biogenesis. Expression of PGC-1α in the entorhinal cortex may reduce oxidative stress and inflammation in this region of the brain, which it is believed may prevent or treat Alzheimer's disease. Human PGC-1α has the UniProt accession number Q9UBK2 and the amino acid sequence set forth in SEQ ID NO: 1637. Accordingly, in an embodiment the therapeutic gene comprises a nucleotide sequence which encodes an amino acid sequence as set forth in SEQ ID NO: 1637, or a functional variant thereof. A functional variant of SEQ ID NO: 1637 has an amino acid sequence which is modified relative to SEQ ID NO: 1637 but which retains at least 50%, preferably at least 60, 70, 80, 90, 100, 110 or 120% or more of the specific activity of the native amino acid sequence.

In another embodiment, the therapeutic gene encodes LSD1. LSD1 is an amino oxidase histone demethylase which protects against hippocampal and cortical neurodegeneration. Specifically, LSD1 demethylates mono- and di-methylated lysine 4 on histone H3, and di-methylated lysine 9 on histone H3. Human LSD1 has the UniProt accession number O60341 and the amino acid sequence set forth in SEQ ID NO: 1638. Accordingly, in an embodiment the therapeutic gene comprises a nucleotide sequence which encodes an amino acid sequence as set forth in SEQ ID NO: 1638, or a functional variant thereof. A functional variant of SEQ ID NO: 1638 has an amino acid sequence which is modified relative to SEQ ID NO: 1638 but which retains at least 50%, preferably at least 60, 70, 80, 90, 100, 110 or 120% or more of the specific activity of the native amino acid sequence.

In another embodiment, the therapeutic gene encodes a GSK-3 inhibitor. GSK-3 inhibitors are known in the art. A number of GSK-3 inhibitors suitable for use in the present invention are disclosed in US 2016/0200763, for instance the exemplary GSK-3 inhibitors L807 (SEQ ID NO: 1645) and L807-mts (SEQ ID NO: 1646).

In another embodiment, the therapeutic gene encodes a Tau phosphorylation pseudosubstrate. A Tau pseudosubstrate is a competitive substrate for kinases which phosphorylate Tau, such as GSK-3 and the Src family kinases Lck and Fyn. Such pseudosubstrates are known in the art. Such a pseudosubstrate may be phosphorylated, but does not form neurofibrillary tangles. Such a pseudosubstrate may for instance be a peptide derived from Tau comprising one more Tau phosphorylation sites. Preferably a Tau pseudosubstrate has higher affinity for its phosphorylating kinase(s) than does full-length Tau. Tau may be phosphorylated at multiple sites, which include Ser202 and Thr205; phosphorylation of Tau at these residues is associated with the formation of neurofibrillary tangles. Accordingly, in an embodiment the Tau pseudosubstrate includes a Tau-derived peptide which includes the residues Ser202 and Thr205. The Tau pseudosubstrate may be of any suitable length, for instance at least 10, 20, 30, 40, 50, 60, 70, 80, 90, 100, 125, 150, 175, or 200 or more amino acids in length.

The nucleic acid construct disclosed herein may further comprise a Woodchuck Hepatitis Virus (WHV) Posttranscriptional Regulatory Element (WPRE). The WPRE is a DNA sequence which, when transcribed, creates a tertiary structure which enhances gene expression. The WPRE may be operatively linked to the therapeutic gene. In the case that the therapeutic gene encodes a protein the WPRE may be included in the 3' untranslated region of the therapeutic gene. Alternatively, the WPRE may be located upstream of the promoter and/or enhancer. The WPRE has the nucleotide sequence set forth in SEQ ID NO: 1631. Accordingly, the nucleic acid construct disclosed herein may further comprise the nucleotide sequence set forth in SEQ ID NO: 1639. Alternatively, the nucleic acid construct disclosed herein may comprise an active variant of the WPRE, i.e. a nucleotide sequence with at least 70, 75, 80, 85, 90 or 95% sequence identity to SEQ ID NO: 1639. An active variant of the WPRE retains at least 50%, preferably at least 60, 70, 80, 90, 100, 110 or 120% or more of the activity of the wild-type WPRE. The skilled person is well able to identify the activity of the WPRE or a variant WPRE, based on expression levels of a gene with and without an operatively linked WPRE or WPRE variant. The WPRE may be used to enhance expression of a protein-encoding therapeutic gene or a therapeutic gene which encodes a functional RNA.

The nucleic acid construct disclosed herein may comprise one or more introns. The inclusion of introns may reduce or abrogate non-specific expression of the therapeutic gene (i.e., expression of the gene in cells other than those of the entorhinal cortex), and/or enhance the stability of therapeutic gene RNA following transcription. The intron may be located upstream or downstream of the therapeutic gene. Exemplary introns which may be included in construct disclosed herein include the simian virus 40 (SV40) intron (SEQ ID NO: 1647) and the β-globin intron, or a variant of either of these introns. The β-globin intron may be derived from any animal, but in a particular embodiment is the human β-globin intron, the sequence of which is set forth in SEQ ID NO: 1648. A synthetic intron may also or alternatively be used.

Recombinant methods for the generation of a nucleic acid construct as disclosed herein are well-known in the art. Sequence elements may be amplified from genomic or plasmid DNA by PCR and assembled into a construct by e.g. restriction enzyme-based cloning or Gibson assembly. Appropriate methods are well known to the skilled person.

Methods for determining the level of sequence identity between two or more sequences are well known in the art and any convenient or available method may be used. However, for determining the degree of sequence identity between sequences, computer programmes that make pairwise or multiple alignments of sequences are useful, for instance EMBOSS Needle or EMBOSS stretcher (both Rice, P. et al., *Trends Genet.*, 16, (6) pp 276-277, 2000) may be used for pairwise sequence alignments while Clustal Omega (Sievers F et al., *Mol. Syst. Biol.* 7:539, 2011) or MUSCLE (Edgar, R. C., *Nucleic Acids Res.* 32(5):1792-1797, 2004) may be used for multiple sequence alignments, though any other appropriate programme may be used. Whether the alignment is pairwise or multiple, it must be performed globally (i.e. across the entirety of the reference sequence) rather than locally.

Sequence alignments and % identity calculations may be determined using for instance standard Clustal Omega parameters: matrix Gonnet, gap opening penalty 6, gap extension penalty 1. Alternatively the standard EMBOSS Needle parameters may be used: matrix DNAfull, gap opening penalty 10, gap extension penalty 0.5, end gap penalty false. Any other suitable parameters may alternatively be used.

For the purposes of this application, where there is dispute between sequence identity values obtained by different methods, the value obtained by global pairwise alignment using EMBOSS Needle with default parameters shall be considered valid.

As detailed above, the present disclosure provides a delivery vehicle comprising a nucleic acid construct as described above. As detailed, the delivery vehicle is suitable for delivery of the nucleic acid construct to the brain of a mammal. The particular form of the delivery vehicle is not limited, so long as it is able to deliver its cargo (i.e., the nucleic acid construct) to the brain of a mammal. In particular, the delivery vehicle is able to deliver its cargo to the brain of a human. Such delivery vehicles are known in the art.

In a particular embodiment, the delivery vehicle is a lipoplex, dendrimer, exosome or a viral vector.

A lipoplex is a complex of lipids with a nucleic acid. In a particular embodiment, the lipids of the lipoplex are in the form of a liposome, which is a spherical vesicle formed from a lipid bilayer. The vesicle comprises the nucleic acid construct cargo. Methods of synthesizing liposomes and lipoplexes are well-known in the art (see e.g. Balazs & Godbey, *J. Drug Deliv.* 2011, Article ID 326497). In another embodiment, the lipids of the lipoplex are in the form of a micelle. The lipoplex may comprise cationic lipids, to aid uptake of the lipoplex by target cells and to enhance interaction of the lipids with negatively charged DNA. The lipoplex may comprise phospholipids.

Dendrimers are repetitively branched molecules. The dendrimer may be an organic molecule. Suitable molecules for use in the generation of dendrimers are known in the art, as are methods of dendrimer synthesis (see e.g. Chaplot & Rupenthal 2014, *J. Pharm. Pharmacol.* 66: 542-556). The dendrimer may be cationic to promote interaction with the cargo nucleic acid and target cell membrane.

Exosomes are cell-derived vesicles which can be isolated from eukaryotic fluids, e.g. blood, urine and used cell culture medium. Exosomes are advantageous for use as nucleic acid carriers as they are non-immunogenic. The use of exosomes in drug delivery is known in the art (see e.g. Yang & Nadithe, 2016, *Acta Pharmaceutica Sinica B* Vol. 6(4): 287-296).

Viral vectors for use in gene therapy are well-known in the art (see e.g. Kotterman et al. 2015, *Annu. Rev. biomed. Eng.* Vol. 17:63-89). Any suitable viral vector may be used, e.g., a herpesvirus, retrovirus, lentivirus or adenovirus. In a particular embodiment, the viral vector is an adeno-associated virus (AAV).

An AAV is a replication-defective, non-enveloped virus of the genus *Dependoparvovirus*. AAVs are non-pathogenic, single-stranded DNA viruses. Particularly advantageously, AAV serotypes which cross the blood brain barrier have been developed (Deverman et al., *Nature Biotechnology* 34: 204-209, 2016), including the serotype AAV-PHP.B. In an embodiment, the delivery vehicle is an AAV, in particular of the serotype AAV-PHP.B. Many other AAV serotypes suitable for gene delivery, including gene delivery to the brain, are also known in the art and may be used in the delivery vehicles described herein, e.g., AAV-2/1, AAV-2/5, AAV-2/7, AAV-2/8, AAV-2/9, AAV-2/rh10, AAV-2/DJ and AAV-2/DJ18 (see Holehonnur et al., *BMC Neuroscience* 15:28, 2014). The AAV may be a natural or synthetic serotype. In a particular embodiment, the AAV is of the serotype AAV-2/1.

AAVs can be synthesized in cell culture, using e.g. HEK293 or HEK293T cells. AAVs and plasmids for generating AAVs are commercially available (e.g. from Addgene, USA). Commercially acquired AAV plasmids may be used in AAV synthesis in accordance with the supplier's instructions. Methods for generating AAVs are well known in the art (see e.g. Potter et al., 2014, *Mol. Ther. Methods Clin. Dev.* 1: 14034 and Chan et al., 2017, *Nature Neuroscience* 20: 1172-1179).

AAVs have a single-stranded DNA genome about 4.7 kb long. Each end of the AAV genome is formed from ITR (inverted terminal repeat) sequences. In a preferred embodiment, the construct disclosed herein is included in the AAV genome in an inverted formation, i.e., running 3' to 5'. In other words, the AAV genome is a negative sense DNA strand with respect to the construct disclosed herein. It has been found that by including the construct in the AAV genome in an inverted formation non-specific expression of the therapeutic gene may be reduced.

In a particular embodiment, the delivery vehicle is an AAV, preferably the AAV-2/1 serotype, and the construct disclosed herein is included in the AAV genome in an inverted formation. The enhancer may be the Odz3 enhancer; the promoter may be the TRE3G minimal promoter; the enhancer may be located immediately upstream of the promoter (this refer to the location of the enhancer relative to the promoter when the construct is in its forward, 5'-3' orientation; when the construct is inverted in the single-stranded DNA genome of an AAV the enhancer would appear immediately downstream of the enhancer); the WPRE may be located immediately upstream of the enhancer (again, this would appear immediately downstream of the enhancer when the construct is present in an AAV genome in inverted formation).

Other known gene therapy vectors may also be used, for instance a polymersome (which is a synthetic version of a liposome, made of amphiphilic block copolymers) or a polyplex (a complex of the nucleic acid construct and cationic polymers; exemplary cationic polymers include polyethyleneimine, chitosan, poly(beta-amino esters) and polyphosphoramidate).

In another aspect, provided herein is a nucleic acid construct as defined above in which the enhancer which specifically drives gene expression in cells of the entorhinal cortex comprises a nucleotide sequence as set forth in any one of SEQ ID NOs: 1-6, 9, 10, 870-881 and 886-889, or a nucleotide sequence with at least 70, 75, 80, 85, 90 or 95% sequence identity to any one of these sequences.

In other words, a nucleic acid construct comprises:
(i) an enhancer which specifically drives gene expression in cells of the entorhinal cortex, wherein said enhancer comprises a nucleotide sequence as set forth in any one of SEQ ID NOs: 1-6, 9, 10, 870-881 and 886-889, or a nucleotide sequence with at least 70, 75, 80, 85, 90 or 95% sequence identity to any one of these sequences;

(ii) a promoter; and
(iii) a therapeutic gene,
wherein said enhancer, promoter and therapeutic gene are operatively linked, said enhancer and therapeutic gene are heterologous, and said delivery vehicle is suitable for delivery of the nucleic acid construct to the brain of a mammal. The nucleic acid construct of the invention is as defined above with respect to the nucleic acid construct comprised within the delivery vehicle.

In another embodiment, the nucleic acid construct comprises an enhancer which comprises a nucleotide sequence which is a fragment of any one of SEQ ID NOs: 871, 873, 875, 877, 879, 881, 887 and 889, wherein the fragment corresponds to a nucleotide sequence which is obtainable by the deletion of 1 to about 500 nucleotides from the 5' end and/or the deletion of 1 to about 500 nucleotides from the 3' end of any one of SEQ ID NOs: 871, 873, 875, 877, 879, 881, 887 and 889. In another embodiment, the enhancer which specifically drives gene expression in cells of the entorhinal cortex comprises a variant of a fragment of any one of SEQ ID NOs: 871, 873, 875, 877, 879, 881, 887 and 889, wherein the variant of a fragment has a nucleotide sequence having at least 70, 75, 80, 85, 90 or 95% sequence identity to a fragment of any one of SEQ ID NOs: 871, 873, 875, 877, 879, 881, 887 and 889, wherein the fragment of any one of SEQ ID NOs: 871, 873, 875, 877, 879, 881, 887 and 889 is as defined above.

In another aspect, a cell comprises a nucleic acid construct as disclosed herein. Such a cell may be considered a host cell. The host cell may be a prokaryotic (e.g., bacterial) or eukaryotic (e.g., mammalian) cell. The host cell may in particular be used as a cloning host for the nucleic acid construct. A cloning host may be a prokaryotic cell. Suitable prokaryotic cells for use as cloning hosts include without limitation, eubacteria, such as Gram-negative or Gram-positive organisms, for example Enterobacteriaceae such as *Escherichia*, in particular *E. coli*, and *Bacilli* such as *B. subtilis*. The cloning host may alternatively be a eukaryotic cell such as a fungal cell, e.g., *Pichia pastoris*, or a yeast cell, or even a higher eukaryotic cell such as a mammalian cell.

The nucleic acid construct may be integrated into the host cell chromosome, but is preferably maintained extra-chromosomally. The nucleic acid construct may be introduced into a host cell by any method known in the art. Such methods include, in particular, for prokaryotic cells transformation, transduction and conjugation. Transformation refers to the genetic alteration of a competent bacterium by direct uptake of DNA. Transduction refers to infection of a bacterium using a bacteriophage in order to introduce DNA of interest. Conjugation refers to the direct transfer of genetic material between bacterial cells in direct contact.

For eukaryotic cells, the nucleic acid construct may be introduced by transfection or transduction. Transfection may be accomplished by a variety of means known in the art including but not limited to calcium phosphate-DNA co-precipitation, DEAE-dextran-mediated transfection, polybrene-mediated transfection, electroporation, microinjection, liposome fusion, lipofection, protoplast fusion, retroviral infection, and biolistics. Transduction refers to the delivery of a gene(s) using a viral or retroviral vector by means of viral infection rather than by transfection. In certain embodiments, retroviral vectors are transduced by packaging the vectors into viral particles or virions prior to contact with a cell. The skilled person is well aware of appropriate methods for introducing such genetic material into a host cell.

In another aspect the invention provides a composition a delivery vehicle of and at least one physiologically-acceptable diluent, carrier or excipient. The compositions may be formulated in any convenient manner according to techniques and procedures known in the pharmaceutical art. "Pharmaceutically acceptable" as used herein refers to ingredients that are compatible with other ingredients of the compositions as well as physiologically acceptable to the recipient. The nature of the composition and carriers or excipient materials, dosages etc. may be selected in routine manner according to choice and the desired route of administration, purpose of treatment etc.

The pharmaceutical composition may be prepared for administration to a subject by any suitable means. Such administration may be e.g., oral, rectal, nasal, topical or parenteral. Oral administration as used herein includes buccal and sublingual administration. Topical administration as used herein includes transdermal administration. Parenteral administration as defined herein includes subcutaneous, intramuscular, intravenous, intraperitoneal and intradermal administration. Preferably the composition is suitable for parenteral administration.

Pharmaceutical compositions as disclosed herein include liquid solutions or syrups, solid compositions such as powders, granules, tablets or capsules, creams, ointments and any other style of composition commonly used in the art. Suitable pharmaceutically acceptable diluents, carriers and excipients for use in such compositions are well known in the art. For instance, suitable excipients include lactose, maize starch or derivatives thereof, stearic acid or salts thereof, vegetable oils, waxes, fats and polyols. Suitable carriers or diluents include carboxymethylcellulose (CMC), methylcellulose, hydroxypropylmethylcellulose (HPMC), dextrose, trehalose, liposomes, polyvinyl alcohol, pharmaceutical grade starch, mannitol, lactose, magnesium stearate, sodium saccharin, talcum, cellulose, glucose, sucrose (and other sugars), magnesium carbonate, gelatin, oil, alcohol, detergents and emulsifiers such as polysorbates. Stabilising agents, wetting agents, emulsifiers, sweeteners etc. may also be used.

Preferably the composition is a liquid composition. Liquid pharmaceutical compositions, whether they be solutions, suspensions or other like form, may include one or more of the following: sterile diluents such as water for injection, saline solution (preferably physiological), Ringer's solution, isotonic sodium chloride, fixed oils such as synthetic mono- or diglycerides which may serve as a solvent or suspending medium, polyethylene glycols, glycerin, propylene glycol or other solvents; antibacterial agents such as benzyl alcohol or methyl paraben; antioxidants such as ascorbic acid or sodium bisulfate; chelating agents such as EDTA; buffers such as acetates, citrates or phosphates and agents for the adjustment of tonicity such as sodium chloride or dextrose. A parenteral preparation can be enclosed in ampoules, disposable syringes or multiple dose vials made of glass or plastic. An injectable pharmaceutical composition is preferably sterile.

In another aspect, provided herein is a method of treating or preventing Alzheimer's disease, comprising administering a delivery vehicle or a composition as described herein to a subject in need thereof. The method of treating or preventing Alzheimer's disease is a method of gene therapy.

The subject to which the delivery vehicle or composition is administered may be any mammal, e.g., a farm animal such as a cow, horse, sheep, pig or goat, a pet animal such as a rabbit, cat or dog, a laboratory animal such as a mouse or a rat, or a primate such as a monkey, chimpanzee, gorilla or human. Most preferably the subject is a human.

A subject in need of the treatment or prevention of the invention is any subject suffering from Alzheimer's disease or at risk of developing Alzheimer's disease. A subject suffering from Alzheimer's disease may be identified based on symptoms characteristic of the disease (as described above), or may be asymptomatic but displaying brain pathology indicative of early Alzheimer's disease, as may be identified by scans or the like. For instance, in a subject with early-stage Alzheimer's disease a brain scan (e.g. a CT scan or MRI scan) may show shrinkage of the hippocampus and surrounding area.

A subject at risk of Alzheimer's disease may be specifically identified based on family history (i.e., a family history of Alzheimer's disease). A subject at risk of Alzheimer's disease may alternatively be any other person of any age who has not developed Alzheimer's disease, but who might develop the disease in the future. The delivery vehicle described herein can prevent Alzheimer's and so may function as a vaccine against the disease. Accordingly, it is envisaged that the delivery vehicle or composition will be widely administered across society in an organised vaccination programme. Vaccinations may be given in childhood or at any later age to prevent the development of the disease.

The delivery vehicle or composition may be administered to the subject by any suitable means. Administration may be e.g., oral, rectal, nasal, topical or parenteral. Preferably the administration is parenteral. The delivery vehicle or composition of the present invention may be administered at a dosage appropriate to the subject, based on e.g. the condition, size or age of the subject.

In another aspect, provided is a method of driving entorhinal cortex-specific gene expression in a mammalian subject, said method comprising administering to said subject a delivery vehicle or a composition as described herein.

The subject to which the delivery vehicle or composition is administered, and the method of administration, may be as detailed above with regard to the method of treatment or prevention of Alzheimer's disease.

EXAMPLES

Example 1: Generation of Transgenic Mice

Introduction

The inventors performed Chromatin Immunoprecipication with high-throughput sequencing (ChIP-seq) (Cotney et al., 2013; Reilly et al., 2015; Visel et al., 2009) of microdissected adult murine cortical sub-regions and compared active enhancers in each. The inventors found a similar number of active putative enhancers in each cortical sub-region as one typically finds in ChIP-seq of entire organs. Moreover, a large number of the putative enhancers were novel enhancer sequences, and many of them were specific to particular cortical sub-regions. Remarkably, when the inventors created transgenic mice based on single enhancers found to be specific to the medial entorhinal cortex (MEC), they often drove expression specifically in distinct subsets of MEC neurons. These data thereby not only serve to illustrate the enormous diversity of neuronal cell types in the adult brain, they also provide a means to generate cell type-specific genetic tools in a targeted manner, a method the inventors call Enhancer Driven Gene Expression (EDGE).

Methods

Microdissection

Two C57black6 mice (P56) were deeply anaesthetised by injection with pentobarbital (100 mg/ml in 96% ethanol, Ås Produksjonslab AS, Norway). The brains were removed and horizontal or coronal 500 µm sections were cut on a Leica VT 1000 S microtome and kept at 4° C. until dissection. Bilateral dissection was performed, while watching the tissue through a dissection microscope with transmitted and reflected white light (Zeiss Discovery V8 stereomicroscope) applying architectonic criteria (Boccara et al., 2015; Jones and Witter, 2007; O'Reilly et al., 2015; Sugar and Witter, 2016; Witter, 2011) to unstained tissue. The tissue samples were snap-frozen in liquid nitrogen, kept at −800° C. and shipped on dry ice.

All dissections avoided border regions, i.e., were taken centred in the identified cortical area. In horizontal sections, the MEC is easily recognized by the marked shape of the cortex, the prominent white, opaque lamina dissecans and the radial organization of the layers deep to the latter. Layer II neurons are large spherical neurons, which differ markedly in level of opacity from those in Layer III. The medial border between MEC and parasubiculum is characterized by the loss of the differentiation between Layers II and III, and the border with the laterally adjacent postrhinal cortex is characterised by the loss of the large spherical neurons in Layer II. The inventors only sampled the more dorsal and central portions of the MEC. The LEC shares the large Layer II neurons with the MEC, but the radial organisation in Layer V is absent. The anterior and dorsal border of the LEC with the perirhinal cortex is characterized by the abrupt disappearance of the large Layer II neurons. The inventors only sampled the most lateral portions of the LEC, to avoid contamination with ventromedially adjacent components of the amygdaloid complex. The ACC and RSC were sampled from the medial wall of the lateral hemisphere above the corpus callosum, avoiding the most anterior part of the ACC and the posteroventral part of the RSC. Since the border between the two areas coincides with the dorsal-anterior tip of the hippocampal formation, all samples avoided that border region.

In coronal sections, ACC and RSC samples were taken dorsal to the corpus callosum, just below the shoulder of the medial wall of the hemisphere down to, but not touching, the corpus callosum, to avoid inclusion of the indusium griseum. Samples were taken from sections anterior to the most anterodorsal tip of the hippocampal formation in case of the ACC and posterior to the tip in case of the RSC. Samples of the LEC were collected one section after the disappearance of the piriform cortex characterised by a densely packed thick Layer II, a polymorphic lightly-packed deeper cell layer and the presence of the endopiriform nucleus. The LEC shows cytoarchitectonic features similar to those described above. The inventors sampled only from the vertical part of the LEC, directly below the rhinal fissure. For the MEC, samples were collected from more posterior coronal sections, using shape of the section, the presence of the ventral hippocampus and cytoarchitectonic features as described above, as selection criteria.

ChIP-Seq

All dissected brain tissues were briefly homogenised and cross-linked with 1% formaldehyde at room temperature with rotation for 15 min. Cross-linking was quenched with glycine (150 mM in PBS), then tissue was washed and flash frozen. Chromatin was extracted as previously described (Cotney et al., 2013; Cotney and Noonan, 2015). Briefly, nuclei were extracted, lysed, and sonicated (30 min, 10 sec pulses) to produce sheared chromatin with an average length of ~250 bp. 1 to 10 micrograms of final soluble chromatin was used for each ChIP and combined with Protein G Dynabeads® (Invitrogen, cat #10004D) prebound with 5 µg of antibodies to H3K4me2 (Abcam ab7766) or H3K27ac (Abcam ab4729).

Immunoprecipitated chromatin was washed five times with 1 mL of wash buffer and once with TE. Immunoprecipitated chromatin was eluted, cross-links were reversed, and DNA was purified. Libraries were prepared for sequencing using NEBNext® ChIP-Seq Library Prep reagents and sequenced on the Illumina HiSeq™ 2000 platform at the Yale Center for Genome Analysis.

ChIP-Seq Data Analysis

ChIP-Seq data was initially processed as previously described (Reilly et al., 2015). Briefly, reads were aligned to the mm9 version of the mouse genome using bowtie (v1.1.1) (Langmead and Salzberg, 2012). Enriched regions were identified in individual replicates using a sliding window method as previously described (Mikkelsen et al., 2010). Enriched regions were divided into functional categories based on overlaps with genomic features as annotated by Ensembl v67 using Bedtools (2.19.0) (Quinlan and Hall, 2010). Reproducibly enriched regions were determined as the union of overlapping regions identified in both biological replicates. Putative enhancer regions from intergenic and intronic portions of the genome were then assigned target genes using GREAT. H3K27ac ChIP-Seq reads were retrieved from Encodeproject.org for 17 mouse tissues (Shen et al., 2012) and uniformly processed as above. Enhancers for all cell types were combined and merged to generate a uniform annotation of all possible enhancers. H3K27ac counts at each enhancer from each tissue were calculated using mrfQuantifier (Habegger et al., 2011). Pearson correlations for all enhancer signals were calculated and plotted using R. K-means clustering of H3K27ac count matrix was performed using Cluster (v3.0) (de Hoon et al., 2004). Rows were centred on the mean value of the row and normalised, the k parameter was the total number of tissues, and 100 runs were performed.

The clustering result was then visualized using Java TreeView (Saldanha, 2004). Sub-region specific clusters of enhancers were intersected with peak calls from all other tissues to identify enhancers with likely tissue-specific function. Sub-region-specific enhancers were assigned two target genes using GREAT, ranked by H3K27ac signal, and overlapped with vertebrate conserved sequences (Siepel et al., 2005). These enhancers were then prioritized based on brain expression as measured by in situ hybridisation in multiple mouse brain sections available in the Allen Brain Atlas (Lein et al., 2007).

Cloning of Transgenic Constructs

Figure 3:
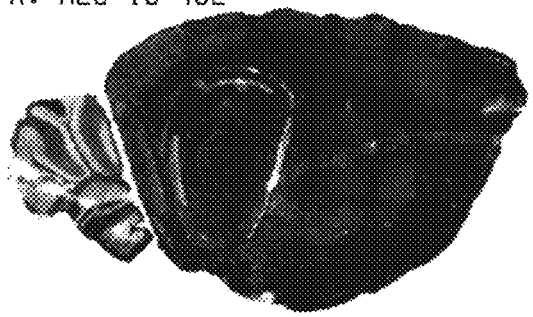
FIG. 3 shows expression of hGFP driven by 8 unique enhancers. The sagittal sections shown are of approximately similar levels of the brain. All mice were crosses of different enhancer lines with hGFP mice. Enhancer lines of all 8 different enhancers used (A. MEC-13-48E, B. MEC-13-53A, C. MEC-13-81B, D. MEC-13-104B, E. MEC-13-79A, F. MEC-13-95H, G. MEC-13-32B, H. MEC-13-123B) show expression in the MEC when the mice were crossed with hGFP mice.
Figure 3:
Figure 3:
Figure 3:
Figure 3:
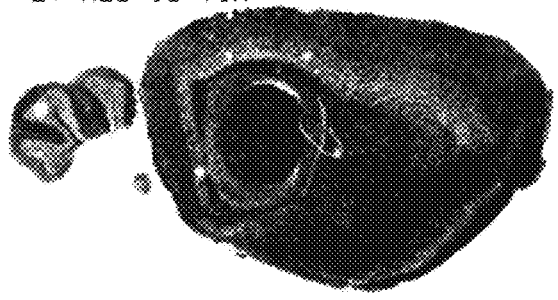
Figure 3:
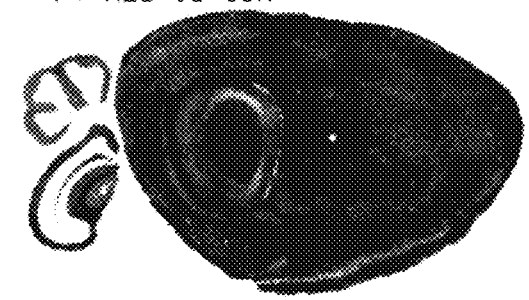
Figure 3:
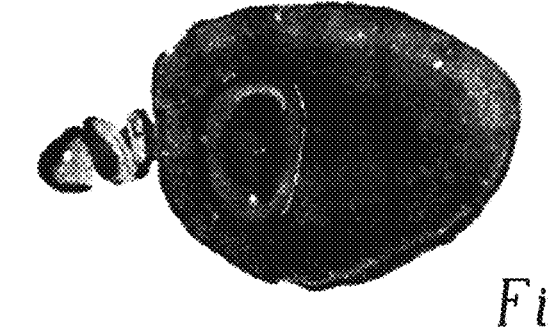
Figure 3:
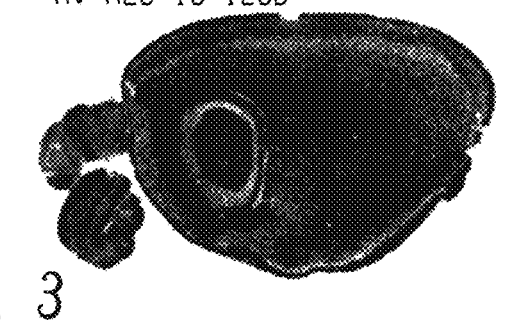

The putative enhancers sequences were cloned from BACs (chori.org) and transferred to pENTRtm/DTOPO® vectors by TOPO® cloning (Invitrogen, K2400-20). The putative enhancers were transferred to injection plasmids by Gateway Cloning® (Invitrogen, 11791-019). The resulting plasmids consist of a putative enhancer followed by a mutated heatshock promoter 68 (HSP68), a tTA gene, a synthetic intron and a WPRE element (FIG. 3).

Pronuclear Injection

The eight injection plasmids were linearised by enzyme digestion to keep the relevant elements but remove the bacterial elements of the plasmids. Linearised vectors were run on a 1% agarose gel and isolated using a Zymoclean™ Gel DNA Recovery Kit (Zymo research, D4001). Fertilised egg cells were injected with 1 µl of DNA at concentrations of 0.5 to 1 ng/µl, leading to surviving pups of which 96 were genotypically positive for MEC and 68 were genotypically positive for LEC.

Mouse Husbandry

All genotypically positive founders were mated with histone GFP mice (Jackson laboratory, Tg(tetOHIST1H2BJ/GFP)47Efu, stock no. 005104). Double positive pups were used for further analysis. Subsequent crosses were done with GCamp6 mice (Weible et al., 2014), TVAG mice (Line TVAG5 from (Weible et al., 2010)), Arch mice (tetO arch, made in-house), tetO-EGFP (Jackson laboratory, C57BL/6JTg(tetO-EGFP/Rpl10a)5aReij/J_JAX) and HM3 mice (Alexander et al., 2009).

Genotyping

Genotyping was done on ear tissue using a Kapa mouse genotyping kit (Kapa Biosystems, Cat #KK7302). Primer pairs for the appropriate gene (Table 3) and internal controls (Table 4) were added to the PCR mixture at a final concentration of 10 µM. The PCR reaction was performed with an initial step of 4 minutes at 95° C., then 20 cycles of 1 minute at 95° C., 30 seconds at 70° C. reduced by 0.5° C. each cycle, and 30 seconds at 72° C. This was followed by 20 cycles of 30 seconds at 95° C., 30 seconds at 60° C., and 30 seconds at 72° C., then a final 7 minute step at 72° C. The products were run on a 1% agarose gel along with positive and negative controls.

TABLE 3

| Gene | Primer 1 | Primer 2 | Product Size (bp) |
|---|---|---|---|
| tTA | GGACAAGTCCAAGGTGATCAAC<br>SEQ ID NO: 1649 | CCTGGTGGTCGAACAGCTCG<br>SEQ ID NO: 1650 | 591 |
| hGFP | TGGGGACGGTGATGCGGTCT<br>SEQ ID NO: 1651 | ACGTGGCGAAGCTCTGCTGC<br>SEQ ID NO: 1652 | ~300 |
| TVAG | GTCCGGTAACGGTTCTTTG<br>SEQ ID NO: 1653 | GCTCTTGTCAGGCACCAG<br>SEQ ID NO: 1654 | 391 |
| Arch | CTTCTCGCTAAGGTGGATCG<br>SEQ ID NO: 1655 | CACCAAGACCAGAGCTGTCA<br>SEQ ID NO: 1656 | 246 |
| GCamp6 | TGGGGACGGTGATGCGGTCT<br>SEQ ID NO: 1657 | ACGTGGCGAAGCTCTGCTGC<br>SEQ ID NO: 1658 | ~300 |
| HM3 | ACCGTCAGATCGCCTGGAGA<br>SEQ ID NO: 1659 | TCATCGGTGGTACCGTCTGGAG<br>SEQ ID NO: 1660 | 200 |

TABLE 4

| Gene | Internal Control Primer 1 | Internal Control Primer 2 | Product Size (bp) |
|---|---|---|---|
| tTA | CTAGGCCACAGAATTGAAAGATCT<br>SEQ ID NO: 1661 | GTAGGTGGAAATTCTAGCATCATCC<br>SEQ ID NO: 1662 | 324 |
| hGFP | CAAATGTTGCTTGTCTGGTG<br>SEQ ID NO: 1663 | GTCAGTCGAGTGCACAGTTT<br>SEQ ID NO: 1664 | 200 |
| TVAG | CGTCTTTAATTGGATTACAATGCT<br>SEQ ID NO: 1671 | CTAGCAAGTGGTTGTGGTCA<br>SEQ ID NO: 1672 | 181 |
| Arch | CTAGGCCACAGAATTGAAAGATCT<br>SEQ ID NO: 1665 | GTAGGTGGAAATTCTAGCATCATCC<br>SEQ ID NO: 1666 | 324 |
| GCamp6 | CAAATGTTGCTTGTCTGGTG<br>SEQ ID NO: 1667 | GTCAGTCGAGTGCACAGTTT<br>SEQ ID NO: 1668 | 200 |
| HM3 | TCCTCAAAGATGCTCATTAG<br>SEQ ID NO: 1669 | GTAACTCACTCATGCAAAGT<br>SEQ ID NO: 1670 | 340 |

Tissue Treatment of Histone GFP-Expressing Mice

The double positive (tTA+/−, hGFP+/−) animals were terminated by IP injection with pentobarbital and brains were removed and dropfixed in paraformaldehyde (4% in 1× phosphate-buffered saline, freshly made). Sections (30 µm) were mounted and scanned.

In Situ Hybridisation

Double positive mice (tTA+/−, reporter gene+/−) were deeply anaesthetised with pentobarbital and transcardially perfused with 0.9% saline first and freshly made 4% formaldehyde (in 1×DPBS, Thermofisher, Cat #14200075) second. Brains were removed and postfixed overnight in 4% paraformaldehyde. Subsequently the brains were dehydrated for at least 24 h with 30% sucrose in 1×PBS. The brains were sectioned sagittally at 30 µm on a cryostat, mounted directly (on Fisherbrand™ Superfrost™ Plus microscope slides (Fisher Scientific Cat #12-550-15)) and dried overnight at room temperature. Slides were stored at −80° C.

Slides were thawed in closed containers. Sections were outlined with a PAP pen (Sigma, cat #Z377821-1EA). The probe was diluted (usually 0.1-1 µg/ml) in hybridisation buffer (1:10 10× salt solution, 50% deionised formamide (sigma, cat #D-4551), 10% dextran sulfate (sigma, cat #D-8906), 1 mg/ml rRNA (sigma, Cat #R5636), 1× Denhardt's (Sigma cat #D-2532). Salt solution (10×) is made with 114 g NaCl, 14.04 g TrisHCl, 1.3 g TrisBase, 7.8 g $NaH_2PO_4.2H_2O$, 7.1 g $Na_2HPO_4$ in $H_2O$ to 1000 ml with a final concentration of 0.5 M EDTA). The probe was denatured for 10 min at 62° C., added to the section and coverslipped (Fisher, cat #12-548-5P). The slides were incubated overnight at 62° C. in a closed box with filter paper wetted in 1×SSC with 50 formamide. Slides were transferred to polypropylene Coplin jars containing 1×SSC with 50% formamide and 0.1% Tween-20 warmed to 62° C. for 10 minutes to allow the coverslips to fall off. The slides were washed 3×30 minutes at 62° C. Then the slides are washed 3×30 minutes in MABT (11.6 g Maleic acid (Sigma, cat #M0375-1 kg), 8.76 g NaCl, 5 ml 20% tween, pH 7.5, dd$H_2O$ to 1000 ml) at room temperature.

The slides were drained (but not dried), re-circled with a PAP pen, and blocking solution (600 µl MABT, 200 µl sheep serum, 200 µl 10% blocking reagent (Roche cat #11 096 176 001) was added. Slides were then incubated in a Perspex box with wetted filter paper at room temperature for 2-3 hours. The slides were drained and 1:5,000 sheep anti-digoxigenin-AP antibody in blocking solution was added. The slides were incubated overnight.

4 g of polyvinyl alcohol was dissolved in 40 ml AP (alkaline phosphatase) staining buffer (100 mM NaCl, 50 mM $MgCl_2$, 100 mM Tris pH 9.5, 0.1% Tween-20) by heating, and the solution then cooled to 37° C. The slides were washed in MABT 5 times for 4 minutes, then washed 2×10 minutes in AP staining buffer. Nitroblue tetrazolium chloride (Roche, cat #11 383 213 001) was added at 3.5 µl/ml, 5-Bromo-4-chloro-3-indolyl-phosphate,4-toluidene salt (Roche. cat #11 383 221 001) at 2.6 µl/ml) and Levamisole (Vector. cat #SP-5000) at 80 µl/ml) to the cool polyvinyl alcohol solution.

The solution was then shaken well and transferred to a Coplin jar. The slides were added and incubated at 37° C. for 3 to 5 hours. The reaction was stopped by washing in 2×PBS with 0.1% Tween-20. The slides were then washed 2× in ddH$_2$O, dehydrated quickly through graded ethanol of 50%, 70%, 95% and finally 100%. The slides were finally cleared in xylene and coverslipped.

Immunohistochemistry

Double positive mice (tTA+/−, TVAG+/−) were deeply anaesthetised with pentobarbital and transcardially perfused with approximately 30 ml 0.9% saline first and approximately 30 ml freshly made 4% paraformaldehyde (in 1×DPBS, Thermofisher, Cat #14200075) second. Brains were removed and postfixed for 24 hours in 4% paraformaldehyde. Subsequently the brains were dehydrated with 30% sucrose in 1×PBS. The brains were sectioned horizontally at 50 µm and kept in TCS (tissue collection solution, 25% glycerol, 35% ethyl glycol, 50% 1×DPBS) at −20° C.

Immunohistochemistry was performed by initially washing the brain sections twice for 10 minutes in 1×DPBS and subsequently permeabilising them by a 60 minute wash in 1% Triton X-100 (Sigma, Cat #T9284) in 1×DPBS. The tissue was then incubated in primary antibody in 1×DPBS with 1 trition X-100 and 5% donkey serum (Sigma, Cat #D9663) for 48 hours at 4° C. Primary antibodies and dilutions were: Rabbit-anti-2A (1:2000, Millipore, cat #ABS31), Mouse-anti-reelin (1:1000, Millipore, cat #Mab5364), Mouse-anti-GAD67 (1:1000, Millipore, cat #Mab5406), Mouse-anti-calbindin (1:10,000, Swant, cat #CB300), Mouse-anti-calretinin (1:1000, Millipore, cat #Mab1568).

After incubation with primary antibodies, sections were washed 4× in 1×DPBS (10 minutes per wash) and 2× in 1×DPBS with 1% Triton X-100. Then sections were incubated for 6 h at room temperature in secondary antibody (all secondary antibodies were raised in Donkey and diluted 1:250). The secondary antibodies were: anti-Rabbit-AF488 (Jackson ImmunoResearch, Cat #711-545-152) and anti-Mouse-Cytm3 (Jackson ImmunoResearch, Cat #715-165-151). The sections were DAPI stained by a single 10 minute wash in 1×DPBS with 0.2 µg/ml DAPI (Thermofisher, D1306) and finally washed 5× (10 minutes per wash) in 1×DPBS. Sections were mounted on Superfrost® plus glass slides (VWR, Cat #631-9483) and coverslipped with Poly Vinyl Alcohol with 2.5% DABCO (Sigma, Cat #D27802).

Imaging

From mice in the lines MEC-13-53A×TVAG and MEC-13-104B×TVAG, MECs were imaged in sections from three different dorsal-ventral levels with a Zeiss Meta 880 confocal microscope. For each section, three to seven slices in the Z direction with 1.5 µm spacing were taken, with a 20× objective and tiling to cover the entire MEC. Two channels were imaged, one for AF488 with maximum excitation wavelength at 488 nm and maximum emission wavelength at 528 nm and one for Cy3 with maximum excitation wavelength at 561 nm and maximum emission wavelength at 595 nm.

For display images, sections were imaged on Zeiss Axio Scan.Z1 scanners in three preset channels: DAPI, d1488 and d1549.

Image Processing

From the Zeiss proprietary file format .lsm, .tiff files were exported. These were processed in Adobe Photoshop, all alterations in levels were made on the entire images. In some cases images were processed to remove visual artefacts.

Counting

Counts were made on the confocal images of single positive cells' expression of transgenes or native genes (GAD67, Reelin, Calbindin, calretinin), and of cells expressing both. Graphs were made in Microsoft Excel, statistical analysis was done in SPSS.

Results

Figure 1A:
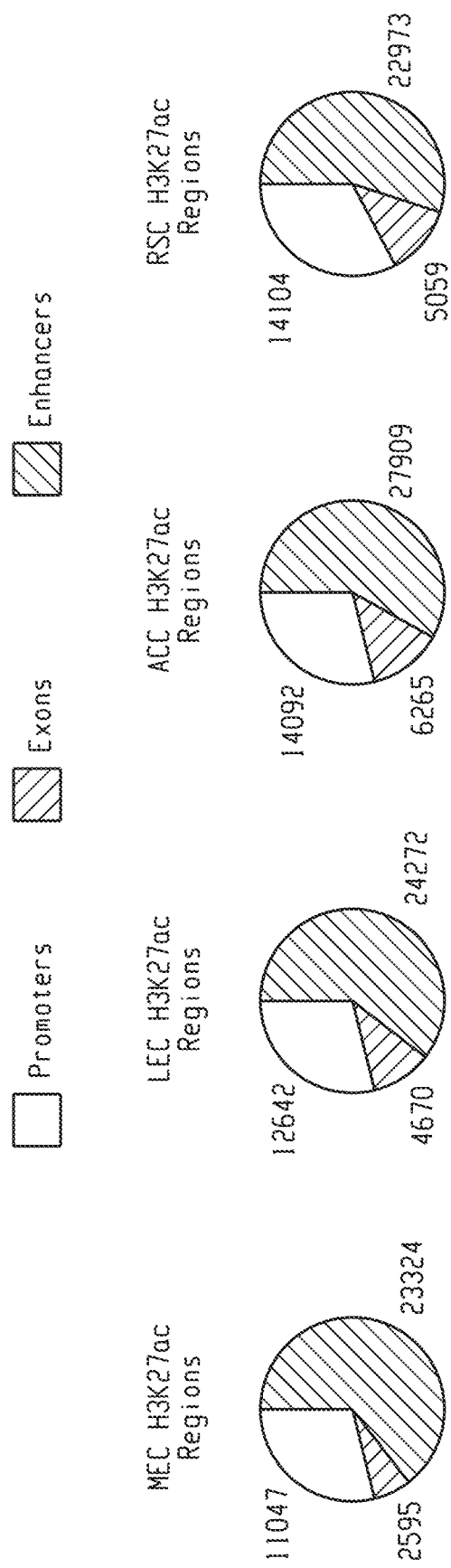
FIG. 1A-C collectively show the results of ChIP-seq analysis of brain region-specific enhancers, revealing a striking diversity of unique and novel enhancers in different cortical sub-regions.

Enhancer ChIP-Seq of Cortical Sub-Regions Reveals a Striking Diversity of Unique Enhancers The following brain regions from two adult (P56) male C57BL6J mice were microdissected: the medial entorhinal cortex (MEC), the lateral entorhinal cortex (LEC), the retrosplenial cortex (RSC), and the anterior cingulate cortex (ACC). Each mouse was processed separately and the samples were used as biological replicates for further analysis. ChIP-seq was performed on homogenised tissue against the active-enhancer-associated histone modifications H3K27ac and H3K4me2 in samples of each of the four brain regions. The regions enriched for H3K27ac reproducibly identified similar numbers of active promoters and distal cis-regulatory sequences between two replicates of each brain sub-region (FIG. 1A). Nearly 90% of all active promoters were identified in at least two samples with the remainder being active in only one sub-region (17032 total, 2045 unique).

When more distal sites were analysed (>5 kb from a transcriptional start site) the inventors identified a total of 59372 reproducibly active enhancers in at least one sub-region. Of these, 31% were only identified in a single cortical sub-region (18185 unique relative to other sub-regions). Surprisingly the number of sub-region specific enhancers in the cortex was similar to the number of total enhancers active in any single tissue thus far interrogated (Roadmap Epigenomics et al., 2015; Shen et al., 2012). Furthermore 81% (48077) of enhancers identified in these sub-regions were not identified in bulk cortex tissue from mouse, demonstrating the potentially vast repertoire of enhancers active in the brain.

Interestingly, when comparing the total number of reproducible peak calls in these 4 cortical sub-regions (59372) to the number identified in bulk cortex treated in the same way (13472), the number of putative active enhancers one obtains from the four cortical sub-regions is far greater than what one obtains from the entire cortex, even though these four cortical regions compose only a small minority of the entire cortex. Of course, this is comparing 4 pooled samples to a single sample, but each of the individual samples gives numbers similar to bulk cortex (FIG. 1). Without being held to theory, it is believe that the most likely explanation for this superficially puzzling result is a reduction in signal to noise ratio when pooling heterogeneous sets of tissues for ChIP-seq. This would tend to favour those enhancers that are expressed throughout many cortical sub-regions at the expense of more specifically expressed enhancers. In support of this, 89% of cortical enhancers were found in one or more cortical sub-regions, and 78% were found in at least 2 cortical sub-regions. In comparison, fully 31% of the enhancers found by the inventors in the analysed sub-regions were specific to a single sub-region.

Figure 1B:
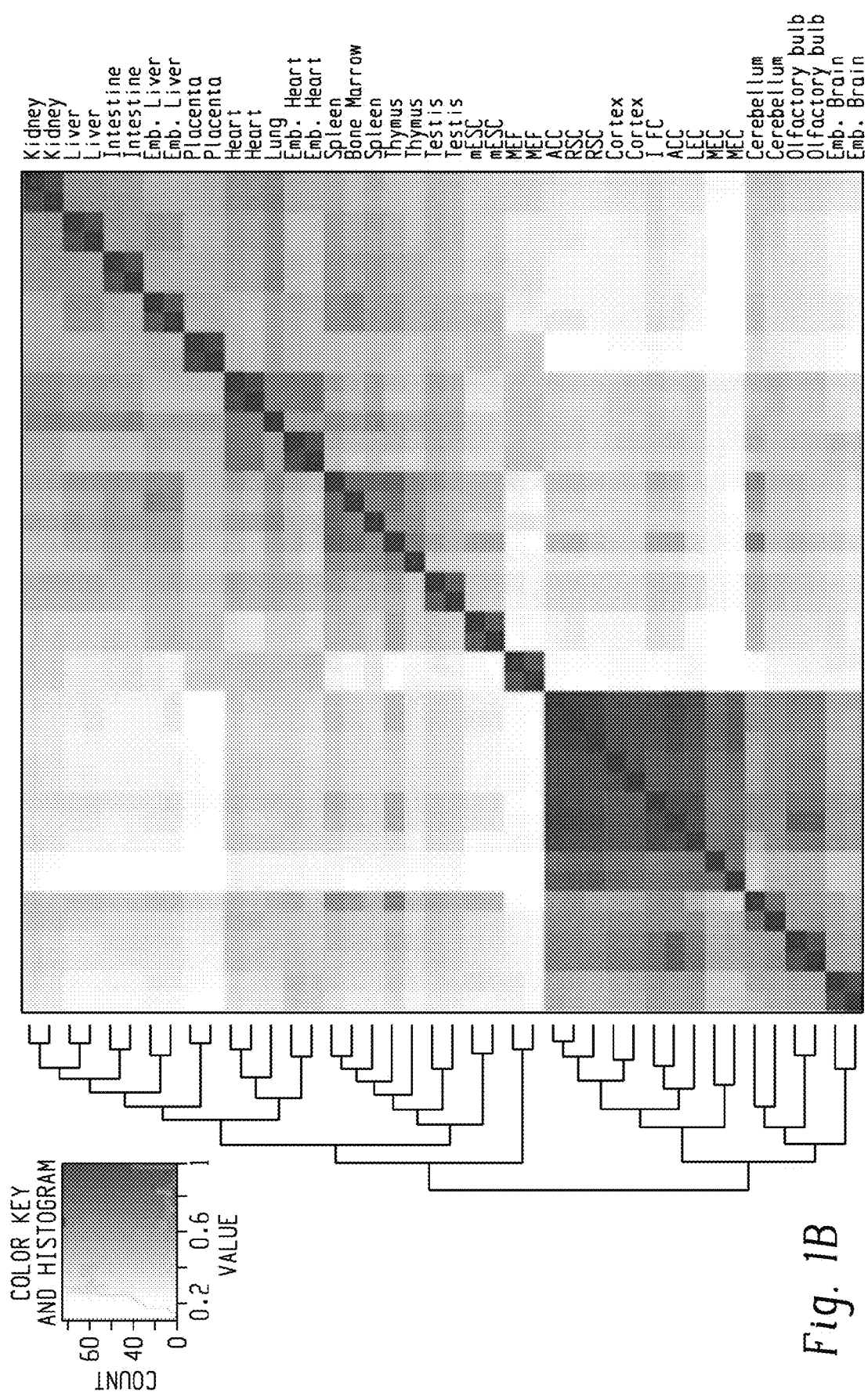

While many of the enhancers identified by peak calls alone are specific to this small number of cortical sub-regions, the goal of the study was to identify very specific regulatory sequences with limited activity within other regions of the brain as well as the rest of the body. To ensure the identification of such sequences and exclude regions with weak activity elsewhere, the inventors expanded their comparisons to include a variety of mouse adult tissues and cultured cell types (Shen et al., 2012). The inventors first identified active putative enhancers in additional mouse samples and merged them to create a unified set of enhancers for consistent comparisons across all samples. The inventors then extracted normalised H3K27ac counts at 108299 discrete regions from the sub-regions profiled in this study as well as those from 17 mouse ENCODE samples (Shen et al., 2012). Hierarchical clustering of samples revealed two main groups of mouse tissues: neuronal and non-neuronal (FIG. 1B). Amongst non-neuronal tissues, the strongest correlations were observed amongst developmental stages of the heart and tissues that make up the immune system: bone marrow, thymus, and spleen. In neuronal tissues the four cortical sub-regions profiled here were well correlated across all enhancers assayed but clustered distinctly from cerebellum, olfactory bulb, and embryonic brain. This analysis revealed that while the samples of this study are distinct from most tissues of the mouse there could be sharing in enhancer activation amongst other larger brain regions such as the cerebellum.

Figure 1C:
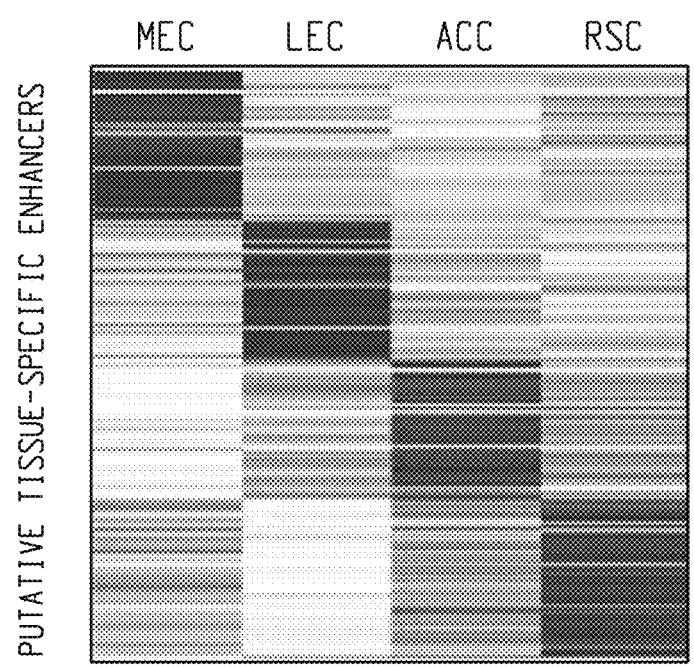

The inventors then utilized k-means clustering to identify enhancers that were significantly more active in each cortical region (FIG. 1C). Those enhancers that were identified as most specifically active in a given sub-region were then further filtered based on those that were never identified by peak calling in any other mouse tissue. This stringent analysis yielded 156 to 1824 completely novel putative distal enhancers for each cortical sub-region (FIG. 1C). We then assigned these novel enhancers to putative target genes based upon the GREAT algorithm (McLean et al., 2010). Gene ontology analysis suggested that these novel enhancers are enriched near genes associated with a variety of neuronal functions.

Region-Specific Enhancers Drive Transgene Expression in the Targeted Cortical Sub-Regions To test the specificity of these novel enhancers the inventors prioritised them based on H3K27ac signal, conservation across 30 species and expression of two flanking genes based on visual inspection of in situ hybridisation in mouse brain sections (Lein et al., 2007). Based on these filtering steps, 8 enhancers deemed specific to the MEC were selected.

Figure 2:
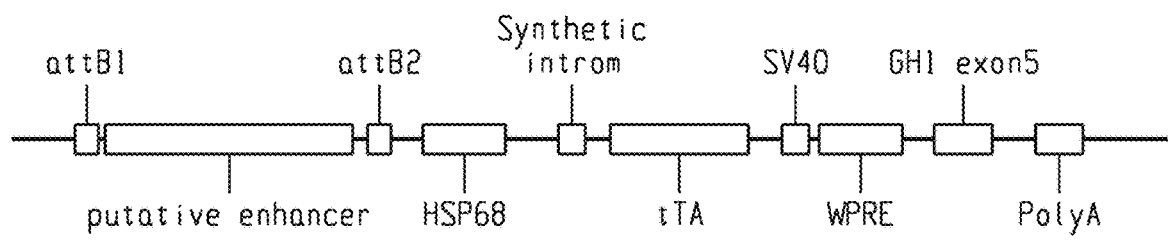
FIG. 2 shows a schematic diagram of the injection construct. The putative enhancer was cloned into the injection construct by Gateway® cloning. The synthetic intron, SV40 intron, WPRE (Woodchuck Hepatitis Virus (WHP) Posttranscriptional Regulatory Element) and growth hormone 1 exon 5 are present for optimal mRNA stability and expression of the tetracycline TransActivator (tTA). The construct is linearized with appropriate restriction enzymes depending on the sequence of the putative enhancer.

Putative enhancer regions were cloned into injection constructs upstream of a mutated HSP68 minimal promoter and the tetracycline transactivator (tTA) gene (FIG. 2), gel purified and injected into the pronucleus of mouse oocytes. Founders were crossed to tTA-dependent histone-bound GFP (hGFP) reporter mice (Jackson laboratory, Tg(tetO154 HIST1H2BJ/GFP)47Efu) for visualisation of expression patterns. The inventors obtained 96 genotypically positive founders from these 8 constructs, 23 of which did not transmit the transgene to the first generation and were discarded. Of the remaining 73, 33 showed no GFP signal in the brain and were also discarded. 36 of the 40 lines that did show expression in the brain expressed signal in the MEC, including at least one from each of the 8 enhancer constructs (FIG. 3).

Figure 4:
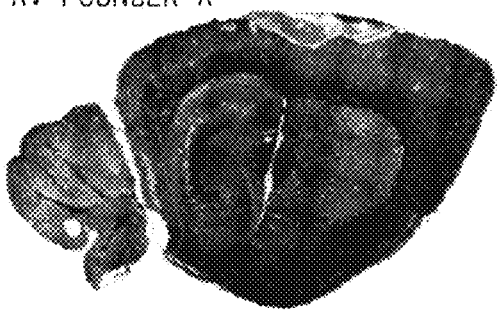
FIG. 4 in panels A-G shows enhancer-driven expression of hGFP in various genomic insertions. The sagittal sections shown are of approximately similar levels of the brain. All mice were crosses of different Odz3-based founders crossed with hGFP mice. Expression in MEC layer II was found in all lines except for founder D.
Figure 4:
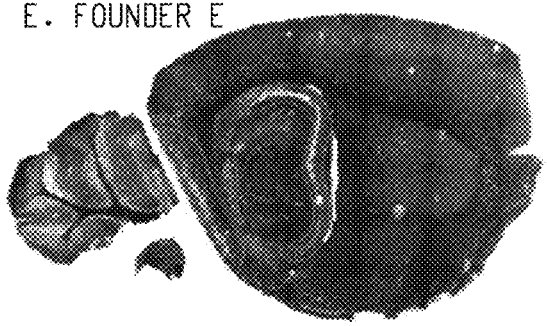
Figure 4:
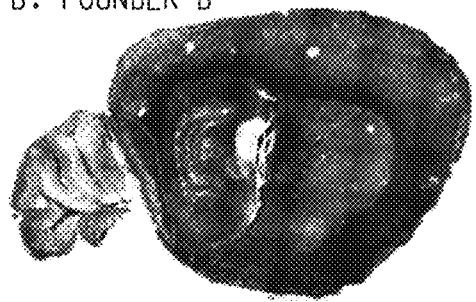
Figure 4:
Figure 4:
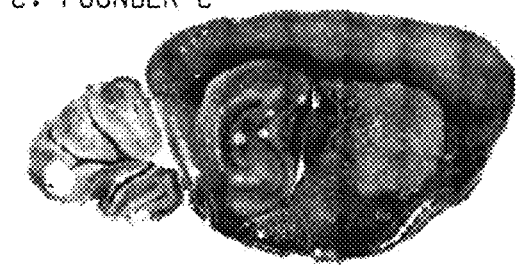
Figure 4:
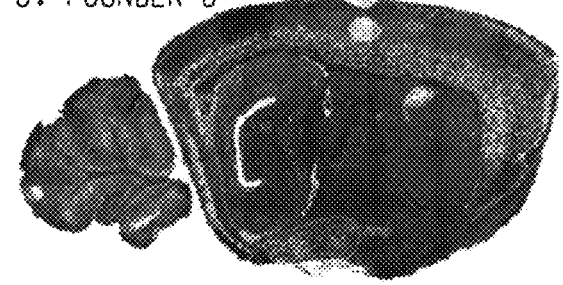
Figure 4:
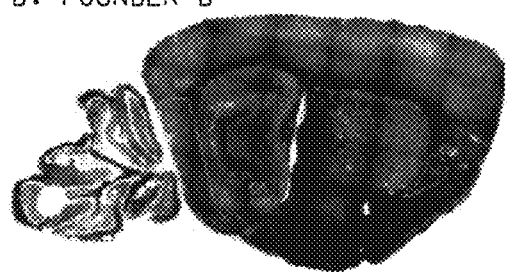

Transgenesis with pronuclear injections inserts the injection construct pseudo-randomly into the genome via non-homologous recombination, leading to what are called insertional effects. There are two basic forms of insertional effects: variable expression and penetrance of transgene expression that is specific to the promoter construct presumably due to the local chromatin environment, and expression that bears no resemblance to that of the promoter construct but is presumably based upon random insertion near local cis-acting regulatory elements which dominate over the promoter construct, i.e. positional effects. FIG. 4 demonstrates that both kinds of insertional effects were seen when multiple founders from the same injection construct were obtained.

Of the 7 lines obtained from enhancer MEC-13-53 (SEQ ID NO: 2), 6 showed GFP expression in Layer II of the entorhinal cortex (EC), one exclusively so. Additionally, some lines showed GFP expression in other brain regions including CA fields in the hippocampus, piriform cortex and scattered expression elsewhere. Line G showed expression in Layer II as well as in deep layers of the LEC and MEC, but also strong expression in the dentate gyrus and deep neocortical layers, whereas line D did not express in the EC but showed strong expression in Purkinje cells, ventral CA2 and the claustrum, which we did not see in other lines made with this construct. Since each founder line has a unique insertional site, the inventors interpret lines A, B, C, E and F as a core pattern of activation with subtle variations resulting from the local chromatin environment, line D as expression dominated by positional effects and line G as a combination of the two. The lines resulting from other enhancer constructs with multiple founders similarly showed core patterns of activation with subtle variations.

By utilizing functional genomics techniques on precisely dissected regions of the brain and quantitative comparisons to many other tissues, robust, reproducible regulatory constructs can be identified that are not strongly affected by position of integration in the genome.

Due to its long half-life (Commerford et al., 1982), any cells labelled with histone GFP during development will likely continue to express the marker well into adult life. Since these enhancers were isolated from adult brain, the inventors crossed some of the more promising founders to other tetO payload lines and performed in situ hybridization (ISH) to determine steady-state transgene expression in adult brain.

Figure 5A:
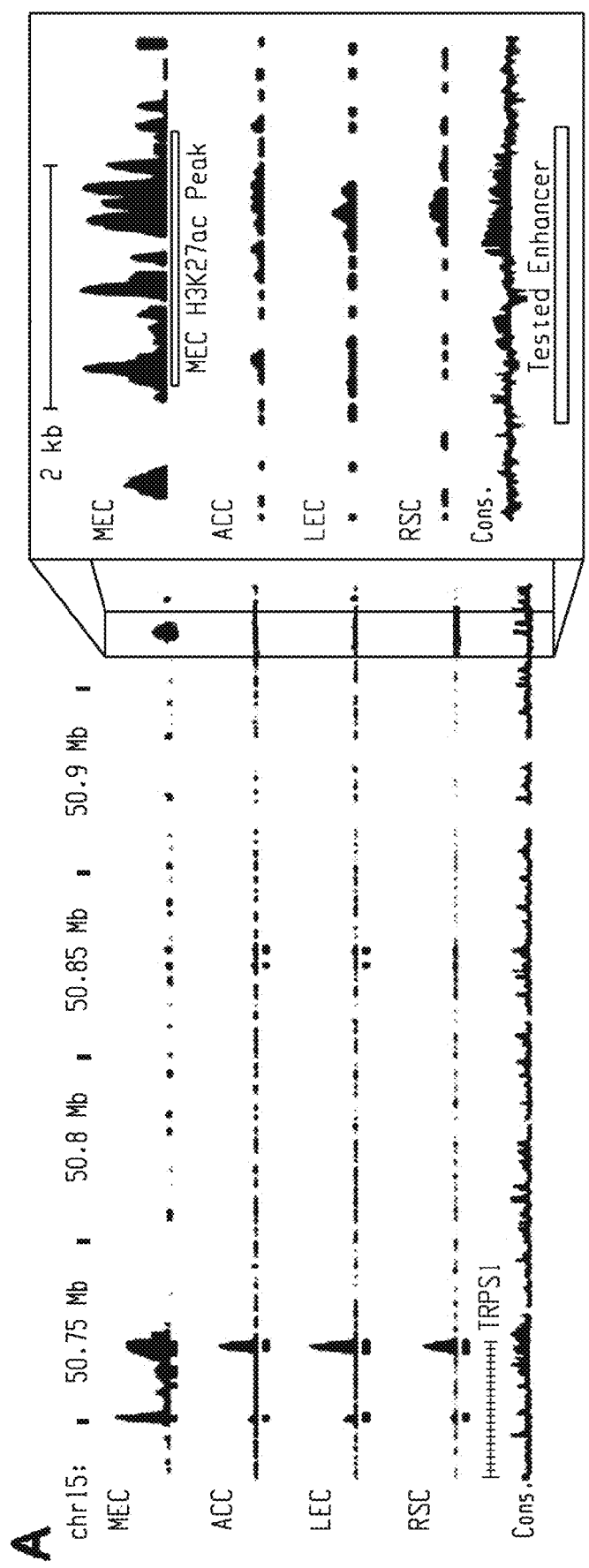

The inventors found that adult expression patterns were in fact significantly more specific than the hGFP crosses, with several of the above MEC-13-53 lines shown in FIG. 4 becoming entorhinal-specific. More importantly, as illustrated in FIG. 5, transgene expression becomes far more specific than the expression pattern of the presumed native gene. FIG. 5A shows an example of the results of bioinformatic analysis of one of the eight MEC enhancers (the putative enhancer was annotated MEC-13-104, its sequence is set forth in SEQ ID NO: 5; the resulting line was named MEC-13-104B) which GREAT associated with the genes Trps1 and Eif3h. Note that the promoter region is a strong peak in all four cortical sub-regions, consistent with expression of the mRNA to varying degrees throughout the cortex (FIG. 5B), but the enhancer peak (FIG. 5A, top right) is greatly enriched in the MEC. However, when mated to an HM3 tetO payload line (Alexander et al., 2009), the expression is almost entirely confined to the MEC (FIG. 5D). This was true for 6 out of the 8 MEC-specific enhancer constructs injected (and may also have been true for the lines terminated based purely upon histone GFP signal.

Figure 6:
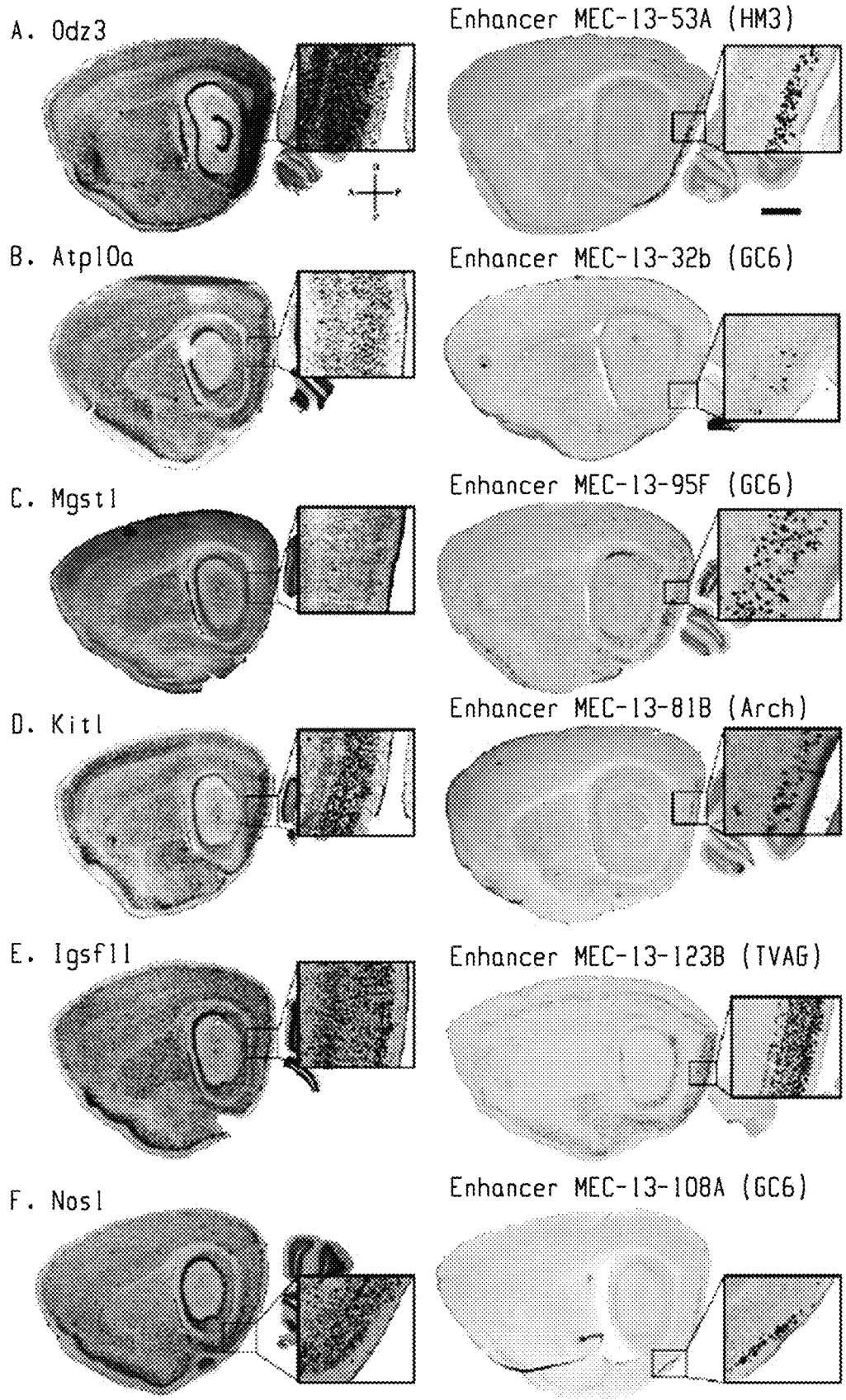
FIG. 6 shows that MEC-specific enhancers drive transgene expression in distinct sets of cells in the MEC. Left-hand column (panels A-F): ISH showing expression patterns of native genes associated with EC-specific enhancers. Right-hand column (panels A-F): ISH showing EC-specific expression of transgenes driven by the corresponding EC-specific enhancers, payload transgene in parentheses. ISH for the native genes from brain-map.org. Scalebar in A is 1000 µm.

FIG. 6 compares the expression patterns of representative transgenic driver lines made with other injection constructs containing either MEC-specific enhancers (FIG. 6A to 6E, right-hand column) or LEC-specific enhancers (FIG. 6F, right-hand panel) compared to the expression pattern of the presumed associated native gene (FIG. 6, left-hand column). Note that while the associated gene is broadly expressed in the brain, the transgenic lines all express more or less specifically in the brain region the enhancers were isolated from. These data show that in essence, one obtains region-specific expression from elements of a non-specific promoter by taking a single region-specific enhancer from it and using it to drive a heterologous core promoter. This in effect solves the problem that most genes are expressed non-specifically in the brain: using EDGE one can obtain specific expression from non-specific promoters.

Region-Specific or Cell-Specific Expression?

The above results show that one can get sub-region specific expression from sub-region specific enhancers. Whether such enhancers drive expression in specific cell types in the targeted brain region is a more difficult question to answer, in large part because there is no consensus as to the number of cell types in the brain or even how to classify them. However, there are indications that these enhancers do specify particular cell types. First of all, the different EC enhancers drive expression in different layers of the EC (FIG. 6), and neurons in different cortical layers are almost by definition different cell types (Cajal, 1899). Since three of the enhancers drive expression in Layer II and three drive expression in Layer III this raises the question of whether the individual enhancers driving layer-specific expression specify the same cell types.

Since there are relatively few neurochemical markers for Layer III of the EC, we investigated the expression of immuno-histochemical markers in two of the three Layer II expressing lines derived from MEC-specific enhancers (FIGS. 7 and 8). Neither of the two enhancers appear to drive expression in inhibitory neurons (For MEC-13-53A, 0/738 transgene expressing cells were GAD+, FIG. 7L, for MEC-13-104B, 0/1579 transgene expressing cells were GAD+, FIG. 8L). Excitatory neurons in EC Layer II are typically further sub-divided into reelin-positive stellate cells and calbindin-positive pyramidal cells (Witter et al., 2017). Line MEC-13-53A expressed exclusively in reelin+ neurons 222 (1162/1162 were reelin+, while only 2/1151 were calbindin+), while line MEC-13-104B appears to roughly correspond to the relative densities of the two cell types (976/1717 were reelin+, while 482/1855 were calbindin+). Thus it appears that MEC-13-53 is a stellate cell specific enhancer, whereas MEC-13-104 is active in all excitatory cells of Layer II, so enhancers can be layer specific and contained to a subset of cells labelled with neurochemical markers within the layer. Neither line expresses in 100% of marked neurons, which could either be due to insertional effects or further sub-divisions of neuronal cell type within groups defined by these neurochemical markers.

There is evidence for a larger degree of functional differentiation within MEC Layer II where both stellate and intermediate stellate cells express Reelin but there is currently no genetic marker that differentiates the two (Fuchs et al., 2016), so the latter possibility is plausible if the morphology and physiology of the two different types of Reelin-expressing cell types are in fact a valid sub-division of neuronal cell types that have corresponding genetic identities.

REFERENCES

Alexander, G. M. et al. (2009), Neuron 63: 27-39
Azevedo, F. A. et al. (2009), Journal of Comparative Neurology 513: 532-541
Betz, W. (1874), Anatomischer Nachweis zweier Gehirncentra. Centralblatt für die medizinischen Wissenschaften: 578-580, 595-599
Boccara, C. N. et al. (2015), Hippocampus 25: 838-857
Bonnavion, P. et al. (2016), Journal of Physiology 594: 6443-6462
Boyden, E. S. et al. (2005), Nature Neuroscience 8: 1263-1268
Brand, A. H. and Perrimon, N. (1993), Development 118: 401-415
Briggs, F. and Callaway, E. M. (2001), Journal of Neuroscience 21: 3600-3608
Brodman, K. (1909), Localisation in the Cerebral Cortex: The Principles of Comparative Localisation in the Cerebral Cortex Based on Cytoarchitectonics (Leipzig: Verlag von Johann Ambrosius Barth)
Cajal, S. R. y. (1899), Comparative study of the sensory areas of the human cortex (Clark University)
Capecchi, M. R. (1989), Science 244: 1288-1292
Chen, X. et al. (2008), Cell 133: 1106-1117
Commerford, S. L. et al. (1982), Proceedings of the National Academy of Sciences of the United States of America 79: 1163-1165
Core, L. J. et al. (2014), Nature Genetics 46: 1311-1320
Cotney, J. et al. (2013), Cell 154: 185-196
Cotney, J. L. and Noonan, J. P. (2015), Cold Spring Harbor Protocols 2015: 419
de Hoon, M. J. et al. (2004), Bioinformatics 20: 1453-1454
DeFelipe, J. et al. (2013), Nature Reviews Neuroscience 14: 202-216
Dimidschstein, J. et al. (2016), Nature Neuroscience 19: 1743-1749
Douglas, R. J. and Martin, K. A. (2007), Current Biology 17: R496-500
The ENCODE Project Consortium (2012), Nature 489: 57-74
Feng, G. et al. (2000), Neuron 28: 41-51
Fogarty, M. et al. (2007), Journal of Neuroscience 27: 10935-10946
Fuchs, E. C. et al. (2016), Neuron 89: 194-208
Habegger, L. et al. (2011), Bioinformatics 27: 281-283
Harris, K. D. and Shepherd, G. M. (2015), Nature Neuroscience 18: 170-181
Heintz, N. (2001), Nature Reviews Neuroscience 2: 861-870
Heintzman, N. D. et al. (2007), Nature Genetics 39: 311-318
Hnisz, D. et al. (2013), Cell 155: 934-947
Huang, Z. J. (2014), Neuron 83: 1284-1302
Hubel, D. H. and Wiesel, T. N. (1962), Journal of Physiology 160: 106-154
Jones, B. F. and Witter, M. P. (2007), Hippocampus 17: 957-976
Kim, T. K. et al. (2010), Nature 465: 182-187
Langmead, B. and Salzberg, S. L. (2012), Nature Methods 9: 357-359
Lein, E. S. et al. (2007), Nature 445: 168-176
Luo, L. et al. (2008), Neuron 57: 634-660
Madisen, L. et al. (2015), Neuron 85: 942-958
Magnus, C. J. et al. (2011), Science 333: 1292-1296
Malik, A. N. et al. (2014), Nature Neuroscience 17: 1330-1339
Maniatis, T. et al. (1987), Science 236: 1237-1245
Mank, M. et al. (2008), Nature Methods 5: 805-811
Mayford, M. et al. (1996), Science 274: 1678-1683
McLean, C. Y. et al. (2010), Nature Biotechnology 28: 495-501

Merkle, F. T. and Alvarez-Buylla, A. (2006), *Current Opinion in Cell Biology* 18: 704-709

Mikkelsen, T. S. et al. (2010), *Cell* 143: 156-169

Nord, A. S. et al. (2013), *Cell* 155: 1521-1531

O'Reilly, K. C. et al. (2015), *Brain Structure and Function* 220: 2873-2893

Parker, S. C. et al. (2013), *Proceedings of the National Academy of Sciences of the United States of America* 110: 17921-17926

Pattabiraman, K. et al. (2014), *Neuron* 82: 989-1003

Paul, A. et al. (2017), *Cell* 171: 522-539

Pinto, L. and Dan, Y. (2015), *Neuron* 87: 437-450

Prabhakar, S. et al. (2008), *Science* 321: 1346-1350.

Quinlan, A. R. and Hall, I. M. (2010), *Bioinformatics* 26: 841-842

Reilly, S. K. et al. (2015), *Science* 347: 1155-1159

Roadmap Epigenomics Consortium (2015), *Nature* 518: 317-330.

Saldanha, A. J. (2004), *Bioinformatics* 20: 3246-3248

Sanyal, A. et al. (2012), *Nature* 489: 109-113

Shen, Y. et al. (2012), *Nature* 488: 116-120

Shima, Y. et al. (2016), *Elife* 5: e13503

Siepel, A. et al. (2005), *Genome Research* 15: 1034-1050

Silberberg, S. N. et al. (2016), *Neuron* 92: 59-74

Soriano, P. (1999), *Nature Genetics* 21: 70-71

Sugar, J. and Witter, M. P. (2016), *Elife* 5: e13925

Taniguchi, H. (2014), *Frontiers in Cellular Neuroscience* 8: 8

Tasic, B. et al. (2016), *Nature Neuroscience* 19: 335-346

Vermunt, M. W. et al. (2014), *Cell Reports* 9: 767-779

Visel, A. et al. (2009), *Nature* 457: 854-858

Visel, A. et al. (2013), *Cell* 152: 895-908 von Bartheld, C. S. et al. (2016), *Journal of Comparative Neurology* 524: 3865-3895 von Economo, C. and Koskinas, G. N. (1925), Cytoarchitectonics of the Adult Human Cerebral Cortex Weible, A. P. et al. (2010), *Journal of Neuroscience* 30: 16509-16513

Weible, A. P. et al. (2014), *Current Biology* 24: 1447-1455

Wickersham, I. R. et al. (2007), *Neuron* 53: 639-647

Witter, M. P. (2011), The hippocampus. In The Mouse Nervous System, G. Paxinos, L. Puilles, and C. Watson, eds. (Academic Press), pp 112-139

Witter, M. P. et al. (2017), *Frontiers in Systems Neuroscience* 11: 46

Zeisel, A. et al. (2015), *Science* 347: 1138-1142

Zeng, H. and Sanes, J. R. (2017), *Nature Reviews Neuroscience* 18: 530-546

Example 2: Viral Delivery of a Gene Under Control of a Murine EC-Specific Enhancer Methods Construct and rAAV (Recombinant AAV) Preparation EDGE-rAAV constructs were synthesised in plasmid pAAV-CMV-β-globin-intron-MCS-WPRE (modified from pAAV-CMV, Agilent, by insertion of the WPRE (SEQ ID NO: 1631) at the MCS). Control constructs were generated as follows: a non-specific rAAV construct, without a region-specific enhancer (non-specific CMV-GFP), was generated by cloning and inserting the eGFP gene into the MCS of the pAAV-CMV plasmid upstream of the WPRE, and removing the β-globin intron; a second, no-promoter control construct, corresponding to the non-specific CMV-GFP construct but lacking a minimal promoter, was generated by inserting the eGFP gene into the MCS of the pAAV-CMV plasmid upstream of the WPRE and removing the CMV promoter and β-globin intron.

To generate experimental constructs, the CMV promoter, β-globin intron, MCS and polyA sequences were removed from pAAV-CMV-β-globin-intron-MCS-WPRE (the WPRE sequence was not removed). A hybrid promoter (consisting of the enhancer and minimal core promoter), transgene (eGFP) and polyA sequence were then cloned into the plasmid in reverse orientation, to circumvent any promoter activity from the 5'ITR. The reverse-orientation hybrid promoter was cloned into the plasmid upstream of the WPRE, which was thus located between the promoter and AAV 3'ITR, forming an insulator from any promoter activity from the AAV 3'ITR. Constructs were generated using the following minimal core promoters: the TRE3G (SEQ ID NO: 1642), FGF4 (SEQ ID NO: 1639), HSV-TK (SEQ ID NO: 1643) and HSP68 (SEQ ID NO: 1630) minimal promoters; and the following murine enhancers: MEC-13-53 (SEQ ID NO: 2), MEC-13-104 (SEQ ID NO: 5) and LEC-13-8 (SEQ ID NO: 9). The LEC-13-8 enhancer sequence was synthesised by Genscript, USA. The TRE3G minimal promoter (mTRE3G) is the minimal promoter from the TRE3G promoter (Clontech), and corresponds to a mutated form of the CMV minimal promoter (mCMV). mTRE3G may alternatively be referred to as mCMV*.

The minimal promoter sequence and transgene were first cloned into the plasmid. Each minimal promoter sequence (in reverse orientation) was cloned into the plasmid such that it was flanked by the MCS at the 3' end, into which enhancer sequences could be cloned, and the eGFP-sequence with stop signal at the 5' end. Enhancer sequences were PCR amplified using primers with flanking restriction enzyme sites for EcoR1 and Sal1 and cloned into the MCS.

Plasmids were maintained in the Stbl3 *E. coli* strain (ThermoFisher) to avoid ITR-mediated recombination. Positive clones were confirmed by restriction digestion analyses and subsequently by DNA sequencing. Endotoxin-free plasmid maxipreps (Qiagen) were made for rAAV preparations.

The above-described cloning procedures yielded experimental vectors such as that shown in FIG. 9. The WPRE has the sequence set forth in SEQ ID NO: 1631; the promoter shown in the figure is the TRE3G minimal promoter (SEQ ID NO: 1642). The enhancer and promoter control the expression of the enhanced GFP gene (eGFP). The construct is in reverse orientation in the pAAV plasmid. An additional control pAAV plasmid was also synthesized, which lacked any enhancer but was otherwise identical to an experimental plasmid. This "no-enhancer" control contained the TRE3G promoter.

The synthesised plasmids were incorporated into AAV serotype 2/1 using standard methods. Specifically, a pAAV plasmid synthesized as described above (either the experimental plasmid containing the enhancer or a control plasmid), along with AAV plasmids encoding the structural elements of the AAV, were transfected into the AAV-293 cell line (Agilent), a HEK293T-derived cell line optimised for packaging of AAV virions. The day before transfection, $7\times10^6$ AAV-293 cells were seeded into 150 mm cell culture plates in DMEM containing 10% fetal bovine serum (ThermoFisher) and penicillin/streptomycin. Calcium chloride-mediated co-transfection was performed using 22.5 μg pAAV-containing the transgene, 22.5 μg pHelper and 5.6 μg each of pRC (Agilent) and pXR1 (NGVB, USA) capsid plasmids. After 7 hours, the medium was replaced with fresh 10% FBS-containing DMEM. The AAV-293 cells were cultured for two or three days following transfection to allow AAV synthesis to occur, whereafter the cells were lysed. The AAVs were isolated by standard procedures culminating in heparin column purification.

Specifically, the AAV-293 cells were scraped from the cell culture plates, then isolated by centrifugation at 200×g. The cell pellet was then subjected to lysis using 150 mM NaCl-20 mM Tris pH 8 buffer containing 10% sodium deoxycholate. The lysate was treated with Benzonase nuclease HC (Millipore) for 45 minutes at 37° C. Benzonase-treated lysate was centrifuged at 3000×g for 15 mins and the clear supernatant then subjected to HiTrap® Heparin High Performance (GE) affinity column chromatography using a peristaltic pump (McClure C *JOVE* 2011). The elute from the Heparin column was concentrated using Amicon® Ultra centrifugal filters (Millipore). The titre of the resultant viral stock was determined as approximately $10^8$ infectious particles/ml.

Rodent Details

Experiments were carried out using C57BL/6J mice obtained from Jackson laboratory and Long Evans rats. All mice and rats were housed in enriched environment cages according to the Norwegian Food Safety Authority approved protocol in a 12 hr light/dark cycle with food and water ad libitum.

Stereotaxic Injections and Perfusions

For rat experiments, the rAAVs were stereotactically injected into three-to-four month old Long-Evans rats. Injections were performed with rAAV at a titre of $\sim 1\times10^8$ infectious particles/ml, into the MEC of the rats. The rats were deeply anaesthetised with isoflurane gas (induction with 5% isoflurane (v/v), maintenance at 1% isoflurane (v/v), airflow of 1200 ml/min). To maintain the body temperature of the animal, a heating pad at 37° C. was used.

Rats were injected subcutaneously with buprenorphine hydrochloride (Temgesic®, Indivior) and Metacam® (Boehringer Ingelheim Vetmedica) at the prescribed dosage. Local anaesthetic Bupivacaine hydrochloride (Marcain™, AstraZeneca) was applied at the place of incision. The head was fixed to the stereotaxic frame with ear bars, and the skin at the incision site was disinfected with 70% ethanol and iodide before the incision was made using a sterile surgical scalpel blade. After incision, the mouthpiece and ear bars were adjusted so that bregma and lambda were aligned horizontally. Mediolateral coordinates were measured from the mid-sagittal sinus, anterior-posterior coordinates were measured from posterior transverse sinus, and dorso-ventral coordinates were measured from the surface of the brain. A craniotomy was made around the approximate coordinate, and precise measurements were made with the glass capillary used for virus injection. Coordinates for rat injections were 4.6 mm lateral, 0.2 mm anterior to the posterior transverse sinus and 2.6 mm deep, with the glass capillary lowered at 10° pointing towards the nose. 1000 or 1500 nl virus injections were conducted at a speed of 100 nl/min using a glass capillary and a nanoliter injector (Nanoliter2010, World Precision Instruments, Sarasota, Fla., USA), controlled by a microsyringe pump controller (Micro4 pump, World Precision Instruments). After completion of the injection, the capillary was retracted after a 10 minute delay, to give the virus time to diffuse. Finally, the wound was rinsed with saline and the skin was sutured. The animals were left to recover in a heating chamber, before being returned to their home cage, where their health was checked daily.

For mouse experiments, 10-15 week-old adult C57BL/6J mice were anaesthetised with isoflurane (induction with 5% isoflurane (v/v), maintenance with 1% isoflurane (v/v), airflow of 1200 ml/min). After applying the local analgesic Marcain™ (Astra Zeneca, 40 µl, 0.25 mg/ml, SC), the global analgesic buprenorphine (Temgesic®, 0.03 mg/ml, 100-150 µl per mouse dependent on bodyweight, SC), and meloxicam (Metacam®, 2.5 mg/ml, 100-150 µl per mouse dependent on bodyweight, SC) the head was fixed in a stereotaxic frame. Subsequently the skull was exposed by a single incision of the scalp, craniotomies were made approximately 5 mm posterior and 3.3 mm lateral of the bregma. Then, the virus solution was injected at a location 0.3-0.5 mm anterior to the transverse sinus and at a depth of 1.8-2.0 mm from the brain surface. Unless otherwise stated, all injections were bilateral injections of 400 nl rAAV injected at a rate of 50 nl/min. Mice were given a second post-operative injection of Metacam® the next day, and their weight was monitored until stable.

After 4 weeks, the rodents were sacrificed. Rodents were anaesthetised with pentobarbital and perfused transcardially with 0.9% saline followed by 4% paraformaldehyde in 0.9% saline, and their brains removed and sectioned as described in Example 1 with respect to mice. Brain sections were then immunostained as described below. In situ hybridisation experiments were performed as described in Example 1.

Immunostaining

Horizontal rat brain sections of 50 µm were prepared using a sliding microtome. Brain sections were stored at −20° C. in 0.1 M phosphate buffer containing 25% glycerin and 30% ethylene glycol. Multiple labelling of free-floating sections was carried out as briefly described. Every sixth section in the series was selected for immunostaining and washed in phosphate-buffered saline (PBS). Sections were permeabilised and blocked for 1 hour at room temperature using PBS containing 0.1% Triton X-100 and 3% normal donkey serum, or, when staining for reelin and calbindin 0.5% Triton X-100 and 5% goat serum and when staining for NeuN 0.3% Triton X-100 and 3% BSA (PBS++). Sections were subsequently incubated with primary antibodies in PBS++ at 4° C. for two days with mild shaking. PBS-washed sections were incubated for 2 hours at room temperature with secondary antibodies diluted in PBS++ (or PBS containing Triton X-100 without serum/BSA).

Solution containing 2.5% 1,4-diazabicylo[2.2.2]octane/ polyvinyl alcohol (DABCO/PVA) was used to mount the sections in Polysine slides (Menzel-Glaser, Thermo Scientific). Antibodies used were rabbit anti-GFP (ThermoFisher/ Life technologies A11122, 1:500), mouse anti-Reelin (Merck Millipore MAB5364, 1:1000), mouse anti-Calbindin (Swant D-28 K, CB300, 1:5000), mouse anti-NeuN (Merck Millipore MAB377, 1:1000) and rabbit anti-2A peptide (Merck Millipore ABS31, 1:2000). All corresponding secondary antibodies were from ThermoFisher/Life technologies or Jackson ImmunoResearch laboratories, 1:400.

Confocal Imaging and Analysis

Sections were imaged using a confocal microscope (Zeiss LSM 880, Zen 2012 software) with either Plan-Apochromat 40×/1.4 Oil DIC M27 oil immersion or Plan-Apochromat 20×/0.8 air immersion objectives. The quantification of GFP+, reelin+ or calbindin+ cells was carried out manually using Zen 2012 software. Approximately ten 50 µm thick horizontal sections were selected evenly from the dorso-ventral axis per brain. Imaging and analyses were conducted by the same person to control inter-analyst variation. Scale bar=100 µm.

Results
Generation of a Cell Type-Specific Viral Vector

The inventors' goal was to obtain cell type-specific expression, rather than cell type-specific infection. There are a number of published accounts claiming distinct tropism for different serotypes of AAV (Watakabe, A. et al., 2015; Aschauer, D. F. et al., 2013). The inventors therefore restricted their analysis to a single serotype, AAV2/1, which has a mosaic capsid of serotypes 1 and 2 (Hauck et al., 2003) and is commonly used to infect rodent neurons, and a single enhancer that gave highly specific transgene expression (MEC-13-53). FIG. 11A shows the expression pattern obtained in a murine transgenic cross in which TVAG transgene expression using MEC-13-53 is demonstrated. Expression in this line was limited to reelin-positive (Reln+), calbindin-negative (CB−) excitatory projection neurons in layer II of the medial and lateral EC (i.e. stellate and fan cells, respectively (Kitamura, T. et al., 2014; Varga, C. et al., 2010; Witter, M. P. et al., 2017)).

The inventors realised that in order to obtain results with similar degrees of specificity with viral vectors, it was first necessary to find a minimal viral construct which by itself did not significantly express in infected neurons. Because viral ITRs themselves have transcriptional activity (Flotte, T. R. et al., 1993; Haberman, R. P. et al., 2000), the inventors reversed the orientation of the GFP reporter transgene and minimised the effect of the 3' ITR by using the WPRE as an insulator (Zufferey, R., et al., 1999), such that the sense strand would exclusively be under the control of the exogenous promoter (as shown in FIG. 9). The reverse-orientated design substantially reduced the background expression in other layers (FIG. 11C-E). The inventors screened four different minimal promoters that have been used for transcriptional assays including HSP68, the same heterologous minimal promoter used successfully for transgenesis (see Example 1). The results can be seen in FIG. 12C-F, suggesting that EDGE-based anatomical specificity is attainable using different minimal promoters. Due to the size limitation of rAAVs, the TRE3G minimal promoter (Loew, R. et al., 2010) was selected for subsequent experiments as it was the smallest minimal promoter that yielded layer specific EDGE and had low background expression.

MEC13-53 EDGE rAAVs Express Specifically in Layer II Stellate Cells in Wildtype Mice The layer specificity of the MEC-13-53 EDGE virus was further confirmed by NeuN counterstaining (FIG. 13A), which drove the inventors to investigate the principal type of cells targeted by the MEC-13-53 enhancer. Two principal types of neurons, Reln+ and CB+ cells, are observed in MEC layer II using cell type-specific immunomarkers. In rodents, Reln+ cells in MEC layer II form the sole excitatory projection to the dentate gyrus, while calbindin+ neurons do not (or only sparsely) project to the hippocampal formation. Intriguingly, MEC13-53 EDGE was observed exclusively in Reln+ and not in the clusters of CB+ cells in the MEC (FIG. 13C-D). MEC injections of control virus without enhancer (rAAV TRE3G-GFP) resulted in non-layer specific GFP expression surrounding the injection site (FIG. 13B).

Enhancer-Guided Layer-Specific Transgene Expression Works Across Species

To investigate whether mouse EDGE rAAVs retain their layer/cell specificity in a second species, the MEC-13-53 rAAV we stereotaxically introduced into the MEC of wild-type Long Evans rats. Surprisingly, MEC-13-53 EDGE was even more specific for MEC layer II in rats: in the brains of rats injected with the MEC-13-53 rAAV, strong and highly localised GFP expression was seen in the MEC (FIG. 10A). In addition, injections of control viruses in rats produced even lower levels of basal GFP expression than in mice (FIG. 10B). Similar to EDGE rAAV in mice, MEC-13-53-EDGE expression was detected almost exclusively in Reln+ cells and CB− cells (FIG. 10C-D). Of the 1803 GFP+ cells, 100% of them were Reln+ while a mere 1.83±0.68% were CB+ (29 out of 1589). Layer II-specific GFP expression was evident in multiple sections in the dorso-ventral axis of the MEC (FIG. 14).

Other EDGE rAAVs Recapitulate the Expression Pattern of the Corresponding Transgenic Crosses To examine whether the EDGE rAAVs could recapitulate the EDGE pattern seen in transgenic crosses, a comparative transgene expression analysis were carried out on multiple enhancer EDGEs. EDGE from the transgenic crosses was determined by ISH using the respective transgene probes, and enhancer driven GFP expression from the corresponding EDGE viruses was analysed by immunostaining. MEC-13-104 and LEC-13-8 showed characteristic transgene expression patterns in transgenic mice (FIGS. 15A&C) that were recapitulated by the corresponding EDGE rAAVs (FIGS. 5B&D)

REFERENCES

Aschauer, D. F. et al. (2013), *PLoS One* 8: e76310
Flotte, T. R. et al. (1993), *Journal of Biological Chemistry* 268: 3781-3790
Haberman, R. P. et al. (2000), *Journal of Virology* 74: 8732-8739
Kitamura, T. et al. (2014), *Science* 343: 896-901
Loew, R. et al. (2010), *BMC Biotechnology* 10: 81
Varga, C. et al. (2010) *Nature Neuroscience* 13: 822-824
Watakabe, A. et al. (2015), *Neuroscience Research* 93: 144-157
Witter, M. P. et al. (2017), *Frontiers in Systems Neuroscience* 11: 46
Zufferey, R. et al. (1999), *Journal of Virology* 73: 2886-2892

The use of the terms "a" and "an" and "the" and similar referents (especially in the context of the following claims) are to be construed to cover both the singular and the plural, unless otherwise indicated herein or clearly contradicted by context. The terms first, second etc. as used herein are not meant to denote any particular ordering, but simply for convenience to denote a plurality of, for example, layers. The terms "comprising", "having", "including", and "containing" are to be construed as open-ended terms (i.e., meaning "including, but not limited to") unless otherwise noted. Recitation of ranges of values are merely intended to serve as a shorthand method of referring individually to each separate value falling within the range, unless otherwise indicated herein, and each separate value is incorporated into the specification as if it were individually recited herein. The endpoints of all ranges are included within the range and independently combinable. All methods described herein can be performed in a suitable order unless otherwise indicated herein or otherwise clearly contradicted by context. The use of any and all examples, or exemplary language (e.g., "such as"), is intended merely to better illustrate the invention and does not pose a limitation on the scope of the invention unless otherwise claimed. No language in the specification should be construed as indicating any non-claimed element as essential to the practice of the invention as used herein.

While the invention has been described with reference to an exemplary embodiment, it will be understood by those skilled in the art that various changes may be made and

SEQUENCE LISTING (1673 sequences)

SEQ ID NO: 1 - DNA, 2382 bp, Mus musculus
agttgagccttgaacatatgagtgatgatgttgaacttatcccttgggataacttagaggactggacatccttttctctatacgagagttttctgttttgtttttgatatgggtccatgttgtgttgcctaggtcaacttgaatgttttgactgcctgagcagtgttaaggttctgagaggttaagtaacttgtagctactgcagagtggtctgagcctcaaacaggtttctcacattcctatgcttgcggtttttagactttttgtaagaaccactggcactttttttttttttctaaagtatcacatcttcaatgtgttaggcttagcagatttgggaataggcccaggaatgagtatgaaatagcaaagatgtgatgcttatgtgatggcccacatttgcgtaaggcccggtgcttgctctggagaggcgctcattggctagtcaccagacatgatgacgtggatgggaagggctatggaatttcctgaatcctgtgcaccagaagcctcagcaagccagtgtggaatcttcatacaaagccctcagtgtctccaactctaggcaaccgtgtgtctgtcctctgcacacgtcaaggtggggctctaacaagtctctgcatctgggaatgtgtatttcccacttctatccagcctgccattccagtagcctccttttcaaaaatactttagctttaggaaatagtttattttctgttggcagagtgtggcccatttgtcatttgccgccccattctgtggatgagaaaacagaggcagagaactgacattgtaaacccacatctactgaagttcaggtttccagttggttcctgagcatttagtacagccttcaaagaggcctatgatattccccatactccctgcctctaagttaatttcttagtttcccttggaagttttccttctcctccagggaaggaactgggtagtttgtgggcttgagagagatggtatgtgtatgtggagccttacctcaggtatcttacctccatctttgacctttcatcattccaatgcagaagtcccctccccccctcctttatcacttccgtactgtgggaagagctgtaggcttatgccccacttctcttccttgttatgggaagacaggtcaaattcttccattctgtgaagtttgggattgatattatcgggccctttgtgtgaaaggaggaggaagctgagttccatccagggctgctgttagggccctgagcgaggccctaggctgggctcttaatcctgagaagcagagtgattactaggaaacacctcttagagaagaagataggtaaggatctggagttgccatgtaaggaccagagagggatgtgaccagagatgtgcagaggctgtgggtgctgcagatcagtgatggtggaaatggagtagcacatgggccagggcatagggagaccaagaatgaattataaggcatatggagtgaagacggatatgaaccttgactcatgggtcaccgaattcagtgggctcaggaagagacctcggttaggtcactctgactagtaccttggtaagcacaggaagccacaggctactgtaaaatgtggaagtctgtcttctcttgtgcctattccaggtgccatgtttcagttacagtgcaaatgaggtatttattcaatcagatctgttctctctctctttctttctctctctctctccatccctctctctctctctctttctctctccctctctctcactctctctttctctctctctctctctctctctctctctctctctctctctctctctctctctctgtgtatgtgtctcactctctctctgtgtttgagatgtgtaatcttagtctggtgcccaggcttgctctgacttctgggctcaagtaacccatctgcctcagtcattgagtagctgggacgatgggtgagagccaatactttgagctcaaagcataaaagcccttacccaggtccttgtccttgaaggtgaattaatgacatgtcactcttcatatggcattttgtatttctgctgcccagtcacagggctcttgagctccttgcgccgaggatcctctatagtgcttgccaggagtgcagcttcctaggctatgccttttaagcagtcactgtctatgttctgaacacgttttatcctctactggattgcagactctatttagggagatcccctgagccacacttaatgggcttgagaaatatctgtctctgggacaggggttgagagagcgggatagcccacattagcgtatgttctggtaggagtccagggcaagagtcccagcaatgtatagctgatagcaatctacagatgaagtgtccaacagggattatgtgggtaccaattacc

SEQ ID NO: 2 - DNA, 2181 bp, Mus musculus
acctataaatatacatagaaagcaatgtcctaaaacctgtgcaaatataataattacacataattttttcaggtcttataactgaaaaacggctggtatcagagaaaaaggatataatgggcagactcactagcaatggtaagagatctagccacttgaagacaattcaaggcaaatttcctaaaagttgagtaattttcaagctgatacttggtgtgacattggaagtcacctgttgtacatctccccatggcccactgagtttacagatatgacagctgtcctcattgtgtaaatcacacaacacatctatgaaacttttgtagatgctgaaagagccctataaactgtttaactgattaattccatgtcaggcatctgagtctagtaggcccttttgtttttaattctatgtacctcacccagctctaactgagaggtttaatagcatgagcaaaaattcaggcttgtctttaatactgaatatcattaagatgacatcaaaattgaatgcaagaactatcattaagcaaacggtgttctgcaaaagacatgataagtcaagcgtctgtaagatgctctgaaagacacaagtgtggacccacgtccgtttggccctgtgtatcatcatccctctttatgcttctctatctaccttcatgatgatgcctctctaattaagaatctacaccatgactttgcacaaccgagtcactgaagcacaactcggcagaaagatgaagttaggctcacatttaacacaagagaaatatttacttcaatcctctgccatcctctcacggatttgtcactgattagatgagatgggatgccacaaacgtttttgcagcttttaagagggaaaaaggcatcctttcgataaatgtcttcgtgttgtgctaccagatgtctttctgcagcctctcatgctttctgattttatttttgtaagtgtgagaacagggaaaatgccagccattgtagtcagtcagcctgagccccagcaagcgctgcatcgtgcgatgtactcttactgggttttacataagcactgaacttggagtacacttagcccctagggataccatcagccactgctcacaccaaaacctgtgtttggtcaggtccatcttgcaggtagctcacttcaaaaagtctttttagtttcaaaacatatcatcacccaccaaacagattgggctaaggttctaaacactctctgctttctcctctttttctttctgatgttccaagtcttaaagacatttgatattaatgattataatagataactaggcatgagaataacagctgggtgtttttaggggcggcaggaatttggtaagaagctaatttcaaagcttatcataagactactcacactattagttccacgctgtggtcatttttgctaaatattttgtggttccggtggaatgccaaaaggaattttctgacaacctcaaaatggtgccaaaatctactctagatgacaagaccacttaaggttaataaagatcttctagactgtgcacttgtggctctgaggtgctaagttcctcacgacagaagcacaggggtcccccccccccacacacaaaggcttcctcttatgctcatccctgagttttgtcctcagtatctaagccccaaagagtagcttgagatcgtttcccatctgcctcttttgttccctaaggaaaatatcaaacacaccaacagaaatagtttcaaaagagccatttgactaaccttagaaaatgaccaccccaaatcagtagccttaaccaatgggaccatgtagaaaacacagtcagtgaagacacacatgcttcagaaattgcttttatatctatacctgcccagtccccagagaaagcccaacagaggagtaagtgttcattctagatgtcccgtgtctgttgcacacctgaaagtgtgtaattggagggagccagagaagtttagaagcatagctcaagactgtagggatcctagggaaagttgtttcctgagtagcataaatgagacacaggtttatccgattccggactaaagaatacgcattcaggagagcactcaagataactcatagatcagtaagaatacaatagacaagagaccaagaagcatacgctggctgtcacaggcagccaccaatcaaggctgttcatcagtaca

SEQ ID NO: 3 - DNA, 1930 bp, Mus musculus
aaacagtgtcatgaacttcaaaatttctgtgacatgaacttcaaaatttctgatggggccatgagtgttgcttacattgatacatttgaacagaatacaacagaacatatcaacaacccctaaaggctcagatgaaacaacgcatctataagcattcaaagaaaatatatgcaaccccatatgctaataacttaaggtgccttgggcaagtagattcagaattatcagccttaaagattcacaagaatttaaacccaagaccctactgtgctcacaagtaagtaattattcctccctcccctttgccttttgcttcatataagaccgtgagaggcaggaggcacctaataataggaattataggctctcttcattcaccctacctccaccttcagatgcgtgtgagacttaaggctttggttggcagttaaatacaagaacaatttttgttactcttgacagtacaacatgcttttttgagcttatgggggaaaaaaggtttttcttggaaatcttagctatagcaaatggtgaacaaattaaactgtgggtgggggccagtgaagaagaccatagaaacagaaactcctgtgtgcagctctcaacaactttaaatagctaaattcccaacagttattttatttaatccttggtttctggggatttttttttatttaaataacttacattgtttcttgagacagtttaaggccagctaagtgtataatgtgtcactttgctcccaatgttgtcattgaaatgtctgggggcattcctagcattgaaaggagaattctgtcagcagcgtcaggtagaagcatttccaagttctatagagaacagacaaagccaggatgtttcctgtgccaattagcagttttgctgagcaagaaggaagtgtgtctaaagatgtctgaataagaacccagcaagctcgggatttaaatgagaacagcgcagcaagcatccttgggcttttggcacccatgcggactacagtaaagagttcccaagaaggtcatccaatcccactgaatcctggggattatgtgggagggaagtagccttatggcttatttgcttcagcacatgtccacgggaggacatttgccagtgcccggcaccatgcagcttataaatattttccagtgattttatgaatacagcttttcaaacgccagacaattggtgcgaaagaatacgtttcagtgaaacctatgaattgtctgacaattcaatgaagctgcgagtgtgtacttggaagtaacagatgtgctcacgatctgtatttggtttatgttctggggacaagtttttgttttttagctgaggaatatttacctgatgatttgcctgtaacagtggctccatttagggatctgagtctcctcccaggcttttagtgaaagttaagcttcgagaaaatagactgcattatagtatagtcgccatttcagaggttaaactgttacatttattttactataatcctcagttcttataggtccctattcattctgaaatataataatgttttgctttagttttttattttcaatctgttatcttcctatgtgcaagttcattttgctttctccctttttaattcttaaactcacctgcaggtttagttttcctcttctatgaaagaggcttaacatatctcttcagattacagttaacaatacatatgtgcatgcatataaatatatacatatatacatacatatacatacatacatacatacatacatattatgactgatgaacaaatagaaaacatcaacaaattggtaagcactcagtaagtcaagcaatgtagagtaacaagcatattgaaatgaactagcaattcttgagaagggggagaaatgctagagacaaatagacaactaaaaaaaatcacaggtttagaagtatgttccctgta

SEQ ID NO: 4 - DNA, 1224 bp, Mus musculus
aatggaaacggctaagataagagcctattgctgaaaagttaacttcaggttgtattcagatcattcagagaccaaaaacaactcaagggcttatgtttttgttagggtaagaaagtgtagtatggtacagtgctcatcgctctgatatgttaaacttaccaaagtaaaggtatgcagaaaatgtcgtcccaggtcctcctctttgttgctaactaaagtatatattatatactggaagcatcatctcatagaccatagttttgaattacacagacataattgccaaagagacatgagatgtatattatttatactattttcttttgttatttctcgaaggcaaatacaatgcttagtaccattttgtctcagttcttttactggagagttattctgaagttccctaagaaagtattcttgatggcactccattagagcatggctcgtgaatcaagcatctgtaagtgtctgtgaaaaatgttctgggctggataggaaactgtatggtgaccaagtacccaggatcaaacagaatacaaatgtgtaaaaagtgttagactctcagttcctctagagagccatcatgtagattgaactaagtaccctttaagaacagtgtcgaattttaaaattctatgatactgtattctagttaactgtagctgaattattcagggaagaattgatttgaaaaacttgagtttaagttctcagactggatttgtaatgatcctgtagtagcctagggagatgagagacaatatgatgttcacttgacaccgtagggtgtgtgtgtgtgtgtgtgtgtgtgtgtgtgtgtgtgtgtgtgtgtgaatttgagaatccattaaaataagattgaaaagaatcatcaaaataaagcaccgaaaacaattcttagtaggattagatgagtgtttagggaccactacaaaaattaacaaaagcaatgagagtcaaaacacttctgaggaaggatttgacatcatttcttcttagtatttttctcaaaactgagacgaaatgaatcagcacaacattgaaccaagtattatgaaagagaaatttcagccaaactttgtgtcaaaaattatagtgaattatgctcaaagtatatatgtttctatatacttacacaatgttactgcaagtatttatggtgctttctgagtagtctttaaactttttattcacaaaatgtagtttctaaagcactggcttttc

SEQ ID NO: 5 - DNA, 2460 bp, Mus musculus
aacaactttggggatatttaaatgcaaaatagctccaaattattaaaaatgtcttcacagttttgccgacatgcatttagccatgaggtacagagaatgaaatcagtgatgcttttcttgatccagaatacattttcattttgtctttcatgcactctagccagatgagtgggcagctattttgaaggttgacaatctgctccaagtcttggaaaacaggcaagtcccccaagaaagaacgaagagatttgcgatcttaattcagagtagggagaacacatgagttttagtaataaaccaacacttgagagagagaaaaaaaacccctagcattgctgtttattgatgttgtaatattggggaggttgttgagtgtgccttcgtctctccacttttagtatgggttcatggacatttcccagagttgtgctgtgatcggtgagcacattaaatacttagctttgtacctgacacatttcctgacccccaacacttgtatttcccatgtcctgtgccctcttctccactgctcatgcttgtttttttactatactgactcctttttctatcctgaaacaaagagatgactgaccgaccaccctgacttcggatgactatgggaaactgtggtaccacaaacacaccttgttggggggcagcatgagttagctattcatcactattggacaaataggaacaccctgggtattactaaatagaagaactgttaggggaaatgctccatcaatcccagataccccaccacaaagccttgtgccatcactggaatctgttgacctacttacgaaatctctaattctattcctgatagcctataattaggatgatctgaaatagcccgaaaacattccgtgccagcatttatccccaaaggcaagtcgagaaaccttcaataaggccttttctgaaatttgcttttgagtcaacagatttggcaatattttaacttgtaggcagacagaaaggagaaaggaaagaaaagagacaactagacagaagtcagaacgggagatgagaaaaggggaaggaaggaaagaagatagaggaacgggagggagagctaaatgatctcacttttgtacatttcatcaaaatgtagagcaagctcttgcccaaatttattagcagttatctcagatatgtgaagaaaggttgagagagtcactccaaataaaacaatcccaataaataaataaaccaaacaaatctttatgtcaacacagcttctgcttttgcgtttggctgtagtatgagaaaaaaaaatcactttgaaaaaagcaagcatgaatagaactgtatttcaaccccaaatgtccccctaccctctcccccccgcccctgacaaatagagcttcagaaacgcaacacctatcaaatatttcctcagaaatgccagattgctgggattttaaagagttctacttttttttcttccctttttgacatttagacagattgagtttgagagaggaagtgactcggagtccagcctgccccgcaccactgtcagaggaaataaccgaagcaaaatgaagtgataatatactgtagaatatttaacagaaagagtgaagcaggggcttggggggtggggagtggatggcaatctgagaatatacaactgatccccaaaatagatgcagtctcctgtgcccgagcagatgccaactacagaggatcgtgaaacggtagaattaccttgctctgtgggctgtgtgttgacatatgaacaccgactccccaatagtcagaggagctggctcttttccctccagtctctgttaggctttgtcacagagcctgccaacttttccctttctgtatattcgtcagtgaaagagctggtaagtgaccaccgtaatggctgcagcatgttgctgtgtgggtcttgacagaaaactacaaccctgggcccttctgtcacagcgtgaatgaaatcagaaagtccaagggaggatattagcaaggctctttccattctggagaagactcaaggcgataagggacattgagatttcccacccaaggaaagagtcataaatagggcgatgaaggaaaaacacaacccccttctgcgagtttaatgagaaaacggccacctcctggggaatggggtagaaagctgaggtgctgtcttaacagcctgcaaaagttgaaacattgacaaaacaagctttcttcatctgctgaaaacagggaactgttttaaagaaccccccacctcttattcacaaaggagtagagactgacacttggagaaggccgattttttccttttctctatgtgaatagttgaaaactttctcttttctttcctggaaaatttctcctccatctatgtgctgaccttcctgatgtatgactgactctcttttacccaccaagtctggggcaatcaccaaaacagaggctcggggacagtttcgtcctagccctccc

SEQ ID NO: 6 - DNA, 2665 bp, Mus musculus
ctatatggagggcatactcacaatctcctaaagtttaggaacttctcaatgtctaaagaattgaaaaatatacatggaacacatgaggtgatgctttctcattgggaactgttgattttaactgactttcttcacttctactggacccttgttgcagagaaagctatttagatggaacctgattccggcagggatggaagaatagacatagggccaagaagtcacctttgtttcacataaactctttgtggcaatatcctctgtagataaatatccttttaaaatggctcttttactcacccatgtacttacactcatttcttccctgacccacaaagtccaacactgatttatttagcagcttttcagactctgtatgtaaccctgatatagatatgcgacttgattcacaacacaatgtccttgagtttcactttaaaatcccactaaagctccatctacattgtattgattaacttactccccatttaaattatttactgtagaaaagattagttaatctgagcactaacctgaattctctatgaaggaaccattgcagatttttttttccatttggtaatccttatttagactggaaaattaaaaataaaacagcattaataaagctaagtcatttcttattaatgcatgcaggtttatatgcaatttaaaagatctgatggtagattaactttggggatttgcttgaatctttaaggtgctctttattattaaatggagtttctcttgcttatctaaggatgggcttcagtttgctttcaaatctgaaaatatgaaaggatcataaacgtacattgagtcagtgctaccaaattccaccagagctagtcttaagagtactttaggaagatgtatattgatttttcagaacacaaagatcttccctgagcagctcttcccggctccattattggcaggacagtttctacggaaggattctctgacatattatttctgcactgacatacttacagatggttccactgtagctgaactgctgaggtctctctcagcttaatcaagaatgcttattttacacttttaaaagcatatcaaatgtgaagcaataataattaagcctcttatttttatgaagccttcagagatctgtgaaaaaaggcaacatgtagtactttgtaaatgtcaaatctctttacagaaatgcgaaggaggtatttcaggctgtcatctgttcttcatgctgcctactgaccctcattgggagctaccgattctagaagattctgtgcccactgaaataaatagctcactcaggcacaaagcaagatgttggacaacatacaggacagcagcacccactttaattctaccatgcagtgtgtttcataaagaaatgggaactagaagcttagacattaaagaacagttgcagttggcaggcaaggaaggtgaatgcctttagttccactgtgacaaatgacaagatttggaacaaggaagctgtgtttcaggcatgtaaaaacagaaaaaggataatactttttttttttttttactatcctcaagaaggaatatttaacatgaaaattaaaagtagggttgtcccaatgccaagtaaatttgaggagtgtaaagaatgaagctggaattagaatgtttatcaggtatatacggatgtgtccccatcaacatctgatctatgctctggactgtctcatgtaaattcaagatccggagctaaaactgtccattgtgtttgcctggaattatttaaaaatagcttatcatttacaaaaatatcagttctacatgaaaatatatatgacaactccagatataggccaaaatcatgattaaggaagcatggtacagataggcaaggtgacacacacctttaataccttggcatgccaaggcaggtggatctctgaagtcctaaagctctgtcatagccacattggttactggctacactggcatcatcaaggaaattcccatctggtcattaaactcatcaaatatttcaactttgcttctgtttttgaatcagcagagaaggatttttcattgtgctagcttcttaggtcactctgtcatttcatttgtcatatttctaggttttatacttgcttactaaacaaatgactttataatctacagatatcattttactgtccatcattctccctggattcagaggcactttctcttttcatcaagttatcactatttttccactgtagcaattccaaagccaatgctcttagcaaactcttcttcccagaattaaagtccatcaccagcttttcttgtccatgagccatcttcattagttttatctttttttctaaatctgtaagaatttggacctcaggaatagttcttgttagttaccaccccagcctatataatggcttctacttgaacatggacttaatatttttttcttttcattttgagtagatctagttgctggaatggccattcttatacagaactagatgtcacagtgtaaagggcttactcttactttgtagagagttaatggagacatatataatatgtcattgcattgctttgtgaagactagagacatatattaggtatttcaggcatatataggaagatataataggaagttggtcagtatgggttagatcagtgtgatggtttatatatg

SEQ ID NO: 7 - DNA, 1532 bp, Mus musculus
cttattaactgagttcagatgatcccaagtggaaaataaacatcaagaaaggaacatgcatggatcagagactgtactttatatattctttgcttgtgttcctccccaatgaagcattgggaattgtggattgtagcattatgtgcatgttgcagaatagaacatttaacacttggggctgggaaggtaactcagttggaaacttgcttgccacagacatgtatatgtgaggtaatggatctcctataagcctagtgctgggaggagcagagactctggggctttgtggcacagacaacctcgcccagttactgagtttcaggacctagtgagtcaccggatttcaaaagctgttaatctaaattgtgcctaagaaatagcaaccaagtttgacagccaacatcctcaatcatgtgcttatatgtgaacacacacacaaacagacacacacacacacacacacacacacacacacagagagagagagagagatagagagagagagagaatttaaaattgatgctcagatgattcttgaaacaaaccatccatttggatatctgtgaagctaggatctgattcaagtatgcctaactccaacatcatgctattttgtatatctcagtgttccttactggaaagaagcaccttttcagctggtcagaccgattaaatcaaccaaggaggtgaacaggggcaattctcatgaccatatcacacttcccaaaatgaagaagctgagagattccatcacatgccccaatcacacagcttctagcaggaggctagagaacccatccatctcttatatcactcaagttctttccactatgctggagctccatattttacataaaagctatcagtgtcactggacattgaaattaccttcaacacattaaaaggcagttggttgactaaagccaccaggcagtcacatttgtagctcccgatgacaatcctccctcctttatcactttgcataactcatgacatttgaagccattggtgctcctcataacgtaccttttctcttgtctgcattgtcttgttcaacaaagggaaatgccagttttgacaactgatgaatgccacggtgagcttctcagaatctcttcaagttgttttaggaataaagaaacattcactgaaacccttctgtcaaccctcagtgctcgctcatctccaccttttgttaagtgccgccctccccacaagaaatccatcagaacattggcctttgaatctttagctttcagttgaatgttctccaactatcctaaactttgcatctctgggatttcttagtatggtcctaagagacaaagaacatttggtattactcaattagttgcaagtcattagtaatggttaattaacaatagcattctctcttttcctgtgcttaaggcaagacctggctagcatcaacaccacttcccagtaagttttgcctgatgtttccagatgttccttctatgcctacattatagcctctgtcatactacagggttccatttcatttttatccc

SEQ ID NO: 8 - DNA, 1171 bp, Mus musculus
tgtgtaagcaacctgcagcatgatttctgtatttattttgaggacaatgttgagacagcacagcagggttaattcttatcaccaagccccaaaagtgaggggtcaatcttggaaccctacatggtggaaaaggtgattccccatgtgagcttctgcacacacacacacacacacacacacacacacacacacacaaccaaataatataaaaagaatatgaatgtgtttctgttttttcagagggggctctgaatgaccaatccacagatccagctatatgaagaaccttctctaattctacaatccatctctagcattaaatcatttgaatgctgctgtggcagatttttttagtgaggtaatatgtgaaatatatttatttgtagctatgaaggaagatacgacaagaaggcaaagaacacccatcacttgcttgaaatccactaaatgagcaccttcagatgagcaccctggaatgaaagaagctaccctctcagcttagaaccaaaacatcttacattcacaaggcattgtaaaaaagacatttgctctgaaaacaagacaggggacacaatgtctatgacattacatgaaggtatatttgagtaatcatatagtttaacagcttactctaacatataaattaattaataatatttttaaaaatacaaaacttttcttacgtttctaagactcatcgaatgaatttttcttttcatggccttttaaaaagttaagaacattacacacacacacacacacacacacacacacacacacacacacacacacaaatatacaccacataaacacaatgcttgttgagtcaaggtcttaatactcagtctaagcttgcctcagttcaccacagctacaaatacagagtacaagagtacatcactgtggatgcctataaaataaaactgtgtttcaattgtctgacaaaagtcagactgggtcctaaataaatagcacattcctcttaactgtcagttaggtaagtgtccttggacagcgttctgtggttctcagagaaagaaagtatggactgtatttgacacagttgttaagctgtattggtagtgagcatatctcaagatattgatatcagcattttatgtatcctcaggtcctcttggcaaaatttgtcagcctatgtaataaacacaga

SEQ ID NO: 9 - DNA, 1077 bp, Mus musculus
aaccattaatttaagacaatggcttttccagtctccaaaaggttaccaaaaaagtatttgatcattagttgtcttagtcataataatttctgtatgtttcaaggttaactacccagagtcctttctcaggtgttgactctacttccatataaacactgtatctgtttaaaaatggaaaattacaactctcacaatgatatttatgagggatggtgtctatgtatttagtataaaagaatatgagaaaagttatcaaaagtgttgtagctaagctcttcagctctccaaatgcttcaagtcttgttttctttgtccctcgtggcaccctgaatgtgtgcctcggagatggaatgagttggcttttctcacatctgttagtcagccctcaactttcagtcagatctgtcggcttcccactcgactccagccgtccgccagtcttccctggtgagttgcatagcaactaccgctcagcctcacctgcaaaaggttagcccaacagttttcatgctttcctgaaatattttttttcagctctcgaaataagcaagccagctggtagcattctaaatagatctcctctgatctcctccttaagtgcaatacaattgcctacccagtctttgcaaacaagctgtcagggaagctctctccaccggagctgggatgtgagagggatgttcacctctgccagtcatcggccggtgatcgcaaggatcactctccatctttcttgacctctgcgtcatcgtcagagcacgaggcagttaaatgaatggctcattttggtagcagtcgtcctggctatcacgcaaaggacaacccctgtgagcattcgttcttaggactcttcctgcacttctgcaaggctgctcactgtacaccatagagcgccagtgctccttgtgctgtagtctgtataatgctgccttccagaggacattccagaagccctagatacgatctcagacttgtgctgaagagttcacactgtgtgttctctctgtgcaggaggtcaaacgccagcacggtgacgcttcctgttcaatgtcacaggaataagtggtgggatgctga

SEQ ID NO: 10 - DNA, 680 bp, Mus musculus
aacttagcatagtgagacaggaagcagccactgtcagtggtggccgagaaggggacttcacgcggtcatcctgaaccatagattctgggagtcttggagcctggtgcaattattctctcatctgtgtgcaggagggagggctctataatgagtgtaggtggccgctcgagaacgaggtatccaggggagggaatccacccacggtcggtcttccatctctgatacttaaatgtcaacagagccaaattggctgctcagccagcccttcctccacctctgctgctaaggctcagcaaacttgccgctgtgcccgccaagaggggacacagccttgagtcatctcagaccacttcctgctcatgcactgggtgaccttgaacaggtgattcagccagcctgtgagtcagctgctcttggaacctcaccctgggggcaggtgaagagacaagtcctcgaccaagatcatggatatggagtggatgggtggatggatggacagacaagacagatggacagggtagagagacagggcagaagggatacacaggtaaacatgtcatttctccttttgcacctgtgtgatcactattttatcgatcataaagaccttgaggacctactgtgtgttgtgcagggaacagtgcctacattttgacacacctactcctggtggtgcagga

SEQ ID NO: 11 - DNA, 1008 bp, Mus musculus
ctggagaggccccataccacagaagagttttttgaagaccaccttttactctaggtgattcgtgaatacttaaaggatgtttagagtatgaagctactgttattgttgaaataaatcacaaggccacacaaagtcagctctaccacttctcctgcataggccaaggaggtgagttttgcagaaaggaaagctcactcaagtccagtgtctgtcagtcacacagaaggactgatagttttcagggtactctgctcatctgtcacttgaagtggggcatagggaaattccttttggtttattactgcaaacaacgtctttacactccttccagaaccctgagagagtggacaatcctgtagattctacagggttaggaggaggtggttagctggagataacttagctggagcaactcctcagccatgccaggcagcgagagctctgaagggttaaatacattgattttaattaagcaggctgtcttcgccagctctagacagcggccctcccacagatttttgatgctaaacttagcccttctaatatgctggcgtcttcattctctgcctgaactgattagccagcccttcagtggagaaccccagtgatgtgacagttgagatgttagagcagagagtgtagaacacagtcttcctcctcctgccatgtggcacacaaggcagccgtgatgacctgcaggtgaaacacccacttctggactatctatcagtgtgtatctgagagctgggctgcagcaccgtgtgccaagaccctactctgcagccttgcgagggggttccttggagaaggggctggggtggggaccctctaagaggcttgcgttagacccatgacatcacatgctctgagattacacaggtaagcacagggatagatgtgaaagactgagtcagtgatacctcttctttccagccttcagctcctgcccattgctagagcgtgccatttccattgcaccatgaatacgctctccacgttaagtgaaac

SEQ ID NO: 12 - DNA, 867 bp, Mus musculus
attctttaattgcaataaaaggtactaaggttgcaaaaagaaaaaaattttatgagcactgtctgagataccttttggaaaccctagaccccttcaaagagatcaagtaaattaacctacaaagatagattcactcttattaagcagccgcagcataggggctcactccattcacagaggtttcccagggaggggctcactccattcccagcctttcccagggagccgcttcctgcagagccactgaggtatcgggagaaaacgtggctgaagcactcaggggaggatttccacaggcactgagttaatccagacaatttgaaaaggatcagcctcatgctgtcttgaaactgccccggtagcctggggaggaacccaagtgggaagaaaggcagctggcttgaggtgcagacccagagccttgtgtggagtggctggcccctgcttgatgagaatgatgggccctccctctggactacacacactcatgggcacacgcacatacacatcccacaccgccacaaggagcatggctccctccgaacacatcagctctggtcgccatagcaacgcagtagccaacttcccagctgaacaacttttaccagacacaagcacattttcctgccctgcccttcttcactgggtgctgagagggaccagagtgtgggctgtactgaaaggcctctaaaggggtcagtgaccccagggaaggaaggctgccccacttgtgtgggttgctctaccaggaagggccctctccagatggcaggactgggtgcataggtcttgtctttctggagtacagtgagggaggcctgggctgaacagaaaatactggggttcttacttctcggagaaagaaac

SEQ ID NO: 13 - DNA, 2809 bp, Mus musculus
ggccgagttgtagtcacggggaaggcagagtacatggggtggagaactacctttggcacatgcgcagattatttgtttaccacttagaacacagctgtcagcgccatcttgtaacggcgaatgtgggggcggcttcccacacccctgctctgtctacatttaaatttgaaacacgaaacatccattgtcttcacttgatatactctctgggcgttgcttcacggacacagcatagaattctctgctgcatcctgagaaagaactggccttccctgcattaggggccttatgaggggaacatttcttacaactctcacatacaaaccacgctctgattccgtttggggatgagaagaaactgggccttttgaagccaggcacacctgtgcctatgctgtgacttgaggcaagtaaatggggaccataaaaatgtatgggtttttctacttacgatgggatggtgctggtgtggaggtgtggagccattgcaggtccatggctcctcctgtccctaacaccaagtgtgagtaaggcgtgtgacaccagggcactaatagagtgtgtgtgccatataggaagcactagcatggaaagttgtagacagttaaatgcagatgccacatgatatggaataaagtggcccagctgaattctgggtttgccactgagagcagagctcagtaaacactttttataaagaatcagctgggaggtatttaaactctgtggctctactgtgtaacagatgtggttgctgagtcaccgcttattgtgttacaaaacactttccactgcaagacttctgagcatctggggttttgagtggagaggcctgtgagctgagaccacagtttgaatctcaaggctgcctccaaagtctccttgtgctcagccttctccacgcctgtgattttcagaaactctgcaaacagctgtgagttttcaacactgcccacaattggatccataaagcaaactctctcccacaacaaggatcgagagaggagttattaaagatgcatggggggggggggcggttaacatgcaaacatcatgggaactgacagccagtcaacaaggaatcacatgctctctctctctctctctctctctctctctctctctctctctctcttgtctcaaggtatagctaaggtagcacacggagtgtctgaagatcacaggtgtctgtctccatgctagtgatttttattttatttaaaattaactgatgcatcagcattgccctgctagcaggaaaagattgtttgtagcacatttatatcccagtctgagatgtgttcagcctggttgttggtagctatgctcccattgttcagcatctttctcccttgacaaatctctgtctggtggccagggaaaaataaagaaatgatgcaaagctcgtgagatgcatcaagggtcaactctaccttcatgagcaaactggtgttttgaacaggaccggaggagggatgggcagcactacattcagctgttgaaacaaagaagctgatttttaatattaaaagaggggaaatgtgggagaatggtcatgcacaacgaatgtcttgggacacatgagggtcgtatgaagggggcctggtgttatctgcagagccggccaatctacgggcaagtcctgttggagtcagagggttagaagaatataagctcatctcaaccttacatctcaacctcctgtacgatgggaagatactggactggaaagatggctcagccatgaaaggcaaggcttacaaccgcgagaggaaaatactgtttcatgttagcttcctgtggggctttcaagaccagttctaggactagatctcagcgctcaggaggcagaggcaggtagatccgtgtgagcctgaagccagcctgctttacacaatcagttccaactaggcctagggctacacagggagaccctgtctctaaaaggtgtgtgtgtgtgtgtgtgtgtgtgtgtgtgtgtgtgtgtgtgtgtgtgtggtgtagtggatagggaggaatgaaaggccacttcctagcacaggtccatagctctttctgtttaatttcatttcaacaaacgtctagtcggtacatacactgtgttggatgctcagccaggcatatgagcctcagatgaatgaggtacgaacacactcctgactctacaaggcttgcagcatgctgaagcaagggacaggagacacaaaagaaaatgtcaccagagattataagccgtacaaagtggatataaaaacaacagcacaggtcaccatgagagaaagcgagccctcagagggacctcactagacagctcagcccaggtctgtagaccagcatccatgaagttcctgagataaggaacagggaagggcctacactgtgaagcaggaggcagctgggcatcccagagcccgagggtcagcggtatggctcaggagcctcactcccctttggaggctgtggccagtactcagaaaacaggatttttctttaatcctcatgtagctctgaacagcgttgagctgtaacctgtgaataatttatgtctatttccattaaaatcaacaactgccctgtgcagtcccaggacaagacagaagcttggctcttaggaaagcagctgagaatgtactaagcccatccccaaggcttttctctttacccatgattccctgctccaacactactaccaaccccccagctaaactccacagcccaccctgccttgctggcagccatttccatactccaggcttctgtctgactattctccttgggagggcagcctttccttctcctccactgtttg

SEQ ID NO: 14 - DNA, 1570 bp, Mus musculus
ctggcatggagatgtcattcaaacaattcagagaaatacatcagggtgtagggtcggaaacactgcttggaccatcaacatcctttccttttcatgctctgaatgagggccacggtacattatgtttgcagattcccaagaatagcctgcttgtggcatatctagtgtggtattcctatttcatgttcattctcatctagccacccctccacttgcctccattacagggatcccttctacggctccatgcaccttaggtagcctcagcatcatcttttgctggccatatgcaatttgtgaaggcaaggatagtatactttctccacttgtcttttataccatatacctattatgcctaccatcactccatgtttacagacattttcagtggataaaaagtgctttcttgaagcgaaggcacccggtagcatgtgtccatcctaaaccagatgtctttgagacaatagccagcctcatacccagccctaatcctggactctctccaatctttctccatggtgactcatgctggctgccagcatcctaacatgctccaatctataccacacaggagtcacactcctggaagtcacaaggtcaggttcagtgctacccccccaaaaagcctgcaaaagaagaacgaatgctgcaggtacatcacaagaatgtttttgttaactaaccagaaaaataacactgcaaactgtctttgtgcctgacagcattcaaagctctttttgctttaattagcatctcacagactcaccaaaacaaagctaggggcagagatacatttcaaatcctgaatctgaagatttaaaaaagtgttattataggccagtcatttgtccccgctgggcctcagcttccatctctgtctctgtctctatctctatctctgtctctgtctctgtctctctcccccctcacacacccctacacacacacacacacacacacacacacacacacacacacacacacacacagagggtgatgtccagagacctagctgtgtaagccccaccaggccccagctcttgtcttactttccagggatctttgtagatgttgctagctgcctacaattggtgcctatatggacacaaaaacccccttgttctctgataggcaggtatatctgaaactattaactgtaccagtctcttcccacttgagcagaaagagcaaagatagaagagcctaggaaagagatgtggagaagtgcagaattatgaagccaggataccaatgctgaaatgaacaaatacaaaagtggctttaccccttattcatattcttggcagtgtgggggagtacaaaagaaaacatttcctgttacttccacaaaacatagaagaatcataatattaacaagaaaataaatatatgtactaaaattagcattgccttggctgatggcttctgtaatgttctcaccatgggactccaaagtcagaaggaggtgggtatggtgctttctgtttgcttctacctgggcgatgccttcaattcctctctgttttatgaactaatatggcatctccctagccaatccaatgatctgact

SEQ ID NO: 15 - DNA, 3550 bp, Mus musculus
ggtttttttgtttgtttgtttgttttttgttttttaaagctattcaatgcttcccaaggggtcgcgacccacaggttgagaacccctggtctaggcactcctctgtaacaagcaaagttatgtggttataaacttcaaaagtgcattgttttgtctttacagtggatcgttttcgagactcattgctggccaaaatgccgaaactatatgactgtagaatgtttgcccttaaatgggacatctatactacccactccaaaactcggggaacaccacagaaaacgaggtattaaagaatgtaaaagccagctggaagacagaggggaaagcagtaggatgcacgcccgcaggcatggcatggccatcgcctcacaaaccttcagctgctctgactgcctgtacaagactggacctggcaacattgtgtcatggagggggaaatgcctcacaagccctataggcagttaatggctgcttggaaaggaacatattttcttcagtgctgtagtcactggaaaggtgccggtgttcctgtaaataaccctaattaaaaccatcaagtggttcaccaacaaataaaattcgtaaaaatacaagagaggaccagttggagagaggaagggatcagggagtaaggggtgtggcagagaggtaatgggatgaatatcactgaaatacatcatatatgtgtatgaaaacgttatatgaattgcattatcacatattggtaatatatgccaattaaagcttactttaaatattttttactgagtgtaacagaatttagctggtatccagtcatttcatttctagcacaaaccagtctttccgattcacagttgcttggtctcttttggacttaatatcgttcctgtgagatgggtgctcttctgcatatcatccccttaccaaggatgccctgcttcgctgggaagaggcagctggtgccctgccttccaggatgcacgcttggtctttgagttgccctctttcctaattgggctccactgagaggtaccgcccccatctggtcctcaccattcatttccctgcttcagctttgcactgccttccccttgtacaatcctattggctcattcttactcacatctgcagtccttatgagaaccgtgggaagtctctacatggcccctccctctgtctagagagcatgtgatctgagaggcacctcgaagctgtcctcagacctgccagctaggtttgctcaggtatcactcttcttcctccccggggccctactgaagacagaccgacctacccggtcctggaagaggggtgtgaatgggactctttacaaccctcctacaacatccactgcccagcctcaacccttcaaccataattcagcccagcggcaatgaagatgctgaagacctcttcaagaaatcacagcaggcacctaagtcccaacatcatccgctgtactttttatcctcctccccccagctggtcacatttttatctccctttgagtggaaaataaattatgtcatcctgccttctaaattttcagctctctacactctggctcttgatatttaaagccgagattttttaattttttttaatttgtttaaagaatcagctttaagattactgtttatgctctagcaaagaagacccagtctccaaaacaaagcaattagtccaccgtcttcagaatgtctctaatggtccccctccctccctggtcatcccgttcacgcagcggccctcaaccaggtaacccattcacagctattgggttacctggttgaggatctgtactggctgcaagcagagtggagattctctgaaaggcaattccagggccttcagactgctaaggctaccgggtgagtcatttgcatgagctgagagaaataggaagattttaagatgggcaggctctcaggacaagagagagagagagagagagagagagagagagagagagagagagagagagagagagagagagagagactgacttgaatctgcggccacatgaggcagaagtctgcccctccctactgttcagacactctctatttctctacagccctctctgtactcgtttgtctgtttttattttctaccttgacataaaaaataggtaactttttcctaaaagatatatatataaatcaaataaaatcatgtttatgtgccccagttttatgtcttttcagatacttttgacagttccatccttaacaagtgtaactcactgttctttcaggaaattgaaagtgagtatccccagaagttagggagcaaaccacatgtgtgttccttcaccctctctacccaccccccaagtctccaaagagggatggctcaacgtttccagcttgctaaatgtcacaagagatatttaggtttggcacataaagaacacccaaagatggtgagggactgaggcaaaatatggaattattccttaggatctttaaaaatgaggagtcttagcctcatttttaaagaacctatcttctcccatggcctaagattaccaagagccagtgccacggctcctgggtctatgaacagggccacgctgctccgagctctcttgccatttccagttatcctgcaatagcaacactatgaggaactggctgcatgccttgagatctgctcatctgctccctgttgccccaccaattagaccttgagttagccacacagagcccagtaaacagctatggggaaaaaaaacatcattgtagtagctatgtgcagaatggagccagccagagtcaatctttagtcgaggtgtcacactgaccactaccaaagatttggcagtggtgtcttcctcatgtacttagggaagggagctcgtgtgtgctctcatgttcatagttgggtaggggtgtggtgtgtgtgtgtgtgtgtgtgtgtgtgtgtgtgtgtgtgtgtgtgtgtgtgtgtgtgatagctatgtatgtaaagggtgtgtgtttgtggtgggtatgagtgtagtgtatgagacttgtggggagggggcttgtaagctcctttgaactttgtggaaattccatggcgtctaggctccttaagaatctagactctcccaaagagtatttgtatttccttatgacaagctcccagagggacaaccaactgaagattgtttaaactacacttttgagttgtgacttcagagactagagaaattgtgtaagtgctagtctgcctgtgcgggagggtgggcatggagttagaaattcccagggtgagttttttccactccacttagaaccaaggctgagagaggttctcactcctaactgcaatacccaccacaaacacttaccatcaggacacttaagaaactagccttggatgggatggggacagcggagatgactcagaaaataaggacaagagttcagatccccagcacccatatgacaggccagtggtggtagtgaatgcctgtgatcccagcaagatggagataggcagatctacggagcccactagacatccagcctagcagaactgcttagctcctggtgcagtgagagaccatgtttcaaaa

SEQ ID NO: 16 - DNA, 1625 bp, Mus musculus
cgcagaatttacctcttcacacgcggaagaaggaagaagccgaattcggaaccacacaccatcttcagcactgtaactcacaatcttcactatgacccacgatattcagtattgtgacccaccatcttcagttctgtgacccatgatgtccacaatgtgaccaacaatgttcagtactgtggcccctcatgttctctcgtctctgctggtggcatatacccgcaccatatctgtaaaggtctatagctcttgggggtcttggtctgggatattgccagtgcccctggttctgagattccaaagctgtgtggttaacaggtgagggattgctggataagcagcttctagaacttgaatgagaattttttccccatctgccactttggagatttttcaaactcattcctctgtgtattctaggaaagtgctcgcttgcgctgggcttgtctgcttctggcctgaatactgagctgtgtaattgagggaactcaagcataggcagttcatggttgtgtgaataagcaaactactcgctatgtgacctgattgttttccaaaattacccagtccctggtttcacttgtcgttttggagcggcagtgggaggatggggctgtgacagtgaacgcgttcaatgggtgtaattaatccatttcgtgaaaacagattttctaaattatgctatgacttgcaaacatttttaaccctttacagcccaaggcaagaaagcagcattttggaaggtgcacgtttccccccagagatcaatctgattcctctaagcctagttgtattatcgatacagcagtacttgttgactgacacccacggcatggacgttaggaaggatgaatgagtccttccgctaataccgccattctgcttacccatccacaaagtgttccctcctcatctatctgcagtaggtcccgaaaaaaagggaacaaacaaataaacaaacaaacacccaaaccattatttgtcagatccctaagatagaaggaacagcaggaatctttcaagtctttgccacccctggaagcaacatcaatgatccagtgcaagacgataaaaaccaggggacatgaaagccagcaagcctccgggtgtgtgaagataaccatctgtgtccagtgacgtcttcaaaagatcaccaacagaagcctcaccgtgggaacatctgtacctccatcttgtctggcccccaaaacctctccatataccaccaaagaaggaataaagtcggctcccagaggtctcagaggcagcgtctacctatcagcgctctgtgctaccatttactgtaattaagtgataacattcactccctttgaaaacattgggaaaataacaaggcttcctgcgcagagaaatgcaattctaaggtacactactgaggctcaagataaccggcttgatgctggcggttcttacacagccaaggaatacagaggcgaccagcatgtgctaaatttgaatcgctggggacattgtggactgatgtagacaatgggaacctgcaggttttatatgtagggagatcgagtctctagttccccctcaagtgtgataccgttttctctcatttccatattgttctaatgattagtctgcaaatgacaact

SEQ ID NO: 17 - DNA, 1750 bp, Mus musculus
ttctttattatcaattgaaagcagctgggggtagaaactctcaggtctagaagtgcagattttgggagctgaagcaagacaaagcattagaaccaattcccatcatcttcccaccaaagttataccaaaagtttaggaattagaattctgtgtcaccatgtcttggtgttttctgttgtggtaattaaactgaagactaatagtctcccaaaacaaacactgagttttgtgcctgtgtgcacgtgtgtgtgtgtgtgtgtgtgtgtgtgtgtgtgtgtgtgaatgcatgtgtttaaagtcatttcttagcttggtatggttgctcaggcttctcaatccaacattcaagaggcagtagcagacagagaccaagttcaagaccagctacagcaaggtcttttctcacaagctaaggactgagatctagctctagtagtgtagtttcccagcatgtgtatgggcttggatgcattcctcagcaacagagaaagcacacacacacacacacacacacacacacacacacacacacatgggggcatgggcatgatcacatagatgcatgcataaaagttctttccactgctgaatgcttggatcatgtgttcaagataaaagcttggagatgaagaatttgtaataagcataaaaacaggttctcttaactgaggattaagagattgtgggatattcgggtgaaggctggctccaaagaatagcaagtggttaccgggttgttaggcaacagccactccagccttctgggagaacaggtatcctttgaagaaaaaaaaaaaaaaaaaaaaaaaaaaaaactggctgtttaacagttctggtttctagtactttctgtaagctctgcactctacagacaacagtgcattccctctgtctgaagggagcccactgctccctggcttgctttgcatgctgggagatacttgagtttattgtatgaaattcagaacagatggcagaattctttaacatttttttctaataatttcatccacagaagcctgattgtactgtttcagagacatgtgtaagttatcaaaatattattgtcattttttgcctgctcgttatttaataatgagctcttggttagaaatcacaaagagacatatgtggagaatttaaagagcacaccacagcacagaacaagaaacgcagctgtgttcacatttggagtgtgaggtagaagatttctgtctcctttttttttctttttcttttctgtttttcttttctaaaagatgaatttgccaagttctactatttcagaaatgtgctatatagtagcagttaagtaaatacccagatgttaatacatagaaaactggtgaaattattagtcctacctcttgaaaatcatacaatcaaatttggaacatacatttttccattttatagaacactggtaattttgtcataatgcttcagatcacctgtattataaacactgcttcaattcaagaaaggctcttaccgctttgtatataaggtctagagattgatattttcatttacatttaacaatacagaagtttaacgtgtctgtagattcttattctatgagtctatactttgtattactatattcattgatatagtgattaggcttcatgactgatgctccttttccatcccatgtattgtctgtattttcatagagctctatagttctcaatgctgtgtaatctttgttcaaaattcaatccactgtaaacattataacgcttttttt

SEQ ID NO: 18 - DNA, 1600 bp, Mus musculus
ccagcttccacgtggaatgcaccaaaggcaggaacgaaaggcttaaagacttaggaggcccacactccctgttgaccgcacccccaacctccagtcaggagcctctcctaaacaaaatgctacaaatctgataaaaagtactgtatgataatagtattactaagaggaatactactaaatgctacgaacttaattcaagtctctccattttttaaagctacagcccaggagtgtcttctacaacagtggagtactttctaacagtcagcaataccttctggttctcttccacttccgctctaagctgcgcgctcacagccgttttcgttattgctctaaaaaaggataaaagtgtgatcagtgtttagcttagcattccatataaaggtcttcagttttcctgtttttagacatgaaccatatgactcaataaattataaaaataagaactaagtaaacctcacagctgcagaactggcaaacgtgttcaccctgcagatgccgcatggtggcaggacgtgacaagtctggtggcttccgatttcttgactgtgtggccctactcctgatgtgacatttgctgctcagataactagccagcagaaacgtactccggctgactgctagtcctattaaatcctctcgtggaggctgaaccctgtgtgtcttccagaagcgtaatggctttaagcataatggctttaagcgtaatggcttaagaaatcttccataggcactccacggtgaaaaaggggcttacttaggaaactcttagccaagaatttaaccttagttatttaagacaacatctggaaaagtttctaagaatttggcttttagacaattttgcctcacattcatagtcagagattaacactacagaatagacagcaatgtcaggaaattcattctgttactatgaacaagtcagtctccctgagtctgtttctaagtcaggaccctgaatccctcttctctcttcctcctcctttcagaagaactgaggattaagcccggagccccgtgcacatgaggcaagtgttctgtcactgagccctaggcaaagcccctcttcataaggattcaaaaatggcagtatggaccagactgtggattagctgatgtggcctaagtggggcagtgccaagagcatctaaatccctctctcttcaaccacacagccaacagctgtcacgtgttagaaagaagacactgatcgcaacagtacttacaaataggtttcacatccaagcatttttacattttagtcacatcatgttctgtgcaaacatgaaaacaacagggaacaatgtgaaggagagggatgtaccaaaaccttagcacatacctggccttggtaggaaagttctgactaatgtccttcatcaccaccagagataatgccccagaagcagccaagattcgggcagcagtctggaagctgagatctgcacaacggcacatgtgacattagagcacaggaatccatggtaatgatggtagacaatgtccccaacactacccacaatccattgagggtgaagacgccatagaatggaactattcccgacggtgtcccaggcttagctcagacctcgtt

SEQ ID NO: 19 - DNA, 1575 bp, Mus musculus
tccctctccctctccctctccctctccctctccctctccctctccctctccctctccctctccctctccctctccctctccctctccctctccctctccttctccctcttcttggagatatatatatatatatatatatatatatatatatatatatatatatatatatccaatattcttccagcagaacccatggagtaatcttgattcagagacataaaatgttcagtttataggggtggcaacaggggtagtactacctagcagagacagccaggcctcagccttggcaggagtcagcaggagggacctggagagaccccagaagttctcagctgtgcctctctcaggtaaggaaagatcaacaaggactggagaccgacagtcattgcacagccaactatataagcaagcctagctcagtctccatcactgtcggtcgcgttctatttatactctctaaacatcacgtgtcctccacgggtcttgcctcagcacatgcatctgttcccagctgacatcactctgccaatcagagtctgagttggttgccagaaattgcagcacacccccaggaatattttggtgtgtctctctctttggagtcctggcaaacgcagttcaactatgcaacgtaaggtggacgtgagtgtcgttaacaaaggatcctttatcgcatgtcctttcacacgcttactttagcagaacatcctttcatctgtgtctgcttcagtgaaaagttccttcaggagtctgccttagcctttctcctgtgtccacttcaggaaaacactccttcatgtgtttgcaccagcaaaacaccacacaacacaactgactttccaaagaacccttacgtttccatttattgggagtgattttttttttttaaagggaaagagacttctcactcacatgtctgttttctatctttctgaaagagggtattaaccaaaaataaaatcagtgtaggcagaatgaagagttttacatttgcttgggaatggagtcaaagtctgtccagccttgcaaatgtgtcttagggttttacaaaaggctgtctatgcttataacttaaaaacaaagatattagtgagaccaccacatttcaggaagtgtgtgcaagtagataggtgactcagccaatcagagttctctctgctctgctcagccaatcagttcatctgccctgctcaggcaatcagtgttctctctgccctgctcaaccaaccagaatgctcactgtccttgaagagtccttcttccagtatccgtgtgagacatctcacaactgcctgtaactccagcaagtgtctgatgtccccttctggactcccagggacctgcacttactcgcacacaaccccacactgacatgcattcacacacatgatttaatatatatatatatatatatatatatatatatatatttaagtaaagaaaggatggggtactttgtaaggatgggacaaagtaccatctcattttctgtgtagtttgggagaaatggcaccttgtgcagaggtgaagagaggccagccacgctttggggaacctgtggtttggcctgtg

SEQ ID NO: 20 - DNA, 2100 bp, Mus musculus
gttctaagtgctaaggtaaagcactcctcataaagttgaagcaaatataaatgctgtacagctcgtaaatgtaagctaggtgctcatcaaatgtaagagagtactttatccccctaataatacttcatgcacaatgcatgctgctttctgtctgggtaatagagagagtaatatctgtacacactgtattttattataccttttattaatttgtgatttagcagtgaaggtctgatccgtgttacctatagtgacacaggctaccttcaaagaggccagacctaatatctgagagatagaggaaatgctacctacttatgtcggaagtcaccctacaaaagcctgggttcttgagatcccactactctgtaaagtttatatttccaaaatatatcagactacttaaaatttcatataaataacaggttatgaaattagtagctattgtcatttgatatggcaacatgaacttatccataaaaacacattcttaggtttagattttggataaaggtacaacttttagatgatgcaattaaacttctggctgaaacacaacactcttaattctgtctcttactatatttctgaaggtcatggacagaacaaattaagtataaatgcatgtacatgtacgcatgttatacacactgggaacctggctggctcgggtgtgatgggatgttctttattacgcaataaaagtgcagtgctgaagcagaagagactgcagtgttattaaaatgccaccctcacatgttgctctcggctgactattggacagcatccaggaggggagaagggcggagcaaaacaaacagaacaaatgcaacttaacagcagaggagaaagctgcaaccttcactaaaagcagagaaatctcaactcaaacactcaggactcttggatttctcctttcctcaccacggactcagtcaggatgtgagccctgccattatgcatggcttggggctgtttgtgagcttcctccccatctgggactgaggcaaattgcaggtttccagggaggggaatgcttttacagcagggatcaccgctttaagcacttcatgggagcccgtgccaagtccagtgacactacctgcctggctccctgtgacaacctggccaccaggttttgtatttttagttacagaaaatatataggggcatttcggaagcctgacattgttcttcgctccaagaccataaacacgggaagagccattaaaagccatttcatttcccttccacctacaaaatgaatgtaattattgcaggggcatgaaaatgcttcaatctacgtttttgtccctctcatcttacaaagtccaccgttccctttcaggtccctagcaggctgccttctccaaaggctgcatatgcttactaaaagcacctctcagtccaggcaagctgtcagcaattactgcagtgaactttaaatcctttcctctaactaccgcggtagcccagaaataatgacacaacttctcattgctttaaaatgtcaagctgaccactcagaaatttcagctaggtttctccgggcaggcccaaatgataagatattttatgagccttccatttcagcccctgtttcattacagcacagcctaacaccttcacggtatagcaacaccttctgggacacattaaaacttaaacaaaccacagaaactgccaccagaagagagggaacaccatatatctggcacaagcaaactattttccttccttaatctgacactatcacttcaattgttttaatttttctccaatatcactctctttctgtttttttaactgaaaagcctataactttattcatatatttacctaaatatctatttatagatatacagatataacccatatataaacaatagtgtaccctctgagtaatttagtagatactgaaatatttctgtcaataaatatggacagataaattaactatcagaaaatattactgtatgaaatatatattctccctttacaatgccttttgccttttctttttttttttattttaaactccagattttattccctcccagtccaccctccaactgtcccacatcccatacttcctccccg

SEQ ID NO: 21 - DNA, 1800 bp, Mus musculus
taaccagttcactagttaaagctactaggtctcttcttaaaagaagacaaacaggttcgccttgcccatgagcttcatattaaagaataaacaggtttcagatggtttctgctaaagaagcctgctttacaatgactgctttcaataacgagtacttatgtctttggtaaatgactagatgaaaaaatttcgttctgaaatatataaagatttgagaataaaaaaaacttgaataagttataaggatctcaaaaatgattgtggatatatagaaataaaaaaggtttcggattccttttccattctatgctgttattgccctgaaatttggggggggggggtgtcaggatttgatgaagtaccagctgttttactactcagtcacaagctcaggattttgagttttctttggttatcttctagatatagacttagaggtgctttttattgggttaaaatatctctatccaattatacacctggctctttaaacagaaaaaaatttttttcatgttcagagaaaaatgctacagttcttactaagactcaaaggcgtaagtctgctgcttcacagagtcccatcaactgctttccctaccatgtgaatttcaataaaatggcaacgctgatctatctccttttatgaactgaaaattcgcatgagcttcagggaatcagagaagtcgtaagacttggatccacctaccagagtcaaatggactccggacagtacagcctgagtttctgtatctgtctgtccctaagaatggagtttcccctggtcttgggattcctccccctccccggtaacacaaaaatttaccttctgtcccgagtctatatttgtctcaacagattttcacttggctgacagacttcatccagggatgcaaactgcagagctctggacttgctgaaaattatgtaaaccagtccagccaacatgattgctccttgtgccttcagctggatcagccaatccagtgcttctgacaaatgccccattgtccagcctttcactagcctctcagtcttctggggccctggcaacaacaccctaatgtcagctggaagtagttacggaagaaaatatgttgtctgttaccccacctaacaggctgaaaatgctaagtcaaagagaaactctgtggcatagaggacaaaatggctacctataagctgactgacacatcagaaaaatgggcccagatttgtcaactcgtagatttattaactaaaatagttctacaatatgataggatacttaacctgctttatgcaaaataaaaagtattatgtgcctttaaaaatatttctatacaaatcattcaggactataatttggctgtactcaagaaacattgcaaaaagggacctgagataaaataaatgactggtttcccatccatgtccaggctccttctagatagtaactctaatggttagtagatctaaaatataaacaagtacccatcataggatcaaagacttgagaggcaacaccagggggaatgtaatgcccaaatttaacctgtaagccctatctgctcaggacaacaggtaacttcctagaatgctgggaactgtagttcttggaaaataacaaagcctcatgggaaagtaccatgacctataggtttgtccttataaaccccttcaacataacccagggctcaaggccactctctgctgagaaatttcaggaatggtcctgaccaaagcccttatcttggtcagtatttaatatttaataaagcttgcttttaagcttgccccaaaatggtgagattggttttgctt

SEQ ID NO: 22 - DNA, 1625 bp, Mus musculus
cagttatcagaaatgaagcacacgtgagcactgggtgtatgtgagccattcaacaatcctcagttgtccaggaaacgcaaattgaagtgggctggattccatcccatcccatccccaatgagaatggctgtcaccatgaaaataactaacaggcagtgttggtgaggatatgggggaaagaaactgtacctgctgctgatcagggatataagctagtgtggaattcagtatgggggaccaaggactttttttgtcttataaatctcaaatctcagtataccactgcgggaattcagggaacaccatcaaggcaggaaccccgaggcaggaactgatgtagaagccacagaggaactgtgcttactggcttgctgctcctgccttgcttatcagtcctttttacaacacggcaaaccaccagcccagggttgacactatccacagtgagctgggatctctcacatctaccagaagcttggtcatcagctagtctggtgaggccattttctcaactgaggttctcctttcgaaggggtctagcttgtgtcaagtggatataaaactagccagaacgcaactttttctactgctgtggtcaggaacctttaatttatgctgctagtaggtctagggtgtagggttctgcttagtcttacatgatctcatgcaaacatgagactgtcagacattaataccagttctaggtttagttacatatttagtagatgggcgggtgtggcacaggggtctgggatggcacacatctaaatcatctctatagtagcatgccaggggaagattatactacctatgaaaaatgagtacatcttagaggcagacagtggctatagtgcaaggggaagagaaaaactgtgatcctctgtctagtagatctactgttttttattgtgttgctaggctggaaacaatcttactaggaaggacacacaagcagctaagggacctggaagacagaacaagaaagcagtacaactgtgtttccaataccggacaaggatggcattggaaagtcattataaagctgttctggctgtgagcatggaaagtttcacacaagcagctaacgagcagaactcactatatgtgccttacgtgatgaccaaccaggctttcccctaagagtgtaagaataaattatcacttgaaaaatctattcatggaatgaactacattaaaagactagtagagaaaaaaatgctcaaggctgtttcaatagatgataaatctcattgctcaaatttccccattcgctatgttaaaatgttaggactggaatgtgggaaaatgccatatacccgagaagacacaggtacaaaccaacagcagctgtgtattctagaaacttctctttaacgttaaggtgctaccatcattcttcaacagtggttaaagctacgaatagaagaaggtagccagggaagccatgaacggtgttaagaaaatccttttggagcggtgccaaaccatggcgagaaactacgagcacgtgggcatccagaacttctcctctcgctgaagcggcagcatggtcttctgtgcccccattcacaaggtttccccagatgctcttgcctatgcagagctggacctaatgaagcgcaggc

SEQ ID NO: 23 - DNA, 1775 bp, Mus musculus
aagctacccctccccctccccccaacttaaaaaaggcacaatggccagcctctacaaacaaaacatctcccttccttccttccttccttccttccttccttccttccttccttccttccttccttcttcccctccctccctttctttctttctttctctctttcttttatattcttctctcatatatttattaccctcaaccacactttctcctccctccacgcctcctagttcctctttcccacctttcatttcttccaaattcacttttgctctgcttcccttcagaaaggagctggcttggcagagatatagaccaaacattgcataacaagttacaataagactaggcacataccctcatatcaaactggatggggcaagccagtaagagataaaaggtcccagaagcagagaaaagtgtcagagacggcccctgcttccactcttaggagacctacaagaacaccagactatacaaccacagcatatatgcagaggacctaggtcagactcatggcggctccctccctgattgtcatcagtctctgtgagcccctgtgagccctggttagttgttctttggtggccttgacctctctgccacaaaatagctttctaatggtttacatttggtagtgcattaacatagcagtaaagacaatctctctcttctcaaagagatattgaagtggcacaaagctacttacagtttcaaggttgaaatttggagtagcctggttgggttggaacctttatgtcttacgtatcaactgtggaactccggaaaagttggcttctctgtgttttgtctttttcatctttctcatccatataaaggttctcattggaaggtagtcaagagctcagcacagaacctggcacacagtaggcatgtggcacacctgttctttatttctggcatgtgaaagtatttatttgctggtatgtgttttatgctctagaatgagtagattgcactgttcaggagttcaagttgactttggaagagcactgatctgaagtttacaggaggctgcctcttcaggtcttgtcaactacagactgtgttttttgaaaaaaaattgatgagctgtcctgtgaacattttagtgcagtccaagaatggatctttgctgtttaatctgtagcattgcagagtggaccaggagctctcaaatgtggtccataccttcagacttactccaagagcacaggaagttgagtctagaagagtgttctcaacctgggagtcgtgtccctttggggggggtcacatatcagcgatcctgcatatgagatatttccattattactcataacagtagatagctgtgaagcagcaatggaataattttgtggttgggggtcgccacaaaatgaggaactgtattaaatggtcacagaaccctggttgagaaccactggtttggagtctcagagttgtctgtcctatgatataaacctctgttgcctgagtgggaagttggaagaactgctatcttaggcttagagtcactctaaaatacaaatacattctaaaagtctaccttcattgtaaattttcactgagatcacctcctggtgagcacaagaaacctactaaatgcactagattcctcagaaatctctgaaaggactgtaaatcaaaataactgagatatggaagaaaatatagaaccaaaagtttcactgctaaataaatctgttaaataaatcagatggctgaattctagagtgggtctgactttaaggtacactcactggaacttact

SEQ ID NO: 24 - DNA, 1550 bp, Mus musculus
tatttaccattcaaggtgatgtacacacatgcacaaagcaaagtttgtaatcattctcactacttctcatgagaatatgttgttgtgattgtgtagaagttgggaggtgggacttccaatttaaatgacccaagttcagtcacatcaacaattctgaagacaaatttgattatgaggcttaactttttaaaaagagctttcgtaccatcatcactgaagtgggaaatggaggcaacaaaagtgacctcaaaatgctgctttgagagtctaatataaaactgcatttgataaatgtttcctgctcaactcaagaacataagagtacacagaacaactgcttcagaggtgattgttctcggataacaatgagctataattggccactcaagatctttagatccgtcaataaaaagtggggaattgatcatggtaagttggtgtgactatatctgcccctgtaagcttatatattttttagccttttataaatgtagagtattattaaaacaaaagcagctattgtaaatgcaatcagtcttttaaaaaactgaatcaattggtattttaaaagggtgatgactaaagtgataaatatattggcaatgactcaaaatattttttaaaaatgtgcacagcccctgctgttttcttaggaggccttgcctctagtcagggtgaatgtgacagaggacagcaaatgacaagaggaagcagagaaaaggagccctttataggctacgatagtttccggattcaatgaccccctagccaccaccattcccaagaatgacttttcttgccccgtgctaaatgcatatatgtcagatgccacagggcaaggcatctatgaggctcatgaaaatcactatcacagaaagtgaaagaccttctggacaacattcaaaagtctaaatcactcagaatcaatacacactgagtgagtagctggaatacgcctcctgtttaatcaccgaaaagaactgcatgaaggtaaaagttaagttaaatttatgaatttttattttgaagtattctggcagccagtacaattactgtaacatatctagcatgacatgaacattgtctgattatttgaaaattttcaaggcatagtgactgaatctgttcaattctttgtttcagaccataacttaagcattcacaatggccatcattttatatattagtctttgaacaaggagagtcctagctacaaggattccccaggaatttctgaaagtatcctctgaggctaatgtaatagttatatcagcctaactttgcatttacaaaaatcaccctcttccaatacatggactgtatgcatattactcacactttgaaatcatgtgcaagcacagaatctcttttaaatacccaattagaattagacttctgcagatgaccactctctgaatatctgaaatagccattaccaatattcatgctagggaaataaatgaatccacgttcgaacctctcttaccatgtgaattttaagtgtcaggttaatcctgacaaagggatttgccacgcatatatatagtgtg

SEQ ID NO: 25 - DNA, 1550 bp, Mus musculus
tgagccaccatgtgggtgctgggaatcgaatgtgtgtcctctgcaagagcagccagtgcttttaactgctgagccatctccgcagctcctgcttggcccactcccattgtgcatcagctgtggggaggatgagtcttgcactaaactgaaatgttcctccttgtaactgttccccagagcttcccactcggcacctgttagctcctccctccgccacatgatctgcatgcagggacttcacaatgccatctggacacagggattttatgtctccaggtagagtacctggaacctttgtgatttttctagatgatgcataccagcaacatcgccctactgtctggcttctcggccacaatggcgatgagcctggtaacagtgatgcagccccagtctggcctgggaatcgtttctagtttgatctgaatagttgactttcagagactgacacttccaatatattgcttttttttttggcaagctgagcaatttgtgctaaataaaagccaaaagctttaaaatgtttaaaataaagacccagtaatctgtattttgccctcttctccctacctctccaccccttccctttctcttccttttttctttccattttgtttgtttgtttgtctgttttcccatttggttctaaagaccaaactcagggcattatctattccatgctacatgcatgttgtcactgagctaaatccccagccttccctgaaccctgtctttcccttctcgtctcagcatggggagaggattctgtgcaaatcccttagcagcaataaggccagattacaaaaggagccatcacccacctcataaaggaagagtggggaccagaacacacctggttgtacttctatgtgagataacaactgtcccctcatttggactccgagactgtctccagaaccggtcacttcctgacaaccacttaaaagctcttaagattgtgtaaacatatcttttctctcctcctcgacagaaaaagagacacctaagtttccaagtaacatttggttgggtaagtaatcacacccctgtgatttcactcacacaggggttcagccttttatcctatttaatgccccttggtttattctaacaaacttccaaaggacagagggaaatctcccttgaccccctacatcacccagttagaaacatctgtaaaagtttactgggctgcacacttaagctgtaggcattttatcatgtataggttataccgtaataaagtcgtaataaaggaaagcaagcaagaatgaggtgaatacttcccgctccccaaatctgtactcagcccccttacagagggagactgttgggtgctgtactgggtggggttttgggtggaaacatcaggtgaggagagaggaacagccatgtggtagactctgcaaaggggacaacttgaaaagccagagggagcttctgcctggcaagatgatctaggacaggggatgtgggaagcagatgtggaaggtgagaggtgtataggaaggttagattcatcttctctccttcacagcttctgtctgcca

SEQ ID NO: 26 - DNA, 1925 bp, Mus musculus
accactttttgattggctttgaggccttctttgcaggaaagaagttataactggtatgatatgcctattggggttaaaaagatgactcagggatgaaaaccaatggctgctcttctggataacccagatttgctttctagcacccatatagaggctcacaaatggctataaatccagcacgaggtgatccaatgccctcttctggctggggacttccacaggcaacaactggaatgtgtgtttgataaagtatggcttttgggagcagctttatccattcacacacagtatctgcatgaaaagtctgtgcgtatattattttgtattttgattaccagctgtgattaatgataaaagaacatgccaacaccttgctgtggctttaagaatgactcataagacctcacccttccctgaggatcattactaatgattgttggaaaaggggacgattttctttagtggcataacctctggcctcgatgagtatacacacatatggtgcagagtcttatatgttgacaaaatatccatacatataaaataaaattcaaataacagataatacctgaggaattgtagactcttgtagggatgcttttgctgttgttttgataaatggacattgcatgacaatgacatttcattctaaataaccatgtttatgatgatagattggtagtgctatcagttttggtcagagaagcctgtgttcagcagtgtctgcagacacccataattgttcataattctaaaaataagtgactgctgaatgccaagctataaatgggacagctatagcatctcctccaagctcaggaaacaccacagaaggagaggtaggaagaatataagagccagggaaagggagtaggcgatgtggaatcctgacttctaggcatgccatggcttttgtactcctatactcacagcagttatgatgaacagcataagtgcatgccaacaccttgttgtggcattagcaatagctcatacccacccttcctcgaggatcactagggaagggaatgattttctttagtgaaatagccccctggttaggtgctcatgttcttataaacaaattctcccataggctattataaacaacgtcaatactcatgggaatgtgggggtggaaagggggagagggacagacagatcttagctgcaaagaggaaggtgattagtgggagtaggaggagcaccacagagagaaatatgatctaaatgcatttagcacatgtatggaaatgtcataatgagatccattatcatgtataattaatctatgctaatagaaagcacactttaagataagaaaaatgggaataagtaccaccgggtattattgaatttaggatgagaaattgtgggctttaaattagaaagttttatgttttgaaagtttcagccactgagtatttctggacaagaagagagcttcatgttaaggcagctgagttttctgattgattattgttttggcatttaaagtcagcagatagaggtttaattgacagtctactccatttagggtagaacttgggggaagacttttccagaagaattttcaaatcaggcccctggcagagtttgcagttagcaatagcagcccaagtttaagtgattgctgtcttgggacactgctcccccaaccccaccgcacccccagtaaccactgccttttgatgtaaccaatcagtgggctatttgggctacagaaacaaagtccttcccaaattcataatctattccgcaatgtgatgatattagggggtaagacctttggcaaatgaccagaacaagaagacacagcccttaagaagaaaccaatgttttatgaggaaagataagagcacaaggcttctctctctgttcttgaccttgagatgctacaagaagacagcaacctgcaatcccag

SEQ ID NO: 27 - DNA, 1525 bp, Mus musculus
gaggacaaatatgcatgcataaatttgtgtcaaatttcatctgtaagtaataatatatattcatatttacatatccagttcatatacatatataaaattttccttaatgggttcttaattttatattttcttataacttagatttaatattaaaaataacatgacatatagatactttctgtgtaagcaacctgcagcatgatttctgtatttattttgaggacaatgttgagacagcacagcagggttaattcttatcaccaagccccaaaagtgaggggtcaatcttggaaccctacatggtggaaaaggtgattccccatgtgagcttctgcacacacacacacacacacacacacacacacacacacacaaccaaataatataaaaagaatatgaatgtgtttctgttttttcagagggggctctgaatgaccaatccacagatccagctatatgaagaaccttctctaattctacaatccatctctagcattaaatcatttgaatgctgctgtggcagatttttttagtgaggtaatatgtgaaatatatttatttgtagctatgaaggaagatacgacaagaaggcaaagaacacccatcacttgcttgaaatccactaaatgagcaccttcagatgagcaccctggaatgaaagaagctaccctctcagcttagaaccaaaacatcttacattcacaaggcattgtaaaaaagacatttgctctgaaaacaagacaggggacacaatgtctatgacattacatgaaggtatatttgagtaatcatatagtttaacagcttactctaacatataaattaattaataatatttttaaaaatacaaaacttttcttacgtttctaagactcatcgaatgaatttttcttttcatggccttttaaaaagttaagaacattacacacacacacacacacacacacacacacacacacacacacacacacaaatatacaccacataaacacaatgcttgttgagtcaaggtcttaatactcagtctaagcttgcctcagttcaccacagctacaaatacagagtacaagagtacatcactgtggatgcctataaaataaaactgtgtttcaattgtctgacaaaagtcagactgggtcctaaataaatagcacattcctcttaactgtcagttaggtaagtgtccttggacagcgttctgtggttctcagagaaagaaagtatggactgtatttgacacagttgttaagctgtattggtagtgagcatatctcaagatattgatatcagcattttatgtatcctcaggtcctcttggcaaaatttgtcagcctatgtaataaacacagagatacacagaaatactccatcctgttatacaatgagacaccaaagaaattttctactttgtcagagcattcaggacagtgtgcatcctgaaaagaaaaaggaaagctacatcacaaaatgtttgtgttttgcagtctttgacagtaataaacactacagatacttgagcacacat

SEQ ID NO: 28 - DNA, 1525 bp, Mus musculus
tgcacacacatacatgtaggcaaaacatctgtacaaataaaatacgccaatttaacaaatgaggatttgttagacctgcaagggtttaagtattgttctcttattctatactcattgacatttgctgttttcttcctactttccttcatgtacttcttcaagattgcctcactagaagacaaaccacattaactatgtaaagttctctaccactgcacttcagcagtacttggtagcctttgggaagaaaggtgggttgttttttttttaatttttgttttttgttttttttttcacaaacatcagagagcaattttccctctgccaaaaaccagtgaggcaatttcagtagtgccttcagcacatttcaaactcctcttctagctaacaagaccaaacatctctggttacctgaaagtgttttcaataaagtagaataagagagcaaatggctaatttttttctggattaactcaagacattagttgatgcttttttgtggttaacctacttaaagatgatcaaatcactttgctaccgaggagagcaactgtaaagaactattacataaaaccctctgctccaacttacctcatccttcttcctaatgaaaacaaagaatcagaaaccactgccttgaacttcaggaatctcagtaagcctacttcttagtcatgtgagttccttttcttctcctcaataatgacagcaatttcttttacctaacgttataggacattattgtgcatttgttttaatattgtgagtactcaaaagctgggtatggtagcttatgcgtataataccaccactcagaagtccatgacaggaggatgatcacagattttaagccacccggggctatatagtgagtttcagttcagcttgaaatacagtgtaagactctgtctcaacaacaacaaatatgaccgctcagttttacaaactgaaaaagattgaggcaattcttgtatagttcaaattgctcatgctggaaagttatataaatccctatttacaaatctgtgatgtaagtccacagaactctcaacacctaagctttgttgataccttctctcacattagtctctgacctacactaatgcagttatttatagtctttagagcacttggcttgattgcagaaatattaacatgactgattcctcatgatttctcttaatgtcagttggaattttataccacctgtatatacgttgtatatatcagttttccaaattcactttttaattctaaattactctagcccaatgactgtagaagagattatagatatacaatttaagtcagtgaaaaatactataattctctgaagataaggtagtaataaaccagtgaaagaaattagaactgtactaaaataacataaaataaattgttcaccactgccgggcagtggtggcacacgcctttaatcccagcacttgggaggcagaggcaggcggatttttaagttcgaggccagcctggactacagagtgagtttcaggacagccaggactac

SEQ ID NO: 29 - DNA, 1750 bp, Mus musculus
ccaaagtgctataaatctgctaattgatttctgtacctgttatgtttgattaggtgtattttattgtcttcttggttttaattaaccctgggcttgtcaaaatgcttccaacgacaaagaatatatgatgaagtgtgataaactctattaacacaggctgacttttgtcagtaattgctctcatgcacaagagttattagaaattagcccataggggagaagaaaagaagccatacttttggtaacaatttttatggccaccataaatcagcggatcggcccctatgtacagacgataagcaactgtgagtgaccatagggccctatagaagatcaatcactcactggtgtcatataaatatcagtagtgacaatatagaaagaattacgaagtctggatgataagagcaaaaattataacaacatccctggctgtccacattagacccagagcatgagcataagaggggaagccaaattgttaccattgaggctgacccgaggggtcctggatggtgcttatgcaatccattcaagactaagaactccaacgaatccatcagcttctcagatgatgaggatagtttttcatactaaaatcattctcatcataacatcctaccaaggtgcccatatagatctttctgttgaaaaagccaaagcaaacatttgtattcttctatctactggtctagatagagaagagcaaaaagactgggtcgtctgttgttgcagttagcttgtgttcttcctgtagcccactcactagcagcataccatgagcttttcatcttggaactcccagcagaagcatgcctccagaaaaaaaaataataataaccatggaaaattcctcttctgcaacggtatcactgccagaaccccgaacctcttcatgtggaacataatttattacaatcaggtgactgccttatcaggttagagaaatacctgtgatatctgggcataaaaagaaatcttgatcaccttccccaaaccccttctcacttcctttctcacccagacatgaaaggaacacaacagcaggtgatatattttcaagtgccaacggggaagaggcacttctctttctgctttctcttctattctctgcttttagattgctctgagatgggagagggtgtgcttatttctgttgatctgcatcagctgggtatgttttgttttgttttgttttgttttagtagaggttagctaatcttaatttgatttttttcaagtaaacaacttttgggttgactgattctacatactgatcatgacatacacagaagtccatctccatcactgacatacacggaagcccatctccattactgacacacatgggtggtcctctttataactgacatagaaagttacctccatcttcttctcctgtttgtttctcttactttttcttatcttattgttctaagtaagtcttcaagcgctataatgtacagaagtggaaagagttgctacccatgttttagtcctcatcttaggaaaaatgttttgaatctttctgcatttaatgatgttggctatctgaaaaatgaaaataatagcacatagaatcaatcaaaagttgtttctttgaaaaacaaaacaaaaaacaaaagattagcaaggttaaaaaaatacccagctgatggacatcaacagaaataaacattaaaaaattgaggaaaatatgcaagaccaaggaaaaatgtaaagtaagataatatatctttgtcattttgat

SEQ ID NO: 30 - DNA, 1825 bp, Mus musculus
tagaagattgtacgtggagttgaaagttgtctcttctgagaaaagagtatgtaatggtctcctttgtaacatttattggcctgttaagtctttctgtataagaacccccgaagctacatccagttaacaaatcgagcgtgctctgtggtgctatgaaatagatagtaaaacatactttctgagtgcttaagtctggtgcctattctaaccatatgttttactaaaatctgcctgcctgcaaaagagcttaagctaaaggcttaagtgttttcttaatgctgtaagagtgaggccttaggttaagtcacaggtgtccttacaagtgcaactgtctgcacacagacacatatatgcattacttgtctctgcctgtttggagacagggtctcatgtggcccaggctggctcccaacatttgaggtagccttgaagttttagtccacctgccggcccccctcccctctcaagtgctgggattactggaatacagcacaattcgggtttgtttgtattgaggatagctcacaagagtcttgcatgtgccaggtgacattctactgctgagctacacacaccccggcccctagttttaaattttttaataattagattctgaaaaacgtagttttggctgaggtacaaatgtgctttaagccagtttgtgctttatgcttgcagtaaatgcctacaaccatctgggcgctgcagagtctaatgagaagctcgggtttatggggctccctcgtgtcatcgctgagtaacagcccgatgagtgaggcttccctgcccttgctgggtagtttggccacacactgctgcctgtcactatcagtccctctcctggcatctgcctgaactctgacccctcagggcccccttctgatggaagctcttaactacctagtggtagggagctggcatctttctctgctggcttttctcactctgcatggctcagctgggcttcaggggaacttgtttttacacaggcagcctcttgttacgtttagacatagctccgtcttatgtaatgaaatgaagtttaactctgagagaaggaaaatcggctccagcgtttgagctcataggtatagaggcatgtggaaatgaaactttctagacttgaaaagctcttttcaaacccaagaataattttgctaagcaatagcctaatagctgaggcattgctgggttttcttattaaaaagaacgtgacccattgttggcagcgctgtccccactgtttatggaagaaatcacacacatgtatcttcatttcatagatttggggtttttattttagtttttattccacttattctgggtgggtttggatgcatctgcaccagaggtctggggacacttatgggagcctggggtcaagctcacattgtcaggttttagcaagcacctttacctactgagccaactcgggtccacattttcagttgtttaagagagtttctctgtgtgacttaggctgctgtcacttaactagcaatcctcctgcctcagtctccccagtactgacatcataagtgtgtaacaccacacctggtttagttcatagatttttataagaaaaaaagctagttctatgcagtgtcagacaagaagttagggctactcatttatcctcacacttaatcttttgtgactgacttccactgaattccaccataatacaaacgcaggtaaggtcgggcttggtgcacatgcctttaacctcagcagtcagaagcaggctaggagtttgaggccagccagatctacatcatgagttccaagccaaccagcatagcgagaccctgcttcaaaactaaac

SEQ ID NO: 31 - DNA, 1575 bp, Mus musculus
tctgttgtcttcatttcagtcactgtctgtctgtctgctgtcccccattctttccattccagtcttggcaaggcctcattacacagcccaggagggccttgacctcataactctatcttagctccacttccccaacctctgccaagtgctgggagtccaggcatgagacaccaggctgagctctccacctctaaaatgagggaatgaatagtttttccttaccagctttattgagagactcaacctataaagatgcatggagggcaattagcagggcacttaataagagcctgattaatattcactgctagtcagttccgtgtctgctcaagtttcccagttttgagggtttctaagcacatctcaaatataatctcatcaatatacatgaagttccttgacacacgtcaaagcagtcaattatatatatgtgtgtgtgtatgtatgtatgtacatatgtacacacacacacacacacacacacaaatcctctctatgtataggtaccaagaagtggaactggttcccacaaagtctgaacataggagaggggaatagtgcatgtagtgggactgtgttggctgttgagagaattagaaaggatttctgcaggtagtattttcttctccttgttcatcctgtaattgctgacaggcaggtatagtgggctgtccctcccccttgcgttctttcccttgagtctactgaacgatagaagtgttactagaatgtgaggtgaaggggctttcctacttgcttctgtcatcatcatcaaacaagagacctccccatctccaagactgtgcaataaatgggggacagggtccctctgggcacctatgctcttagacaggaatgagttgagagttgagtacacagtgaggagcttccatgctgctctcctctagctgacatacgggacttaagaatagctccatcagatgcgtgttaaattttatatcaagttaccctaaatatagacagactgtgtggtgaagactggatgcttggatttagattcctgtactgccactccctttcaggctgagtctaggtgaggcattaacccttgtctgcctgtggagatgtcctatccgtacttaggagatgtggccacaaaaggcatagatgctgacatgagcgaggatgtatctgcatggcgctggaacttgttagacatgtagtaaatgatttctgggtaggatgagcttgtgtttaaggacagttacaatttccccttcagagggcttccctgagaactaagcacggatccagtttttagctctcatccagcatatagctttatatgaacatcattttctcccctagccaggattccaactcaaggtgtaggacggcacctctatctgctagttagttttgcttcattaaaaacacactaacattttgtgaactgaatggctctatggtcagcataacattttggactgggtttggctggctcacgtgtcttggaagggccagctaggagtgtaggcttgtcattttcccacactcttgcttcctccagtgggatagcctatgcctattgagatgctgcttgcaaactcccat

SEQ ID NO: 32 - DNA, 1925 bp, Mus musculus
attataagatccatttctcaaatgaggaacccttccaaggacacatagtatgtgtgtgggcagagccagtctttatttaagcctaggtttgttttcattccaagtgtgaactcttaagcacactgctctgtctaggaggaagtatcagagggtcctcttgaacacaggcgtatgaagaaaaagcctcaacaccagaaacagaaggcttcaagggcttctctaaatacaattcattattatccagatagggaaattgagtaccatagtctttggtgtcatgcttcatagcagagtcaaaccagaaataaattgtgtttcatagtctgttctttgcctcatgggtctctgtatttgaatggtggcattgtatgctgtgcctgccagctacagaatgtctgtcagtcacgcattgttggtgaaagaaagaaagaaagcttacttcagaaacatagatgatctctgtatcctgtctttctctcatataactttgaatttatgaatctctggaaaagactcccatgaagtgatagctgaaatatatccatcgttttaggcattctgcaataagttgctaaatgtataatcttgacacaaactgcttgatgaaaagcaagtggtttccatgacatccaagacagcatctacagcatgcaaacaccttcctaatataggttttttttcctagtaaaaatagaaagctgaaatatcagtgtatttaggttggaggggggcttgaaaaatgaagacatttcactttcttcaaaaccactattttaattcttgccaatgtacttgcagtcatccacagtattcacaccatgacatttgcctgtttatttgaggcctgtgttgctgaaagctattaatagataatgattagaactactttgtagtcggtttcatggggttgatgctcactctgtcaccgagcatgtatttccttcttgtgagaatcagagactggctgaataaaaagaatctaaatcacccagaccttgttcttcagtaataacaacaacaacaatacacacacacacacacacacacacacacacacacacatgttttctgcatggaacagcaaggtacctacccagttgtatttctatgtgtcttttagtggctattccaagattccaaggataaactcctgggagagataagaacactatctaattacccctaaagaatatatatttctctcccaccattttccatcatggtaccttatctgtttcctctgggagtcagcataggaaagaggagacactgacatgcagagtctgtcttggcatttacagttgttcgatgtaaacaatattactgaatgtcaaacaaggctcttatgagaccttgacaaaacaaatcaaaccaaacctacttcataaatgtaaggctagacaagaacaaggctaatgtgtggcccactcaaaattttacctctacacttaactgtgcagcttttgcttcttcaacactggcaaaagtacctccgtgtttagcattgttcataactgagcctacactccaacctaccagtagagagaatctgttatacgcatcacttatcaatttaaaaagagcctatggccaatgagttggtgcaggaaataggaggtggggcatctggcagagagagagaggattctggtaaatcgtcaggagcttggagactctattggaacatagaggaggtcagaatcatgggagctaagcagagataaccagccatgtagaggaattcaggttataataaagaggaggttctccctggacatggacccatgaaactgaggagaggtaacaaaccatgtggaggatataaaatagtttgaatgggttaaataagttatgatctagtcagggaatgagccaaagcctgtgtcctaggcatttaagcaggggctgggaggaaaaacttgaat

SEQ ID NO: 33 - DNA, 1950 bp, Mus musculus
acagacaacagagtgggcagcccactcaactcagagtttcccaattctttcctagcatgtttgattcagacaagttaatgccttctcctttgggaaaggagaagaatactatctaccatgcagatagacgatgtgatcagtggaagtgaacatcagggttaccatgatgatcatcagcagtttaacaagaatctaaccaagtgcctgcctatcagtaaaatgagcaatacagacaagggctcactcttagggagttgacagtctagtgttggtgggggaggagcgggggggagagagagagagagagagagagagagagagagagagagagagagagagagagagaacaagacatagagataaaaagaacatacacaaaattcagaggtagagagtaaagaggacattacatcacatccagggatggtatttgtgcaaagtattgttttcccacgtcctgaagaagagaactgtaagagatagtgtaagagacagtgcatttttttgcaaagaggacgacatatgccaagctgctgagggaggagagtgtagccgtgatgcgttccaataatctgctatggaacaactggcatgaggagaaatctaggaaataagaagagtaattatataacaaacctaattctgcagtagggaatctgtggtatttaaagaaattctataattttaaaatgttccaacttcagtccatgagtttaggagaaatgttttcaaaatgaactcaatacaaattcccctaaagaggacagagggaaggtgactggaaacagctctgctgtaagtttatgtcatgcattcctcaatgccttggtcttatatcctgctctgtgttccttgatttctatttgggatcttgctctcttattgtggtttacacataccaggggtgctcattaaacatgtatttcatcagctcctgtatagagatggtcttaaatccttgcatatgagtccaaaaaagtacaaaatttcctgcacacacacacagacatgcacacacacacatgcacagacacacacacacacacatatgtacacacatgcacacacacacacagatacatacacactttcacacacatttctattaaaccaaatctctgtactgtctaggcaaaagtgctagactgtaaccaaccccccactggcctatagatggatgctctgttaggttcctttagagacagctctagatggttttgttgaaaaataaaaaaggattacgtaaaaattcttttctaaacttttatttctctctctataaaaagaatggatgggaaaaaattggaaccttttatgtatgtatgtatgtatgtatgtatgtatgtatgtatgtatgcatgtgttcatttattgaaataaggttttgctacgcttcccaaactggctggtaaagcctgcattcaagtgatcctcttccctcagtatcctgggtagctgagattctggcatgttggagctgtgctatagtatctgggattcatttttattttaacaataattggcctaactgctacaatacttcgagaggtttcacatgtccacatctgtgttgtcctttatcagcagtcagtggctccattgaattacctctgcctgtcaacagaaggtccaggtgtttgtcagaaaagttttacatacttgggattagaaggaatctcgaagtcaggaaaagaggcaatcccggtgagattatttccctctattgtgtcaacttgggacccttcaggatcctgtggggaaacaaaacaaaacaacaagaaaatccacccctgccttagttcattatttgttatcaaagaatatttggtgccaggtaagctttaaagaatagagatttatcttgtcccacaattctggaagctggagttggttgaaagaagcccatactgaacaggagagccatacgacttcagctctagatggaaaaac

SEQ ID NO: 34 - DNA, 2125 bp, Mus musculus
gtgtggggctgtcactctcactgtgcaagtgaggggcctaatgaaatacagtctaaagaacttatctgcctcccttagctggttgtccatgtttcattgactagacaatgacctttggtccctgatactttcacatcctcagcccactgtaaacagttgccattgtaaatggtaacatttttcttagtaactcataaaataaccatccatcatataaatagtagcatcttaagagtcaagaaaataaggtaatgcttgctctatttctgtagtagaaagaaaaatgttttctaatttgtgaaagatcagtttttcgctataaaaaaaaacctgaagctttagctttaaataagtgccttgagtagagagagttgactgttctaaaattcaaggtatttaaatatattttgttaaatatagttaccaaaaaataagatactaaatcagatcatcttacttaaaaaaatgaaaaataataaagtaaacttaagtctttagggcttaaaaagcttgctttccccaccaccaccaaaagggtagaaatgacctttaaaattggcaccaaaatgtatatgaaataccacacggaaacatcccttccagtcagaaacctcaaggtagagcatttgacaaaaggggtgcttttctgtcacaaacagtagatggtagaatgtgaaaagcattaggaagattgccacctaaaaacctttctttgacaaatggctggatttcatctcagaacattgtttttctggattaaaacagatttcaagatgtacttttgcacaaagctggaagtagtggcacacccttttaatcgggaggatctctgtgagttcgaggtcagcttggtctgcatagtaagttctaggacagccagggatacatagagaccctgtttcaaaaaataaaataaagtaaaaatgtgttctaagcagccctaggtccctgtggatactcttcagagcttccacacatttttttaacttcatttccacttcttcaacttgtttttagatgttattaaaattaaaatgatgagcatgtgaaagtgctacattcaaattctgaaacaattacaaaccacgccttaacctgtgtcacagcacatttgtacaggcctactctaaggaaaggaagccctaactagctgttctcattgcttctggtccgtctttcttcctggaacatatttcaagcagacagcagaaaaccattgtatcactgcaataacttgccgtggacaccaaagacttacacatgcatctgcattaaaatgcacagttctgagtgcttgccttatcctccaagcagctttggaacagctgatcaattgccttcctccttcaaacatattcttcctttccgttccaggagatcccctctgatggttctctgcctttcttactggtgcttctctgctgaactcactcttgaacctgatcaagactctgctgtctatactcattacctagatgatctcattcagtctcagggctttaattactgagcaaatgctggcaagcccctaaatcctatcttcaacctgacttcttccctgattccagatttcttaagcctactcaacacttatgcttagacacctcaaacacattttaatttaacatatgtttttatttcccaaaattctacctcctgaactctaccagctatccaaaccaacaaaacttactttctctgacctctttatatgtcattgccaactagtcagccagctctgcttgctgctatcagattctactaccaaaatgtatccaggtgagttgggaaattaacattttttaaattaggtattttcttcatttacatttccaatgctatcccaaaagtcccccatgcccccccaccactctcctacttaccctctcccacttcttggccctggcattcccctgtactgaggcatataaagtttgcaagaccgaggggcctctctttccaatgatggccaactaggccatcttctgatacatatgcagctagagacaagagctccggggtactggttagttcatattgttgttccacctatagggttgcagaccccttcagctccttgggtactttctctacctcctccattgggggccctgtgttccatcca

SEQ ID NO: 35 - DNA, 1750 bp, Mus musculus
aagccatccccatgagagtagcaatcactggaagtccttactgtaaggcgtcattctgttttaacttcaaccagctcttggatttcatcttgtgtctggcaagaagatgccatcagactctgtcatcttgtgtgtggcaagaagacaccatcagactctgtcatcttgtgtctggcaagaagacgccatcagactctatcatcttgtgtatggcaagaagatgccatcagactctatcatcttgtgtgtggcaagaagacgccatcagactgtgtacactttggaagaccatggttaagccatttttggatcacctagtctaccttgctcccctttcagtagcaaatttcctcaaatacgccatttagtggctctctggattcattccaaacccgcaactctcctgaactgtaggagccagcaatctagcagatgggggtgggcgggggaggggatgacaaagccttgcctgggtggaacttaggggagtggcaaagcctccccttggtccaagacagagtgtttagaagcaattgacccatgtatgtagaaactaccaaccacaacttgctcctcctggtgtttacagcctgagactgcttccttccagaaacctcagaagacctcctccttgtgccaaacacaattgtttgagtagtctaacaggtgccctctatcaaggtgagcagagatcatccaatcctagcttttctgcacatgtccctgtcatttcctcgctgtctgtcatcccttcattccctgtcaggattccaggacaaagccgtgtaggaccaggtaacctctcttcctcaacagccctgttttgagaccagtttcccagtgcgcatagatacacaaaggcagcaaaacatataccaggtccaagaactaaaaccattctcattattaaacatgcagctggccctctgacctttgagcagtcttccaccgttaatgcaacacatggaatactttccataaaaggttttcctccactaaatgatagcaccaagaagtgagcaactttatttttatggatgcaattgtttgaacataaaggatcccccagtgattcataagttgaaggcttggttcccagagcagcatgttcaaaagagcttggatgatgagggctctaatctggttagtggattaatccattgatgaactcatggctgattggggcttttgaaggtggtagaaattataaggggtgtggcctagctggaggaagtagatctttggggtcatgcccttgaagggcttactttatctccaggcctttggtttctgttcctagaactgtctttctgcttcagctgccatgaggtcagcacaccccaacccccacatccctaccccacacccccgccatctatgactggtctctgcagtcaagtgaccacaggctgaactctcagaagccatgaagcaaaaataaatcttttctcctttaagttgattttctcagcattttatctcagcaatggaaaactgagtgatccaattggtctctctactttctcctgtagttaaagcaaaataaatgtgaaacaaaaccaggaaattccatcactcctagtatcaagaatttaaaagccagagagatggcaactgtgctagctaccagctaattgaccacttgagctcagttccctcggctcacaaggtagaaggagagaattgaccctgtaagttgccctctgaccaccacaaacacacccacaattaatcaattaagataaatttt

SEQ ID NO: 36 - DNA, 2650 bp, Mus musculus
aaattgcttatacttattgcttctgtgcactaggcatgtccaaatagattagcatatacttgatatttatcttgacttatattttattattcccctttagaaactgaggcacagagagaataatgaccttctcaaggttgcctagaaaggaagtagcagaactcagctccaagccacaccgagtgctgtggttccggcatcaaagtgcttaatcacacacacataacacctctcgaaaattcttaatttgctacacatatttatcaaatcctgtgatttttagtttcctgagtaggaggggaggggatttaaaggagagctgctcccaaaaatgttagaatcaaatgatgtattgctgtgtttgtttcttaaaattcttttcctgtcttcatgaacacaacaaaaagcacccttacccagacagacatcaaaacccgagtacttctgaaatggtttgtcctcagaatgtttgacgattatagacaaccgacgtgggacaacccaacctaatggagatggtccgaactaaatacaaagctcaaagcaatggcgcagcctagaaatgctatctgaaaggctaagcctttggatttttatactatttggaagaggattgggttctgttaataggacagacttcgtgcaacatatgttaaggaaaaaatttggaagcactttaaaaatacaagcttggaagcttaagcttgcaaaaaaaaggggggggggacccttaaaatgttttggagcttttaggagaaagtcaatattaaaattagtaccgagcatagagaaaaggctctgtgagttgagtgactgttgtttttctaaatgtcagcatggaaacccaaacagagagaggtgagctgggtccctggaaagactgactgggaaacctgaatgctttttgtgacatggatgatggcaaccaaaaacttgccaacagtgggatgacaaggtattccctggctgtcagggtgacctcaggtcatacttgggggtactattgaatggctgtgggctttaaatcaggaagcagcagatatggaaaaatcctaccaactcctgagcgatatccccagagagagctctttggagtctggaaaacattcatagatagtttgaagagagctttatgctaaaatgacagtcgtgtaaacagcacaggaaagtaagcaactttaaacataacttgtggtctgcttttatttttaacagcatggaaaataaccaattttaaaacataacctgcactctgttttcacttaacttcatgatatatatatatattttaaatataatgtttggactgttaacagaagctaagatttttttcaccatggctttagagccttatcctgaacacagtattttatttagcagtaaactttaattagaacaacttcctctaaaggtgcaaccacctacactgagaaaagaaaaagaaaaaaaaaaagctctagttaaattctacctgagtttggccctaatttttctcatctgtaaaagaaaggcgtgtgctacatgctctttaagagtttatgggaagcaggtagaaacatccagcttcaagcccaacacttgggaagcagcagcagtagactggagagctccagaataacctgacttcattaaaaaaacaagacaaaacaaacaataacaacaaaacccttactttaaagaaaaagacagacacacagacagacagacagacagacagacagacagacagacagacaatttctgtctatagcaaaccatcattctacccaaggcttttcctcttctgtgtataatatattggcacatacattgattggagagtacacatgtaagtcaagggctatgtattaatgagccttctattttttgagacaaatacaatgacaaagggactcattgaaggaagagctgtattggggttatggttccagagggatagatccatcttgtcatcaaggcatggcagcagaagcagaaagctaagagtgagctggaagtagcttttggcttaaactctgaaagcctgccttcagtgactccttcagtgacttacttccttcagtaaggtcaccaccccaacagtgccatcaactgaggacattgttcaaatgcctgagagcagttcttatttaaaataccacagaggttgcctgggtaaagaggatcccatgtcctctctccagtctcttctttaaggtcttgtagcagccccaagccagagtaggccaataggactggcttctgaattagagtcttatgtgctgttgaggaccttggatgatctgccaaactctgagccacccacctcccctgtgaagccataaacatagcaagtttcctgtgttctagagatcccactttacagcttctccattgtgagtggctggctgcataaaaagtataaaaaggacctgattacctgagagggaggggggagagggagggggagagggagagagagggggagggggagggggagaataaggaaccgtggtttaaacacagatagatgttcactgactcctcccttgaggaagagctctcctatagagacatggagggctagggatgtatgcatggcacacccacacataatatacaaacaaaagaatatcacacttcagaaagttcccaccctggtaaggccata

SEQ ID NO: 37 - DNA, 1700 bp, Mus musculus
gtagaagcagaagcagcgtaggccaagaaaagctttctttttctgctgaccttggcattgaggaaagagaggactctatgtataacacaaaaattgagagttatctgcatcaaattttccatctactagactacagagaataaagctggaatttgaagcgttaatgattaagaaaagaattacataagaattgagaaggaggcaagcagagacatgattttagaactcatgtttacaaatgatttctgagggacatttgtctccgctatttcccttgggacagggcaccataacaataaatacaactcttttctgtctctcaaagagagctgcagttttttttcctactaaacacaatcaaatgtaagcatttcagtatcagattataccagtattagttgcatactttagcataggtctgagaataactcaggtacgcctgacctcaaaacgaagcagttttgtgttgaccagagcctaaaagcacaacccccattagcattagatgcaagtatgaaagaattattggctctgagccactaagtaaaaagtcagaggtaataggtacaaaggtttttcaagcaacaatacctaataaatcacagagacaaaaaaaaaatcaaaaccaaaaatcatgcagtaggtaacaacagccaccttcatcaatcagtaaaacaattctgtttttaaattccactacagtagctaaaaaaaaaaaaaaaaaaaaaaaaaaaaagatttgtggttaaagctctgctgtgcagtagtctgcccgcttcccacatggaaggtggtattttgaaacaggaaggacacaggtgtgcttcatttgaaatggaattcattaacaggctctatgattttattctgctcctacaatgtcagaatggactgataagctgcctgccacacttcaggcagagggaggcacagccacaagagttttaaaatgaaaaggctgaagagctaggactacacacaatgcaccccgtgcctgctgatttattcaggaggacaagggtaaagatgatcttgtcttaatttcagtgcattttcaatgtgacagagccctgaatccagtcactaaccccattaaattacttgccaagggctggaccctatttttctttggaaaaaaggtgccaaggcaataacataatttgtagtgctgggtttctaatatacaataattctgaccatttaaaacagtttttataggaaatattttatagttatagaaatagtttttgacattttgggggggaaagaacaatgggccgtttacaggtctacacagtagattaatgaatctaattgagtctgtagggaaatgtttcagtttaactactggaactaatttatacattcactacatcgtaataagtcaatttaagtttctggaaataaaactggatatcctgggtatagatttgaactataaatttctgcaagaaaggagtctgtgtgttcattatacattgtaaaattaccatatggacctgtcaacacttcttagcacagctttgtaataatgtcatttagtttaacattgtaatgtgccaactgaattaatgtgtatgacacaaagcatgcctccctcccaacctctgcttctggggaactgtgcaacttttaaagatttttttttttctctcaaggcaagagcctcctacatttgcatagggaacttcaagatgaag

SEQ ID NO: 38 - DNA, 1500 bp, Mus musculus
ctctctctctctctctctctctctctgtgtgtgtgtgtgtgtgtgtgttcatgtgtttgcacaggtagttgtacacacttgtgtggtattttcatttattgctctgaagattatgttctgagtgaggatctctcactagatttggagttccgtgattcagctaaactggttagtaagcaaatgcatggaacttcaggctctgtgttctcagccctgggattacaggggcacactgtgtgaagcatgctttttgcctgggtactaggtatttaactgaggtcctttacctactgatccgtacgtgtagccacatcctgtgagattttctcgtagaaaaaagaaaaagaaatctacctttggaaatcaagcatagatatcactgttctctgataaatgtattttcttgagagtacagagcaactgaaatcagacactgtaatagtgattccctttaaagtctttgcagttgtcgtgatggaggtgaagaagcaagaacagcctgggagggaatgcaggtgtacttgtgggctttcacatgatcatttctcttatttaatcacattcaagggagaaactcagaggctggaagtcagtggtgcccaggatgggatgctaacaagtactgagagtagtaggaacatttggagggcatatattctgctttgttcttgcaaaatcctgacattcagtccagagatcgggatgtgtataatagaaaacctaataatatcgtgggaagcatttcctttcatccgcaaaagagaacgtacaaagaggacagatggtgatacatttgtgataataggccaaagcactgaaggtttttttttttttttttttctttgacagagcttgcccgcagacagaatgcagtggcaggactctaatctggctttatgttgcccagttgttcactgacttcctctgcctattaataagtgttcagagactgaatttggtttgcttttctctgctgtggctgcatgccctgcactgaattgctttagccatagcacttcaaactgggctgccgcacccctttcctatccttcccttacctgaaatccgatgaataaaaatgtctcctaacaaccattttgatcttcctcaattttgcctaagaactaaaatgtgcttttcagcccaaacggtgcatccaaactcaatgttgaacgtgcagggcttgcatttgtttctgtttgtttgtttgtttgttaagtttgtttgtttcattttctttgtttggctggtttggtttttttttgtttgtttgtttttattttttagacattgtattttatttaatccaggctggcctaaaaatcactaaatagcacaggttggcttcaagctcacagtaatcttccactatcctcctgcctgcagaaattatgtcctccatttctgatgtcctactttgttctcaagaaaccctttatcttagcaatttgaacagatggatctttctaaaatgttcttgcagggattctggatattcag

SEQ ID NO: 39 - DNA, 1725 bp, Mus musculus
tgtatgttaaaggctctctggcaataaaacatcaacagggaaacaaactatgcacaaactgcaaagcgtgcttgctggtgagtgaaacacatacaacactgtatgccatgtgacattacatgaaattctaaagtgataaaactgcattgagggacagtggaagggatcaacagcgactaaacatgaaacgcactacagaacatgaaaaccctgagtatcttgatccatgacagtgggtacataaaactgcacaccatattatctggcgttaatggtgtttggagaaaacaccccacaaagaaacttgatatacaaatgtctttcaggaggtttaatatgtttacctaagcttaacattactgactcttatcaagcagtcgatgtaatttattttaaaaatttaccaagacagtattgcagtatactaagtgatcatataaatttcaaaacctgttccattaagtttctagaagtaaaagttgattctgaataattaatttagtaaaaacataaaaatcaatttgaagcgctgctacaaatacatatgagaaacaatctgctatggacaagaaatcacattcattggaaagcgtcctaaacttgttctcaatggtgtgtagtctttctacatgccccaggtgctcctccgttctgaaaaggctactgacaatgtgcagcatggcaaggtgaccctcaccatggtgggaagccttggaccttaagagatacagagcattctaccaccaacatgtacaggggattaacaaaacaaaccaagaaatcatacttctataacatttttatttccgaaagagaccattttattttgacactaaactcactggtgcaaaatcttgttttcaaaaggtttcctcaacaaagcagtttgttctgagctgcacagttcactgtattacaagcaccaggctgaacaaaccaggactgagagagtcgccttatgcacattgctgttgtcccacatcactcagaacaaacctttttagatcgctaactaccacaggagtgctgattacacaggcaccagcaatttcctaaccaatgaccacctgaacaatgatgtgttcagcttctcagaccctgcagcctttcaaaggtgaatcatttcacagtttggaacaagatctccatagcaacttccctttgagggttttagaatcaccatccagtaattctatgatcatcaagctcaaccattcccaatggttcttttcacagcagatgggaaaggatgccttgaaattttacagtctatttcaagcaattcatctggcagcctattagaattcaaaatatttcgaccttcaatcacaaagcatgttatctgaggctgtggtgatctcaagtcaagacaagcagacgttttagtctaatcatccatgatgagaagagactgacaaaaactcttaattcaaccaccatcaaaatgcttattttaactgcatgaaagtctttcaacaggcaatgaaaacacaccatgcaccattttatcacaacctctgtgcaagaaaaatatgaattctgaatattgacatggatctcagcacttcttagactacttagaacaagggcattctttaaaagttagcctacatccaactgaagagcactattattctctgccagaaatcacagacaaattggtagtgcaccttaggtcagtcagcctaataaaatcaagaatatttgcattttttgtttttttaa

SEQ ID NO: 40 - DNA, 1600 bp, Mus musculus
ctacataataactgccagttgtgccagcaccattttttgaaaatgctgtcttttttccactggatggttttagctcccttgtcaaaagtaatcatcttttaaattcaccagtaattgtttgcacactcaaatatctatctatctatctatctatctatctatctatctatctatctatctatctttcagatatatacctctccaagagtatatttaccgcagaatgtttaagtataagtcacaaaagtactcctaaggtttgtttgtttatttgttttttttttcactacaccaggggctgaacaattccagaaatatatgagtgaacagaagttctcacagaataatctattgttagaggacttgtttgctgaaatttatcttgaagtgccactgttttcatcctaagatgtgattttttttctgatggtctaaatatttacaagaaaataatataacccatctatttctccaaaagtatttatgtcataaaggggtaaccactatgacataatgtcaaagaaaacggcaatggaggagtctgtggagttcacgttggtattggtctgagtggcataatttctatggtgagtgctttatgtggcaccaggccctcctttcagaactgagtacctgttctcctacctccggggagggctgtctgctgatttcttagcttattgatttgcctgctgatcaggatctcctaccttcattagggtcatacctgcttcctggggctatcttacatctagtaactggccaatattgacagtggatactacagccctgacttctatggtggaacaactctttgggactaatctgtaaccagatctccccttaggaccgggactacagatcaactacagattaattaattaattaattaattaaacaaacaaaccatcagcaatatgtaaagtcaatctcctgccaccatgaacaagccagtgttatgtctactatggaaggaatcctgaaggttctccaggaactgggagaatttcagtgggtctggaccaagggtccattacataaagtgagagaagaaagagttccccaacccaagaggaatcactcaagatttaaaatttaacaccctggcaaaggctttgggaaacaatgttagcatattgctagaatggttcttggaagcctggaaaaaagttactgccaagcctataaaaatagacatgccagaattgccatataagacagtatatgaaagaaccgaaagtttcagagatgttatcttggttcacaaaagcctggaagatcagccaaacagccatgtactacagtacaatgcagagccaatgacataattaaaacattagtgaacggaatgccactgtccctgagaagcccagtggtagttagttcctgagctaaattctttagcagaagcatggtgatagggattgctctgacctctgcacatagcacaaaactccctctccgcagatgactgagaactgctatatctcatccagcttcacaggcagtttatagacagtgatctagacaattcattccttttcatccttctcagcgcagaggaagagaacacttcacatttccttgtaggaaagaacag

SEQ ID NO: 41 - DNA, 2025 bp, Mus musculus
atcaacgaatttgcactgggtgttttgtcatgaaaagattgttcacaagtgtctggtgttctggtgagtgcagaagccatgattctattggtccagacatgataaaggatctgccctcttgggggactgcctagaaagtccatttctaaccacctgcccagaaagagaagacgacaacaaaccaaataaacaattgtgtctgaaacaagcttggtgagccaatacagttatctgggttactatgggaacataaacatcacttgggcatcacgaaaaaagcccatctgaacataggtgacaactcaccaaagctgtatcactagaacatactgagtagcttgcaagcaagtatgtgtatgagtctcttctccaccacctagagtgcaacaaactcttatattaaacatttgattcaaacataacccagaaggtccacgtccatccttggctgtttcttggtcaaaatatggcaaggttgtctaaaggttggtgttcgcatctaaactaatattttttttctttcaaactaaacaaaatacttcctatctctttgtacttctccattagatttatcactcttaggcctgagaatgaatgcaaccaggagacagacagaaggacactgattgctgttgccatggaaagagggatctactccattcagggccctgtagtttccatgggaacagcattgatgctgttgctggtctccagactggcagaatatactggaaagaaaattgcagagaataaaaagaagagctgaaatagtcagaaagctctcagctgggtgaagctataccagtgtgctacatggacccacatcaggaacacagaaatcatatgtacacttcatggaccaacttccatccttgaaaacaaggatgaacaagcttgaaaaggcaagctggagttagtaagaggtggattttcataccaaggccaaagatgaatgcatcctctgcctcatgccacaccagcaacttatgttattattgtattaagaataggctagataggcctaggaagcttgatggtatatatttcacatatattgcttatactcatcacagaaattatacaaagatgacactgatgttccctcctactaatgaaggagaactggctccatgaaacatgggtgggattgaaccctggtctccattccattctgtgaatgcttatgaaaactatagctgtctgtcatgttctgccaggcaatgagcatcctatttctattcacagaaatggtccttgttcttttgcatgtgtcgtgaaaaacacagcctcacatgatgactagcaccagacatctactctaaggaagttgtggggggtcctggagggtctttactgtctggtctatttatagatgagggaattgaggccaggaactaccagcagagccttctagctgagtgtacccctctgctttcatgtgctcctcatggggagctttagctattctgtaaacactatttcccacactcatatatgcaaggtcccagagtattgtccacatagagagtttgcctgtatctgtggaagtgcttagctgccattatccactcttccctgaaccgtgtagccagtgaggcaaagcctacgccatgaccaacagcttctctctgctttgtctgcttcatggaagctaagcatctgctacgatctctagatcatactatgtgctagaaccggaggaagtcacacagagatccctgagaggccaccatcccaatggtcagtaggcaaacagaggcaaaggataatgttggggattcccctccccccccaaaaaaaacagaatgatggacctctggcaacaattatatttccttgttcagtgtgtacagccagggacatctgacagtgccatttacaaatgcgtccaatcagcttctggcatgacggaatcaaatgtttactatacgagcttgttgaactctagatgactgtgtaagaagtcctgttctgtggactgcactgtactggattcaaaaggaaagtttaattcgactttaagct

SEQ ID NO: 42 - DNA, 3400 bp, Mus musculus
cccatcttgggatccattccttgtgcaggcaccaaactgttgatgcagtgttgtgcttgcaaacaggagcctagcatggctgccctctgccagcacctgactgagaaagatacagatatatatatagccaaccattaggctgagcatggggaccccctatgggagagtttagggaaggactgaaggagctgaaggggattgcaaccccatagggagaagaacagtaccagctgactagctcctttagtgctcccacggactgagccaccaaggagcataaatggctcgtctgtggcccccctacacatgtagcagaggactgccctgtctgtcctcagtgggaaaggatgtgcttggtcctatgaaggctttgtgcctcagagaagggaggtgctagaggggtgaggagggagtgggtgagtgggtgggagagcaccctctcagaggcaaaggataagaggatggagtgggggcttgtggaatgggaattaggaagggggacaacatttgaaatgttaaaaaaaaaagaaaaacaaaacaaaacaaaacaaaaaaccaaaaagaatgtacaagcagaaaaccatacccttaaacatttatatggcaagcccaggcagaaagtagtgacagtatgtttaataatgatgttttatctaataacatattggtcagataataatataaaaagaaagaaaatgatcggctgaaggagactgcgtacatgtctaaaatttctgaagtatttaccaagttttgaatacagaaaataaacagaaatgtaatttacatgtatcagtatatttccatcttataaacgataactacattttgcaatagattaatgcatcatcaatgtttaacttaccatagtatgaaatgcctactttgagcctgaccaaacacattgttgtgttccatgcaagccctactcacattagagctcaggcagacctatggtctgtccttccttttagagcaaagcattcacattcctagaatcttttttttttctgttcataagtgatgtatagtaaccatgtctaaaatgcttgaacattagtgtctatacggctgcacgcacacacttgaaaatgtgtgctcttagttttttaggtccaacgtgaacgatttgactggactgctttgtggataacagtcgctatccaacagttgctactgatccttcagggttcttcactggaacacacagtacatttgtaaactttctggaagaagaggacagagggagcatctgtggtcaccccttcccagaaggaaacaaatgccatggagaagggatgatcccacctgcatgaacactgctctctacaaacacaaatgctgtcgtccctacacatcctagaggagtggttttaatgtcactgccaagttattttattatacctatgtaaaaatagagtgaatcattagtagcagtactgagaaatcattagtaacataaagtttaaacactgaggatatttatttaaaaatcccaaatgttggtataagccacaggattagggagatttttatatgaacacttttttttcctacaatttgtatgactgaatttaataaagttccatcccatgagaatttgggctaaaaaatgatataattatagagtctaatattttaacttgtcttccaaatagtttagaaaagcaccatattaaaaatatttgattctactaaccaaacacatagtttgaaaatgaaataatacatgaatattaagtacaaaattcctctttcccaagtggcataatcctagtgtgacaggagctgaccactcagatgaagttctatctaaagtcatcacaatgcttttaaatcaaccctgtcatgattactggattcattatttctattgatatcatcctgtgattattttcctcctatgtgtggggcaaaaaaaatagattaaaccccatgtctagcattctctcctctaagcacatgcttttcccattaactccctgtgtataatcatggagagctcaaaccatagtgttctcttatggaaatctttgattatgctctgagtctgattgttgttgttgtttgttgtttgggaaaatgtcctatagctttcacaaaagaattttattttaataatttgctactgaaattctttaaaacttcccaattcctccaccacatgtcagctttaagggttaataagtatcatgagattctagaaatagaaatttatgggtaagttttagtgctatatccatacctccaaattacacagtggataaaatgtcagtagaaaattccatggaagagatatttttcaatggacaaaacctgtattattcaaagtctcagagctctaatttaaagtctatattaaggattatatcagaacccgtaacttcacaggtaaataaataaagattatatatcaacatatattttggaaaacagtaataaagtcattgcatggcctgggctgataaaactgacaagtccaggatattcttgctctcctgaaattctaactgagatcagagactggactgaggagagggttcaaggctattggagaagtcatttgaggaaatagaaatggtcctttttgggtgtgatgggatattgcacatttggatcccaaatttggtatgatttatagtgctggcattttgagagcttggaaacaaatgattgtgaactcattttacccaaggttattagtagtgtcagaagggaattaaaggttttaacattgaaattttcagccatgaggacatttaaggcacacaattagttattagacaatgtcaagcaaattagtaggctcatgttcaagacagtctttctcttgccagtgccataaaatgtgccactatttattttaacaagcagagcctgtcatgggaaattgatgcataggatgcaaaactgggacaagagaagtaacaggctctctcctaaaactcactttattattatactatttaatttgaagataaaccagatggaattcggcaaattaaaacacccatttcaatctatctaagcctatgctttacatacaattcaattaaactgttagctttagtgatgtagacaggtgagagcttgaaaaccacctgactgatttatcactctctgaaatgtgatactcctgtacatttttaagaatgtttaaagaaatgagaactggacttagaggttcagtcattatttttatcttacatatactttcatcaaatgtactaaaattctactggacatcagattaaagtgtagctgaaaagactcttgtctagtttctcttgatagagttgcaaagtttcatgtcatgtattacttagacgaatttgaaaatgtttatattttagttcagtgatgattctgctacccaaacaggatacattgcaggtggtta

SEQ ID NO: 43 - DNA, 1550 bp, Mus musculus
gaataaaaagtgactattcaaatttctcctaggaaagatgagaaataaagtagaaaatgagacagaaaaggcacattttctatgcattttgagagagattaagaggtagaaataaagaccattcattacacattttatatatgtattacatctttaactcataaacttgtgcaattaaacaacaacaaaaggacaaagaccacaggcttagagaagcacaacggagacgcactagttattagtgcattaaattcactttgaattcttgagtggctatttgcacagtagtcccgttctatgtagaaccccctgggcagcctggctacttgtctctctacctccccttgtgtgtttggagggtgacagggcacgacagtatgctgtggattcctcctgtgagcacacacagctccacaccacaggctactgctcctcaagagcagatgttctccctcatagccagctctgcaatgcacaacaccgacctctctgtggctctgctgcctcatctgcattgttgtggatggtatgatggtaaatctcatgtatcaactggctaggctatggtacctggtaatttaatcacaggtctagcattactgtacacttactctgcagggtataacatctatagttactctcaatcttacaacaggtatcatttagtaagctgtaagactaaggaaaatgcatggtttcctgcagaaagaagaaattctgtctcaaaacttgagtatccactcttgctacacttccagcctgctatcatgccctacataattcagacttgccagccccaacaatggtgtgagccaattctttaaaatagaccagctacagctacagtcatagctcctgcatagcgatagtccagagctccttctgtttctctaagagcaagcagacccagatggtaccgcccacctttctgccttctgagtggaaacccccaatctccccctctaagctgtgcacctgccaagactggacatggaatccagaaggtctacaggactgagggacacatggtgcccctgaccccaggggatgacgttcaatagcagaagctgacggaacctgatggagacagtcttctctgcccctccttgtgcgacttgttcccaggctggagactggagcataagaagggccaccctttcattttttttttcttacagttttctatgatacatttaattcaaatcctaattaaagtaaaatttgcctatgtttatacttttctttcttgaaaatataatagaagatacatagcaaatctttttttacaccaaagccttagacccttagagaaaggtcctctgcttttttttttattagatattttctttatttaaatttcaaatgctatcccgaaatttccctataccctccccctgccctgctcccttacccacccactcccacttcttggccctggcgatcccctgtactggggcatataaagtttacaatagaaaggtcctctgcttaaatattccaagttgctagaaattattcctgcttaatatgtttaataatagagaaagagg

SEQ ID NO: 44 - DNA, 1700 bp, Mus musculus
atgcatggcagatatgttagcctaaaatgtgacataatcagtaaaatacataacataaataatgcaatactttgtatgtctaagatagcgtgctacatctggcaggcagctggcatttacaaacagggactcagaggctcagcaggttgccacttcaggaaacaattcccaagacctgggcactgctcccttaaagggcacagcaccaaaaatatcactgcaaaaggcaattagaaaatgaaagctcagccgggcatggtggcgaatgcctttaatcccagcacttgggaggcaggcgaatttctgagttcgaagccagcctggtctacagagtgagttccaggacagccagagctacacagagaaaccctgtctcgaaacaaacaaacaaataaacaaacacaaaacaaaaaagaaagaaagaaaagaaaaaaaagaaaatgaaagctctttctctgtattgctttcagaaatgttctggaaagctctggaagggattctgtggtgaactgtggtgtcatttatgggccagcttcatctgtaatactaggccatcacatgcaaatggcatctctgaattcccgggctgtgctatcctgggaggggaaggggggctgctgctaaaggctgccgctaaaggagagtatgatttgagtctcaagcaggctgctaccagtcagcaccatacagcgccaagttggccagtgtcagagacaaccattgctgttattgttgtttaggtaaacatacaaaataccggggttcaccatgatatcttcactcatagataccatggtctgttcttattttcccctctctccaccattggttccgttcttccctcagccagccgaagcctcgctttctctttacatatatccgttatcctttcttcatctctcagttgcttgcctttatgggctcagcctctcctctctgcttcccctctctagtttaatggcttgcaaacaaacatagatggcacatacatatatgtacacacacataattttaaatttctgttctgtgtttcagaaaacgcacattctttctgagtctggcttgctcttgcttaacataaggatttctgcttacatcgatttttctgtatcatgatttcatttttctttacagctgcattttaaaaatgtggttattaactatgtcctaacctttgtagagtctaaccaatcctgccccaggtaattgtttgtaatatcaagcctcctgcctgtagccctccacttcttccaatatttaatgcgtaggaactcctttttcaatgtctgccttccaggcgctccctggaaactggtggcgccgcatcgccccctgccggcaaagtctcagaaacctccttctaggttgcctggctctttaccgcgcgcgagaaagaggccacgtttgacaggtctcttctgtgctctgtcgctggccctgagattcagagtcaggaaaaatggagtcttaagctagatgtcttggttgaggcagtaatcccatcactaaggaggtttaggcaggaggatcctaagttcaaagcaaacctgggctgcatagtcaggccctaccacaaacaaaaccactatccactgccattggtctttggagatgtttgtttccttctgggtctcgtcccctttctttccatcagggtttcactgtgagagagaatgtcagtaacattgatacggagggtt

SEQ ID NO: 45 - DNA, 1750 bp, Mus musculus
tctcagtattcacttcatactctgggccatttggttacacgctgcctcttaaactgtggtgtgtcactccagttcttgctctgaggtgcagcaactgcagtgtgtgggaaataatcctgtttatcatttgaggtcagcttgttaaatctgggaggtgattaggggtatgagccatgtgttagagtggtctgacaatgaccatgcatgaattcagattcacgcatgtaaatggcatcctccctttctttcttttgaagcaaagagatgagagctgttaaaattcttctctaagatgctatgtgctttttggtagaatgggaaatacagctttattaagcattcatccaatctgcaggacttgtacagcatttatcaccgtttcaattctgagcttttattatctgcctccagcaccgccaccctggacaccctggactgctctcttctctccctttgatttcaacaacaaaagatgcagacccttttgaaaacatatctcacactcatgtgtagccttcgtaaacaatcttataacattcattcatgtgtggttgtcttgtgagctacggtagccacgttttttacttcagctctttctgttttctgtttgaattcagaagcttattcttagttcccagggcatttatgtttccagcacacccaactctctatggcactgcctggaacggctgtggctggggatggggatgttttgaggtataacattctgtccaccatagccaagcagcttcagagaacaccagacggggtaggtgtatactgcggctctgtggcagatgcagtttcaaatagcattcatgaagagcttttttcatatcaagaaacacgtgccgtgtgcctacttaggatgctgacacttcacagttgatacactcatatattttccccctctcttgatgggaaaggaagggaactgaggttcccttttcaaacaaaccatttttctccccaaagctctctccttacctcctttccctgtgaactgtaattacaccaaatctatttgatgaaattctatgtgttttctaactgcccattaactactagtggctggccagtgctggagagatgcaggacacatctcagtttgcttcattacctgttggctctgggattgctatgttcaaacacatatttcgtttagacattgttgggaaagtgacttttacacaatttttttttgtttcattttctctactagtttcaacactaatgtaatgagatttgaatctctcacagaaattggtgctaaaaacatacctattagacagtttgatgatatcaaatatgatatttataaaatcttgaccacaaaaggcaagtttagtgtatgactgtgctttgaactgaattttatattgtgttctcaaataattagatggtacattttcccaaatggaagaagtgaggtttgccaacaagataggtggatttcttggaggctcttgagcttcttgtaaaggcagtttcaaacatcaagaaactgatcagaaattgtgattattcccagccctgcagtaaatttggttatggaaaattaaatacactctgtccagagagcctgaagataagcaagtgtgttgttccttttgggtaactgcaaattgttttctttaaacttgtgatttggcaggtgatcatcccagtgaacactaacaatttggtttcattgtgacagtgagatgtcacatgatgctaagacccaagtcgttatgcaagttgtgtaagc

SEQ ID NO: 46 - DNA, 2150 bp, Mus musculus
ctctagtattttgtcttcttcctctgccctccatctctataatttcctttctattttcattttataaatgtgtaggtttttttttcacatctaggtttttgcacgagagggaaaaggtatatttatcataaggatagatatagatatagccaagttcaaatccctgcaaggaccatctgctaaatgcagaaacaacaatcttcctccaggggtctaagtaggaggttgcaaaatcagacccaaggcaaatggaagtgcttgctctttgaagtggaaatgcttctttctacctattaagttcctcccaggaccacagcatcccatactacatatgaccttcataaaattcctacaacaatctctttcctccataatttttctatatgatgtggacaacatatggcagtactgagaaacccataatttaagtctaagtgtcacagatgctggacaaattctggcttaaactggaaacttaggatcatagtggcaatgtgcctcttgctgaatgactgcatagaatgcaatcttcagagtctttctgagaaggaagaagagtataagtccttcatgttcttggtagttgatgtcactgctcgtccttcaaggttccaaatggtgatgaatgtaaattttttaagccactaagcaaaactaattcttctatcacactgctaattgtataaaggctgctcactatacaaatatgtttatgacaatgtagagttttagtgtttcttttcaattacatagggctgtttatctgaggtgaaactaccttcagttttggggttttgttgtttttgtttttgttttgtttgtttgtttgtttgcggttttgctttattgtcggatttatctgcctaacacttttgtctctttcctattctctcaagtccttcctcacagttctctctttaagaccaagatagcaactttagcctacttatctcagaatgtgtcccttagtcagcaagccttccaaaggattaaattttccattgactttaggtcacccagactatcaatagagccctgaactgtcttgtccacctgacttctgctagcaagacctagatcgaacttcactgtatgcctttgcatcttcttactctgagtacagggagcaggagcatcaggagcacaatctataagcttcatatcaagactggcctacagagctcctttagaaactgtactcagcaaatgctctcttgtttgagctatgtgtgtctgataaaagcatcagaagtactttgtctgccttgtttccttaatagcttggctgttgcttttggatctgctttgaaggctgtttctaagatctttcacttcctagtttctcttgtattcttaggatataggttgaccttcattttcttcctttaaacttcaattttattattcttacaaggtttcttcatatctaaaattaaagaggagttggcatccttccccggcgttattctctccccaggcatcttccacaacaaccttctattttcactgtagccctactctggaattcacaatgtaaattgtacctgtaagaactattccccagctgtttccctgaagaatttaaagatatttttaagccacacactgacatttcagctattcttcctgggtccttcttatagtaaaatcagcggctttagaatacataaaaaaatgttttttatttttcagttaaatgctagtttcatgattttggttaaattatttatccagaccatcaagaatttgtatcaaaagttcagaattatatgacacatgataggcagtagaaaaacgaaacctattttatcaaagaaaaactatttcttatataacagctttcaagatgcatccacagaaaatccatttggaaaaaataacaagaatttaaaataagtttcatcacattggccttcaaactcaacaccttccttaaaatgtgatctgctttcttacttactacctttcctaacgcccatgtacacatggaaagacaagtagaatggttttctaacagaggggaaaatctaaaatgaactacgatgtgagattatctgtatttgccaaccctaaacgttgctctgtctctataaacagtagtgttaccatcattctgcctagaatgtggatttagcacatgaaaatggcag

SEQ ID NO: 47 - DNA, 1725 bp, Mus musculus
ccaaatttatcatcaccttgagtttttaggataaagctgattgatgtccaagaaaagacgtctcaaaaaattttcaatttgtaatttagaactccaaattaacataataaacattgagccctttcagatgttctagttctaatctattatgagctagtgtagggctctgctgagcagtttctgataaaagactgtgtgtttatgtattcctacattcaaaagaatctaagacttctcctgacgtgctaaggttttgaaatatatgtgattaaattctttcaaatcaggattgactctattggaagaacaatttaaaagaggaacacacacacacacacagagagagagagagagagaaagagagagagagagagagagagagagagagagagagagagagagaaacagagagacagagaaggaggaaaggaaggggaagggaagagagaggggaagagggagggggggatatagggagagaagagagtcagtttgtaagatacttggcagttagattcttctgggacttagttctgttgctgctaatcctctgaccattaaaacaaacactgatcttcgaagggacaaatgggatttgtagctcagcttcataatctctctcccctaaaaatgggccattgattatataattttatatgtaatgtatatatatttttgtaaaacacaagaaagcatctataaagagagagtactgcatagtcaaattgtatagggcttctctctagtctccaccctacttcttgttcataaacaagtagtctggctattttaactttgcaagcaactggctgatgttcttccttagcagtcatactagctgtgtgtggcatgaggcaaagctttccaaatcagcccgctgtaaacagagaggtggtaaatactgcatttgattattttctctgtaatttgctgttcatagagatgttttgcatatgttgattaaatatgtactttctgctgcctagggagtcagagtccttcacagcagaccagtgtaatctggtcccaggaggctgcggcactccagaggggcacagtcacatggactacctgcttctgcttgtcttagcaacaatgatcgccatatgtgaagctgcgggaaaacagatgctgtttttccatttgtgaaatcaagttgttggaaagtagtcaggtttccaacgcacaagagctcatctaatcaacctacagagacagtgtgagctttctcagaaatatttgacaacattccctagcactggtgactagaattacatatgaaattacaaagtgatcatcctttcctcaacatttgtgtacataaatctctttgtatggctagaaatggagtccataattttctcaaacaaaagcagtatatagcacagttgctagttacataaagagattcagatcatggtctgaatgtagggtctctttactccagcattaaatgctattctgttaatcatcaggtctctctttccttgagacaaatgaagtaacactaaagactcattaataaagataatttctttttttatcaaatcagaagcattatttcaccaagagcacaagccttaatattctagaatccattcccccttaacccatattgcaaggagtcaccataccatgtgtatagcaaacatttaactctagctgcttgcaaagctcttttacaaactatgatatatttctcagagtcagtatccacaacaaaga

SEQ ID NO: 48 - DNA, 3400 bp, Mus musculus
tcatctcattttagcttttatggggtgagaaaaaggttacaacaacagcaactgcctgtgagaaagtttcaagcatgtttaaacatggaaattcaaatatttctatttataatagagaaaatagaattaataccaattaaaaatattatgttaagagatataaattgaaatatattaagctgaagaataaaacatattatcatgatatatagtctttttccttaatgaatgtattatgcatactgtgaaaggaaaaatgctttaaaggtttaatcacactgtcatttgtatcttttttcttgattggataaacatgttgttaagaaacatctctggatataaattttcctaaagtcttatgtacagcattttggtcaaatcagcttttcagtaaaatacccatgttctctgccacatatcatatatcctcaggtgaaccattcaccaagagcttgggaaataattatgttgatttaatatggaataaatgttcagaattcttagcttgaaatggtagcacatgctgcccattccagaacttagtgtatggaggcagaagaaccaggacttcaaggtcagattttaccacttagctagtttgaagctacatgctacgtgaaaccatgtcaataggagagagagaaagagagagacacaaagagagagagacagagagagagaaagaaagacagagagagacagagagacagagagacagagacagacagagatgtcagatgcatatagacacagagaatacagacatttttatttatgtcagaaatacatatatcttaaataaaactgaatttatgagatataaatctctatatgttctttcagtaagatctgttgtataattaagttagaggctagaaagacagttcaggagtaaagaatacttgcttttctttcaagggacctgaattcagtttccagcaaccatatctgatagctcctacgagctttgtaccaccacttttcatggccagttagttaaggctggggtttttcttttcacactctgtatattgtaatacttaaaatatcaaaggcatgcctcaagtttagtctcctcccaatccctgttactacagaaaggtgctgcttttaaaaggctgtaactaagttacaaattaagataaagatacttcttaggtgaggcgaagcatagtttcccggggaaggggcttgtagagggatttctctaaggcctgctttgatctcagaaaacattgcagactttctttacatttaaaaagggaacacaaacttcaccatccttatttctttattcatgtcaacactcctctattcactttccatgctctttcctattttcatggcaatttatgctgcatacaacttatataatataaggcaactctagttagggagacaattcttttgtatgaaaatgagtgctaagcagaaaaaaaaaaatccattgtgcccttagtagctgtgtgagttgacatgtcattgaaccttccagaaaaaaaaccatgccagtatgattttccccatatcatctaatgaaaagttcgagagcacattttaactatgtattgttcacaaatgcttcaccatcccctgacaaatggtctgtagaaaatctctaaaaccttctctcccagtactacagcttaaaagattcatgccatcaaatagtgcacctcaaaggctaatgtctgctctccaaatttcagatactgtagcctaataaaaatttaaaaagcgagatctcctccccagggagcagctgtcaagactttcttaaaagaaagaaacataaacagcctctacctagtcatctctgagaacagacaaagcaaagcgaaggtttaagtatttctaaaagagaaaaaaaaattcaagttgtgctagctgaagttaaaatgatagacttttaatctcataatacctacgtatccaaaatattccaaagaactacggtgcatttatgaagggaaaattaaaatctttggcatgcaatgtgtatatatagtatgcatacgtatgtatgtatgtgcaatcatataagacaaggcatgtgtgcacaagcaggtataagtactcataacctcttctaggcatggggcagtttctctttaaccactgtctccctcactgttctctgaggactcttgatttatgatgttcgtggctgcattacattaagtcatggccgccctggagacaaaacatagttcattttagctctacagcatcgagcattctcctcgccacacatttcatcaaccatctttcatttgtactttctggcccagcaaaatcccttttagtaatatcccttcaaaggccatgacctgggaaatcttaggaagaaaagactgagctccttaccttatgtctgtctgtggacaaggactttgtattaaattgccaaggtcaccactttcttccaaggaaatgcaatctcattgttgtccatcacagcttcttaaagtgtaattatactatgacttcataatacaggttattttaaatcaatttagtattgattatttttttattaaaaaaataaaagaaagcatcatctctccagttttggagagcactatcctgttcagatgccttctgctgatgtgtgcttagagagaggaaacacagtcactcactctggtctggtcttccagtagttgtttcagaggtatattctgttaggataactccgtaaaaactgttttgtcctttcgctgatcacatgtgaaatgaatcacaggtggtttattcttgtgaatattaaaaccatacaaatgagaaagctgtcattgccatgagtggaatggcctcatcagcctttataaatctgggccaatctttattttttttccaaattattttgatgatttgactgcatttgagcacaataagctagtaatactatgcacatttaaatgattttcaaagttaatatttgaaaattcaaatgtgatatattataaaacaattttaatttaaagtttcaagtttctgaaattcaagttgtaacttgctttttaaaaagaaatagaaaacatactaatataggcctggtaaaaaggtctccttgctacaccctccatgcaagtaggagttgtgaggaccttgaatttccagaaccacataaatgtcaggcaggcatggcgggcactgcacttggggaggcaccgactggaaatagctggagtggtctcatgagttacactagccatgttagtaaactttgcgtctaattaacaaactgtcttgctttgttttcttcttactacaataaagcaatttaaggaggaataattttatttgcctcataattttaggttctctcctgtcatggtggagatcacaaagtctggtggcagaaacttaaaatagctgaaagcagaaagagaaccca

SEQ ID NO: 49 - DNA, 4200 bp, Mus musculus
agccaaattccacttcacacagaaatattatctgaagcaccaaaagtaaacgaagattcatcaacacagatgaacatcagaaacaaaggccaacaagcagactctataagaccagttgaagtagttgatagttgtattgttaaaaccagttaaagtagtgaaaagctatatggttaaaaaccatttaattcatgcagtttctatgaaacatggaaactaagttgcatgtttaggaacagatgcatgctggaagatcactggggaaactaagcaaatgatgaacacataattaaaaattatggcagtgtccaaagagggttaagagagaagggcccagaggactctatatggttttgcttcttaaactagattcatagaatctgtgtgtttcagttgtgtgtatgttttatacacatgctataaacaagataaatgatagtagtaagtcacacattttcgtgtgcttcatgtttaatttataaaactaaagcaaagggctggtccttgtgttttggtctttgatttctttttgtgtaacttttgaactaaagtcccattattcattttctgctggccatttactgctcatctttccctgcttcccaaccagtttcatcaagctagaatctaatccccattggcccgtactcaggaccagagtctgcctgcctagcaaacaatggatcctgagtatatttattagctggctcagtaaatcatataaaatttatcaacaaattagtatgaggtggtagtatgatataaacatatttcttttaaggggtacagctttgagatatattttcttggggtgatattttcagagaattaattgattttctcatcaaccttctctgtatgtgaaccatagcttctcctcatacagccaaccactgacttctgaggttccatttcctcacaggagggaatttgagttttgagagttacagagtcttcttcacatgacaggataaaacattaggaagcacgcgcgttctctcatctactgttgtcactgaataggaaaattactcatgctttctgaagggtataatcttatccctggaaactgcctgcaaaataatttgcttgtattaaaagaatcacttttccttgttaatttcttaatgaaaaacagtgtaaaaactattacttaaatggcatgcaaaatctgagagtacttaatctacaggaaggctagaaaaaagaaatgaactgaaacaacaattataaaaccagctaagacactattaaacaacacttcacagccattttttgaagttttgcttttactcaagtttatctcattttaattactttaagcaaaacaaatgatgaggcttgagagaagaaattaaaataagttcttaatattactcccatatgtatatatgtattttacttccatatgtatatatgagagtaatattaagaatttattttcatatatgtaatcacaaatcaattaaaattatttagcttctaagtgaacaactagggagaagagaaaaagttaatttgaaggttattcctttcttcgatttatttttcaaatttattattttaatgaaattgctcattttaagggccgggggtgggggtggggggcctgaacaacaggttatcagcattgatatctgagaaaaagtgataagactctcagtaatttcctgtcacaggcagctgcagagccaccctgtgggaaatgaccttttgccaataatgtaaatttaataacttaatttctctttgtcttatttcttcatcaataaaatgggtataacaatttatattatatctataagatgacatgaattttagaaagcaacaaaaataatatctataaaatgcttagacatgaacccaggttataatatattacctaatacaatttccttttatttgtctaaaatatgaagttttctatagtatttatttaaactgtacttgtgacaaatgatgactgagacaggcaatgataggagatgtttgaactccctgagacactactgggacactgcataagctcagcatggaatatactgcttaagagcacaatttattcactagtatgtactatgttgtctatacacatacatgcttccttccacacagctgagcaaccccagaattccttacaacccagcacctatcaagctgcatatactctcacttctgaacaacaacaacaacaacaacaacaaaaatgttttcctttccccactaaagtgaaatttaaatagttgtatcctctagtacattgttagggaaacccactatttaccaccttatacctatgcattatgggaagggcttttgatgtaagaaaaataaatacgtgaactaatatgtcagtcaaaatagagaatttaagctttagtaaccaagtcctcttccttctaaatctcacgagaagagtccctgaaccatgggcagggacctgtggccgggcaggggactgggtgagtacacttttctttgtggtccctggtcaatcttgacagttgtctccttctataatgtccaacacttctttgctctaagtaaagttaccttcccacttttgtaaatctgtttaggctcttatttattagaggtgaaacacctggggaatgcccggcctagaccctaatcacatgaacaagacaatattagaaacatacactaaagcttttctttaagcatttaatatgtgtagacaatttagaaatgcccttgacatattagctctaatgtgcatataaaggcatctgtcaaaaaatcttgtattaattaagtacatcaattaaagtatgataaaatttcagttgtcaaaaattacacaggtctttaaacatgctcaaagtgcataatgtatagcaaggtatcttgtggttatctctaattctaatgggaaacaagtatttatgagaaggagaagcaagccagagatggggagacagttgtagcaaatgccttatctgaatgaggactcttatctcaagtgaaagcagaactcaaatttcatcaataaaacaaattgtttatgaggaggaaaaagagctgataagcagatatgaaaggaagacctgtagtgagttagcatgcatgtgaagagttaggaaaataaggttgggacaccattaggatgttcaaggatccatcacagtagcatcactaagttatgctcaggatagcaaaaacgtttcagcactggcaggaaagtcaaagagtccagctgctttacaagacattttggcggtttattaccagaccaaaagtgctcttgcagcatgagctgccaatcacatatctggtacatacccgagaagatagaggcttaggttagttcaatgcagaaattctgcacacgtttatttacttcactttattcataactggtgatacttggaggcaatcaagatgtccttcagccactgaaaggatgctccggtaccttcagacaagagagccttagtttgttctcaataaaaaagaactatcaaaccatgaaaagcaacggaagaaggttaaacgctttttgctaagggaaagaatctgccctgaaaatgctacactcaacgattgctggaaagtcggactaaagaccaaagcaaaacagccaggggaaagcagggctaagtggaaggagcagacaaatgcaatggatgcttagggcactgaaactatcctaggttgcactgccttggtaatttgtatgagtgtacatttgctgaaatcgatggattatgcaccaaaaggaaaccctaagaatccttggacttccgtggagaatgatgagtccgtgtctgcctcctggaaaagtgaaccaatggcaggatgtagggcaaaggctgtaagaaactcacttactttatggtcccttttattaacaaaacttctccaaaaactttgttatttctttttctttttttcttttttttgagacagagcctcactatgtggccccagctggcccggaactgactatatagatgtgactggcctcaaactcacagggatctctttgcttcttcccacatgctctgagtaaagacctgagtcactgtgtctgtctcattatggtataaagttactggcagtcaaggactgctgagagtcagggactagtttctcctgggacaaactccctgaagtcagccctaaacatatgtatatgtgagcaatatcaaatagacttacaagggagtaagtgtataa

SEQ ID NO: 50 - DNA, 1625 bp, Mus musculus
aaccagtgactcccaagaagctaccgtaagtgagataaaagaaatactcttgtgcaaatgcatgaaaacataggatgaagatgagggtttggaagtttcaagtgctccgaaatacttagcttgtgtctttggtagaaactggcttctcttatttataaggctttgagcattagatgctagagttggtttggagctctgtcagataccattaggagtgggcacataggatctaagtcttcagaataaaatccatatttgattcacagtcaccacagccacttcttaggatctgtatgtgccagtactatcatccctgtacgtgctgggtaccacttagtactcaggtagtgcccatgaggaaaacagcctcctccctactgtacaaaccatcaggtaacagggtagctaaataacagtgacaggattttggtccaggtttgctgagatttgagtcccttcctatgtgtcatgtctcctcccactccacatttatcacatttaaatgttaacacttgcttcatcgctgctatccatccatagatatcttagagcatccatagagcaccagcagaacagcaagttgctcccgaatgcaggaccctgtgtgaatggtgagggtagtacgtgacttttcaagagtccaaagtgagaggagggcctccctaccccacccccatcctctgcttctgtctttaaaacatcagcctatagtctgacagctcttggcagtgtggttggttattttccactataaagaagagtaaatttgggctcaagtgagtgctactgaaggcactgggtatgacactacttgcctgccatcaaaaattgagaccttctcttatactttaaacttgaatatctcccctagaaatttagtggtaaggacatgtttttaaagtgttccagaactgaaccaactcctggcagagccaggctagtgagagaacgggaatagaatcgcagcagccagccacgtctagaatgtcatggcaggaaaccatactggtagtgacattcacaggagaccaaacattttaactggagagatggagggtttttaagaccttataaaaaacaaatcccgaggcttacaccgtaattttctcctctgacccttcattttccctttcttcccctctttcttccctcccttacaaaacaaagtctctcgctttagcttaagctgggccaaacttactgtagccccatggccccaactcctgacctccctgcctcagtttgacaaatgctggtgctgtaggtgtgcaccatcatgccagactctagcatcagtgccttatgaagaggtgaaggaatcttcaagagcactgatctcaggtcatctttttataggtgttctcaatgccaggagggacttagtgtctgtgccagaggcagagcctcattatccagttcagaaccctgcatccaaactcccatttgggggcatacctccgcacatctgaatctctcccttttctcttgtgagcttttgtctgagtatttcttttgtgcctcttgacttgtggctcctaagagatgctgtagttagaaatgtggatgctatagtttaagctgctgtcccatcttggaacaagttatcatgagacgattgttaatga

SEQ ID NO: 51 - DNA, 1900 bp, Mus musculus
actaaggaaagaattatatgtttataaaaatactttaaattcttttccagtattggtaaggtacaatttgataattataaatgtttctaagatctgactaagaacctcaccagggtctataataagcttatatgattgttttgtatagcataataagccttttgccagattgttcctgtaggatacaagccccaggtaaactcacagattagcacctacattttaaatgtattctgacctgcttgtcacctgaaggcaaagctgataaaaatgaaactcatacatggggcctcaccttataaaattgttcttatttcttgcatggatatttttttcctcttgagattcaaaaactgtattcactcttgctccttcattcttctgaagctcctggaatcctagctggctctggcactccatcctcctctgctagcttttatcacagcagagtggcagacctttcaaggagcttttgagcaagctctctgggattttttctcccgctcttctaaagactctcgacttttgtgtaagcattcagaaccttcaccatgtgaaccacctgacacatagtctttaacacttttctgtgtggtatttctataatgcttacatctgtgaaaacccaggtctcttaggaaacagatgaaaattaaaaaagaaaaagaaaaacgaaaaataaaaaagtagataaattgcaagcccagatgtttcttttataggctatggggaggtgcaggtgtttctgagtgacaggtggaatggtaatctacgtggaggtgggtgtctcttggcattcattcctcttggcagaccttgtttccctttacttggacaagtaggcattcctgcttaggtacaggcactttccacattctggctgcattacctcctcttctgcatgtatttctcgttgctcaaacatttctgggtgtgtaaatgggataatgaaaatagactcctcattcttttgtttcctattctctctaattgaacagctgtattcacagagtgacatttaatagatagatcgaacctgggccagaagataatatgaaagataatagaattcggatcactttcatttcaacacactcccagaatagctacaccatatgaataaaaaatagtggtgggattaactgcgttagtagaggcagtgataaacctgaccgtgtctaaggaatcaactccaggatagaggaggatatcaaagaagaaggaacatatgaagaaaaagaatcttattcaggaagcaaaatgcatgtgtatagatgtagaatattcggggtatgtgtgtgtgtgtgtgtgtgtgtgtgtgtgtgtgtgtgtgtgtgtgtgtgcatttgtgtgcatgtgtaatagagagaggagtgttaaggctattgtgaaaaataagtagaaaggtatcagatggaaattaaactataagtggtttaaatggctgcaaaatatagttcacttagtagtttgtgatagcagactgaatttttcatagttggtaggcttcccatagttgtgagaggttcattttcttttatggtttttatttaaaatatttttaaaaattttgaaacttattttgtgtatatacacgtacacacacatgcatgctgtggtgtgtttgtagaggttagaggacaacttgtgggagttggttctctccttacaccatgtgtgtcccagggaacaacttaggtagtcaggtttgaagcaaatgtgctcacctgctgcctgtctctagggagttgctatggagaatgtctgtgcacagtttggtttagacaacttgtatcaaaaaacttgctactcagagaacgcactctgctttctgtttcaaatggtatttttgttcctgattttagcaaacttcagctatgtggctcctcacataggcaaa

SEQ ID NO: 52 - DNA, 2425 bp, Mus musculus
aaatgagatcagctcagagtggatcccagagtgtgattgtagccttgagccacccaccgatggttagagtaaaacagggaccaggtagactcatctcggtccttccttctccaggaagattcaagatttgcaggctggatttctttgttcccttttcacactgaagaaaaacaaacaaatgaacaaacaacaaaacccagtgtgtagagcagagacttcttccatccttttctctgatggtcaggttcaatcccagcctctggtgctgcctgctaagacaagtgaatagggtctaggtgagggtcaggctgtcacagatgtctttatttagaatgctgtggggaaaggatagtaagtgttctggtctgttcctgtggttgtgatgaatatcctgataaaaggtgagttaaggaagaaaggacagatttggtttgtagttacagattacagtccatcatgtccagggagttggagcaccaagtcacatcacagccacagtagaaagtggagagaaaacagttgcatccacatcacctgatgctctctcatccagcttgctcctgtcctatgtagttcaggtctccctgcctagggaatggtgcctcccaaatgggctgggcctcccaacattcattaacaatcaggacagttccctaaatacttatacatcaattaacaatcaagacaacctgatctgagtaattcctcagttaaggctgtcttccccagtgtattagctaatctcctgttgcttaaagttctaggtagttagggtccattgtggcagggtcagcatgacagatggtggcaggacagaagccatgagcttacatcctgaaacagacacaaagcagagagagtgacctggagttagcataaggctttttatctcaaagcccacctccagcaagtctgcaccacctaaatcttgctcaaacatcgccaccaactgggaaccaagtgttccgatgcctgagactatagagggtattttcgttcagacctccacaccagttgattctacgctggcattataaactaactgtcagaggtgctctgagcttaggagcagcggggaggagtgtagagcttccttttctcttcccttctgtgtactctgccatttcccttctggtggttttcttatttctcattagcccctaagtgttaagtaaattcctacttctgttacattccccactggcaattcatacttctatatccatggaagaagacatattctcactttctggctcttctatgtaggtatgtttcaaagagggtagcatagaatgacatctttagacagaataggaactaaaacttgtatccactttgacggagggagagttacaaactcatgtctgatgctctgtttagaggcctgcttatgccagttttgtatgtatgatgtataaaacctttacgtatcagagagcttcccatttccgttatcatggctgttgatcctattctttaaactcctataaggatggctctaacaccagatgacgcccaggaagtatagatgggatgggatgtcaatcctgagcttaaccctctcccaggtgttactcttccaactgtgtgaggatgagacaggacatgagccatatcaggagagcaacgtggtaaggcaccactgagtgaggcttaagacagcaagccttggtgaaataggcttgacctattttagatagattgttgcccagccagccatgtccttggaagaaacacgggcatcctgtgaagggttaccagcctcatacttacttttgtttatttccttaaattaagatcctgcagctccaggcaggagcaggagaggaattaaaagtgttctcctcgggcagagctctttttttatgccgaagcgataaatcccaggttttattcttgcaaatttcagtgcagtttgaattgttttttaacatcagagccagctgaagaggctggtgggccatctgggattttagcagcactttgtggggtggagggatggagagtgcctgatgcaatggctgacacgtccgacccaatttcagtacacgctgttaattctagctttgattcctcatttacatgagataccacctacctgtcttagatgctagacagggtcttcccaacacagtttcaaaggggctcgatcttgggactggagaggtggctcagcattcaagagcccttccagctttttcagtggttttgagtttggttcccaatactctgtacactgggcccttcacaactgcctgtaactccagctctggggagtcgggcgccctcttctgacctctgtaggcacatacccacacatagaaacacacatactacacagaaatgagaatttaaataagtctttttaagagcttgagtcagtttcaaaaggctaccctagttcaaagtagggcaatagataagt

SEQ ID NO: 53 - DNA, 1500 bp, Mus musculus
ctatctaaatccttctgttcctcccccgttgtgtaacatattacctatgaagtagtctttttcttacataggaacattagtctaaacagctatgaaaatctggaaacaaaaataaaagtatttgtagtacctttgtgtttcatccagtgtgcatgtgtctatgtgtgcctgacattgtttttttcttttcctttctctctggctcaggaagagataaagaactccaagccaaagaacataggaagggaaagaaaattgaaaaaaatcaaaagacaaaaaagaactgagggcaatcactatccctgacctcaagctgtaatacatagcaatagtcataaaaactgtataatattgttaaagtaacaggttgatagatcaatggaatagaattgaagacccaaaaatgaatccagacaacaatggtcacttgattttgacaaaggtgctaaaaccatccagtggaaaaaagccagcattttcaacaaatggtgctcattcaactggcagccaacaaatagatgaatacaaattgttccattctgatctccctatacaaagctcaagtccaagtggatcaaggatctccacataaaatcagatacactgaatctaatagaagaaaaggtggggaaaagcctcgaaaacatgggcacaggggaaaagttcctgaacaggacacaaatggcttatgctctaagatcagggaaaactcttaaagccattgctgctctgtaagccttcaccagaatagctttaggattaggactgcatgttgtgattatgatgtttactgaaagggcctggggagcttcaatttgtactctcctgattttaccagcccctgtcagcctcagtatacagcagcccagtaaatataaactggaggttcacatatgaaacactaccttttactcagttgacataataaaagattaggattaataattaaaaaaaagaacttcaagcatctatcctggacagaaagggccccctgattcagaaattaagtgctcaagtaattaagtttctttcattaagctactggtgctttcagcagcagtttttttttttttgccagaaggcatcatcttttgggctcagaaaaacaaatagaattaatttccaggagccatcagttacttgccctgagaacacagcatgttaaaattgcacaaaacatcaccctttggccctagaatagcaagagagttaaactgtcagagtcaccagctctttgcccccagaatagaaagagagaatagttaaattgctggaagccattagcttctggtccccagttcagtaagtgagagttaaagagaaaggtcatcagccgttggctttcatctgactatgtcccacatcagcacctgtcaggtcagtacattgccaatacattgtttattagtgtcacaaaagtccaagttttgtcatatgtcttgactattatgcacagttctttaaagtaaatcaaggtattgcatgagaattacaaatctt

SEQ ID NO: 54 - DNA, 3050 bp, Mus musculus
tcacaggagcatgtgttgtggctactcaagccttgttgcttttgtttgtttgttttcaaattcattaagctaatattttcagaaacatccaacacatttacaattaataaatggaaaagatgttaagatgaaagaaatgtacatttcctagattcattttttttcaatatgtttagtacattcctatcataggaagcaggcactttagaaagcaaagacaaagagtactaggggtgaggttgtacaaaatctactagtcccaaaattattaacatcacctttttagtttcaaaatccagcaatttgtatgccagaaacaacataatctgaaagacttggacccaatgggtttgagtttgagttgagtgaatatttagttaatctgtaatattatttttaaaaggctctttcaagtggtctaggcttaaatggcccttgagattagtgtttaccctctttaaccaatactattccctcaaccacctattctttgttactctgtcctcttgtctcctttaccccagggacatcatctggtatatttctacatgaaaattgtggacaggaaggaaatgctatggaaatgcatgtcactgttatcccctccagaaacacagcagctcttccgatgcaagggattctcattaaagtccaccagagctgtaatgagggccattacacagaattatggactgtatcattgatcgaagttagagaattgacagggaaaaatgcagaggggtgcaagatatttgaatacgaggcagttgcaggaccgtgcgacagacattcttgacaagaagcagccaattatagcttaaatttctggcacctaaccagttgtgattaatagttttccattacattacagacatattattaatgtattaaaaatgtcaagctttggcaagcactaatatggcgtggcccagttggtctgcagaatttacatttaatgagctcccattgacacagaaaaaggtattgaccacagcagaatgcaaaccagtgtatagtcataagctattctttagtgtaatttttttttccctcttaactttgaagtctgtagcatcctctctttagggcccttcatatggaagtgtccttacttctcattatcacacaggctacctgataaatccttcactttttgtattcgaagaaattaaatctaggaactttagtgacaaacatgccttgggagaatcagggatttgttacaaaagtataattaggggatttttcaaaggaaataaatgttgtaaaaatagaatattatttacaccaccaccttcaatacttaacgctgctgacttccagctggctgtcctctcaaccaggttaaaaatatcaatattttcttaaaagctaggccatgggtgcaagtggatagacaaactgattaggtgaaggacagccaatgacatgtttggggacttagtatcctaaatgagtcctttctggcacataactgaactaatttcaaactattttgaatttgtctcaagtgtctgcgggtcattgggataagggcaacttcagaagggctctgggcagctcaaactccaaatctgtgtttttctcaccttgggatctcagaacaatcaaagactgccacaatctacatatgaaatgaaatagtaaggagtcctttttgattaaaaaaaattttccccattaatataccacacgtccatggaactctggtgaataaatttacagagctaataaaaatgcaaaattacataatggatctcagattgataagatattattgattaaggttaaaaataggctacccattgcctttgcatccgtggaacatacattttcccaggaatgtgtagctgcttcccttccaccttggattaactttgcagaggagtttgcacaaacccttcttctcaccaaagagagagagagggagagagagagggaaagagaggtatacaaaatattacgcaaaactaataataattaaaataatatagccattgtagtctcaaagcaattgccaatttcatcatctgagaggaaaatattgccagcaaatctaccaactctcggctggagtttaggattctttttattatataatctcactaggaagtgggggtgtggtaataggctaaatattccataaatctgcagctcatcggggcacctgaaatagacagccattgactcatactttacaggcattaagacttttatagaagtacatgtttctgaatgggtatgaaaagaaggaaaattgaaaataatcacgtttcattgactaaaggaactgcagaggtaacaggatgcaaagccactagcctgtggagattagcagctgtgaacagtcacagtgaggtcacatgagatgcgtttgcatcccttcagtgttctttgtacgcctgtctgttgtgaaaatgggatctttgggtttcttcctaagaaacagaggctcctgtctttttgttaactgtctcaaaaacagaatgtaattcaacaattttgacagatcttacttataaggaagtatgactgggtattattaaaaaaatcctgggagtttagaaaaaacaagtaccccacattagtattttaaagatttctatttttatcaatagaagatcaatgatggaagtcagtgcatattttctaggatgtttgtggagggataatatgtaaaaatgacttcagaatccactaagtctaaaagaaacctggcatcccgctgccatgtaaatgatagatccttccttctaatatagggaagttcagaaatacaagcttccacagacacagctgaaaaattctacacccacttaaagtttgaaacagaactccagattctaaaattaaaaacacttttctgaaaatatgttaaaccacttacttcctataacaccacataattcacacagacacacacacacacacacacacacacacacacacacacacacgtgtgcacttttcactactaacatatccttgctttcccaggtcatatgagatttcatttccttcccagtgacttgaggtttttgttactcaga

SEQ ID NO: 55 - DNA, 1950 bp, Mus musculus
tattaatgccctctttctggagcagcttcacacactaatatgggagacaaatatacaaaaatagtacaagaggcatccacataagaagagagagtcaaaaagtgactgtggaaatataaagagagtgtgacagagatacttacatgttacctttggcaaagtgggaaatctccagcataaatgtgaacaagtacacatgggaaatgatgtacacacacacacacacacacacacacacacacacacacacacacacacacactcacagaggccccatgttgttagtaaatcattcttagcatcctttatggttcttccaactgattcactgaggcaggctctctcaatcaaaccctgaaaccctggatgcacaggtgctctggggatcactcatctctggctcgtgaggctggaattacacaccagccaccacacccaccaagcatccgttaccatgttttcaaagtgaatcatgtgattttgaagatctcttctctttgtacagtttatatttctattgagaagcttcgatattcctgtttcactctccatttttttttcaaggtagaaattagactgaaaaccctctgacctctcatcagggggatgtatactgagttttcaacttctgttgagtgtacaggctaggaaggtgggaagtaaatattaaataaggagagtcccccagcttgtctgctgacagtatggaagaaccacccatcttgtgacatttctctagatcttcacacataggccttatttgcactcacaccttgggaggagagcagatacacagtgcaagtagggtgacttattgattgcctcaatcccagattgcttctcgcctttatgtggccactgccggttaacatcagccagttgtcatttgtctttgggtcttcaaatgttacttgtttttctctgctcttctgttctctttgtccttgtgactttgagccttgaaataaatgaaatagagcaaccccttcatggaatggtttcaaggagagaaaatgaactcttgtactgagtcagctacgttacctgcactcaagtctgcattgttctaggacacggtgccaagagcttaattcataatgattctaggctgcagacattattatcattatactacttttcagattagagttctcaatttagaatatgttcagtggtctaagagccagaaagtgcttggactctagattttggaatctgtaggttggatcacaaagagtttgtggtctatagggcttagagttattatgaacatacatttcttcttgttcagcatgacacagccagtgcagattccagactaaccttggtggtttccacagagagcagcaacaaaaggaaagctctccatggagaatgagctctgcaggatgatctgcagcagggattgggctgctctctgaattgggctgtgttctggtatatcttttaggatcctgtaaaacatgcattttgatctatttttggtattttgttaattttgaaatgtgagccacctgcttccgaaggaaggtaccagaatagagagtaataaagatgtaaacatgacgtttatgggcaaaagcagacttttagcagcacagttttaaaacttaagtatttgacagctgttttgcaaaaaatagacgacatgcttctactctgtcaggaaggctcacaggtatctgagtctaatatgaggcatggggaagtagccgagggcacattgcacaaatggattaattatctcgcttgattattggccacttctaaacttctattttctaaaatattattttgcacaaaactgggtgtaaattgttatgtccaacttttttttacatagttggtggtattgagtttatagctttatgtatacagctagttattaatggaatatatatatacacgtgtatgtgtgcatgtgttgtgtgtatgtgatgaataggaata

SEQ ID NO: 56 - DNA, 1575 bp, Mus musculus
tcatagtgattcaatccaagaaagtcaacattttctcaaaccttttgtcctggatttcagttttcttgttttgatggtaaactgcacaccccactgtagagattggtctccatgtgtgatgtaggaaattgctttgtttcctcttcagcttggaagtgttgcagagaggtgggtggtagcagaagggagtcagagttttgttgttctgctttgaagcctagctgttatttcagtgtcacacaccgagcaggggctgcgggcacacacatttgtggagatccacagtcttcctctagatttgcaatctgtggtgagactctttctctagggcctgtttcttaaaataaggaagactcagtactagagtttcacaatgtcacaaatgcatggaaattggatgtatgtgtatatatgcagaagcaaagtttaagatatattgttaatattccctaaatgaactactcttgggggcagggtctgtggatctgctggaagccctgctaataccttttgttgttccttagaaataagcactcatatccattcattcatccagatgccccttccccctttcgtcttccattttctttccctttccatttttaaagatttctctttgtccttctttatttcatccatcacttctttccacactgataaggcgatggtggcaggaagcaggagcatagcttcatttctcctgcttccttctcttttctaccttcccttccctctcttgcttgcttccctcctgtcctgctacctgtcacccccaagtcagccttgtcgtttctttgagacagttgccttaactgaaatacgtgggcttccttctctctgtctttcaaagctttgatgaatagcagacaagaaagaaagccaacaatgttacttcataaatgcagtaagagacaatgagaacattccatgcaggttgtgtagccacccaggccttggccggaggtctgtgtctgtagctctattttgacagcatgtgttcttcatccagaaaaaaacacgtatgagttttaccttcttttcactgactttcttatacacacactggcacaggtaaagagatagaagtctaaatgggtctaactaatgatttgaactattactctagtgtgtcatgctgcattctaaagtacttctgtaactttaaatattgttaagattcttattaagaatcatcttggtcatttctgtaatttaaagtagatacagtttggggggggggagtacaggaatgcccttgttaagtatgcaccaaaacacaggaagtcttgttttttgttttgttttgttttgtttttgttttttaccccatcaagcagaaatctgtagactttttcaatgataacaaggcatctaccatgcagtaggcacagtgcttttaaccagacttctaaaaggaataaggaataactcctactcttcaacaattcagaccctattagtaaaaattacctctcagcttcagttctcttgtgtataaaacagacctaagaatacataacctgatcacttacaccaattaaaagccatatttgtgctatgtgttcaggtgatggc

SEQ ID NO: 57 - DNA, 1800 bp, Mus musculus
gcatacattatctcaccagctgctttcttaatgtaatagcagcagtgggcaaaaaccatgtcactgatgacagctcttttctgaccttggtctcccagccccacctactgaaaacaccagaacagctggaggagagcttattagaggccggaagctgacctcgtgtggggacctggggcttgtaacagcagtagttgccacctctaccttctccatctccaagggggcaatgccaccagcaagagggttcctggcagacctcaggaggctgtgcagagctgcagaaagaatactcatgacccacagagccacagtctgagggtggcaggcatcagcctgtgggagattaagctcatctgctctccgcctccaaccctcacccccctccgatctctcatttctcccgtgcattagccatcattttgaaagttttactgagttaattaaattcttctagtgttgatggtaagaaagctgaaacattttcaactgagattgacactactcaagacacaggcttcggtggtgtttgttcagtaacactcggatatgtcacaggattgctgtgagaacatctgagagctataatgagctaaaagtcaagcacaggggaaaatgtgttccagactgctgcagatgttcgcaaatcaaatcatatctctgtgaaatgccatatagaatattcagctgctgtaagatgcaatgtgagagaacagttccactgatttgcactgagtttaacttttttggggggtagcctaaatcatatggaatataacgccccccatctttgaatcaattaataacagagtcacttgattctaataagtggcatgaatgaatttcttgggctgaaagtagtgtattcattgatttcagtagcacccccagcctggaaaatacattgattaagaggaagatggagaagaaagctggtacccgttttctttcgttttccccttggcaccgacctcagaagagctctctattgaattgattcatgaagattctgaaacgtctctctgtaatattatgctgttgctgatcagtcctcctcctaccccacctctgaaaatcaaaaggaagcttagcagatggtgggcaaggcactgtttatatcaatgaaccttttctctcagcagtgtagactccatcactcagccgttctcacactcccatatgtctggtaccctgccctgggattaaaatattatcttcttcagtaagtggtaacaccgtgtagaaattgacaactcagattaccaaaactgagatgaaaattctgaggtggcgttagaaagttcagcagaaatcttaatttcacattttctagaaatactaaattaacaagttgacaatatcaaatgctggcaagaatacagagcaataaaaaaagggtaatagcttactaaataatgcatagaatgacacattaaacattcttttgattatacccaatactcaactctgaacttataggcatttcttcatgaaaaataaaagtaaatattcagttttgagatagaggaccaggtcatttttgagagattttgtatattttttatttttttgagattgtgtattttatataaaacatgacatataactataaaatctcaacgatatggctacctaaaccagaccttgaacaatgacatcagttggcatcccaacatggatagagaaaataacaacaacaaaaacaccacccctaaataaagagcaacaggtcattaatgactgctgagaaaaccaggctgctccagagctgagtcccctaaccagtcatccaatactatg

SEQ ID NO: 58 - DNA, 1900 bp, Mus musculus
agctggaaaagcacaggaacttttcttgtattgactctgaaaatattctaaaccaatgcagaaagtgttgctgccttgatcactagataaaatgagggttttcttgtttgtttgtttgtttgtttgtttcactttttctctcctcttctttgcaacctttgaacactactaactttataaaacacaggaaattgttataaaaagcaactaattgaactagatgccctggtacatgtctggaacctccggacttagaagacttgagatccaggcaagaagatgatgagtgtcagggctgccttaaggttgtacattgagatcctgtatgtgggccagcatatgggggcaacaagcaacactcttcactacagcatctctttatactcagttaaagattatcaataaagtaattatagccatccaatttcttattatgaagatgtatatagtgaacattgaaatctttttctttaagacagatacaatgtagaccaaggtgacatagaatttgcagtcctagctcagttctcaaatctttggatacaagcatagggagtccctgaactataagaactataaggacatttctaaccactcctttccactcataattgattctgatacatattgtgtatctggtcatcagcctgaaaaacagcctacaatggaggcaatgaacttgcttttatatcacaacaactgagagaaggaagaattaaaactcgtttttgttttctttgttttgttatattggagttgagagacttcagtgttaaagataaaggcaagatgaaggcatcctagaggcatgcttaacacagaaacatggccacccagacctcctgacctctagaaggcaggctccaagaggcctgaggatgtcagcattccataatttctcaaactaatccattggttacaatgagcttgcctgttgtccataccaggaagattttttttttttttggagtcagtccatagctctgtgctattatatttcagggtacagagtcacatctaacaacagtgtgcacccacgtggcatactcttacatatttcaggtggtcccaccggccatattaaactgagacattcctaataggtgctaagaaagtaatgatcaaaatgagtttaattaaactaatttttaggggcagtgagcagaggggcaatcactgacacatatgcgacagcagcacattgtaactcagaagattatttgctattatctcttcctgcagatcccttgacttaccttttttaggtctcaagccctggttttattttgtcttctccctacactttctgaacagtttttttttccctctcaaataagctatttgtccagaaacgctaaagcgaaagtgctccgtctgcacaaaaggcgcttttagaaagccagatatgcacagctaagctgtgcttgcaaaactgtttttcttaaagtgcagtcaattgaccatacagcagcactaatttgctcttaaccagtaaagcatgtgcacgcagtgcccacatgacagcctctgcagccagggctggggctgcttgcttatacatgcagctcaggcaagtttaagtgcaccaaccacccttggcgtagaacagaagacagaactccgctgctttatgcaaaaggccgcctttccatttcatcaggagtaaatcgtgtgctttctccatgaatcaaagcttctcctccagaaattctggaaaaactggttaaagctagccttctgtaaaaatctaacatcatcatcatcatcgtcatcataaccaaattaaatgataatatccatttacctattatataaaaataatccgtaccccatcctcaaagttcatttttacttatattttttttctcagactataggctacttatacgtgcttaacttc

SEQ ID NO: 59 - DNA, 1800 bp, Mus musculus
ctgcttggtttgacacagattttttttctatgtcctgaagccaaagtatataacatcttcagcaatagagcctcaccatggggttgtgctgaataacctagagactagcaatagcctgtgttgttttggagacctttggggtctttctgagaataactcaaagggccttagactctgaattttatttttaacccatctcttctaggagcaacattacctctgactcttctgcagggtaatcccatttgaacttttgtttttaagttgttatttgaaattagcatgctaactagtaggtttcacttggggggggtaagcagaaatcagggactatataagaaatcaggggttggagggagtgacaacccaaaggaagggggtataagaagccacatggacactgattatttatttcacaactcaactaaagtagttgtcgaatcttttctttgtggttacataccctttcaacctgaaaggtaaacagaagatcagactcaagaactacattcagagaaaagatagaatatcccactctctgccacattccaacaaacgaacacacacacacacacacacacacacacacacacacacacaccaaacaaacaaacaaacaaaaaaaaacaaaaaaaaaacaaaaacaaaaacccaagcttgccttgaaaatatgtaatacatgtgagagttctgttaagggggcttatattccccaaacgtgaattcagaatgctgttaccttagcatttctaagtgaacctgaaagttaaggagaaagaaaataatatactaatcaccacaatgcagcccagagttccacatatctcaagtagctggtggcttagctcctctatccacttggctgttttgattctttgaaatataggaaggtgccgtataaatgctgaacatcctagaaggtgtactttcctctgccagggtaatgttttactcaagtcattcagctgcatgctatattgcttagtttccaacccttgcttttcttccttaaaatgtgtaccctgctctatgacgtcatctgaattcttcccgagaccccacccaccctggagaatataccttacacatcctaaacctgactgtaagttgcttgaaggcaggagatcacatcttccagaaccaagcaacatcttgcctctgctgtagctcctgaatatgtgctggtctaataaatctctattgcaacatatgttctaggagttgcttttggataaggcttcactaagaactttctgaagtgctcaggacttcgtgatttggctgtttctcagaagcaccaactggcttttgcttgtttttagttctgtgtatgaattatgcatctgaagtttctctcctactgtgcctggctttgatgacatcccaagctttcagttctctctatttctttgttagattatacgctttatctcattcttggtctggcttttccacctttggacactaatgtgaataagcaagatcccctttatttatttcctcttgtcacatgcagcttcatgttcagccctgcttgtcattttataccccacagagatgaccagaaaccctctgatggatgccacagtggcggtgcacttaccacacattagttggggggtggtggtggaggaggagcattccaatgaggggaaataacaattttctttcctgttttagttccaagatccctcagcccacgaagtcagcatgtctctgcattgtgttttatattatctctaggcaggaatcactgctgatatgttagccccttcagcacctatgctcccacgagttggc

SEQ ID NO: 60 - DNA, 1800 bp, Mus musculus
gatggctgctgtctggttttaattcttaatttatcttacacacggttttgagtttccatatagaaagatagatgattttgtataattgttaccataaataagatatagaacagtctgtcacattccccacatcccagactccttcctttgttgtcacaatacagccatctcaaccttggacactcacctgttccctttccttaaagctttgtctcttcgagaatgcaaatggggtcaaatggagccacgagtgtgtacctttgaaagactaacttattttccataggaggcagcaggtgacattgcacactgaggacacgatagttcacttctttatactgatgagtatgacttcaagtcaacatgaggcattattcatcctttcacctgctaaaggacattgtggttgtttcttgtttggcacgtttatgaataatgctgatataaatgttcatgtacatggttttgctctgagcataaattatttccttcctgcacaggcatgctattgttatgctgtaggatatattagttatacttaaaattataagaaacgtcaaaacagttttcatcccagccatacggtcttgcatttccttctttctcttgtggcagatcagcttagtgcggagtctctgtagaggttaaaattacggcattttgttggttttgctgtgattcttttgaggttttgctattggacggttttccatggccatcctaatgggtatgtgtatggtaggcttcggtttggtgttttgtttacacttccctaatatctgacatcattggtcacctctgaagtgtttgtttaacatcttgcatcagtttggctaggcagcacccagttacttggaaaaatatatcaggatggttctctcagtgtgtctgccagttgtatttatcgctgagatcaatagactctggaaagccacctctcatccatcatgctggagggcctcatctacttaattgaaggccttcaggagaagcatgggcatttcacagagagcaggaggcctgcagtttgctgccttggcaccagtcctctttgcatcactccctgctggcttaggaaatgctgctttccatagctgcctgagccacttctttgaattaagcatctctttcaagagaaaggtcctgttggttgtactcatctggagacccttgctaacgtgctacccagaccttttccccatattttatactctgtggtgtgtgtgtgtgtgtgtgtgtgcgtgtgtgtgtgtgtgtgtgattattgcattttccaaagtgtctttgagactggataaaaattactttactagatatgttgtattcccatatgttctccagaaactggctcatgataaaattctcttaggagtgtctttctcataaaaatgtttccatttatatgagggtcacatttttcatttttttttctttcaaggatcacatgttgcgtatcacacatttatttcaagtcaaggacacgaagatctccggaggtttgtgtgtttatgtttaggattcactgggcagcgaggttacagcgaggtttgcctgtcacacgaggcatggatccaatctgcactttgcctttgtacaactcatataagactttcctgacactgcttactggaaagactcatccttgctttgtgggattgacttgcgtctcaatttagtatgctggtgtgagcttgtgcctaggcttgctattctgcccagtgataatgtgcttctatcactttcccagtgtcacatctttgattgacccaggtttagaatacactgcggaattgaatagca

SEQ ID NO: 61 - DNA, 1725 bp, Mus musculus
gattcaaaccacagcacaggtaatgaaggataaaacaccaagaaaattataaaatgcacaccacgtctataaactcttctctccctttcattgtctctctgtcagtgtagtgtttctgtatctaaatatccaaggcaagatactttctgaataaaatgggttgatttgtctcatgtttctagtagctggaaagctcaaatggccaaaagccagcatttgccaatcgtcactggtgtctctgtcacaccatgacaatgaagaagcaagagatacagaagatagagaaggagccaagcacatggaatagctacaattataatcattcaatgactcaaactttaatttggaaatgagaactgtcagtcccacccacaaagcttgtgttggtcagccccccaaacctctataccaatgattgtcaactttcctagtgctgcgacccactaatacaattgtattaaatataactatttaatagtgttgtgatgacccttataacttcatttttgctactgttatgaattgttatgtaaatatctgatatgcagggtctgattatctgcccccacggagggtcaggacctacaggttgaaaaatgctgctctacacccaagatgatgatcatgtcaagagaaaagctttctacggctcatggtttcaaaggttgcaatccataactggctggtcttttggcaaagcgaagtaggaacacatgatagaaaaaccttttactacatgatcaggcagctaaaaggaagatccaaaaacaggccctaaagtccccttcaaaagcatgtccccaacaacgtgtaagtctcgcaatagtctccaccacttcccagtagccatggccagggaatcaaacctttattacatggacatcgagcacatactaaagactagagctacagtgctaccctagttcacaaagatccaccaactcttaaaactatcacatcaggagcagagcttccagaacgtgaattttagggaagaaattcaaaccatagcattttctggttttcttctggttaagctccaacttaaaatgcacctggaaagctaagaagaagccctgggaggccccagggagaaagagagtaagaatacactgtagcacaaaggaattacaccacttgccttttcctttagaattggcctgaaggtccttcctcattgttctgctgtgagttgttttaccctgccttctgtgctgtgatagagccacctcaatgagactgttactacactatgaatcaatagactgctgcctgtggacgggcaagcatacctctcagttacctccaaccgggagttgtctatatctggatcttcctcagaatgattgttagaaaacccggagccaggcccccgctcagtctttctttggcttcctggatgaaaccattatctcatgcttcatatacatttccaccattgccatctgctgtgaggtaatagcagagaggaaacccttaccagagctgagctgatgcaggcttcatgcctttaaacctctaaaactgtgagataaagaacttagtttcttgtgggaaaaaaaatttgactttcgtgtaaggactatgtaacagagtatttggataatgctgcaaatgtcttctaagagaataacaagagtcttagcagctgtaggcaactagaggtcgatcttgccatcactaactgtgaggagtgggtgtggcagcagtcccaaaggcgccagg

SEQ ID NO: 62 - DNA, 1925 bp, Mus musculus
tttttatttttgtgggtcagtgtctcactatagagccaagcttgacctggcgctacaagacttccatgtagctcagccttgcttcagacatgagattctcctgccttaccctaccaagtacttggaatgtagctgtacattccagctctggcctctcttacctattaaacaaatgggagtaataaaagcacacttttctttctcatgatgtcctcatttattagaatataacatatacaaagagaattttaatatcatatagtttgtaaataaagggaagaattttaggttttgcttcacttgtatgccaatattttgcttattataacccagttctggacatacgagtatttaaatgaaagaactgtactctattagcccacattgcttaaaaaatttacagttttgatctactggtgatatgtttctcaggatgttttttattttttctcaaaagtgctggaggctgaactcagaggtttgtatgtgctagacacgtgtacctctgcggagatagggataatcaccgatctttattttgagatggagtcttttcatgccagtgaggctgacttcaaaatagcagtgaatctgttccctgaatgctgggattacaggcttgtactctcatgcaaggcactgtgcctttctgctgtgaaaagtagctcgcttcctttgggtctcttctaaaatgcatggactctttaaatccctgacactactctttacttacaaagccttgtgatattaaattaggaaaatagcttaataaaggaaaataaaaattacccattaagtcagcacaaggtaaactttctatctctcaccttctaacctgttttataatgataagacactcacggagctgtgttctgcactgtaggtttttgtccctgatgtaacagtaggggcgttcgactgttccctgtaagctcagaatcgacatcttaggatgagtacctcatcaagatgtgcagatgagtccctgataagcagcactctgagccttatgtctcaaaagctgtaatgtcaaaccaccatgtgtttaaatttgagaaagagaaattgatgctaacaataaagaagaatgtagtgaggaattgagagcgttttttccttctgcaatattaataataataaaaataatgagtacacaaaaggggttaagttggaacattgacacgatttctttggatctttcattttaaggtgttcctctcatcatacactctttcacagacagcaagcaatgttatttctgtaatagagcataaatattcaagagatataaaaatagtgttttattttttaatttcgtataagctgggacacgatcacttgttgaaaattaaatagtgtaaaccagcatccatattacgtgtgatttttctctattgtagccattttatattttcttctgatccttgttttaatttcatcttcattcttctcctcttcctcttcttttacttatcatttatttcctagtgtataacaaaaatatcaggtcagcttccggacataggaaatccgcacagaacaaaatgtataaatccacgggacacctttatttattattcattaatgtcagttaataactgactgtcacttgccagtcaacgtggaatctgataaatggctgccattgactgatggacgtattcatgagaagatgtattggcagagtttgtaggccacttgaaaacagttaagcatcctggttcagatttggagatgacgatttcatcatctcactgacttttctttaaatatcatcacttaaattgatattaaattatcaatatcacacttgattcactagattaattttagatttctagcacaacttataaattagagaaatgagtgtgtaattttctaagggacacgggtccctggtgtgtgacctgcatttcaaggaagaa

SEQ ID NO: 63 - DNA, 1925 bp, Mus musculus
gattagttcatattgttgtcccacctatagggctgcagaccccttcatctccttgggtgctttctctagctcctccattggggatcctgtgttccatcctatagatgactgtgagcatccgcttctatatttgccaggcactggcctagcctcacaagagaccacttggggcatatgcaatggtgtctgcatttggtggctgattatgggatagacccctgggtggggcaatctctggatggtccatcctttcatcttagcttccatgggtattttattccctactctagtgaggaatgaattatccatgcattggtcttccttcttcttgattttcttgtggtttgcaaattgtgtcttgggtattctaggtttctgggctaatatccacttatcagtgaatgcatatctagtgacttcttttgtgattgggttaccttactcaggatgatatcctccagatacatccatttgcctaagaattctaacattcttttctgcattaaataactatgtctacctagtgcacttggagaattcctctcctgtgccactgcccacttctttcccgtgtcctgtcaattactgaatataatcatcattagaaagtgcagtgacttcacagaagcccagcacacacaacaggggctgagctacatccatagcaatcagttggttttgatatgcccagcatggtagccacttgtcctggagagactgctgagagagtctgggaaatgaatgtgacctttatctgtatggagcacagattgcccatccctgttcttcctgtccatggaagggataaaggctatgtaaattatgagcgtgtacctgctctgtggaaaacattcaaacatgacttattagtctgttcaaaggtagaggtggggagattcaccaaaagctcctatagagcaccatatacaaggagaatgcttgctaaaaggcacattgcgaggcagagagatcatgaaagtaagtttgtttagtcactgttttatttttctttctgtgggacattacaggccaatttggtagatggagaggggaccagagagtaatgagttccagaaaccacaggtaaacatgaaattgtgcttgtttgtcaccttcacacactcacagtgtgggtggccagaggaaatattcttttctcagacaaatatactgatttgtaccataaagtgtgtggtgtttttttcctaactactctctgtaactagtaaataaataatcacataacatacttatattaagatttaagacagatctattgtctcacagtacagaatacagagaataaacatggtagacagaagaaaacatgctctacttgtcttgaaatgaaaacaaagtaagaaaataacatttaaggaaaaagaaccacctctgtactaagcctcggagtctctctaggattaagctcaacgttctttctgatgctaaggatagaacaaccagctgttgaactttgaagtaattggttcacagctgtgcttatactgagatggaaatatggaaatacatttgtacagaggaagaggtttttttttttttctttttgagttgtaatgagagagttgtcaaattaaacccaaactgctgtgagtaaaataaattacatgtggaaattcagttcctgatactttgactgggtggatcctttcgttatgattcccagaaagaactcttatgctaatcattagaagaaagcttatcttattcccttatattcatatcaaggaagcaagtgacctgaaatgagctctatgtacttttgtatcataaaatatgtaagaacagactcaatgtaaaacagcgcatttcaagcatttattccaggcatgcaacatctaacacacaaaaaatgttaagaccacattcctggctttaaatatatttgaaatatacttgggaaggtg

SEQ ID NO: 64 - DNA, 1775 bp, Mus musculus
gaacacactgggaagaaagggcatgaatttgagagagaacacagggggagaaaaaggaaggggagattgtgtttatttataatttcaaaaataaattaagaaataaagggaagaaatactaattgagtgtactgcacagcacaatgcaaaataataaatgaagagaaaatttcctattttttgttacataaaatttagccttaataatttgaactataatcttattaggctgacacaatatgtgatccagctactacttttgaaaagcccttgttaatagtactagatagtaatacattattgtgttctacataagagcatctaggggagaatactagggaaatattttaaagtctagtcaggaatgtcctcatgagttcttcaagaatttagcagaattctttattaaaattaaggatacataacaattccagttcatttctaaaatatattttatcttaatttttccttcctttgagatttttaacaaagtccataatataaggcctcctataaagctatcttgcacttacttcaatgtgatcagaatttcttcagtgtctctgttctttgctgaggaagccacgacatatctggcatggttataacagcagcaatgatagaaatcctgactgtaacttccactgtgatttgaaaacacggggtttgatgggtgcttaaagtgccaacactggcctggagactcattagtgtttcctgtaccatgtcaacatgacagtagtacagcgtgtgcccactgtgctctattgcttcttgtgatgttggagagtgtgacacacgaggaaatggccatgaggcaatgcagcttagaagataaagaaggttgccaacaaatgacagtgggagacagaaaggctgtcactgctgctaaatatgcaacagattccatcctgcttctagaagagatgtctgtggcacagaatgatagagaaaagggtgctgtggcacagccaggaaatgcacaatcctaaaataggtggtacactgtcaggttttattgttgttgttgttgttgttgttttattttgtctaactatggaattcaagtgtttttaatgatttggatatattttgtaaaaccataggtcagtaataacttgcccagttttatgttgctagcataatgggtgttgtacttagcactctttgacacataggaaggccagcaaattccactcaaactgtggactctgttgctttgtgtcattgtgtcaatatgaatggacatcctgactcaatagctttagataagttagaattagaagaggggttatttattgtataactccactggttattgtatccatggtacaagagacattgtcttgataattattctaaaattaaagaaaaaaagaagtgaaacatgaagtgataaactgcctctctgtgtgtcgcacgtatacctgagcgcaaggcctaaaacttggaaatatggcacaacgcaggtaagagaaagacttccccattactctgtgggtcaagctttaatgtgaaaaaaaaaatgcctcggatttttaataagagtatttgggggaacaagaaaagggaaaatattgtctttaaagtaagagtaaaaaaatctcccctctttataatgttaccctcaccatcctttacctttacctttacctcttttgttgttcaagattccaggtcattatattcctacattaaaggatgcatgtatctgaaagtgtggtatgcatttgtgtgcatgtgtgtgtgtgagtgtgtgtgtatgtgtgtgtgtg

SEQ ID NO: 65 - DNA, 3800 bp, Mus musculus
tcagcctttatgggacaggaaaaagaagaaaggggagaaaaaggagagcatgaaggtgggagggtgtagggaagtgcagggtagatatgggaggagttgggggattgaaatacattacatgcatgtatagaattctcaatgaattagtgaaaaatgcttaaaaattaagaccgaggagctcaagaaacaggctcggggagaggggatctgtcaaaagactaaagaagcatccacaagccattgcctaatccactgccatcctctctgggaacaatactcacaagactgattgcatatgaatattgacacatatacttgcttaggataacattatatcagatctttacgatccctaccaggaaacaaacttcaagtgtctctgagatgaaactctttttttctttatccctttccaccttcttcagctcagttctagtctttcccacccataccacacttactcattcattcccccaactacagcctcctaacggcaaccttatatgttgtcacagagctgatgcccataaaagcttgcaatacagaggaagggctagatgtttgtggtttttcccttttcaggcagatctgccagaccgtgatctcatagaaacttctattaactcataatgagtagctcttgcctttcataagtggtaagatgtgtatgtcctgtggaccacatccaaatgatctggaaatttctacagattgtcagctaaaatctgcaagtagactaaatgccaggttgctgagccctgcaaggggaatttgaggacaatatacaaataagtacggggactccttcgtggttgccagggaactagctgcagagtgcatacgctgggctctctctcctgcttgacaccagatatactatgaaagctgggagcttacctaagcctacagatgaaggaaagttattttaggcatgggaagagaagatggaaataagttaactggttcaaagcctttgattaacagttggctgtgatgtcaggcatcatggctctactgccctggaatttgcctctatagagactcagtgaaagaccattagctccatccaaaggaatgaaaaaccatttagaggtttcaatgaaagggcgtgtgtaatcctttgtgaggtcaggcctttccacccttggttttgctctgtggactgggtgctctacagacatgcatagaatgccgagtttccctctggaggaccactgttagaatggtgtgccatgtgttcagtggacagctacgcattgcaggatggatcttccctgcggagctagagtctttcatcatttaatgctctccgcgtgccctcctgtatccccagcgtccattatcacagcctgttagcccatgtccttctcttgggtggcccacccagctgtatgcttcccactaccccttcctcaggactttcgattcatcagtgctgtttcagctcccacagacactcacagaaaccacaccccacctcagaatgctgtttgatgcttgccaggatctgcatatgcttctctctccatctggaaaatttttctccgctcccctctctctggctaactttccagcatctcttatgaattagctctggcctgagggaaggacgtcagctgtgtgattgattcaccagtgcaacccaagctccagcatgctacttggaaggcagcataaaccaagagatcctacttgtctgcaggaacaagtcagtctcttctgggcaacatggttgttgataaccacctcctggatcccttgctgggaggggtctgcatctgagcccatggttttcctctatgtcctgtatcctacctctagattctaagcttcttaagcatagaggccatgctcactcatcttttaggtcgttggtgtctagcataggccccccgatgcagtggatactaaatcagtgctgaataataaacaatgggactgaagtagatggtttctgctctcagacactgcctcattgtgagtgatttttttctcttcccctttcactgggcaaggaagtctctctgcatctacagatcgactacagcaactcaatgaagagttattacttgatctgtaaaacaagatagctttgtaagaaaggggtgaccttgggaatggtagttcttcaaaatccagccttctaatctgacaaatgggcattaaaaagtctcgagtgttatctcatggctgggcattatggatatttgacaaggactcaggttatctagttaatagggagatggccttgggaattaaaagtgagggagtgggtcaagcaaggcagagaaaagatttaataaaaggcttctatggacaagatgggcctaaccctgctagaggccctcggaggaaccttgccttactgtctagagatgggctggaagcttgacagctgtcctcctcccctcctggcttaactttggtcctgggggattgacttcccctttgttctataactaagcaaacactgctttcctctctcaaccctgggataatggaggaacagcccagcagagaaaaagcatcacacatagacttgggatattcttagtatgctggaaaatgaaggctagagctgcaggtcggctccaaggtggaccacagaggaaaggactgtctgtagagagtgtatctgtctgccaaatggcccatcctatcaaacggtttccttagaaagtaagatgattcgttagcctaacatgtgatagaataccagggatatgaagtatgacattgccttacatttcagcaatgccccatccccctaccaaagaaacttcctaccccttctagccctgtctttcagcctctgtcctcccatagcagactgctgctgttgaattagcctcatcaaacccagcttgctttgttcctgaaggatcctggaggagcccacagagctctggtgacgctcattatttctccacgagaatcggagacctccagtaatgagggctcactctggcatgtctttttttttcctgtcagagagccagtgccgcttttcccaccctgtcaccaacttgaggaaggcctgaccatggagggggtgcatgggagagctgattttttctcctgcacaaggagcatgctacagtgggggtcctcctgtcacaaactacccaccaagaggtgcatgggaaaccagagagcccttgattatgaagcttctctggcctgtcagctccacagccaggacacctcagacttggtctcgtaatgagattttttggtgtggctccttgcaggctttctttacacgccgaggatctggacgtgtttccattagcagggccagttttagtttagttgcctacaattaactagtctgcaaatggtgaggctgggtgatgcattgacctacttgatagaactctctggtaatgacgatgccttgatcttcatttgaagaagtgaggtcttaaatattcatatgttttgagccaatgactttatttcttggcatgctttgtaaggaatataaaacatttttccagcagagatgcttgtcctaaaattacttgtacgtggaatggcgaacaacaataaagagggcagtgaccaaatcttatgtaatcgtgtggaaaaatcatactaacataatgttcagataaaaatagagattttaatattaaactgcagcacaatcatcccagtgaaaatgagcaaaataaaaatagcctataaaatgttttatcaacggtagtaattttacggatttttttttttattctctggactttcatgtctttttatgttaagcacacacttcagctcaaatgacacttctttttcaa

SEQ ID NO: 66 - DNA, 4900 bp, Mus musculus
tgtcaatattattagagtggaccagaagaaggacaaaaacacctaggaagtgaagttgagagttagaccagaaaagctaagagtagtaatgcaatctcagggtaaaatggtttcttcttttctaaatcattcttctcatatattttcttgcttttagaattaattcactcattgaacaagcaaactttttttttcctgaaggactcaaatattagatgagaaagtgtattattacccatgaagtccccaaagtgtattaggcaaggccactgtaaaattctaaaagtatgcctaagaactaaaggcctttctggtccctttagtattatttccttgagctcatgagtcctttctacattgtcagtcttccacacattgaggaaagctcaggctggagtgagcagactgatcctttcactgttaaggacagtcactgtgtaaagctccacagagccacctcatggatcatgtacagtcccctcatcaatcttgccagctgtctcatattgtgtccttgctccaatattgtccataaaaatggcaggcagaccgtaaatcactgttgtatttctatattttaactcagtttacactttcaagatttacttcatgaggcaagtaaaaggttacaaatttacattataggactctatcctgacttagagctcactgccatcactcatctggccctggcccagggcaggtccttgtataccatcagtgtgtgcctagcagtcctggcttctggttggcaggtggaggtgtggtctcaccattcaacttatgcaaaagaatcacaaggaaagaaccagagaaggtcacaagaatataatgttccttttgagcccctttaactgtcagcagttccaaagactggaaagatgctaaggaaatgtaccaactgtagccatgtctcagtgtacatacgtaagacatatgtggagatcttgttaaatattatcaccaatatttaaaggtcctcttttaccactgcataaggactttttgaaaatttatatataaaaactaacccttatgtaatagagcaagcgttcccaagagcatgaagaataatgtttaccaagggcagtcactgaatcgaaccattaaagaaatagatttaaattattcatgagaacaaaaataaaagtcctaattctttttgtaggcatttctctcttaacccttttaaaactctgacacacagatgttagactctcatgggacagcttcacccatgccatcttacctgcctttcaaatgtctgaaaaaaacaaatctccaaagttagaaagctgcatagcaggtgctgtgttcctgaagaagacattattttaggaatgaatccttacttctgttcttactcctttaaagctgctaaaaaatgcccacacaacatccccaatttcatctttctttacggctggttttatcaactcataaagtccctgatcgccactggctgctttttactttttaaacttcttccctacaacccttgaggcacggtttctctgtgtagccttgactgtcctggaactagctctgtagagcaggctagccttgaactcgaagagctctgcctgcttctgcctcccaagtgctgcaattaaaggtgtatgccaccactgcccggcttcctctctacttttctcaatcagctcttaattggttccagtcccttccggttaatatttttttgtttttgttttaaatttaattgtattttaaatgcaacacctcagttatgattcgggacagatgctattaatggtgctcaggaggaagggagggctgagatcgatggtcggcactccttcaggtaaagaaaaccctgcaacagggctctcaggcaaaatcccgggtgacacaaagactgtgctggtccagggcacctggctgaaggctgcaccctggtccccccacactattcatactgagtgtgtgtagagtctgctggaaggtaactagaaaactctaggggaaaaaaattaattccaaccaggaaaaacagtctgacagcttaataatacattcgagtagatgcacaaataaccagaaagacctatttactctaggaagttgggggcagtaaattctcagcatattcttgaaacaagtgtattcagttcagcacgggtttcctgaacggtatcataagccaaggcattgttctaggacttgggggaacaacaaacaaacaatttggtctgtctgtctatccagagttcaagcaggaaagactggaggtaggcaggtaattacttctaattgactgcatgcatccctttatcgtaaacaatccttccctgagttcctctgctgactcctttcctcaacgacactccacaagttctatgatgttctgatacacagtagcgccaccccccccccttgttggaaatgtcttgtcctaaacaaaggctgtttgtaatgaagagggaaactcagggtgccattcctttgaaagagcatcttctttgctggagaaggcatggcaaatgtgctctgagcagagaggtaggcagggcttaacaaacaatggagaaaaaccaaacccccaacaagaagcattaatacttaaaggagaaggccagcagtgataggaacaacatcatcaaactttaatccctctcaggcattatccttaaattcacagaaatccaagtttttaatcttccccagatacaccatacagtttttttctctctcctaaataagctctactttcctttatacctttatacagttttctccagagctttaccctgagtctaaaatgatttctcggtgtgtccatctgggtgatgttggtcaaacctgtaggtgtttgactgtaagacattgatgacaaactcatcagagctgaggggcagggtgagccatcaagttcatcagaaagatgagggaaacttctttgactcctgccacctccccaccccaccccagtccttctttccaaaatggccagggaacaaaggcgagctcaaatgggaaaactaggaagaaggtttgtccttaaacctctaagagactttctttgctaaaagcatattttaaaaaagatatattttcattgtaatataaatataatttggtagacaagctcaagttttctgtaaaaaacattagttctaatatgtatattagagtccactgggatctatgtatattctgccagaacacacacacatacacacacacacacacacacacacacacacacacacacacacacacacacacaaacacacacgtttcaatggaaacaaatttctttcctcctctttccatcccactcactaggccctttggaaccctgatatttaatgtggataaaataatccaaatccataatgataagctctgggtacctgttgggatggggacgggttgtgatagtaaatacattattttcgtctttcatacaaagagtagttaatgaatcatttgaaaaactgcccacagactgattaagtcagatttatcttctgattaaatgcataagcaatagccaacggcacaattcatgtaaacataagtgttgtatatttataaaccacctagctagtggctcagagtgaacaaaatcaaagagatttagccccagaaagcaagcagctttacttccaaatttaaatgtcatgtttgtaatctgattaagaatttcagaaatcaatgtagaaaatagattttattttaacaatgaatgctattgtcttaagatggacggtgggtgtgaggatgaggaggagaaggaaggagtgcaactctaggaagaatctcagagaataatcttctctagttcaagggggctatagaatgtcaacagctcttccacttgtgtggttccacagacagaagtcagtgaaaagaagggttctcagcatctccatgtatgtgtgcatggttacagaaaactgtacccatactcaattcacacaggctgtctgtctgtgtgctcattagtgaagggaaattgtatcagagccgttttcatattcactccccctccatgacccccccaatctcatagtggtagcttaggctggtctcaggttagtgacctctctagcctcctcaaggctgagatggtagacaggtgataccatgctcacttacactctccgctcccctcccttctcttagagtttctgacttgactggactgcgtgggacactatcctgcttcacattctctgggtgaactggagaagtgacgcagatcccatcaaactggcacaggtgggcttgtagccccaggctggaggaagtgtggctttgaattctttgtgtgcaacactttcacaaaagtaaagacaagctctagggttgcctcagcagtgaaatggctttcctcatgattacctgaggagtcaaagctgccacaatctttctgtatgttatgtttctatttttggatgtctgaagtataccccataagatgtacaaaagagaatagcaaaccaggggtctgacaaggaaggtggctgctggttaaataacttaatgaatagacttaggaacagtactctacaattgctaagattatgtttataatgggtttttgtaaatgagaaaatatgtttgattcatgtagaaaaatgtctatctcagttacataaacatttgtagaataggagagagacataaatacactaatagtaaagtaggattacaggtgatggttatacttatctgtagttttattttcccacatttacctcatttttataataatatagcaattttgtatctgaaaggaagttataaaaaatgaaaaaagtaagtccttcagtttggagccacagagctaaacgctgttcttcctccctagagccattaggcaggaactctggccacaccctgttcctacactagtggccatagttcttgatag

SEQ ID NO: 67 - DNA, 2175 bp, Mus musculus
ggggagaagagagacctgggaggggtgggagagcgaggcactagcctgataagagcaccaaaaatgtagtttattttttaatgaattcatgaacaacataaatattaccaccaagctaaatggatgtccatacctagctagctggctgatcgctttcctattttcttccttttgtaacaatttcctttccaaagtgattggttcctaacactgatgctccaaagctattgtggacatgctgactgaattcttaatgagctaaacaacaaacaaaatggctcatctctgtaccccagctagcaccacaaactggctattattaaaggtgtgaacaagcaaacaaggaagtaatgaacctgcaaagtcaaggttctgtgaaatcacggggcatcttgcatttaacagttcagatttattactcattatcttctacaccagaaagctatagatccacatgttgatgtcctgtgtgtcatgatccaatgcccccctacccaactacgttcctccctctcattcttgtctttcagtctttttttccttttaattgctagatagctaaattaagacaatcactgcttgtgaaacctccacctacccacttgcctttaggttaccctccccccttttaacctatagaagccattgatctacagacatcctctagctataaaaaaatagctgaggctttaaagccagagggtgaccctaaaataccctacacttacaaaacttgaaaacaaaacaaaacaaaacataggatggcaacagggctattctaccacctcctcctcctcattattcttactattaccactgctaatattacattaataagcccccaaagaacaaaagcctccattttatttcaaactctatcccttgatctcttgatcgagtgggccctcttttagctcacagacatagttcaggatttgcacatttatagctcctcaagaggttggcacagaaagtgtttggcttctaatggaagtctctagagtctcaacatctttttggataaatatatgaaaatttatgtttttttctaataggagaactcttagaattaatacagaaaataaagtacttaagaaaagcagcctacttcagtttcttttccattgagagatccatatacacgtacaggttaatgttaacacatttggttaacaccaaataagaaaaagctaagacagacgcaagaattcgtaaaagtacagatactgccctcccccatatccatcaaatgcatgaaggaatgggtaatcaggaatgaaaagttaacattgcttccttccaaaggggaatcaactaattctgcctacagtccatcacctgcaagactttaagatacaagcttgagagtgttcatgtccctttttatcccccccaaacttgcaatgacattggaaaaatactgcattgcagcatttgccagcacacactcgtatgtctagcaatcgatgactagctcaccaaaataaaaaaaaatacgtatcaaatgtccaggcatgtaaattaagtgtgcggtagccacagatcactggaattgctgaagaaatttgtcaagactgaagtagttctgtccatatgtaatgccctctatcaagattgtccgccattccttacttgtgacactcacagataatttgtttcttcttctttttttgtttttaatgaaaattgggtattaaagtaccaaaggctaaatgaagcagaatgtctctttatagatgggatagtattttgtctaggaagagaattcaaccacagaaaagagataagtgcagagagaagagaccaaagcaaaggatttgccctgagggaaccctttcattgttcatagtaactctgacttgagaaaagacctcacttcttccacaaatccttttagagaaaatgaacacacacacacacacacacacacacacacacacacacacatacacaccattacacaaataccattcatgtaatgattttagatttaaaatttcaaacccatttttcctaatagaaaccttaaatttaaaatatctgaagtctaccatgtctcaaatacttttagcgatattgaatctggagctaaaatacatacacactatcatttttatttctctctctttaaaaatattcggctagaactacctcaaaataacctggtcttgcttt

SEQ ID NO: 68 - DNA, 1500 bp, Mus musculus
ttgacctgccaaacaggttcttacccttcattgactaccagccctgaaaggacaaccatcccagagggcatatcagggtgtaagaagggaacctaaacagaacccttccccaatgtcctaggcagtccttgagtggtcctaggcttggaatttagtaagactgttacctattcagaagaattgactccagaattgaaagagagatagtgagagaaaccaagaattactatctactacaaagagttagaaatttcagggcaagcttaacaaagtaagtttagaattcttattatagttatgtatggcagactacatcattgaatagaaagagtcccccacaaaatcacttagaatcacagctaagtcactcccatattcagaaatttacaatggtttagaaagtagatcctgctgtggtttaaggaggaactagagtattgcattattcatgagaagattagctagagcagaactccctagcacatactttccctagcccagaggaatagcacagtcaggtatttactaagagctggctggtggtgggataaacaataaatcagaattagaactatggtttgcacatgaaagcccttgccccaggagtgtaacaacctcacacctggcttctaaggatatagctgacctgagacagagctgactttgtctcagttgttacattacctagttcctgccagtctttatgtatgcattcttctgttttgtgtaaagagtcattaagcattgggtaacctcaatgtaccttggctgatgtgtcaccccacttccttattttcttttgtattacaagtctgatgctcactttgagaaattacattcagatcaacattcccttgtgttaaagtctgatagtcactcaacaccgactccttgcccacctgaataccaaaaccctgattttcctgtgagttgagggacttcctgagtccagtccatagcacctgagttcaccatgaatttcttggcttgaaagaaagctctcatccatgtatcatgttctcagagagatacatggggatagaactcctgcctcagtccagaagttttccagaacagagaaactgacattcatgccactgatgaaaaggaagaacctaagagattttatttggggctcccttaagtgagaagggaggctaccaatggccagatgagacacaggggtaaattaataaaaaagggaaaaattgtggaaggagaaaagtgaatgttggactcagttgtcttgtccttagtgggggacttccatggtagttaggccatggctctgtgcccacagggttgacccaatggaggaatgtcatgggtgtgtgtttagggtagtatttgttgtggattgctttggggctgtttccattttgatgctaaatctgtttcctcaaatggagctgccccaaggaggagtggatcacatactctggtgatttaatgtgaaacttctccccatttaaattggtcaaattggtcaaataaagacta

SEQ ID NO: 69 - DNA, 1500 bp, Mus musculus
cagtccctcactctacagacaagccattcccacggcttgcctggcagcacaattcaatctcaacccactgctgtcagctcttattctgttcctagacacgagtttctttgctaatacaaaaggtacttttctctccttacacagcctgtcaacgtgacttaagagtctcctttccagcctgtcttggaagatgatgatttttcctactgccattaaattctattcggttatagccaatcgatagagccctcaatcatgtcagaaacctgctaatcattaagtttatgacagaattcccaaggtctctaacagtttctcccacgaggtcacagaagttggtgacacagctacaagatactgcatggatatgataatcactgaaaaatgcagtggagaaaactggataccctgagtcacatgacttacattgtctaaatcaagaaaagccgtttctcatgtgacatttatccattccagagagaagaaaagccctgtgtcttctatgcttgaaagacagactgcccaagttgccatggagaccacagggaactattggctagtggactctgtcagtttttaaacaatatatgactgctagactattgtttattcttccccagacttctgactacattggcaactaagataactataccttgacagctagataaagctttcacagatgccatatgttactaccttacccctcttcttgataggccactgtcctaatattattcttgttctaactctaatgaaacattctactatacgacccaactttttcatcacaaattattgtttcttctgcccccgaaaatgctcatcttaaagactgtgttgttaactcatattgttatctcttttgcaaacttataaactacaggaaacccattcagatcttcctctcatggaccaaatagactctacccagataagaaaatctgacaaaatttcccacttactacctattccaaagggtgggattcctctgggtttcaaatatacatcttaagagaaaatttttctttctctgaaaagcacttaatcttattctctactaacaataatgtgtttcaacattttgtcaagtccaggcacttaccatgtccaggacagctccagagaagcaacctccagatgctccaatctcctgtcacagacacagatggatctactggatattttccttctgacctatgctcacatggcttcacaggctctggacagcaggaaacatccaactctcctaagactggacaaatactccacatacccactcttctaggttccctagagatctgccgtccccaaaccagccagaagtagtcagatattacgacgaccctattgctgctttaccatcacctctatctaatttcttcttttttaattaaaccaaaatgggggaatgtgagcattctgtctaaattccacccccacagttacctgacaacagctaggtgtggggcagtggaaggcagcctattttggttgatt

SEQ ID NO: 70 - DNA, 1550 bp, Mus musculus
cctaaattcaagaagtttcagtaaattaggatctaagaaaaaaatcaaatggtacaatgaacaaatctatatcactcatatattttccttgactttaaaaaaataacaaggaaattgttcagcttgtgtcaaaataatgaatgataacatttcattggtctcaatattggaatttgatgaaacaggacctcctcattagtagaatctaagtatgagaagaagcaatagtggcccttcatttcaaatgatcataggtattttctgccaatagcttcatcagggatgttgaaacttacataccaggcaaatgaaaaataagtggcttgagtagctcttaccagtctggaaattgcaaccagttggacagtctctcttgattctcattgcacatgttcagtggatttaggactcaccgcttaataatgactgagagattattacccaaatctgaagtaacttccaggttccaggtggaaaaatttctagaagtacacaatgaagacacatcttaccttgtacccctcacacaatattcattctatagccatttatacacacacttcttgtctatggtaccgcaagcatatggtgatgattgacaaaataagtccaggtagactcactgtttgagttatgtggaagacagcatgtgtagattgataaagatgcaagtccttggttcaggataattaaccatatcatgtttgaagaacatggagactaaagctcactggatttagaacattaactatttgtggaagagcattgtaaaatgtttaacaagagccacactataggagcctgatgggcatttctagaagaacttccagtggctagattttaagtaacccactaggtctatgtcagtaccttccagggaaaggaaacttctcttcagctttaggacaactgatgggacagcctgaggatgggaaacacatggagtaggtggaaagagttattccttggttgaaagtaattttattacaggagaactcagaagacggactgagggcctgaaggaagagagtgggatcagcagcccatccttgtcagtaggagtctggagctgcatgttgtggaactaggactagagaacactgcctgggttctcacagccatgtaaaaattcccttcctctttagttgtccccaagttaagtcttgtggaaattttcagtcaccagagcagtggcaggaactgcaaacaagaagacttggacactccaaggtcaaagaagctgctaggctagtggaaagacaggcactggaccatgattgaaaccccttactctgctgctcataagaacactgatcctcaaatcctagtgtgcatttcataactgtgttgttaaattgctgaccatgtaagtgtaacttttcctgatttttttattcatcttattgttgtctggatacttacataataatttctgagacgatgggcttgttggttgcaaacatggttatatttctcttggagcaggtttaaaattggtacaattcatatccatccattgtttgtaacgctgctattttacgactgtgcta

SEQ ID NO: 71 - DNA, 1900 bp, Mus musculus
ggaagacaaaatttagtggagagtgggagtaaaggaggataatgaggagaaagataaaaaagtatattttatatgtgtgtgtgttcaaaattgaaaaataaaaagaatcactatagaaaaataaaaacgaaaaacttccaatatatgctcctcagagggctctcagcctctgcatggacttagtgctgagtattgggcgtaaggcatgctttggccccctaagtttctgcttccctgtgtatgtcatgaagatctcagtcccatgattattgtgctcttgccatagagtacaacaacgggtcagagaagtctggttacctctcatccctctagcttaccctggaaattgtaccacattctctctaacagtgaagctgtacctgctggcctttgaggtcactgctgtcgccctgaggttagggtatccatttccatgtcaatcacacctaccattctgtctgacctacagagttcttcagatctaagtcatctattattatgtcttctttgtgtctggctcaccaaagcatttattagatgtgagccatagctaccagttttaaaatatgtatgtatgtatgtatgtgtgtgtgtgtatgtatgtatgtatgtatgtatgtatgtatgtatgtatgtatgtatatatgtgtctgtccaagtgtatgcattcttattgtaagtacacacatttgtctacatacatgaaggccagaagagagagtcaacatacccacctttattaccctgtgcctacttctttgagccagggcctctgcctgaatgtgaaactcatttccttggtaggatggatgcaatccccagtcattctcttgtctctggcccgtctcagagtgggggttacaggcatacatgagacgtccaacttgtaacatagatgctacaattcaaactctgactttcatgattacacagcaagcactcttaacagctaagccagttctctagttccagtctattcatttttaaacatttatttggttaggggttcatgcaatgatactatagagcgtgtgtagaggtcagagaacaacttggagaagttgattctccccttccaccatatgggtcctagtgattgatctttggtcgttgtgcttaacagcaagtgtctttagcttctatgccacctgctgactctcatcagtgaatttttaatgtactgatggaagtattatcccagagagtcaagttgaagatggacatgccccatcccctagctgaacataatgggcccattatttctgtaaatgttgctatcttttgtcaaaattttcttagagattttctgatttttcaattgcagactctagaatgttattagctatccttttcaaactgttactgccaccttcattattccaccaacatgctatattctaaatccttggggtctaattccttgggaattgtgctctcatcaatgactttgatttaatttctttgggtgattgggattctaaggctggccttaaacttgctgtttgctgttcatctgactcagcctccttagtggtgggattacagatacgagaggccatacttagctttgatgattacaacccccaggagccacacatccccagctcttcctaagtggacagctcctaaagcagcatggttttaggatgagatcgctccctctggaggaggccaagttactgtctctgatcgttagtccagatatctatctattgctgcctacaaaaccatctcacatttaagtcagcaatttattactaatctctttgtttgagtagagtgggtttgaaagagaacccaaggacaagactagagagctgatggaatttgaggggatttttgaagagtgttgttgtaaaagagttcagagcaatagaacaattggaaggaaatgtgggat

SEQ ID NO: 72 - DNA, 3250 bp, Mus musculus
actacacctcttctgcttgcaaaaagataatattatcttttgcttatgttcagcagtctcatcattcctcccctacaatgttcatggggacccagagtctgctaagaatattctttcctcacagctgactatagagttccaagtctacaaccagcctatatacctaaggttaaaagattatcatgaaacaaaaattggaaagcttgtaaaatccagagagtcagaatgtctgatgtgagattgtgtttactacatgttatagcagtggttatcaacctgttggtcacgacctctttgggggcaatcctttcacagatgttgcctaaagccatcataaaacacagatatgtacattattacagttcataacagtagcaaaattgcagttatgaagaagcaacaaaaacaattttatggttagagatcaccacagccatattgaagaactgcaacattaggaggggtaagaactactgttcgagatatatgccaaggtctttgaaacagggcttacttaggaaaatggcctcagacaaacctactctgctaattttttccctacactctaaggtactaacatttttaaacataaaatcaagccttttctagtactcaaataactgatataaggtaagcaaatcgaaggcatatcagtgtagtgccacacacctctaatgtccatctttaagaagtagaggcagaaacatcaggttattcattggcagcctgagccaaagacaatctcaaaataaatgactaaattagttaatcaataaaaactaaaataaataaattataaatatggttaatctaagttctcagtgtcctacactagtatagcatatgctaccattcctggatagaagtgaatggttactcacttcagatagagagctaatgacagaacaaactgaagatgtcaccaaaatttaacttggtaaaccactgacttttactgaggttgcttacagaaatatggatgaggggttacttacagggcagaaatgactcaaagacaaccatttctccaaaatatcatccctcatgtaatctggaaaattctagtatactgtataacctaaaggtaggtcagtatgtcagagagtatcctttcctgttatatcccttggtctcagcctcttccagatggctcagtttatatgagagtcttttaagcagcttgattggtctctgtgtctctcaggtggcctggctggtctgtgagtgtctctcagcagttttcagtgcttctatatgcttcaagagggtgggaccttgtgtgtctagttagtttcagggacttcctgaaacctattgtttatgtcctgggcttaatgagctttcctgcaggatggaaggttttgacctaccttgagaatatctgtgtcttaatgagggtcctaagattgaagttcctatgattaatcctaaatcttcctagaatgaaaagtgcttctccatttcagaaactgtatgttaccactgagacttttgacagctggcttagaagctgactgagctagtatggcttttcttactctaacctcaacttgtgcttatgagcagtgcaatagtgttaggtttatggtacatgccacctaagtgtgattgctggccaaagactacaatttattctccattagttattattaaagtctcattttcccccatgagaaaataaattctactgttattttgtgtaaatgttgaccatccccaacagatttatcatttatttgggaaaccagagtctttttcagaattttcatgtgcaaattctgaaaacatcaaagcttttggttgattctttctgaaaccctcaaccctgccaacaccgctttaacatttatggtcctctaagggtcttaggcccagagactatatgaacaatctctagctcctaaagggcaagaaagcactgttaacattctagagtttctctgaacttctagacctggttgataaagattctagttaccgcgcacaaaggaaaatccagagaagcagtgagaaattgtattctggggcttaggcacctctgcatccatttgcttatgtgcatcattacactaaatgtaaggattccagccagagttctggaagtttagggataccacagtctgactccaagacatggcctctgaataggcatctgcacaagctggttcagccatggcgctgggagcaaatgtgcagaatgcatggctgatatgtccaggcttcctcttctccagaaatcattttatctagggagccagaaagccccatggaagacctgaagcacaggcaggtatcctccacctgtccctgacaagcatccccaccacatttctgtttgaaactctcatctagttttttctgtactttgtggcaccaaagtgcatggaaactcacctcctagaatctaaatggctgatacttcttggtatttcatgtgacaaacaccaccttcttcctggccaaagaacagacattgtgagccagtgttaagccttccatctttgatctccttccttgttttgtagtcttgcccagtgaccgtattgcacaacttttgtacataaatgttatctgattcttagtcagtccttgagagtctgggagaggtgtctaggactttaccttaagtagagttggtgttataagactgagatttcctcgctgaagggaagataggtgtaagggaagtggaaggcatgtgcaggacctgtgatactttggtgatttgcagaggatgggtggagtcactagtgcatctggtgtctgttcattgcttagggcagtcctccagtcacagcaatgggtagagctgacaagaaggagttgaggtgggaatctaagtttcccagatatggatgggacaagggtactaggcagcggtggatagagttagtggttcaaattgaacctccctgtgatagggaggcagaaagggacttaggaagataggctgggcatgtgttccttggcaggtcacaggaatgggaagagctgctggtgtgattctagtaacattcctggaaagaagcagttctcaggtggtggggatgggtgtaactggtatcatgagtctggtgtctagctagataatgtaccaggctcccacagaatggaggagtggagctgatggggttcatggatttagtgtagggggtgtgtgggtgccttgtctagggatgggcaagagctctgagacagggagacctttaattccaggacaatctgtgctgtttagggaagtctattaaaa

SEQ ID NO: 73 - DNA, 2250 bp, Mus musculus
tcgtgccttaaggaccactggaattttgattgaatcttaagggatattttagcaaacatgttttttttttttaagtataagctgtttttaaatttacagttgtataaacattgattaagcaacaatgcattccatattaattttccatctaatatatatgaactgtctgatataaatacagcattccaaaatgtgtagccatatacaaatttattaatgtctaaaatttattaatgtctaaaaaacatactatgcatgatgctgtgtgatgataggccacaaaatttttacagtttgaaaacgcattatatattaatataacaatagatacccattttaaaataaacctcatcaggtaattgaaaaaaaaatccatgtcttttgtctctatccaaagaagtgcattattcccatacgcacatgtctaaggaggcttactgttgattgcttttgacttcttttattaaataggattcttttccctctttcaatcaaaattcaccttatacaccaaatcaggtctcaagatatatctttctgagtctgcattcttgttacaggggttaaagtggtgccagaaaacatctggcacagacacccacttctcttgtcgtcactcaagatttcttaacagtcaaggctgtgactagggactcttcttagttggagggtcaatacttagactctgttcatcttgctttgtactgaaattgggtgctgaagaactacagctgtgtggtttttatgggtgagaatagttatcttattttagctcttcctcttccttctggtttcagagcaaaccaccctgcaagtgtatgagcactgtgtgaatgaatggtaggtacatctcacagagaaaactgagatccttagaggagaagggacattgcatgatcctctgtctgttcttcatggtgttccttattggaggtgtaagttatccttcatattttgtttcatggaaatgtttgtactctatcctcatcccaatcatttagtcccatttgtacccttggttttttattgacctgtgattaaaagtggtggaactcaagttatgctgagttaaagtgctccataaggacattctctaatctgaaactctatgtgagctgaggaaggttatatagaaacttctacagtgttttccctttatctattaagcaaagcactgttagaagtccaggtactatctgaagattatatttctcatgtgtagggctcagtgacaagcatgactatttcaactgagcagaacaaagagccctggaaggtgcagtgaaaagactaaagcaaaagtaccaggtgatttcaagttttgagatagggaagaccagggcttcaggatggctgttgtgatgatgcactacttagtagagttgctttttaaaaaaatggttaaattggttcaatgcccaactcacagggtggctgacaaacatccttaatgtcagttttggacatctgatgcctttttctgactgcagttggcaacagacacagagcatatagacatacgttctgaagacagataaaccttggctggaaaaaaaaacattgaaaaagcatggataaaagatggttcaaatttattattcacattctacctctacaattgattctgcatggaactaattcattatttttctatatcaagttttattattttcaagattttcctaatgtccacaaaattgactttctatataagaataaatattagcgaaattacaagtttaacaaactgtgcatgtcaatgatgagatgaccattctattcatcccttagcatgttaagaaacatacaatatgatatttgttttaattgtagtgtattataacaggaaaattcatgtttctagatttttttaaaaaaatttttcgagacaaggtttctctgtgtagccctggctgtcctggaactcactttgtagaccaggctggtctcgaactcataaattcacctgcctctacctcccaattgctgggattaaagacgtgcaccaccacgcccagcttctagattttttttaacagatcttgcctgagtttatttctaagaacagaataggacagtggtcatctgcaaatagtgtgtggggaggtgtgtcacagcagtccgtctgtcttcacacttgcaggagccttttctatggggccttcataggggcctgggcacctttgggggcctgagcacctttgggagcctgggctgggtctgaagcctgggccttagttggagctttgg

SEQ ID NO: 74 - DNA, 1750 bp, Mus musculus
agtaatggtcaattttctctcagaggagatgagaagttctattattctttcccttgctcacaccagccatttaggtgagagagtaagggggtgggtgggtgggaatacttgtcacagtgcattcaagctagttataaaggtgggattaaaaagtgaggttgggagaattttataacctaccatgtttattaagtaaaatagctaagaacatacgttttagtgcaccaaatgctagagccacaaattgagaaaactatatttttggaaaccataacgggatcacttctgtggcttctgataaacaataacgtaaactgatgtcatcattgggcagctccaacacttaccttagagcacagaacattctcactccatcaataaaacaaaggtatcgtattatcttctgcgttagctcatatcaatgcaaacagtgcagatgagtttagcagtattagaagtcactatggaaatttattatttcatctgcacatggatactttgtagagagtaaacgataggaaaacactttaaccacaaggtggcagtaagagctacatatattaaacaggggatttcaaataaaaactgacttcagccagatctctgaggatgtgattgtcagaataaataacctctcctaatgcggcatatgcggagagcctcagcaaagctacttgcttatggcctctgcggataagcaccttccagattgcaagctggataagctgggctattcctgggtcctcagcaaatgcctgcttttgaattagagaacaaaattgtggtggaatatttgtatttgcttcgattcaagtcaaggagcaattaagataataagttataagtaaacatccccaaggtgcgaagtctagaagcttccaggggtcttccctaccacagtgcttagtttaaactgcctctttttttttttttttggtatgaacaataagtttatttaaagttttgaaaatgttttactggtttgctattttcatactctatcactttgttttaatcttcaaaatagtctctttagcatatttatctttgtcatgaagataacggtgttgtctactacgtgctagacaattgttttgtgagagtttggtcaacagagccctagaaagccatctaaggtttacttcacctaaaccatgcacaagttgacacattgcaaaagccaaaagttacccgtgtgaatggggctttcttatctttctgctaaaggattggaggttccctcattgcaaaggcaaagaacaaggagatggagaacaaggagtcattaacttccaagttctttaaataatgttcatgaggggagtcaagctccacaaacatttagaacttgataacatctcaaagccatgcaacaagccaaaacgcatcatgcagacgggtaaagggaaactgctttggctccagtcacggataattctcccattcctgacatgggcctgcatgtcaaactgttctctcttggactcaaagctgggaccatgaagccaaggtgaggcacctgtacaagcacgcccactgccgtcctgccagatcccttgtgcaaggctgtagtgactgtttgtgttttggtttgttgtagacattgctgaattaatgagctgcattatataaattgtgtatgtctaaatttagcatgatcctctaaaaatgctgttcaaaagggcaggagtaatttttctggagtttataaatagttaagatatcaggtttatgaaatctgtcatactat

SEQ ID NO: 75 - DNA, 1900 bp, Mus musculus
gataagaggctttcttttgtagtgatctagcacataggaaccaatattattagtaattaaagcaatgaatcaagatagtggccatttctttcataacttttagcatttatttgtacagattctaataattttgtgaacaagaaaaacattggccttgtggcctgaacaaacttatatatatgtgtgtgtgtgtgtgtgtgtgtgtgtatatatatatatatatatatatatatattcctgattctgaattattgagatttacatgtatgatatatatgtatatatcacgtatgaacatatattgtgtattaaatatcattatttgaagatgttctctttgaatatgaatatggaatattttaggctaaatgttattttaacatatgcttctgctgatttttttaaagccatatgctcagtgaattaaaaaaattaggatgcatttaaaattcagtattgtggatgcaaggacaatttaaattagaaatgatggcagagaaaatgatggccttttccattttaaacacatcagtttgaggctaatctcactgtctaagttatttttcctgggcaattaaaattttactatggttctctcctagtgtccgatgaaaaatgatcctagcaatttcgttgcaatattatgtgttgttttttctcctttctgcatgttagcatacactgaatactaatcataatttattgtgtgcgtgggcatccagtcaaataaaataattttgtctcctccctgggctgtttataaccagctcttaagttcctgtctttcttacttgcatctctgttcagtgtttgctgagacttcctcctaccctgtaagggaaatttgtgagggatggtgacacacagataaatctgtagcacataattgacacttctgtcaaaaatatcagacagtctagacaattgttccttttgacatttgcccacatagtgtggggataattagaggaacaaacggggaagagctaataaaattgtccttttgtaaggtgctgactggctgaccatataagggatggctggacaataactccttatcctgagagttaaaagaggtatagctcaataaaaacgaatgaggtcagacacactgggaaaatctcttgtttttaaatggtgatcaacaggccttgtgataaaagaaccttgaggagcgaagttgaaagtggggcagagaaaggagccctcagatttatgagttacaaaactgcagacgctagaaggagctgctagttattttcactgtattgtcatcctggcgcatttcaaatgtggtctttcttagacttgaaataccactcacgaagcatgagattcatttttagagacctaaatattcagatatggaaattcagtgtaaggaatacagacattaaaagtgtctagatcttaaaaaaaaacataaaaatacttagaaattcatatgttttttataaacctctagagaaatggttccttggataagaaatactagcatgatatttcattaaagttttaagagttaattatcaaacaagaggctctctaacaaaatttcttccatgagattaaaagaaacaaaatagatgtagatggttggccttctaggagtgcactcaagactatttgggccaataagtaaatactctatttcatttttagaaatagttttaatttatactttctcctttaatgttttctacttcaaatgttttaacctcaaatataatttaattcaacaattaatgcaattattattcagtaccaatcatgtcctttgctgaggtataacctaggagtacaaatggaggcaggatgtcccaatgaaagacaatcacagttccaacttaagcaggagatagtgatagtggggtgcatgaaaacatgactgagccaaagg

SEQ ID NO: 76 - DNA, 3025 bp, Mus musculus
aattgcattaatctagaatcatgaatttgtcttatcaaagaaaatatactttgaaactgatgggaagttcagcattctgaactttaattcttcttagggtcaaagcttcttaattcttctgaagaactatggcaaaaataaagaagggggaaggaaggaaagaaggaaggaaggaaggaaggaaggaaggaaggaaggaaggaaggaaggaaggaaggaaggaaggaaggaaggaaagaagcagcaagcaagaaagctaggcagagagacctaacattttggctgttgaatgttttggaaacaatcatatattgtatcttactacattgttataaatacagtgttggtcactagaaacatcctggattcttcttaataatgaactcattattaaattttgaaactgcaatattaatgtgcatagatcatactgacatattaattaataaatatattatagctgtgcttctatatggaattgctttggtttttgtttggttggttagctgattgttttttttccccctcttcatgtagattgtagaggcaaaatccattttccactgtacccttctgttttgcctggcagctgcacataaaatatatgtctatgtctgagcaagaatcccttgaaccactttgattccttgtactcgcttccaaagaatttagaatctagggtgaatttttctaaaacttatcttgttctctcccccctcccaaacaacaacacccctagtaacaccaagtaagtcccattatcatctcaaataaaatcatcttcacatcataataggaaccaagtaaagatgactcagcagaaattccctgtcgttgccagaatgcctggaaccagtgcccaggtgatgacaggagtcaccatctgtttagggaaaagatggcattatcaaaaactggaagagtgcatatctgaactataccacagagtctttttttgttctttgtatggttaaaactgcagagaaataaatgaggctcatttaagaaaatgattattttgtcattgttacagaactggccggtaaatttttaaaaggcaaacaaaacgtgtcttttgtagatgtagtagtagtagtagaagtagtaaacaaacaaacaaataaaataagaaatgcctttctctcatgaaaagttcctctccagtgctgtcagaggcagcagcacattttagagagcttaggcagatggcattacagttctaataaaatgaaacaggcttccgagtgcatccatattttcttgtcatgggaatgccagagggatttttttttaaaggttttagattttccctctgattgtcttcataaatataacttgtgctattgcagaaaagctgaattttaagttgagacccgactgttagctgcagtgcttactgtatattgctatctccctgtataaccaaggctgacattcaccctgtctattggacagcactgggtgaagcagcagttctcaacctgtgggtcgcatatcagatagcctgcatgtgagatatttacattacgattcataacagtagcaaaattacagtcatgaggtagcaacagaataatgttgtggttgggagtcaccgcaacatgaagaattgtattaaagggtctcagcattagggaggctgagctactatcagaaagagtggatgcctcgcaactgtgaggatggagggtcttctgctgctcgaatttctccacttcttcctattgatatttagaacgttaggatttttgttttgtttttgtctggaggggtgttggaatttatttatttgtttgtttgtttatttatttatttatttatttatttatttattttgggttttttgagacagggtttctctgtacagctctggctgtcctgaaactcactctgcagaccaggctggcctcaagctcagatcttaggaatattaagaaagggcctacctgaatgctaaagggatcccaccaccccttgccaaaagcttaaatgaaaacaaaaaaaaaatcattatttcattaagcaaacaatttctccttgaagcattgttgaagggatcagatcaaatgattcccaccaagccttcatacgtagtagccagtgcctgagacacagtgccaatatattccacaaactaccacttactttactactttatgttgggagctaatgaagggaggcagtaatggggtgcacagactcaggaggagggcatgtgggacaagttgtgataagaacatataattacttgtcaaagttaaatgtcattttctttttcaacagacacctctcagtaagaggtacctttctgtaatgtgcccaccctccattctgggccttctacaaatgctaaacttcgtctgaacatctacaaacattttgtcaaacgtactccagcgtattcactcctaagcccacagtgaacctcaaacagaggaaacgaaacccctagctctttccatggtacttggtcaatattgagtaaatgaaaatacatattataaggttcaagtgatgaactatcagtaaataaaataaaaggcaatgttccatgtctttcttcacactgatttatataaaatatgataagagagatggcaataatgtccaaaaaactccatttttatgactttcttcagtatcattcatgtagttattagaaacaaagcagtcaccttcatttagaataaattgtatgactagtgagaatttaaatattacctttaaataatcttgagagactgggttctgcctcaatgaaaggatattttgtcgaggtctcatcagagaagagtatctttgaaagtaaatactatggcagtgtttgcaaagttaaacctagaaagctaaagtctttcatattgttattactgaatacatagatttgtaaaacattataaagcataatattattattattattatggctttaatggtacacgataccctcattaggaaaaaatccctaagcctgtgttgctaaaagcactgtaacgaaacctttccagccctcatgaaacatgtc

SEQ ID NO: 77 - DNA, 2875 bp, Mus musculus
caaaaaccatgttctgggttgacatacttcagttaacaacaacagttagcctgaagcagaactatagaagctaaaaagcaaggttagtacattttgagactttcccagaaccattaacttggttggattaggcctttgttttagtgttggcaggtggtgctgtctacatgctgagtgatacagcctgaatagtacttccatcacggagtcagttgtgctatggtctgggacccttttacatgttaaaaattttcctttagattcataatgcagttggaatctctcttcacttgtgaaaatgtcacaaaatggcttaagcagggaaccttgctatcttagctgcttttccggatgctgtgataaaatattgcaacaaaagcagctgcaggcagagacagtttattttggcttacaaattcccaggaaagtctatcatgacagagaagccttagcccgttaaattcctccaaggatgctggggaatctaggtgtattgcatctatagttaggaagcagagagtggtgaatgctgacacttcttttcatgcatctgaggaattatgctcagggaaggctatcggccattatttggatgggttttcccacctcaactaacttaatgaagatgatatagcacagttatggccagaggccctccattggagtacccagcagcatgtcacctacacaattctcatatctagttgataattaatattagccattgcattgtctaaactgttttaataagctggaggttaaaaaaaattctgttccccaatttgaaaaataaaccagagatatttatccaagaaagtagacacctgtgaaccaaggtgctattcggagaaccaacgtgctattcggagttatgtaattatttccttcacaaatagaagtggttgaatacagctgcctacaggcatcaggctcaaattactgatgcttaaatacacatcctgtacactaagaaacagacacattcagttatcttatctgttgcattgcgtgcatagttttgttttatttcaaaatctagaaaaacctcttatttttagcacacaaatcacaggaacttaagagaatatacctttagcttttaatacaatcatatgcttaaaacttacataatatttgaaaagttcatagtagctggagtttgatacaaagcctggtgtgatggtttctctttccctttcacatctctccactcctttatgtcgtatatttaggatatgaagtctgtataagtaagatgtgagaactctgtgaagattagataaaaataaagttttgctcaagacagctttattcatcagctacaaatagatgtgatatttaaataccaacaatcatattgtagtttgcacataagaatcattttagaagttaagtttaaaaaggaaacacaattgtcaaaatttctgttgacagaaggtatctgcccacgtgtaaatttttccattctccttaatatacggtgtaacagcggcgcctgctttcattctgttcttaagtcagtgacgacagcagcactcagctttatcaggtgattgcattacctgccaggaggtccctgcagagctagttgaatattcctaaaggtcagtgtgtaattgtggttgtgatttcccaaagcagaaatagctagcatttacattgttgcaacctagtatgtcgattaagtttagcatctctggttcaaacagaaatgttaattacttgcaaaaaaaagtgaaaatggtgtacttcataattacaaacttgtatttgcaagcctttggcacgaagtacctttggatatgttctatttctgctgattgaccttctccactcagaagctgggaaattacatctatagatagctaaatataatttcaaggtttttccatctgcaaacacgcgggagctgctctttcattcctcagacagacactgagatactggggtagaagaaggaaaatacaatggtctctcttattaagaagtcccaaatttagtcaggaaagacatttgcaaatatgtgtgtgtaaggtcatacacggaaatatatctggatgctgaagaagcctaattcttggtggatgggcaggcagtctcacaaacagatagaggtgttccagaaatatgtagggtttgcataaagacaagagtgtttgagagtagcaagaagttgagtttaggtttagactgagttgaaggattagagaggaaccaaagaggagaagggaaagatggatggaaaccaggtaccttggccatgacgctgagcctcaggaaatacacgcatatcagaccacacacacaagatcaatactattcatacactttcttcatatttctcacattctgccaaagtcttcaggttatcaactactgagctgctaaaggcagtgaagaataatactgcaggattttgagatacaatgtagaacaaacctatgtttctatgacaatatggagactcttaagtaataaccttgcatgtatcaggttcgaagagggactggttagagactacagatgtgcaacaataccacatccagttcaggattttcaaatctgtccacgggtagtcaggacatttagattacaggttgtacacgtggatctttggtttctagcacagtttctttaacctgtcacaccagttgaaggccctcctgacccctgactttttgagtcactgccattgcaattaagatttcccatttggcaggaaactgcagaggactaatcagttgccagcttcattttggctcaacctcaagacttttcacatcaatgtgtttgtctcatgtctggctcataccagatttctctagtcctttgatctagtttcagacaggaaagaggtgagtttactgtaggtaaa

SEQ ID NO: 78 - DNA, 2175 bp, Mus musculus
tcaggggttcatccaatttgaacctgaaacaatctttcatgaaagtatgttctcattttataaatgaataaactggaccctagtggtctcctagctagaaatcacaggcttaggggctccgctattgtccatacctagatctatcaatgtttaaccaagtcctctcagatgccatgagccagtgatgagatgcagcaatatggttgtcccaagatgttcttgttggttcctgttcttgtttgatgtaggctgtctagggaaatcatgatcttagagacaccctgttccttctgcctctaggagcagagtccatcttatcagctactgaaaaggactcaacagcatgcagacatgtggccattgtaggttggttgggagagaagatgctaacagttggattgtacttttattgatttctctagtacccatgctcttttagactctgaggcacattatgccagaaccaacatgtatcctatatctatgtcccaatcaaaaggagggacagggctgctgtcacccattagttagaggccatgactatttctgctggccaagacaccccagacttctcacaacattcttctctagacctacactgggggataaggccaacctaccttgaaaccatttctaccagagcaaaactgtccttttttaaaaaatttacatgaagaatgtcctctgagcttctatggtgagcttggcatgtctcagttcccacacaaggggtgtctggagcaagtgtagaagcaaagcatccaagctggggaactttcctgtgccacagtaagctgttaatggtggacatccaagtatgaaatcactccttgagtacccacctttcctctgtggagaggacttcagctgaagagagttgcaatgagccttaccgtagtctcagccacacgccccagaagacagcaattttctaattttagggccatttccttggcattttcatttctcatacctttttctacttcttatgcctctgtgtaaatgtcaaatacattgcctctatggctgctgcattccctaagaaaataaagacgtccagcctcaaggagctctaaagggaatgatggaaagcaagtgagacttcaggatgcacaaaccagggagctccatttgcttgaaatggctgttgtgaaaatggtaacttgcccagatctgcttccattgtcaaagcactgccaaaagcaaccaggtggctgcagggtctcagaagcccttcatcctaaacccagagatgataccacgggtacaaggtccagacagcagggagccatagaagaatcaaggcattcgatgtggaataccaataaaaccgtgttttctgagcatctattccatggtcagaataggagcaaatattctatttacttccttctggaaactattcatcactgaggacccactatatggtcagacataggttaaaaaaaatctttgtcttgaaaatcttgtccatgtggcagagaacttgtgataattgctattatgcaagtcctgtgacaaacaaaccaatctagaaagcactgaggtaaaagctgaagagccaagagtatgtagacatcctccatcagaagatgttcctgaactaatgtccagggtctagctcagcctgaggacccacaggagagtcacaaagtcactctacaaagcttacatggagcaaagcatgaaacttggctatatgtgaggacctggccaaggcctgtacaactctaggtgaaaaaagagaatctggttaggacagattgtggtggtgacaattgtaacatggctgatcttcaacctttcccaaactcctcctacctctaattctatttatgaggatatacagcagaggggcaggttccagccctgcccacccacccccaccccctacccccccaaaaaaacaggctggcaagagctgaaattagacatatccatttctacagatgggcataacaaacggtgctttagaaattagaatttaaataccccactggtgtgcaccatatcctaatctgacaagctccactgaaatactagtaaacacacaaacacacacacacacacacacacacacacacacacacacacacacacacatgtgacagccagtggggccctgcacccagtccaaggagtctaatgtcatgacaaggtgagagggatagaggt

SEQ ID NO: 79 - DNA, 1825 bp, Mus musculus
atggatgaccctcgggtggcatctctttttggaattctgtctgccaaaagtatggttcctaggttttagaaactgttccagtatccccacatagcccatctcttattaatgcaaaaatgatttcacaattagttgtcactgagactattccatgtagtgtccatattaaatattacttctaggagttttggtgaaaaatgctcctgaaattgacatgtgagctatgactctgtaaagtagatcaccttccatgagagtctgcaaggagagaaggcacaggaaagaggtgtttgctccttggctagttggatgacaatttaaacttagatacagcacttccgcccctgtgctggcatttacttcaacttacttggctctcacacctttgacatcgtgtagaattatatcactggcttctctggcctccagccagcagatggcagatggtggaatctctcagtctgtataatccccggagccagctcctcagaataaatatcttcctgtgtgttttatatactgtttgattatgtctttctagagagccctgtcagataaaagtctatgccctgtggcccagttcttaatttgcaaacaagtcgacctctttgctggaatgacaggaaagcagtccttctgtatatttcaaggatcagtggaaggcctcacatgtggtgggcagtgacagttaagtgcagggagtctcaagccactgcactctctgggcttctaacttttagttatatcttatgttctccttcagttggtggttacatgtatgtacgcatgtatgtatgtatgtatgtatgtatgtatgtatatgtcctaaagctgaggagctggctcattagataaaacacctattacataactgtgagtgcctgaatttagactttccagcatccatttaaacacttagtaaatacatgcatgccaagtggatgtgagacctcacctgtaattccagcactcagaaggtagagagcagtgatcctggggacaggactagctgtatgggcaagctcaaggttcaactgagtagcctgtccttaatgaataagatggagagtaatttgacaatatgcctgttgtcagccttgggcttgtacactcatgcacagacatacatgtgtacacatatacatattctctctctctctctctctctctctctctctctctctctctctctctctctcacacacacacacacacacacacacacacacacacgctcgcacgcatgtgtgtgtgtgtgaatatgtgtataaacatattcataccctacagtcacatgtaaaacaacagaaaacaaagaaattcaaatcctagatctgtaccaccacctgtgactgatatttaattcaaatcaatcaaaatgatataaatttaaggtctacctcctccatcactgggcatatttcaagtgctcagtacaaagtggctggtgcctgccacatcatcactgcatagaagtcctgtgaatgctgttgctctgtgtcactttgatgactgtaccatcaacaaatgtcactggaaggtttcagaaccacatttatgacttgtgagttgggcaaggccccagtgacaaagcctctaaggataactgaacacctcactaataagctgagtgccctgcagcagagactttgctctggcagttgtcatggcaacacagtgaagaacagcaacagaggtgtgagctgaggcttgctgggtggtggaccatgaaggaaagcctgttaagttgaaaacctggagaccctgaaaggaaggtagaagcttctcctgctcctggcaccaggcccctgtcagggagccactg

SEQ ID NO: 80 - DNA, 1650 bp, Mus musculus
atgcttgagagtgattgttttataaataagagatgacatttttcttgctaaagaaacagacataaatatcaacttggctgaatttttaaacagctttcctctctattttgagaagatggcccttagacatagaaacttcaggaaaaaaatttcttcttctctttttcttatattctccgtgcatcaccaagcctttgcttcctatttcaatttcctttacatgtgcgcacatgttaacacactacatggagcatctgtatccatagttacatgtaataaattcataacactatcagttaatagcatcagtggtgcatctgttctatacttgtttactacacagcctggctctttgttaagcctggcttttggctccgcaattcagtttagaaattatgacagagttgagaagaaggatgaagtaattgggcacctcaagtcatatcgcaggtgactcaaggctgctatttttaaatcaccatctgttgcctgcagtgactttctcagacatcagagctatagcatagatgccttttggcttttgcttacgagcatgattgagactgattatacaggaatcagtagaaggtgaattgttatttttaagaagttgagatcagagcacacatgaagaacccaagtatgttgctggcttgtgatgctctcattggtatatattctgttatgtttcgtcttcccaaaattctcatgcatctgtaatgcctgttttcctggtagtgtggaaaagaagaatgattataatcatcaccaccatggcattagtaatgacaggattacacttaacttattgagatcagaactgtcttggtcacagtattctattgaggtaaagaggcacaatgaccatggcaatttctaaaggaaagcattgaattgggctttgcttattggttcagaggtatatttagtccatagtcatcatgggaggaagcatgaaggcattcaggaagacatgatactggaaaggtagctgagagttccacatctggatctgaagacaacaggaagacaggaaaacacctagcctggcttgatcacttagaatctcaaagccctcccacagagacacactgcttccaaccagagagaccacaccacctaacagtgcctctccctgggtgccactccaagcattcaaatataagagcctgtgatggtcattcttattcaaaagaccatgctaacatctaggaagtaatgtgctctttaactattataccaatgacatgaacaacattggaggatttagagatgtaaaattatttgctcagcactggccaagtatttactgccaccatcagtaattagtttatttccctctaaattattatagacaaaccctaaaattctctctatctgctatttctcttcattctttcttttatccaaatacattctttcacacagtttaaaacctttttggagctcttgactctagctgcatatgtatcaaaagatggcctagtcggccatcactggaaagagaggcccattggacacgcaaactttatatgccccagtacaggggaacgccagggccaaaaagggggagtgggtgggtagggaagtgggggtgggtgggtatgggggacttttggtatagcattggaaatgtaaatgagctagata

SEQ ID NO: 81 - DNA, 1500 bp, Mus musculus
tgtgtattcaagtgtatgcttgtgtttgggtgacagccagaggacaactactttgggtgtcaccctcaggaaagccacccactaattagataatgccctcttctggtgtgtctgaagacatagacactgtactcacatatataaaataaataaatctttgatacacacacacacacatatatgtaaatttatatgccaagtgttggactagtacctagttaaaaaaaaaaacattgatagacataaaaaggagatttaggctccagtgtaacagtgggtgaccctttttttttttttaagcttttcactcattcattaatttattcactttacatcccagtatcagcctcccagtgcctccctcacacagcttctacccgtactcccctgagaaggggaggctcccctggatattcccccaccttagtcactgcagggctaggcacatcctctcacagtgacttttaataccaagaataactgaataattggagaaaacagcccaaattcatgtgagacttcacagaattcacaaattcacagaagacttcaaatagccaaagaaacctaagcaaagccgtattggaagcaaaataagacaaggaaaacacttcaggatatcggcacgggtagagtttctgggtaagacctcagaagtagagaaaacaagaaccggcacccagaattacatcacagttctccccagaaagcagatgtgtcactggccgcaagcttgaggcttcaaaagaagctctctacctactgcttgccatctgaaatgtgagctctcagacattcctgacgctgtgcttcctccttggcattctggattctagccctctggaactgtagcctaaatgaacgtttgctttcactaaaacgttttgtttgttttattttatcaacttcatgtcagggtttaactgacgtcagcctagaaatccctgtgagaaaggatttgttaccctccacttctaccccaagtccccacagttaacatgctcggagctctaaccctgtgccaagcacttaacatcctttgcataatacatctttaaatctgccaatcctgtgtaagaggttttttccccctggatatttgctttatttacatttcaattgttttcccctttccaggtatcccctttggaacccccctatccctttcaccttcccctgcctctatgagggtgctcccccatccacccactcccatcctcttgccctggcattcccctacactggggcattgaagaccctcagcccgagggactctcctcccactgatgtccaacaaggccatcctctgccacatatgtggccagcaccatgggttgctccatgtgtattctttgtttggtggtccagtccccaggagctccggggtgggggtctgacctgttgacactgttgctccctccatggagctgtaaccccctcagctccttcagtctcttctccaactcctccattgggacccccacccccaccccccaagct

SEQ ID NO: 82 - DNA, 1675 bp, Mus musculus
tgcacagcacagatacaaacgaagccctgacctccatctctccatatgacaggaagagcccaccccttcctcctgcatcctcccggcacagcagacggcctagtataacagatggaacatgcagtacccaaaccaagaacagacaaaggctggtccccctgaggtagagtggaaacaaggagggtcttctctacagcacaactttcccttgctcttacccaccaggttgcatgttcctacaaataaccttcaatgctcagaaagacaaattctgccaagtcccggttggaagtcatagcttgcccaagaaagctctcaaccggacttcactaagccagctttgagccttccttctcctaactccccactcaaccagtcaactcattttttacctacctccctccctccctccctccctccctccctccctccctccctccctctttttctccctcccttccacttttccttcattttgaggcaaggtatcatgtagcccaggctggccttgagcttcatagatagctagctgttatcttgaagtcttaatcttcctttctgctccctaaggctgagctgggaagtttgtgccaccactcctggtttatgtggtgctccgaatgaaactcgagggcccatgcaagctaggcaagggctcatccaagtgaacaacatccacagctccctagcatggatgctctctacaaagcagaaagctaagaaaaagaatccaagacccagagccccttgggagcaaatcttggcttcttataagtcccacccatcctgctggctttgtcatttgagtgtgttttctgtccttactaggtctggtataggcagaggcatctcagatggagagtggggagttcattagaggcaaagtctcagaccctactctctgcctattgcaaaagagcccctgggacatggagccatgagttctgcatctgtataggcaatgcaagtcattttgatagtaatgtccaggcaggtgagtgggcacagcagccaagagcctccaccctaaagtaacaaggtccagagtcattttaaagcccccaaagtcactgggtaattgccatcaagtctcaaagaacaaataagaacaagtgccttgcagggttagtgcaaacactaagggggtcatgcgcatctgctacccctaaaaaaaacaccacacagggatctgagaaaatggctcattgggtaaaggacttgtttgttagtctttgcctttgatcctagtgctggagggcccagccagtctagccaaaatggcagactccaggctgagtgagagacaatgtttcaaaaaggagggaggggtggagaaatgattgaagaagacgccagacactgacccccagcttccacgtgtatgtgtacatacgcatccagaccacaataaataaataacaaatagaactacatagaattaggattcccattaagaggtgtggccataacatatttcatgtccctaatggaaatgattgctacaatgacctgtgtccctgcatcagtgacctgtgtccctgcatgtagctcgagagtgagcaagctctgactacttggggtggggagggggtatctcatgaatgtgtttctgcaggtatcaattcagaaaaacaactcccacttccctaatgtgggtgagccaggctggccttac

SEQ ID NO: 83 - DNA, 3325 bp, Mus musculus
ttgcttaataccatgctatgttgccacagaagctacagttataagcaagctttgtctcccagaggtaaaggcctaaccagaacaggtaaaagtaaaagtaactgactttggattcgaattctgtttgtcattctgctttataactctctattagccaagcccttaaatatagccacagacaggtacctacatatatgtacaaccatgtttaacttgttggacttccacataaacgatcaaagaggaaggacatagaaaagcaatgctaatctgatagcaaataaccacataagacaacctttaatggccctgactaagcagcatattcaggcttataagggcttgctttcttcccttcttttctttctttcaactcagatcagctcccagtaacttcttgattcgagcagcaatgggttatgacaagcaacgtagggaagctgaccaagagctgatccactgaccctactgctgctcaagattcactgctgctttattttggatcccatgagatcttgtggtagccaataaattcctttttgatcaagtcagtcaaagtcagtttcattttgttttttaaataccttacctaagactacagttcttaaagatattctaaagtacacacattctttttcttctcaactcttgaaagaaatcaatgataaacaaagtgctgctctaccttttatatatgctgcttgacttgcattttgtatttagctagcaggcctagaacaagcaagcttcatacaagaggaaattaaaacatgtttactaatatgctcgttgtcatacaagggagtagatttgatattcaaactgccccatgatggagcccacaatgctcagcccgattctgtaccaacacagaaagtatttactgtcctgctactttctaaaagggcctgaggagactgcaattctccccgaagcagtacagcactgtagcaacaaaatcagatttacacttctctttgccagagatattataatcgctccttcagagatactctgcctccagtttactctgcttcatgaatttctcttgtatgatatgtattagtatacaagttcaggttaaaaattacaacaggttttgtatttggtaaatggtgtaaaggaaggaaaggagttaaatggaaaacatgttaacaccaccccagcccccaaccatgtccccgctgtggtgctaggcagagaacccagcgtctcaggctaagcaagcgcactgccaccgaggaaacatatccaggaacggagtgtgtaaatgcagaaagtgagatttacatccattttacacttatgatgcactgtgctcaatttactgtagtgtttctaaaacagaaatgaaactacctctctgatgtatcctaagattgttttctctacagaattccaaataaaactattaataactatttagaatggaacttgtatcaagctgtgctgagaaacttacttgtatttctaaatcattagccctagaagaaacgggtttactacaagaggaaattaaagcatgtttactaatctgctcagtcctagataaaagtaccaactaaagggcgtgggcccgaaaaccaaactacctcacgataaacaagaaacaagcaaacaaaaacatttctgtaccaacacagaaatattaatcataaccacacacagttcacctacccaggaagacagctggctcaacaatagggcacagaaaaaaatagtatgtctcaccacaactgattttaagatttagaataagtatgcaataatcaaatcaatattatactaacaaaaaaattttaaaaacacaaaataagagaacaaataaagtccattaagcaagaaaaagggctccaagaaagtgctccaagtcactgaagtaaacctttacaaatcgctgtactcaattagcacactggacaaagtctgtctgcaatgaaagactcctacagtcactgcacaggactcttttgctgcactcactctgtgtgaaaacaaaaaggtggtgaataaaaaaactaaacagaaaaacttagactcactacacttaattcagcataggtcaagacatcttagaaatcaaaaaaaaattttttaaaagaaaatgtagtctttatgataattaaaatgagtagccaaccaaaagatatcactggatgtgttagaaaagacaatgttagataggagtcagaaacacatttctaagtgctgccatatgtccaaatacatttaaaaatagctataaagcattacaaactgcagaaaagtctataaagaacaaaatgcccaaatggtaaatagccatagacatcagcagtcctcaagggggaataagtaagaattcacttgggagaccgttccatattcactcccagcaaccaaatcacagaccacagcaaatgttgaggagagagcagctgaactagaaggtcaaaactggcagggccactggctgacagttctttataaagagaaatatacatccgccctttggtaactgaattcttccaggtactcattagaaacaaagatgtacataaagtcatgaaacaattatggcagcctcttctgtaaacactgtaagcaactccactcaaaaccatgagaataagcaaacatgggctggagagatggctcagccgttaaaggctaggctcacaaccaaaaatataagagaataagcaaacatgccatagatcaatggactactagtgagtaaagaatgaaaacctaggtagtaacatagatgaatcttaaaatacgctaaaacaaagccttaatgacaaagaaagaaaacaattggatagaaacactttattttaagcattagatattcttaagcttattttgaaggtaacttacatagtgtatcacttctcgtctgcatattttacatcatatacattatactttaaccttttgcatatgtgcatgcagtatacacatttgcatgtgtgcacacggacactgaaagttgacattgggtgctgctttcttcaatccctctcttctgtatttaatgagacagagttgagcttactgactagtctagctagccagtttgcctcagggatcgatcctgtttctcttatttcttacttctcttatctcccacttctatcagccccacccctacctccacacaaaacacgaaaaaaacaagaaaaccaaaccaaatcaaaaaagccactttcctataacacaatactgtgttggaatgtatggacttaatatttccctaaggaagcattaaatccactattaattatgtcctttggtaatgatgcgctcactgacacggaacagtccataaaagaaagggtga

SEQ ID NO: 84 - DNA, 1500 bp, Mus musculus
gatggcaggggggacggggtggggtggggtggggtgaaggaatagggtgggcataaaaatgcttcttgtagataagtaaaagtgtttgttgattgaaacagtattagcatccccagatgaaggcgtttttcagcaactctttattcaacacttacaatgggtcatataccattctaggcactgaagaagccctggtgggaacaaaacagagaggcctctgctctcagggaattctcattcttctggtgggggataagtgataagcaaacagataagagaatcttagaactaaacagataatatcactcatttagtcattcaacaaatactcattaagcttctctcacatgtgaaacattgttctagttgctagggaacaaaaacgaagattctgcctccaaggacacggagataaaagaacatgactcggtgggctgtaccgtcaaggcaaatatctaaaatgaacagcttgggactttaaaatgaagaataaacaaccattttataaataacaaagaagcatcccagacaaggaacgatcaggagagaattgctccattgaggaagagaatgaggtgcagaggctccggggtgggatgagcctgtgtgtggactgtgtctggcctgtttgtctgaggtagggggatgagcctgttgtgtggggtgtgtctggcccttgtgtctgaggggatgcgatggtagagcctcgggagactctcgggtgtggcaaaggcaaatggcttcctggtgcctctcaaacatcctgttcacgggctttcatgcacttggaataaatttgttcatacctcggtctcctccgtaaatgtatctaaggatagatagctttggagaaggtccaactagattctagttgtgtgggaagttatgggttcctgatgaatgagtgtgtttacctatccctggaacttacttcttgagatgtatctcagggcatttggtgtgaagctcagaagtgtatagaagtgtggctgccggtgatcaccgggtaagaggctcatgaacaagtcttgctggtctgcctgagacagtccaccagactaggcaaccacctgcatctggccttggaattagaatggaagaggtcactggatggtgcaggggtgacctcaagccaagagaaggatgctcactaccacagtttgtatccagctctaagactagccccccctctctgctccaaacggccttagtgagtcatgtgtcctcagctgctgggttgggggatgggctggcatgctgaccaatacagcagaggataggctgctcatgcgaaaggcatcattgactctctggttctcaggcacttctcaagccatggcggaaactgcatgagagtcaatgaatagttctttttctgaaaacatggctgaactgactctcgagttctgttacagtgtcacattctcataatcactctaggaattgggcaggccagaatcgttatcccgtcatccctgaagatgccagtgtaaggttgaa

SEQ ID NO: 85 - DNA, 2850 bp, Mus musculus
gtatgaggtggaaagcaccgcccagacgagcagtgccggatgggtgaacttctagacagagacatcagtatagatttcagctccagtaatgagctctgaagacttgaataagaagctggtttccaggggacacgcatggaattgttagagggatgtttttctctagtttccagaggttgttgggaacattgtaagaaataagacagctatggtggttggggcataggagacattagacaaatggcgtcagagttcttgtttggtttccgtagagccctgttaggaaggttggtctgttgttcagtgcactaatgagtttggggattccagctccttaacacactgtaagtgactgggcatagtggcacacacctgccatgccagatcttaggaggtggaaacaggaagaggaggacctcgtggacagctctggcttcatagagtttgagaccaacttgggttatgtaagacctttcttataaacagtcaaacaaacaaagcacacgcagagagacaaacaaatacacacacagacacacaaagatacacagacccagaaaaacacagatgcatacagacacagacacacaattatacagactcagaaatacacagacacacatagacagacagacacacacagatgcacacatgcaggctcacagacacacataaagacacacacaaatatagacgcacagaaaaacacacatgtacacaaacacaggcacactaatgtacaaatacacagatacacacagacacacggatacacacacacacatacacacactttgtaaaaatctgaaagagactttatcagttcctttgcatctcagatgaaaactggttgttagtgtcagcccagagcctgatttcttgtcaacagcagcatttcattagatagaataaaaacccagagccgtatcaaagcagtagcagagttaatcagacccaaacccgggagactctagccactttcacgagctgtgcgactatttattacttatttagtatttgtttattgatgctgggaaatgagttcagggccttgcatgtgctaagcacatgctctacccctgagctgtatctcttacttaatgtttaagttttgaggtgtctgccaatttgggctaaaaaaagagagaataggatgctcgcataagttactgccttatttttttttaaaggatgcttttcttgggcaaggaatggcgactgtagtcagggtataatccatagatgtcattttgtcaggtggtgcctagaccagactgctgagatgagaggtctggcctgtcttctctgtccccgtctctggaaactgttttgggactttggacgtctaccagtgccaggatgaagacaaaggtttctgacttgaggacgaagcagatggcctgcgcttcccacaggtaaacatacattccttgtgtgggtgggcactaagaggttccaattggacacttattaaagggctccatttgctactggctggctttaagagctgggaccctgcagagcctcaggctgggaactctgatagcagaatggagtctctgccttcactccctcttctttttgaaggagaaatatattgaaaagatgcctttttcaaaggagaagcaaagcaggggtttcctttgtctggtcctgtgagctttgggacgtgggggaatgctgttgtggctttatggagttcgcatgtcttagccagcacactggtttgtgggaccctgggctgaccaggcatctctgtcagtggctgggcccaacctcctgaaagggtgttgccctgcctgttcatctccttaatgcaattcttcttattgggactctgtatttgttttaggggcgactttgcctaattgtaataatagagcaacattagactgatgtctcactaatatgccaggttcttccttccttccttccttccttccttccttccttccttccttcctccctccctccctccctccctccctccctccctccctccctccctccctccccctgtctctttttgttcttttctgtattttttttttgagacagggtttctatgagtagttctgactatcctggaaaccattctatagatcaggctggcctcgaactcagagatccacctgcctctgtctcaagaatgctgggattaaggacgtgtgctaccatcacctggcctggtattattattgttgctattattactatttattatgatttattattatcactatctttgttgttttgaggaagggtctttctatgtgcccctggctggcctctaacttgcaatgacctttctgcctcagtctcctcagtgttagatcacaagcatgtatcaccatgcctcgctgctctagttttgcttttaattaatgcttcatatggttctgggtggtggcaggcacagggatgctgggaccagaagtcagagctattgaaatgggagaaacacttagtagaacagttattttatttttaaagcagactcccaggagaaaggctgaagtagaaatctgcaggaaacacatccattctggaatctttcaaagctcttgctgacatcaatgacatttggaaagtgctgagcaaaacttggaactcagaggactctgcagcgctaataaggatgatgggggtggtatttatagacactctataccaaggagctgttagtagtgggtatttatttttcaatgttgcttctttattcagtcaagcagaggtcttaaggtgacaggaatcattttcctttttaacatacatggaaaccaagtcacagcaagcaggtgaaggggcgccataaaggtttagactcggtcccacggaagtgcgatggct

SEQ ID NO: 86 - DNA, 1950 bp, Mus musculus
ctttatcatgaagttttcctcaactcttttccttaaattagagctgttggctaattgtgtggttattttttttttttttttcgtttgtttcttgtttttttttttttttccttcccctggccccatttaggttgggcttgaaagtcatatgctaaaggtgatgattaagccaagaacaagagtcttgaatctccacaatcttcagcaacacagagatgaacttctgaaggggagttgggagtgggggaggggctgaggagaaaatcttcagagtgtagaagagagaaaatgacaagaagactagagttgccatctgctggaggagggtaagaatgacatttgacactctttacaagagaaaagagcaactcattagtccaggtgataaatcttcctgagctgggtattgccagttaagagatgacaattaattgagatgtgctgttatttcagaatgggagtacagggatatgtagacagtatatgggatgaggtagcataccctctgcctttatttgaaccccattatagtctttaatgggatgatagctattgctttctgccccttcaaatgccaacatgatacttcaatgtctgtttctttattttactatcaggcttttcaagtatgcctagtcagagtgtgaaggtttttctttctgcttacgtaacaaccaaattaaaaaaaaaaaaaaacatgcaagaagtctagttaggctcaatagaaagagcaatgagctgacagttgtaggctttctcaatggataatctcaatttgcccaccagttctaagtgacaccataagccgattgctgtacccctctgggtgttgatattttaaagctgtaaaattatatgcgctacggaggatgggctgcacagtctaaatcatctcgaaggtcctttttagctctccaattctgtgaatctataagcatttccaacttatgtagcactgagaacatgaatattcaagctaaattctcatcattgcttgcacagaattcagcaaaactgtgtctaatggcctgattaatcagtcactaccatcttctttgccagcgaagggggaaaagtgagttttacccctcctcatgttgtagagaaaatcccagtcatttaattcttatttctctgctgttggttttgtcacagttgctgacatactctaaccccctgatcaggaaagagaagaaatgaatttaagaaacataccgcagctgccagtgacctctaagataaggagaaactgaagatccatgctggagtaaccaggatatggccaaatgcatgagataattcaattggcaaattctgctttaactgaaatgaactcgtctgtctttctgaggttctaaatcttgcatattcacagcatctaagtcagacacccagttgttcatgtattcacttggaaatgtgtagaatgaacatacttcattgttgtttgagatagggtctcactacatagctctgactctcctgcaacttgctatatggaccaggctggtctcatatttagagatacagccatcttggctgaagctcagattaaaggtatgcactgccattcctggtttaatgaatatattttcagtgcttgatttcatccaagtagaatggaacacttaaaactttcattctcctaaagtttcaattattgttggaggaaagagaaacctacatacacagaaaaactatggtccgtagcaacatgtgccaggacagaccatcaaagcctcgataatatcatgacctaaagccttctgtggaccaagagttctgagtaagtgattctgacctgaaactgagtgaatgaaatagtatagtagttacttttctcattgcaaggcaaatctctgacaaaagcaaccccagggagaaagggtttctttttcagagaaagaatgctatgccttgtgttggggaaaggctggagcttggggcacc

SEQ ID NO: 87 - DNA, 1800 bp, Mus musculus
agagctcatgtctctagctgcatatgtagcagaagatggcctagttggccatctttgggaagagaggccccttggtattgcaaactttatatgccccagtacaggggaatgccagggccaagaagtgggagtgggtgggtaggggagtggggaggggagggtataggggacttttggggtagcatttgaaatataaatgaagaaaatacctaattaaaaaaggtcattttcagaatcaacagcatggcaaattcatttgatccttctggagggctgcacagggatgcggaggtgcccaaggatcagagttagtacaaaggtgcccatgtggagacaggattcaagtgctgagcattagtgagagggcagccagaaaacagagtccttggatcacaaggtaaaagggaatctgtctaggcacactaaatatattgctctatacgcaactctctgacacttaacaacatactgggcattgtttcataaccatataaaacacttcacatcactctatcacatatctagaaatactggtgtgtatacacaagcatgcagatttgtagaactgaatgctggagggattcctggaaagagctgtacattatactcccttcttagaagttgattcattttatgctacggcactgcatgtgacaaggagactaggaaacatggtgagctggcaacatctcagagaataaaaataggatgtaaaaccaccaaagtaataggaactgtggggaaagggattttttaaaaagcagtcaaacagaaagcaaactaagcaggtatgacaaggcacagtgtggtatcttgggctgcactctggaacaggaaagggacagcagtggatacagtgttgacattaagatgaagccttgttgaatactaatgtctcagggttaggcaaatgcagctaccaccacagaaatgatgtttaggagaaatggcagatgctatcatgtactctgtgtattacctctatagcctttctggaactctaaaattatttccaaaaatctacttcagaaaaagtttgagaggagggggaaggaatagagagggagaaagaaaaaagggaagtcctgctctgcagaagaggaaggcagcttgatgtaggggaaagatggttccacccatgcagaaactataggcagtgtgttgttgctggagaataaaacggtgtccatgggcaagctgtttcattgctcccttttcacctaatgtcttccttagaaaacaaaaaacaaaagaactccccccaaacccaacaacctcaacagagatttccttgcgttgtcatgttttgatgctcatacacaatagtgtcactgaacactgtcaccacagctgcacctgggaagtgactaacttcactcagtgagtcagcagatctggcattcaggaactggtttgtgaagcatgtgcattgccaaaggtggtgattatgcactaatttgacaccactgtctgtcagttaaatgacattaaaagcaaaacccaatgctttgagagaactggcaatgttttctccccttaaactaggagcaaaatgtctatacacttgtcaaataaataggaagcaaaggaactgacaatcactatacaaaagcaaaaggctaaaaggagagtgtacagattttgatatgtatatcaagaaaggcaattttcggtcataataccctaaaagtatatctgtattctttgcccttatatttgtaatgttcactttaaaaactaaaccctgaaaacaggagacaagaagactgaggaaaaaaaccaagtcacagcaacttatac

SEQ ID NO: 88 - DNA, 2675 bp, Mus musculus
ctcatccttttcttttctggtgctgcatttaattctatgacaattaacagatttcccccaattttcttgaaacataatgacaaaatttcacaaaacgtgaacagaactccccggggttttttttttttttaaacaactaagacggcattattccgactaacttctagtttagtatttaagtctgccatgctttgtgcctggcttgcgtggctgtgggtgtgggtgtgtacacacgtgtgtgtatcgagaatttcttgaaatatagtgcaaaatcatttgcagactctttatagatctcctttggttaaaataatttttcctgactaaactctattaatatttaatctgctccacatgcatgtgtgtctggttctcttattgacaaggctcataaattaggggctggttcaggggaaaaaaagaaaaaaaaaaaaaagactcactactttgagaccgtccacaaggcggcagtagagcatcacttccccccagatgccatgaatctctccgagttccttttctaaacatttggatgccatatctgcccgaatactagtaaaacctactctggcttcaaatttctgttttgccattcaaatagtttttattagtaaatgtaagctagtcgcaatggaaccgttaattagtttttccctgctcacagaaggaggaacctttaaagtttgggtgtcatgtattgctgtttgtgcagtgcccctttcttctcctcagccttaccctggatccttaggaaattttgatgagatcctgttatctgaccatgaaacttcgattcacacacacaacacacacacacacacacacacacacacacacacacttcctagttctaaaggtgttatcctgtgatttttttttccctcctcggctcccagataaaatgtagcattggatgttactatttgcttagcagatgtggcgacagactgtggctccactggacaccgtacttgaatagtatgtcttcatgggtcagaaagaaatgtcacgaagagaactgagagctgcagcagaagtttgcaggtagatttccacccaccaaggggccctccacctgcctgggcagtgcacccctaacatggtgtacacctgagtttgtactatgacctcctgtgtcagactacccaagtgtgcatctgaatgcacgcctcatacatgacaaagagatgggaggccatagagcgcgggctgaccttggatctttcaacgactttctgctgccagtatcgtggtggccctgaggacgagactgccagactctgatctgacataatatgtcatcctgtcaaatgcacgccattcctggaatgaaacataggtatggatacatgcatggtagagagacagagagaagacggttagcaaaacaaattcaaaatgctattccgtagagcagatctgagccacagtgtctgctgtctgctttctcaggaaaactgcagggaacatggctggaccaaaaatgtcagaatggattggagtgttttgccagtggaggcacagcatatttgcttgtacacatgagtacacatgtgcttgccacatcaaagcaaattatttatgaagtatcatctggcaagacgcaaggatcagtgataacggcacacacatgcacacacgtgcacagacgtctcattgtgctgggtaaaaatacccaaagcctaacgccttcaggactgaagattgttttgcaggcaataaaagacattaaagttctgagtgattttaacagtcagaggaacagtgtcctccttaaaatgttctaaatggaaacatatatcatctctgcagcacttaatttttaaagatgtatgtaccaggaactgcgctagggagggaggtgggacatctttattccatctcacagttcacacgcagtgttagagtcatgtaaagacacgggcttttttgtgtgaccgagagcagtgctcactgaaagaacttcaccactgaatgcgacgtcaagtgtaatgacacgatgcttttcctttaagaagagcgcattgattttagacgcgctgaaacttcggagtttccgaagtgtgtttgggttaaggttatgtcgtccttgacagcattcaaagaaaggtttgaattgttgaataaccacctttcacccatccctaattgtaatttaaatgacaatatgctctcaatcaatagctctttgtcacactttgaagatcaagggatgagatttcaccccgtgagtttaccaggcagaaaaaaaaccttcttgttcataaccctaaagaagcatcaactttggtacctgcttcccttcgcatcgcttagatgcaagtctaaaagaaaacgatccaaactctttatttttcccattttgctcccagccagatatcataataaaaatattgccaattaaaaagactgaattatcttcatgtttaatgtcaccagattaccctcagccattgtaatgtaatagccagtcttctcaacatttgctgtatcgggggcaatgtagcaagagttctcgtgattgcttttggcttggtttggtttttattttttgctttttggtttttgtttttattatttctccatgtcagtctttgagagggaagccctggattctgacatcaagtttactatatggacgcatgcttgtcatggaactggggggggggggtctc

SEQ ID NO: 89 - DNA, 1650 bp, Mus musculus
gaggtgacagccaataaaattgtcaccaggagaacggatgttgtaaagcagagccttcctgcctgttctccctcccctgtgggcctgtctgtcactcttgtaatttttaaatgaacaatacgtgcttacacatcacccagaatgcttgcttcctgccttcccctaacagtaaggaacctctaacctgtggccccggttctcagggcttggagaaggatgctggtggaaaggagatgcctgtgcaccgaactcatggaaaggagaattacctggcacaggtcctcagtccaggcaaacgctttcattcaatgaacttttctacgaaaggagaaaacacaacacactgttggaaagaagtgtagaaagaagataccccggagcctgtattttgggggtttagttctgattctaccaagagaaaacagaaaacagaaccagcagagggcgatctgatcctgcccagttcagagaagtgaagccaaacctggacggaggagctaagggcctcaagcaagggcagcagtttgcaaagggaggagaagtggagaggaaaaagaacaagaggttgggaagcaagagaagaaagggacctcagtcaggtgcagagccgaagtaagagtaggagagaagcgcgcggggggcggagcggggagagcttgggcaggaagggtgcgtgggcaagggcggggcttggccaggatgacttaggacagtccctcagccaccttgggtctcttatccctatcttttcacaatgaagcatttcaaatttgaactgaggttaaccaacgcttacatagaggacaacgttgaggatggtttcaggagtggatgtatttttcaggtaccagtccaaagttttgcatttcagtttctcccatccttcttttctggaggaaatgtctccatagtgagatcatatttcaaggccagaagtaaaatgaggtctgaaactgtaactcagtgtaatgactccctagtacttaacaaaaggaaagaaagagtgcatatcactctaagatacgtgattgggctattgtcgccacacaacggtagacaactaacttaggcggttctttcccgtttatccgtgacgtgtgatctgtgaatattcttccaaccaacctgatggagcaccaactcactctctaatatatgtagtcatacgcatgcatttttaaagattttattttttgtttaaagtgtgtgtgtgtgtgtgtgtgtgtgtgtgtgtgtgtgtgtgtgtgcacgcgcatgcatcttggaagggaggtgtgcatgcgagtacaggtgcccactggagctagcaaaaacaatcagttcccctagagatggactgaaggttgttgttgactgtaatgggtgctgggactcaaactctggctgtctataaataagtgtactacatgctcttaaccagtgagtgagtcatttttccagcaccacaaaaatatggctttggtgacaaaaaaaaaattttttttaattaaaaattctcaccctactgggctagtgtcatatttcctgtgtctcctcttcagggtgacctctagggatggcaatttctgggagtgagttgctcccatctaagctggcaacctcctatacccttcccagcaggagcctggctcacgagccgctggcccacac

SEQ ID NO: 90 - DNA, 1575 bp, Mus musculus
gatgccgaatgtatctttcttccctgagattctgagttagtgatcactgagcattggaacacgcacaggcaaagcagcatattcttgcagcacagctactccgttttcaggcaaacctctgtgctaagatgaattagtatagcttacttcagaaagcaaagcaaaacaaaacaaaaaaaagcaaaccaggaaacgccatgctgaatggaaacggctaagataagagcctattgctgaaaagttaacttcaggttgtattcagatcattcagagaccaaaaacaactcaagggcttatgtttttgttagggtaagaaagtgtagtatggtacagtgctcatcgctctgatatgttaaacttaccaaagtaaaggtatgcagaaaatgtcgtcccaggtcctcctctttgttgctaactaaagtatatattatatactggaagcatcatctcatagaccatagttttgaattacacagacataattgccaaagagacatgagatgtatattatttatactattttcttttgttatttctcgaaggcaaatacaatgcttagtaccattttgtctcagttcttttactggagagttattctgaagttccctaagaaagtattcttgatggcactccattagagcatggctcgtgaatcaagcatctgtaagtgtctgtgaaaaatgttctgggctggataggaaactgtatggtgaccaagtacccaggatcaaacagaatacaaatgtgtaaaaagtgttagactctcagttcctctagagagccatcatgtagattgaactaagtaccctttaagaacagtgtcgaattttaaaattctatgatactgtattctagttaactgtagctgaattattcagggaagaattgatttgaaaaacttgagtttaagttctcagactggatttgtaatgatcctgtagtagcctagggagatgagagacaatatgatgttcacttgacaccgtagggtgtgtgtgtgtgtgtgtgtgtgtgtgtgtgtgtgtgtgtgtgtgtgaatttgagaatccattaaaataagattgaaaagaatcatcaaaataaagcaccgaaaacaattcttagtaggattagatgagtgtttagggaccactacaaaaattaacaaaagcaatgagagtcaaaacacttctgaggaaggatttgacatcatttcttcttagtatttttctcaaaactgagacgaaatgaatcagcacaacattgaaccaagtattatgaaagagaaatttcagccaaactttgtgtcaaaaattatagtgaattatgctcaaagtatatatgtttctatatacttacacaatgttactgcaagtatttatggtgctttctgagtagtctttaaactttttattcacaaaatgtagtttctaaagcactggcttttctgggacatatatgtatttcttttgtggcatcgccttcagtaattaatatcagaagtaatttttataaaatgttaggccacactgtccagaattttaactattccttaagcatatcaaaatttggaagtaaaatctttcatacctatag

SEQ ID NO: 91 - DNA, 1675 bp, Mus musculus
ttgatacctaagaagacaaaggaaaaaatgtgtgagaataaacagttggatagtttttaaaaggtacctaataccaaaacactctcttactttctgctagccgcctcctttccaatcaaaacactgcagaagttattaaatgatttaaatcgcccggttttggcatcgacttttcccagttcccttggatgtttttccactttgcacctccattcttcctttcagaaaatgtggataatatctgccaactccgtgagagtgctgaagaggaaaagattaacaagatgtgcacatacaaatttgtttagcatatgttttatgtgacgaaagaactgaagacctagagaatcagagaaacctgcatggttttgatgttgagttgatagaaagttgggattcttggggaagtgaggttggacatggggttgtgatctagaggcaataactgcgggagaacaaatggctagttatgcctgctagctctgacttggcttcttatcctggttcctcagagataggtaagctctctctcagtggaggaaagatgtcaaactcacagctcccgaccttcaccagagaggtcagggaaggaacagagaaaaatctctttgggtttcaggatctactttaaggacgaaaagaaagggagaggtaactgagacctggcttctgcagtctccctcaatgccggtgtgtcatcttctggggctccaggtcccaaccttcgtcattttctttgtggaaagatcgagatgaatgcatatggaggagagatggattctaaaaccagatgaagaggtactttcagttctcctgaggtccttatggctctaatggagaagcagagggaagtgataaacagaagtgccaatgacttaatcatagctcacggtgccgagaagtaacgcgtacagaagaaaataaaatcaaacgtgtccagcgtcctctcgggctaagacaatggcctggaactcagttgtgaattaggagtgagcagattagagtgaaaaagccattttcccctctttccctttacaggagatgctcatacggctgggcttgctacacagatgagcattcacaggcaacacacagtcttcccagaacatttcacttctatgcgtctttgcaaaatgagagagacattgaaaattcaaatttctcattctgtcagaagaaaccagacagtcaggacagtgctgtccatacttacacaccaccagggcagacggagggaggtgttttttgttttgttttgttttgtttttaatcaaatttttaaaaaatcatttttagcatcattttaagaaaaacaaaatggaaaggtgaattgactgagacctgcttgcttctgagttgctttgtttcttattccagccagccagccatggctaaggcaagttgaatgaatttgccccaaaagaaatgaccaggcatagcctggggggctctggcaggaggctgcccgtcatacagactgacttaatcctacagaaaacaggcactagcagggaccctgagatatttaaaaggcagtaattgtgcaccctcattaaaaagcaaacaaataaaaattttaaatttttaaaaagggaaagaaagaaattgcctgagaattgtctttttaaaggtaatcatgcaaaatgaaaagcaaagaagaaatgccagaaaaaaa

SEQ ID NO: 92 - DNA, 1525 bp, Mus musculus
gagtgggtggttaggagagtggggggtgggtatgggtgatttttgggatagcattggaaatgtaaatgaagaaaatacctaataaaaaatttaaaaaaataagattaccatggattaaagctgacatcaacaataacagaaatctcacaaattcatgaaaaaatcccttttagcctatgacctctgagaaaggattactagtagaaaaggaaggatatggaggaagtgaacttgtttagaaatggtgctttggagcaagtcccatctctgttgtctgtaaatcagcagttcagttcacaggttagcagcacagcttgatccacttgtaaacacttcatggatataacagcaatccagttcagtaggttttggatagcaaacatgaatcaataagggtagcacaacctaacagagacaaccacacctctcagcctcagcacaaggcagcaggagggacagcaagaactccagaagaagtttgcctctctcagaaaatcacagacctgaaaagatgtgagaccaacaagcattccacaactagctctataagcaaaactagctcagcctcgaccactgtctatctagttctttttatactccctctaaacatcatgtgtccttcatgcgtcttgcctcatcatgtgagcctgtcttagaatcacttgacatcactctgccaatcagcccaagtccacagaagtggcaatgaactgcaccacataaccagaagttttttgatatgttcctttctatggagtcccaacaaatagagcttaactactcagtgcagggtggaccaatatatgcctcctattagtgaagaatccttgatcacctgtcctttcatgttcttgctttagcagaacatcatttttcctgtacctgcttcaatgaaacattctttcacaagtctgtcttagcctttcacctgtgtccacttcacaaaaacactccttcatgtttgctccaagaaaacaccatcaaatacaactgcctttccaaagaacccttaagtttctactccaggacactatgaaaacaatcctaagaggaaagtttatagcactaagtgccgtcataaagagattgggacttctcaaactagcaaaagtccatatgatgactctagacaaaaaagaaagaaaacacacccatgaggaatagacatcaggaaataatcagtatcggggtgaaataagtcaattagaaacacagagaataataagttgaatcaacaaaagtaagagatggttcttagaaaaaatcaacaagatagacaaacctttagccaaactaacaatcaggtagtacacaacaaaatcgcaaatgaaaaaaaggagatataacaacagacactaaggtagttcaaaaatcattgtcttactttataagcctatactccacaaaattggaatatctaaataaaatagatgattttctagacagattccaactaccaaagctaaattaagatcaggtaacctatctgaatagtcctatcatctccaaggaagtagaagcagtc

SEQ ID NO: 93 - DNA, 2050 bp, Mus musculus
gtttgtgggcttgagagagatggtatgtgtatgtggagccttacctcaggtatcttacctccatctttgacctttcatcattccaatgcagaagtcccctccccccctcctttatcacttccgtactgtgggaagagctgtaggcttatgccccacttctcttccttgttatgggaagacaggtcaaattcttccattctgtgaagtttgggattgatattatcgggccctttgtgtgaaaggaggaggaagctgagttccatccagggctgctgttagggccctgagcgaggccctaggctgggctcttaatcctgagaagcagagtgattactaggaaacacctcttagagaagaagataggtaaggatctggagttgccatgtaaggaccagagagggatgtgaccagagatgtgcagaggctgtgggtgctgcagatcagtgatggtggaaatggagtagcacatgggccagggcatagggagaccaagaatgaattataaggcatatggagtgaagacggatatgaaccttgactcatgggtcaccgaattcagtgggctcaggaagagacctcggttaggtcactctgactagtaccttggtaagcacaggaagccacaggctactgtaaaatgtggaagtctgtcttctcttgtgcctattccaggtgccatgtttcagttacagtgcaaatgaggtatttattcaatcagatctgttctctctctctttctttctctctctctctccatccctctctctctctctctttctctctccctctctctcactctctctttctctctctctctctctctctctctctctctctctctctctctctctctctctctgtgtatgtgtctcactctctctctgtgtttgagatgtgtaatcttagtctggtgcccaggcttgctctgacttctgggctcaagtaacccatctgcctcagtcattgagtagctgggacgatgggtgagagccaatactttgagctcaaagcataaaagcccttacccaggtccttgtccttgaaggtgaattaatgacatgtcactcttcatatggcattttgtatttctgctgcccagtcacagggctcttgagctccttgcgccgaggatcctctatagtgcttgccaggagtgcagcttcctaggctatgccttttaagcagtcactgtctatgttctgaacacgttttatcctctactggattgcagactctatttagggagatcccctgagccacacttaatgggcttgagaaatatctgtctctgggacaggggttgagagagcgggatagcccacattagcgtatgttctggtaggagtccagggcaagagtcccagcaatgtatagctgatagcaatctacagatgaagtgtccaacagggattatgtgggtaccaattaccaagtatgcttcaataccttatgtgaagagtgtagatctttgcatcaaactctctctctctcacatacacacacataccctggttactttaaatcaactctagatgacttaatacattggaaatactatgtaaggagttgttcttttgcattgtttaggcttaattctaggttggttgggcccttagatgtgtaacctgcaggtatggagggttggctgtgcggtaaaggaacagaagaacccaccctttaactattgtctggacggtgatcagtgtagcttatcaaaaggacacagctgtggatagacaagtcagaaagaaagaaaaagagaaagaaagaaagaaagaaagaaagaaagaaagaaaggaaggaaggaaggaaggaaggaaggaaggaagaaagaaagaaagaaagaaagaaagaaagaaagaaagaaaagaaagaaagaaaagaaaaaagaggttttgcctgaccctaggtaggacgatgtttattcacaaagatgggcatcttgtcactcatgtatgagatggccaaaatgtctccaagggaaggtgggaggtggcctcttatggggtgaaagtgacttccgtagtctgcaagagaagctgaagtatag

SEQ ID NO: 94 - DNA, 2400 bp, Mus musculus
caacaatcaaagggtacacatgtggggacccatggctccagatggatatgtagcagaggactgccttataatggcatcactaggaatagatcacttcagaggcccagtgacccagggtacgaaatgctctgcactgaggcaggagtgggtgggcaggtatgtgagcaccttcaaaatgcagcaggagagggagggaataggggctctgtggaggggaaactgggaagagtgtaaatatttgaaaagtaaatgaataaaataagaaaaaatgaaaaaaaaatcttccaaggttaaaacaaaagaaaaaaatttttattggtaaccttttgattggagtatctacaaactctttgcttttaatgttcttacaaatggaagtatgcagatatgtatgtatatacatagaattttgtttcttagcaacagtaagaaagtgatcctgatgttagaatttgatttgaaatgtggtgtaaagcatcattgttaccaagggataatttcagtgtttgagttttagtactctcagagtggagtggcatactaggaaaggtaatgtcagagaatgttccagaaagtctcatggtagcaagtgagaacaggtatcctgatttaaaagcaaagcaagcaaacaaaccacacacacacacacacacacacacacacacacacacacacacacacacacacaatttacagatctcgtaccccaaagcatattaaagatcaacaggtctcctgtctgtcagatactgaaggctgatgtaatacactatccttgcagatgaaatagaacatcaaggccgagtcctgaatgatagatcttaaaactgaagtaattaccagaagcaaaaacaaataccttgtacaaagcaggagcagtttcattcagagcaagaatgtgataattcatagcaatttacctgaccatgatgacgttttcttttcattttcatctgtatgcctccttctcgaaagagcagcttgttgtcagtctacagcaagagcctggtacgagctgagatttagacatcaaccaggagcattactggaaatttttttatgtgaataaatttctttagctatggttgactcggactggctgagtatacgtaggaaaatagagaaaaggtgtgggaccaatcaggagagagatctcaaaaatgataaaagaggcaaaagcctgctgttaccatggagattttttccatcaatgctcctccatcttttctcccccctccctgcctgttgcatcagaaattaaaaaaaaaaattaaaaaaaggaaaaaaaggagtaatagaaggaggaagaccataatattttgtagttattcttcagtttctggctctaattacaaactgagaaaacggtctagtaatggttgtgcctttgagcctgtgtttgactaatggcacctataataaagcctctatttgtgtctagggacagcctcttgtaatcacgagctgtcaaatgcactcctgagctgaacctttgtaatcttcctgtcccaatatcctgagaaggtttgtttatttggaaattaatcacactatgtcgtgtatgtatcacataacaccttacaagcaatacgtttaaattttctaaaggcatagttgtgttcagtttcatcaagctacatacaatataatgcactgtgtgttaaattataataatggtaaacaaataggaaaaggagtttattttagaaaagaaatatacaaaacctagacattctataatcatttacatgagtgtgtccatctgcatgttatacattttatacagagaagcacactgtgtacatgtgtattatgtctaaatgtgaatttattgaattgataataagatgccattattctgtaaacatacatcttaatatttgttagtcatgaagtgtgttaaaaatacaaaaacaaaaccatacatataatacattagggttacccacaaaacctataattaaaaatccattgcaacttaatttgatatctttttattacattctccgctgatttagccctattgatatttgctcagatgcagagagatctacaggactaaaggtactttctgatccttaccttcttgaaaagtattactttccctctgcaaccagttcttcaaatgccaacaattacaaatttcttcaatcctaaatctgatgctttcttgtaaagtaatactcatttttctaccttagaatttacatacttgactgaaattgtaggagatatgactgtgtttatgctgtccccatgttagcaacacatgtgtagccgaagacaagaagcacctaatctctcttagatgctccatgtcacaagtaaagcaaccttctgacaaagttcactcctgcactgaatacactttccaattatccctagctgcttacttttctt

SEQ ID NO: 95 - DNA, 1625 bp, Mus musculus
ttttaggctttgttagagagggttcagagtacccttcagaccagcatcctcctcctcctccccctccctctccccctccccctccccctgtccctacctcacctcagggaggctcagcaaccagggaaggtgggaccacaagagtctggggagatagctgcctcgctcagaaagcccctcgaagggctgacacctattgtgcccgttctgccatgagatggtacgtttttattacctgagagccctcccctctgtatcaggcaatctccatgtggcatttatcctgtctccattctcccacagcttgtgattgcagccacccctgcaaccatctggaaagccatacccattcctttctacagcctaggtgttacaccggcttccatatctcagtcaatttagagagtcactcttctctgctcccctaaggcgtgcaataggttcacatacatttctttctgctgattgccctatggccagtttatttcaacagacctttggcaggaacgattttactctttgttatggaaccaaatgagtcctgttcttcttgagccctaggaaataggtcactgcctagtccaggagttgggtgcttttgtaagtgtacacagatcctttattgccaccggactggctctgaggcatcagctcccaaataatgacacagaggaccttttattaattatgaaagcttaggcctgcacttgggcttgttcccagctggttcttagcttaagttaacccgtttattctcatctacattctgccacatggctcattgcctctcctcggtcttgtacatccaactccgtccgagtctggcaggcaaatctctggcagcagatccagagtccctgtctctgcccaggagtctcgccagtcctctccagctttgctatggacctttcagctctttattaaaccaataagaaggtggacgagaaggatatgtgcaaggtaagatacaggtgcttaacaattagaacaccaataccagagtccaaactgtactcaaatctcctcgggtacagaaatcagcatttgaataatacaaagacaatctttacctctgtgcacgaagatattatcctaacaaccctttgctatgcagagctccctggggccccttgtgatgatccagaactctttatatcacttatcattactattgctgtcactctgtccgtgggttctgtccctttggttccctcatgtctatctctgtctcttcaacattctctcactaaccttagtctgagtccttcctccctgagctgtagcctagcattttctcatttgacgtgaggcaactcacatggggtccgtttggtaagtagatggctgtccctgcctgcctggtgctcagcggccagcagttgatgttgtacggactgtgatggagctcagttggtagagcccttggctagcatgcacaaagccccggggtcgatccccagcagtaagtacatatcccaagagtgttcctgtgtgcctggaatcctagcatttggaagttaggatgatcaggagtttgcggccattatctcatgctacatagcaagtacagaccactcagggctatggaaaccctgtcagattttgctttgtgtgtttcatcccaa

SEQ ID NO: 96 - DNA, 1500 bp, Mus musculus
aagttttcacttgaattcacaatgctctgattggaagaacatatttcattcctatggtaaccagcatttcccctatcccctcccctttgaaaatccaaagggacaccttttacttcagaattagaatatgcagtagaaacaggtgactctatttttaaagcatgtttctctccacaaatagcctcttaccattaggttagaagaaatattatcctctctctcttcttcccttactttaaattctgttccaaattattgttaaccctccacaactacaagttcttcctctctagattcaaccaaccatagattaaaaagtatttgggaaaaaatgtacctatactgaatatgagtggacattttaattgtcatcttctcctagccatataatttataatgtataaacctaacctatgctatacaacagccattttcatcatgtttgtattatgttcatattgtaaataagctgcagataatttaagttgtccaggaggaagagcatggttatgtgcaaataccatgttttttcatgcagggcaattgagcatctatggattctggtttcagtactcatccctggagacaatcttctgtagaaaacaagggacagctgtattttccattgagacaatcgccaactgaactgaaagcttgtcagtggagcctaggcttaaggctgcccagtctctgaactgtattttcctctggaatgaaatggaaaaagtcccttaacattttggttggcttttatatatcttgtgtaacaatccatagatgtctatggctgatagagatgtcacatgcattttaaaaatagccaggagaagaaaaattctactttataaatagaactaaatgtagttcttcgctgtctccaactctcagcgagtgtggcagctataagaaccggcttatctaagcatcagaagactacaaaatgctctctggaattgtaatgccaagaaatgttaggcagaatggggtcatagatgtgactttacatcatagctatgaatattagttcaggaaggtatctctcaggcttctgggacaccctagtggccaatcacccaccattcttgatagtgacccccagctagctagtgatggatgcttgacgtttcacccatcctcccacccgcatccttgacaactgttgaggagaaggcaattcagtgagaaggcacgttcatccccctcagctccctcccctagctgatacaatggatgatcaccagcctcactagtagacaaagttacttgatgttgaccttctgaaacgtgtttctcttgtatgaatttcagagtcttcttctggaattataattaaaaatgcctttaagacaccatggtcctgtttgtaaagcacctgatgtaaacctagctcaccttttaattgtttaattgtctctgttttcaaccttcatctgataggcccgcctcagtttcctgttatcattctttccctaagcttccatatgatgtgactgtcacaga

SEQ ID NO: 97 - DNA, 1600 bp, Mus musculus
atttccagcttttataacatatgagtgtcttaggaggcttaatactgattgacaggtttgaaaataaacagcctatttttgcagatagctcacagctgtattgcttcctcccatggtgagctcaactgcagttttctgtcagagagcctttgccaatagcaagccttctcctctgtattctttaggctaccacataaaaaataattctggtcttatttctttgaaaattaatgacacacacatatagacaccatttaaaaaaaaacagcaagacaccaaaatatttaaaagacacagcaagatagactatagtgaaactaagataatgccattaatatggctgcctggagcaaaacaaaaagatcccagataaaagctattcaactgtgttcctgggaacccagaggatgtttggaacctctatgggcctcaagacaaacactgctaccctcctacccacagagatgttttatctggtttgtgaatgggatttagtcagattttatagaaataaaacattttatagtcaaagtccttttgtaaacctcttgtctaaaagacagaaggccccaagacctaccaccatttggcaagcttgttcttcttcatggtatagtccaagctctgggcatgtcagggagcctgtcctgtgtccctgagtcagatatgcacctgagagatgcaaaaccggagccatttaggactgttgttgcttctgaaacgttctctgtgcccttctctctatgtggaatgtttctgagcttccctcttagaatcccatcattgcctacattaaaaatgcctattaggccaggtagtggtgcatgcttttaatcccagaactcaggaggcaaaggtagatctatctttcggtttgaagcctggtctacagagagaaagtcccaggacaaccagagctacacagggaaaccctgggggtggggggggggggagagagctgttagcccttctagatttccatgaagcttcctggcttcacctccagctgagccaatgactcctctgttcccccagttggtcctaaccttcaccctgtgagccttctcttgtggtcctcctcactctctggagcaagttcccagaaggctttgatggctgtccttcctctagatcgagatcttggaccatgtcttctactctacgtcccagaagctaaaccagggctccccactcagatgatcacagagttctctatttccagcctctggctgtggtggtggatggcagactgcaagagcacacctgtatctccagctcccagaatgcatttgttgtggccacccaccccacccttgcaggaaagctgcagggatgggggactgaggaagacaattggagctttaaatttcattttcactttttaagaaaaaaaaccgtaatcttttagagtccagaaaaattgtttaagtgtaaacacgcattcgcactgtctgggaccagagttagatgaaattcctcaaatgatctcttaatgctaccaaaattgcattcaaatgctcctgccaggcaaagataaattgccatttacacaataatcttacacttaaaagtaactgggtccagagagcttggggaaatt

SEQ ID NO: 98 - DNA, 2925 bp, Mus musculus
tttgtttgattagcaaccaaaggtgttaaatttagttgctttcctattttaatcataataaaaaccaatctaagtttgaaagagtgttgagctgagctgtccaatatctatgtctgtttgtataagttacaaagtcctaatattgatccgtgatttgataccaagaaaaagcatataatttcaagtgtatccattcatataaaaatacaagcatgtttatcaaagtgattccaacttgaataggtaagaaagaaagaaactgctatagagcatggtgatactggtatctctcttatttccattcaagatgaaaacctcaagccagagctggggagatagctcagtaggtaaagtacttgtcatacaaccagaaagacttaagaggattgcaagaacccaagtaaaagctgggcatggttgaacacatctgaaagcccaggaccgggagactgagacaggtggatcgtgggggcttttaaaaagctccaagttcaggaagagaccctgttccaagaaagtaagacggagagtctggcatgtgacacagcaggtaaaattgtttctagaaaatcttgagagctaaaattcctctccttgggacccacataaaagttaggtggatacagcaggcttcctgtaatggcagccttggaagccagagacagggaagcccaagcacaagctggttgtctagactaagacagggagatctagctttaaatgggagatcttgtccaacatctaagctagagagataaagggatatcttgacatcatcctctggcttctatgcacgtccatcccatccacatgaataagtacatgcatatatctgtgcacacatgctggcttagtcagggttctctacagtaacagaacttaccaaatgactctctgtttatatagaaaggggggttattagaatgacttcctcctaatccaacaatagccaactgtggacggagagtccaagaataggtagtaggtgttcactccacaaggctggatatcttagctggtcttgagtatagaccagaatccggaagaagtaggctctgatgccattgaaggaacagacttaataacaaagagagggcaattaggcaaagagccaaagcttctgtcctctgtatccttatgtagacttctggtagaaggtttggctcagatcaaagttttgccttcccctgtcaagacacaaattaaaggcatgtgacttccatctgggaatttacataattctagatgtaaaccaagaatacatatcacagatgcaaatactgagtacacatacacaacacacaacacacaaatacacacaggccaccagctgattctcacagcgaatcgtgagtgccactgcacagcagggcagggtagcctagtgactgaattcctccctccaactcagttgtctgcttatgagagccctcagtgtatctctggctcagttttcccaaggtgtcaaaagaaccttagcttttatgtgaagcagagtgtttgctccttactcgtgaagtttccacttttgtggggcagattgtaggtgggcgagatgaagattccagatttggaaataggagcaacttcttggcacaatggtctgtcataaaatgatcacaagagcagtgttacccagctgtgtctctcaactgcagtttccccatctgtaaatatagatattagttgcaactacatgggatattaggggattaaataagttatgaactagtgagcactatataagtataaatcattataacatgatcattattttatatatattaagaccaaagggcataacctcttttaaataattattcttcactccttttctctcttacatattacatatctaattttatcctagcagagttttgctttctaaaccagattgtactgagccttcatgcataccatggcgtgcctaggagtgagtgttcccgtttacctgtaacaacagctattagtggttgggtgatggcttagggctctttcacagagtcctgtttcctccttaggtgttattctgcctcgttagggagagaaaaccagaggagctgtcatatgccacctgtcattcctctagatttagacatgaaaattgattccagacagaagaaagaaaatgagctccactcatctgtggtcctcatctctgagtggccccatgtctttaaggagccatcaaggatgtaacagaaagcatcttacattgagatgccagaacgaagccattttgtatttcacagagggttggattttgtggactcccctctgaaatatctggttattatgtacttattatttgtaaaataaaatgtgtcttttatacagcccttgctgccctgtcttcaaagtccaaatctccagcagatgcctatgttggctgcttcaccaaatgcttttacttaccaaaactcagttgcctaccttaatattgacatgggtctctgaggcgttctgcgagttagcacttttttaaaaaaatacataatttaacatcttgtctgtttctcccagagaagatgaagtgacaaagaaaaacaccaacgttagtacagagtgagcagctacaggagaagtcagcaaccacacagagaaagaagggataatggtactacgaatgtagatgaaatcattactataattgaacaatagatagcatcacaatgtatctgggacttgagttaatttgtctttggttggtgcgtgttgtctgtttgctctagttcgagttttgaacatccatgataagtaggagacagcctggaacagcaatacagactagtgggaagggacctattcctaaatcagcactatattctctgtgttaactgaagtgaaatcccaatgggaaaagcagaatgtgccccattgtctgctgcacggaggccctgaggtctgagcctccttcaccatcag

SEQ ID NO: 99 - DNA, 1500 bp, Mus musculus
gtccagagggggcactgggatgctatgaccttctgtcataaagacctgtggtggctgtggagagtggtttaccagctgagcctggctttccagcctcatgttctaaaaggaccatgcatgcttgttatagttcatgctccttggtgcttgggtatcagggccaccccaatttccctctctttacagatgcctcctgttattgttctagcttataggacgctctgtctggtccagactcagactgcactcagataaacaagagggtggggtccatgaacacttgtggaatgggataagactcaccagaaggtggcgctattgagccatcactgtcaatacacttgtttctgttttcattttgtttgatgagacatgtgtaatttacaaacagtccccgaaggaatagaactgtggcttgtgcctcacagatctaaacaaaagaagggtgatttttcgtgcctctgatagctccaccacatcatctcagcctaggggaaagaacggaggatggctcacctggagccagctcccaccccacgcagtcagcgtggttcttattgtaggtggtggttattcccatgtagcttccgcctccttctggatagtgttttacgtattggattagaatagaaaacatttagaacaactgtcactgggaagcctacactttggtgtgagtggagtttacctctcaggatgtgcaatcccgacaactcctttgaatttgacaacctaagctttagcgtgtccctcttcattcccatatcaacaccaaggaaatcgatacacctattatggaccagagttcattttctccactgctttctagaaatgtgtcctgttagctttgtcaacttgacatagcctctcctgaggaattatctagcatgtctgtgaggaactgtcttaactattaattaatttacgagggtccagcacactgtgagcagcaccatccctaggcagactgtccatcctggattatttaaacaaagcaaacttagtatgagtccagggatccagcacctgcctttcctccctgggttctgctttaagcttctgttagaagtttctgccctggcttcccttaataatggactgtgacctagaagtataagctgaacaaaccccttctttccctaagtcacttctggtcagagtgtttcaacaaagtaatagaaaggaaactagaagaagttgctttttaaaaaattgtctaaattgaatttcacacatatacataatgcattcggcgtactctcacctcaacccctcttaactccctcctacccctgtcaataccccctttctacaactcccctttccttgttcatgttctccccactcccactgggatagttagcttcagctgtcaactgacacagcctagactcagcagggaggagtgtgggaggattatgagggactgtctgcattggtttgacctttgggggccatgtccgtaggattctatcaattaagttaactgatgtaggaaga

SEQ ID NO: 100 - DNA, 1725 bp, Mus musculus
aagttaaatcctctttcatattaaagatctcccaactctctccattttaaacacgcttacttccatttgtgaatgtgttttgaggaaaacctcacatgtgtgcccatcagctcctaggtctataaacagacagagtgttggggcctctccagctgcggtcctaccttggactaagttctccaatgcaggtaggtatcttatttctcagtaggtacataagccatctataacaaattaactactttaacagtagatgcctgcagcagagaggactcttgaaggagggctctttcctaatgaggaaagacagaagtcttgctgggggaggctccatcccctacctcatctctgttgcatcctttcctcttttaggtgttaaaatccatcatttgaatgaccctggcagaagccttggtcttcagaatatataggcactaagtcccttcccagccctgctgtcaagaactctgcagttgcaggtctgtgcttcaacccctaaggctgattcatcagtgacagtaagcaggggtgctcaggtccacatccttccctccaggagtcaccattcagggtggtgctctgtggaattgcatcatgattctttaccatctcccctggtgggataaaacaggcaaaatggagagttgagtcatcttgcaaacaccaaaacaaagggagagaacaaagaaagtaggaaaatgcttctccaaatcaacaagcagagtcagtacctcctatgttgaacttcctggtacttaaaaggtcacaatgccatgaggtcctgaaatgtcctttccctcaggaaggacacctgaactcattggtccaccatcagtcagcctgagtcacttctaggaaggctgttgacatctgggtcgcctgagttttgtgactagactgtgaacctgccttcttggagggagacagcagggtctgacgaccaccattcaatggagtatgagaagaaataaaaataacctactattcaaaaggagccttgatgaagcctcaagaacaaagtgtgctttattcattatcccgtgcagttctcaaaagcaccgcatccagggaggttcattatcaaaccattttatagaagaagagtttgtggttcaaaatggttcagcacggttcccacaggcatgcgcatctgggagatgttggcacattttgaattcatgcttggggaattccaaacccaagctgttaaatactattgtatgcctttacttaggaaagaattataaaggcaccaagcaataaatcaaccctatttagtcaggggaggactatgctctgacctccttaatcccttcattctaaatgcatctacagctgggagataaaagagccctcttccctggagtaatttcctgttccccctcactgaaagaattgagctggagggacaatttttcaggcctcagacttgcaaacctctgcagttgttggtgaatggtaaatcataaagcgaaggtagctttctctggaattccaggttggattcataagctatagaaaggagcaaaaaaataaacagtgtccctgctgaactgattactgaagggattttttttcttactaatactgttggatattatgcaaacctccctcaaaaagaccttcctgataaacaaactgcagtgttccatttaagggattagtttacaaatgctatggaggtgagtctgtccaactacagactccttgatagcagttgccacg

SEQ ID NO: 101 - DNA, 1500 bp, Mus musculus
tttctgataagcaaaggcattagggtaagttttaagatgctgcaagttacctagaaggttatcacctgggttttctgttcttcgggtgtttatcagcccaaccttagaactacttggacatggaagccaggttgttctaggagactaagaccttggaggcaagcctgattgtttttttaagctggaaaaaactcaattctgagagcttccaagcttttgcagactcattgtgtctaattccagcatagtctcagatacaaagagaatatttgtattctgtccctacacgtcctttattgggctcatctggtattctataggaatagcctcaacctgggatgatcttaagcctgggctccttcagagaggttgtttttaaaaggcaaagaggcaaatagaagcaatatcatgcacttataaaaaaggaaaccaatttaattaacatgggtagtcatgagaaacttcataccagtagctggtcagcaggacagcaggaagccatggttagccaaggaagtaggtaactgagacctggaccccagaggctgagtctcaattcccagccaggagactgcttgcctcttcaggtctaattgcctccatcagtttaatccttaaagaattaagtccaattggcttccatctgtctgcatttgtaaatgtcattctacccagcatgtgttataaagattagctgtgccccttcgttttgttagcatgaatcaatactgtagacttctcggcttgctggatttttaagtcatgtgaatcgatgtcagctctttgtgcagcaccctttataacatgctaatttgatattggataaaatgcctagtttgggaagacaattattgaaaaatttcagattcacttaaaggttagctggagccgtatagaaaagagagattatactactttgttggtacccatgcatgcctgggagaggttctgcaaacggaagtacgggtcaagaagatgcaaaagaaaagcctcgatttggaacttttgtggtggaccctggacactatccattgatgattttagagaactgggcatgctcttgaaaacacaccagtgatgcagggaatcacatcctaggtggaaaacaagaagcataatgcatttcctggaaacggcattgtttccacgaagatgtaatctttattcctcagagtagagaggaattaagcaatactcatgcagcaacaaaagtctcagccagattaggtaagggccggtactcttatatagccagcccaagcctttgacctcagcctatgcaaatgcacattgatatagtgatattcatcagtctaagaggacccagaaaatctctccatttcattagttatgaaaaacaacagaattctctgtctatctttctctctcttctcctttctccctcccttttcatctctccctccctcctcctccctctgtctcactgtgtgtgtgtgtgtgtgtgtgtgtgtacactcgtatgttcttgcatgggcacat

SEQ ID NO: 102 - DNA, 1700 bp, Mus musculus
actcctatgttcagttgtgtgactgttagtgagctcaccaatatctaacaggcagtggcaaacctgtcatatgagtagtcctggttaagctcagtgggttataaaaacaaacaagcaacatgaatatgggaggacctgggggaggagggtgagagaggggatcagaatgtaatacacacacacacacacacacacacacacacacacacacacacacatatacacacatatatacatacacacatatgcatatatatacatatgtatatatacacacatatacatatatatatacacatatgtatatatacacacacacatatatatacatatatgcacatatgtgtatatgtgtgtgtttgtgcatttcaggtccagaataattttcttcttatttaatttcagactttattttatttcactttattttcaaactttcatggtgctttgcctttatatcttatacataacttgcaaatttctttttcaaccaacaagccgagtgacagtttaattgagtgattaggagaaaggccttgagctctgagaagcctggtttgagcctggttcttgcaccttgaacaaaggctcagtccctcacagtctttcttatgaaactgaaaaagacctatcaggtgagtgatgacctgaagacagtgtggttctattatacatgtcctggaatgtgagctgggttgtgatggaattctgtctgtcttaaacatgagagtgagtatgtctgctgtggcaagaatggagtgtgtatgtaggttattcaagttgctgtttaatgctcttttagccatacagtttaaaaggatttaaaaatataaggaatgaacgagacccctggactatagaaagttgccacttaagctgaagtccagaggtgctcaggagtctaatgcaaatcaagagaggaaaggggaggctgcaaactcttgggtgaatataaaactaagccctaagagtgggagtaaaatgcacgcttttcaatagaggtgtcaccaagtaccttctctcctcacactttgacaagctcccctttctgtgggagtgatgagggtgggagaccaggagacagtgctccagactgacagtgtcagtcacatgcctcttgttcaaagcactgagatgttttcaaccacaaaggggggaaaaacccttcaacttttcttatttcatccaagctgggttgtctgtccctttgcggttgctatgacaacagcagctctcctccttcttcatttggatctatttccgaaggaagaacaatgaatgcaaaagatcagaaaatgggaaaggcaagtaggcattaaaggcattagaattatttaccctggagaggagaatgctaagaggtggcaattatattgttctgggctattaaaggttactactacagaagtcgttccctgcttgggcccaagataaaatcagatttatggtaactgtcggaaaatagctttagggagaaaaagtccctgatgcaaagttctcagggtctctttgcctctgttgggggacagaatgggaggcatctgaaaataggtgttctgcacaagttattctcctccaaaagtccttagccagtgagacagtagcaacacacaaaaaataaacacacaggcatgcatgagtgcacaaacagagaaaacacacacacacacacacacacacacacacacacacacacacac

SEQ ID NO: 103 - DNA, 4350 bp, Mus musculus
taataagaaactttgatttgtacagttctgagggcttatcagtatttcatagtgaggaactgtgtaaaggcaaaccattgagagggatttggttaagtgataaactttgaccatgctaggcaagcactattgtgtttttttttttttttgtctttttaaaagcaaatatgacttctttagtctttttgtccttcatagaaaggatcccctcactgaggaccttctgttggtgcctaggccagttaatgagtgtgctcttccatagggtaaatagctctgggcaaacctagattccatcttggtggtcttcagcacagcttcccgtggagtagttgttaagatagggaaatatttttgcgttaagtatttggtggatctttcctctgaagctttgaaaccttaaaacagtctaaaaactagctagtgatgccagggatgttttaagataaataaggaagctaaatacagagttgtcttggaacccaaattggagagtgggagggtcagctacccacccattccattcagagggtagttatagtctacattcccctttaaacacaagtatcagaagtagaattaaatgtctaaatggtacgtaaacaacctgtgtgtcgtgttggatgttcagcagtttggatcatgcctgtaagttgcctgttttaaagagaaagctgctcggtattatgtgcaggcatgtctccatggagcactcgtgtttcatgtttctacatatctcagtacaagcgccaacaggcttcgtattgtgctgtctgttcaaggacattgctatataaaatgctctgaagattgggatagcatctccctcctggccagagggcagatttacttcttgtccataaaagcagaaacattttttttctctccagggtaacggatgggaaggttcactagcagttcctttaaaagattggtgtttccacagcagagaagctggctcagacagtaaagctgttgctgcagtataaggatttgagtctcactctcaagcacctggtgacatctgtattccagtgtggtggctgggaaatggtagtctcggaagttcctgccagcgtagctgaattgagagacccccaactaaaaaaatcagagtgcaacatccatctttagtctccacataccccccaagcacacacattcacaaccatgactgtacatatagatatgaacatgtatatgtgccacatacacaaacacacatgtaaaatcaaagactgccgtttcttagggttggattcttgagctgtcttatgacccagtcactgcttacatggcatccactgtcacatgaacccacttggagtcacttggctcctactgggtgctaatggcagtgtgaagtccaccctgaggaattctctgagaattccttctagtctctagaattaggatagtttgtaggtagattcaaacacttaacttgtattttaacagttttaaccgatagtgtataattgtgtgtttagcacaccccccccccataatttgaagacattcacagtgtatatttgtgtttaattagaagactgtatgaaagtatcctaggaactcagaatagtagcggtttctcagaccagttccctctgccatgttcagtgacactcatctgcttgctttctggtttggagattctgtttttgcttaatgattgtgattcataaatgtttaagatattttatatttataatgtatctactagttaaatttcaaaagcttaaaagactctttaggtaacattgatcattgagcttcagtctgaagagttggaaccttttatgtaaaccttccgaatctctcatcagctttctgtaaggcgcactagcccattgagctgagtgtgtgttcccatactgcttctagaaggaagtctcagaactagccctgtctgtatggggcatgcttatggattagaacagtcttcccaatgaatttttagttgttttttcaatttaataagattattaatttcctaatggaaatggactcattttcagttaaatttgtctgcatatatgtgcgattgttttcaaggtagttaatttcagttcttgtcttttgttatagcaaaattatctcattaaaaattaatctaacagtgaacctaatagttagctgtcattccttcccttaggttagcatgccattgtctgctgacctgagtgctgtgcctgctcctcagccagtgcgcttgtccttctcctgttccttcctttgctttttgattcagcttttccctttgctctggtaggcacagaatgcttcactcagggctttgtttgtttgccttttttctttaaagcgagataagatgcctgtcttcccgcttatgtacatatccacctctctgcagttcctagggacccactctgagtgttcttgagagggaaagaaagagattgtgtttctccccaagtcctttagagagctggcttagatacaattccagcctgtctcttaccactgatacctgtagcttgcgagagcaagggcagtctttttcctccccaatggaggatttcctttcaagctttttcaggtgcagtctgaggacaaggcctctgcctggaagctcggtgccctctcttccccatgccctctcttccccatgccctctcttccccatgccctctcttccccatgccctctcttccccatgccctctcttccccatgccctctcttccccatgccctctcttcgccatgccctctcttccccatgccctctcttccccatgccctctcttccccatgccctctcttccccatgccctctcttccccatgccctctcttccccatgccctctcttccccatgccctctcttccccatgccctctcttccccatgccctctcttccccatgccctctcttccccatgccctctggaccagaataccaggggaactcttgcctcgtgtgtgtgcattatcattcaatctctgcctggcccacattcaccacttcccttacttctgtcaccgcagactcatttctcttggttttgacctttataaataaaattacacaacactctttttatgcagttttgtacttgaaagatttctcttccgttgcatgttaaatgctaaaagggaaatattctgacagagagcctcctactccacagccttctctctctctctctctctttctctctctctctctctctctctctctctctctctttctctctctctctctctctctctctctctctttctctctctctctctctctctttctctctctctctctctctctctgtgtgtgtgtgtgtgtgtgtgtgtgtgtgtgtataagataatcatcttgggtagagctgctgccttgatcttactggcttgtcctttccttgacctttgagtagcacaagaagtttccttaagtctgttttctctgtaccatggcgctgtgtgttgctggctccttcaggagccaccacatgagacctgcagggcacttgctgctgggccactccttagtgtgtagccagcctgtctgccttgtacttgttagaagcttctggagttggctggctttttaaaatagaatgaacagaatttttagctgtatttagagtaaatattgggtaaatgtattctttttttttttcactaagagctgaaatttgagtttctataatacctttttatagtccttaatgtcatttgcaaaaacgaaatattttgtgcaagtaaggtcaatgaggaattaatatatttactgaaataaagaccattaacaaagattaatttagattaagaatagaaccttcatgtaattctatttatatgaaatctaatcggaaaagttttagcttctcatgaattatttatgaagcacaacaaatatagacttattaagcaaagagaaaagaatgggatgggagtgaatccaagggaggaacaccctgtaacttttaaatatcctgtttaattacagaaccttttggctgaaaaagtggagcagctgatggaatggagttccaggcgctcgatcttcagaatgaacggcgacaagttccggaagtttgtaaaagccccacctcggaactactccatgatcgtcatgttcactgctctgcagcctcagcggcagtgttctgtgtgcaggtaagctgtagacaggaaaccttgagaaaagcagcagcctacttagacttagagcgagatagaaatgtataagaaaattcagcaagctttagtgtaagaattgaaagataggctgtcaatcggattgttgaccagtgtcacaagtattttttaaaactgacttctcatcattatgtgtaactttttatcttaatagatcaggaggcaatagc

SEQ ID NO: 104 - DNA, 1700 bp, Mus musculus
ctctgttgaagttctatctagtttttcatggtgacttccaacttgtttaaatcctagctaataaatggaattagaggattcaagataatgacttaaataaaaggtcctacacacatgagctaagaagaaactgacataatgagactggaaaaactgtcaatcccactagcaatcaccctagggtagcatttgctttttgttctaaagtgattcacctacctacacagggatttccaactttgacatttgcatgtatgtaataaatccctgaagtaaagatgctagaggaagaaagatgggccaccattgtcttctatatatacactgccatgagttaggataggcccagagcttctaagagccttgcacaactgaaaaaaggcaagtaaaatctgggacaaacatttggaattggaatggcaccttccttccacattgttcttcatccatatttagatgtgtttctttcatctgctttctctaaacacttcccccgaagcacaggaaaactctgtgagattccagagacggctgttattatactgtcctgtctgtttaatcacttcaccatgtaaatacctgcattttgattgtaaatggagtctcaagagatggtagagcgaaggcaggtaattttcttaaagagaaacaagtagcttaagtagaatcctgacggagcagaaagcagagctgtcagaagccatatgcttgtattttcagagcaggatgtagcaatccaggagggaaggactctaaataaataaatgaagcaccacttgtgacaggcaaaagcttgtgttgttttacctattgaacaaacaccgagactccaatagtctttggcaggaacgtcacagtgcaaagccaagtctgagaaccctgttgtttgtgtagtgatccaatccctttcctgaatgtctttacatataaaagacagaaccctaacaatggaatattaactgatttgagtggaaaagcctgtccgtgtgcagatgctactggcaaaatacatcacaatagttatttacatatatctgcagctcttcatcaaaaggagaaacaggagccgagaccatagatgtgttttcatctctgggaccaatgagagatatgcataagacaagggtgctctgaatctatataattgacattgtcataataaactgcatctggacattttccccgtactgggttccaaacccacaccctgcagctgtaatgaaatcatcatcatgttcagaaaaatctatttcaagagttgaaagtcacagacagaggaacggagaagggggtcatacttttctcttttcccaacaacctaagtctggacttggctgccaatctttaaaaaaaataatagtacaaacgtccaagcaactccaagaatataacatggtttaaaagccttcaagatagaatgtagaaagtttctactaattgtcttaaaatatgtaaataacaattgcatatgttttttaatttgtttcagaatgaaatataaagtatccagaaagttcattattggtaatatttgcagagattgtgaataggcaaagtgtatcacttgtgtccatgtttttcaacatagccacgatcacatctagttactgctttcaacactgccttccatttcaaagcactgacataaaaatgttcacatagaaaagcgtgtctgaggattggtttacccacaatgaaaa

SEQ ID NO: 105 - DNA, 1625 bp, Mus musculus
caagttcatgtaatggtttatctttaagatatatcatgggtccaaatgtttgacccagtttcagtaaatgcactagaagtaagaaatattttgcaaatatcattgcataaacgccacacacaagaaagtgaacagggcttaaggcattgcctgctcttctcagcatgtcttctggacaagtaactgtgactgggtaaagcagtatttttttttttctagtttaacaggaaaagaaaatgcaattattaaatgaactgctttatcatccgcacactgcctgtacattttaaaccaactctatttcagcattttaacacaatgaattaaattaagaagtaagactgccaagctcagaagcgtctggcacattctgcacctaacaaacagctcctgtgtgccgcctgcctccctgtctagtccagctttcttctgcatgtgttacttcagggcaccctcggcctgagcctaggaaactacccctaaatgacactcaaagaccagtggccaccactgacatcagcatctccctccagaaccacctacccccttaccttttgctatctacctcaactacctcctccccctgcagtcttgactgatgcattcaaaacactaaaatgaatacagaggactctgtttatatattgctgccacaaaacccatagctagataaggtatagaacctttgcagccattcactgtggagatgcagaaaatgtacactaaaatggcaacattaaaatgcttggcacatcttgtattaaaccatacactctattcatgctggtctagagatgctcacagaaagtccatccctaccacaactggggctcctctcccctctgagtaatagtggccctcaccctatttggcaatgtggatacacgaataaagttacattttcccttgtttccaaggtgaacggagaacatttaattctgtactatccaaggcccccctcctaaaacaaaacaaaaagctggcctgcttgccaaatctgatagcaaatttacctagctcttagaatatgcttccaaagaaaagctgttagtaggattctaacagaacgcctttatgcccagctactgctattaaaattgctctttgcgggggaggggtgaagagcaagaatccagcactttcctacctacagacagacagcacagtgctgaaatcaaaacttcaggagtgaccctccagtaaactcaatcaacagaaccaaatccccaatgagcagaatgctggctaattaaacatcggaagcttaagggctcggctgttagattagaacttccaacattaagagtcggttttctaaaatgtatattctaattatacatcctcatcttgtcaacagatcttaatacctgaagacatcacagaggggagatagtgtgctttgaagccaggcagacagcaggtctgtttttcattgttctgctactatgtaatttgaatctctacattgttccttttttttttcttttcttttttctctctttctttttctttctagaatgaatcttttcctgttttgttttgctgctttcctctcattgctctaaggctgaactacccacctggctaaattcttaaagaaaggaggtgtggttcttagagaaagg

SEQ ID NO: 106 - DNA, 1575 bp, Mus musculus
atgccatcacatcatcgatgattcttatgtctgaaggtgacaggctgcctcctgcctcctggacacttgctaggagccacccttgaagccttgtaaggttcacagcagggccaaacagaaagtccaggggaaggtgtcatctgcacagtatctggacttgtttaatagcatatttcgtaggagtccttacttccatcttatatgaaacccctggtgtctttgagctggctggcaataggaaagagaaagcacagcctggcaacattcctacattagaagcaaacctggaggtttgggcagaaaaaaaaaatatctgccttgaatataaaataatcttttcttgcatttagaggacaagaagaaaagcaggctgaaccactgctttaaaacaatgctttcatggagtcattaaaaatgaaatatggacatgcacagcaaagagccaataacagagatggtaagatcacagattcccttcggtaattagcatgtgaccatgcagaaagattgatgatgaaaataaatggaacagactggatactcagaaagtttagagttgcagaggaggagaaacagcgtctacacacacaaacatacatatttcatacacagtagcatagcacattcacatgtttactgacacacaaagaaacacaaggcacatggcatgcaaacaccacacacacacacacacacacacacacacacacacacggagcacagaacatgacatacatgtcaaaacagaaaaaactctaaaattacaattgagataatagggaattcttgaagaaggacgtggggagaaaaacaagaatggtggagcataagctttggagctttagaaaggaggactgcaaagaagagtggagatgggcaatgtgctgcctacatggacatcttaaccttggcaaagtagcctgtttgtaaagaggctcagaagagaaagagaatccagcctgtgcccagagaggcagctaaggactatcattttcatttgtatgtccaggcagctgctgtgctttattgagcctgaataaaaggaattttggctggagagattatcagagattaaggccaatggcttgtcatcctgaagatccaggttactccattctcagcacttaaatagcaccatataaccgtctgtaactccagtcccaggggatctgacaccactatctgaccttctctggcacctgttcacatgtggtacatatacatgcatgctggcaaaacattatacatttagataagatagaaagaaaatccatgatccatgcattttaaagaattgactgaagggatttgatcatctagctagacattcaagtgaataaatatactgcaacttgcagtatatgagatcctacggaactcctcatgacagaggctaccctgcttcttcttagtttggtgagcagctggggaacacattcttactatagccacacacactctcctgtaagcaggtttcagtcgacagtatcctcccttttcttttgaactgtgcatgtttaattggcacatagtaactatatatatgtatagccaccatggcaatatttatgtctt

SEQ ID NO: 107 - DNA, 1725 bp, Mus musculus
gcaattgtaatatctaaataaaagagactttcaaccaaaatgaatcaaaagagatagggaaggatatttcacactcatcaaagaaaaacacaccaagatgacttctcaattctgaatccccacatttacaacttaaatcctacttttaaaggtgctaatggggtttgagggccacaaagctagcagtgcacaagcagtagaacagatgagacagtgttctttctgcctccatctgcacccaggagctggggctgttccacagccctctgtgcatgggccctgccagggtgagctggtctcccagaagtgctgacacagacttacaggcccacaggagggacaagctcaacccagagacagcaagaccaactaacaccccagataaccagatggcaaaaggcaagcccaagtacctaaccaacagaaaaaaagctacatggcatcatcaggatccagttctcacacaagagcaagtcctggataccccaacataccggaaaagcaagatttggattgaaaatcacatctcaggatgctgttagaggactttcaggaggaaataaataagtcccttaaagaaatacaagagaacatcggaaaacaggtaaaagaacttaaagaaaaaacacaaaattcccttaaatcattacatggaaacaaacaaacaggcaaaggaattgaacaaaaccacccaggatccaaaaatagaagtagaaacaaaaaaagataccacaaagggagacagctctggagatagaaaacctaggaaagaggtcaggagttatagatgcaagcatcaccaacaaaatacaagagatagaagggagaatctcaggtgcagaagaccatagaaatcattaacacaacagtcaaagacaatgcaaaatgcaaaacaaaacaacaacaacaacaacaacaacaacaacaacaacaacaacaaaactcctaagccaaaacatccaggaaatccaggaaaaaatgagaagaccacacctaaggataataggtatagaatagagtgaagacccccaatttaaagggccagtaaatatcttcaacaaaactatagaagaaaacttacgtaatcaaaagaaagagatgaccatggacatacaagaagcctacagaactccaagtagattggaccagaaaaaaaaattccacctgtcatataataatcaaaacaccaaatgcataaaacaaagaaagaatattaaaagcagtaagggaaaatggtcaagtaatatataaatgcataactatcagaattacaccagacttctcgccaaagaatatgaaagccacaagatcctgggcttatgtcatatagaccctaagagaacacaaatgccagcccagggtacaatacccaataaaaatctcaattcccatagattgagaaaccaaggtattccatgacaaaaccacatttacagaatatgattccataaatccagtccttcaaaggatgataaatcccagaagatggagagatctaccatgctcattggcaggattaatatagtcaaaatggctatcctgcctaaagcaatctacagattcaatgcaatccccatcaaaattccaactgaaatcttcactgagttagaaaaagcaatttgcaaattcacctagaataacaaaaaacctaggatagcaaaaagtcttctcagtgataaaagaatctctggtggaatcaccatgcctgacctaaagctgtactac

SEQ ID NO: 108 - DNA, 1525 bp, Mus musculus
aaaatgatccttttatcgactactgcttgatgatcacatgtaatcgatcgtttcatagattcgaaaaatcttgggctgaggaggtagtgctagattcactaccctagcaaacaccaatctttggtaccaaaaataagcaaataaataactgtatctgaagccttctcaaaggtttttcctgcgaacattcttcttaacaggagcagagataccttgagaaatcctaactttgaatctcctgttcttatggtatctatgtgggtgcctctggatctttgtcagactagaggtccagcattccatgctgaaatgtttctgtagaaccggtgtcacctttcagtgactaaagctgattaggtaaacagatagtaagtgtagattacattgacttcggccttgcctttagcttcacggccacaggttttagccatttgggagggactgtggtatctgtaaccacttgggctttcaaaagctgtgatacagtggtgataaagtatgtcttttcaaatctgtgagtctgcagtgtttttatgccctgtgtagcattactggtttattttatgcttctaattacttttcggggcagaaatgatattaagaactccttgataacgattacagaagccatctgaccatcaggatgctatatgaacccggggcaggggagggggacgggggagttgggtgaggacccgttttttctttgttataggaaatcttagtattcctactagaaaagggtagccctttccatgacagtgttagaaaaagacccaagagaggggagtgggcctttcctgagctgtctttgtaggccttgcccagatggaggttagttctcagctacagcagtctgagagttcaggggaagatggtgctgctgttccatatgacagattttggatttggttgtgagcacacatgtcagaaacagataagcatgtatgtgtcattccaaaattagactttattgaataacaataaatacacaaggttcggtgacatttgttatataatcctacctactttgataatctggctgagggaaaagtaggttttcttttattccagtcttaattagtaacattaactctcctatgatatatcacaaggcacaggtaactagctgtgtgtgtgtgtgtgtgtgtgtgtgtgtgtgtgtgtgtgttttaaagatttatttattaaatgtaagcacactgttgctgtcctcagacactccagaagagggcatcagatcttgttacagatggttgtgagccaccatgtggttgccgggacctgaacttcagaccttcggaagagcagtcgggtgctcttacccactgagccatctcaccagcccgtgtgtgtttttaatgtgcattggagttcaaaagatttcagaaaagggccgagagaaactgtactgatagataattgacctcttctggtgtgtctgaagacagcgacagtgtactcacatacataaaataaataagtaattcttttaaaaattaagaaataaaataaaaacagccat

SEQ ID NO: 109 - DNA, 1825 bp, Mus musculus
tattcttgtagcagctatcattatgctccgaagcagcagagataacaacgaagagaactatagactggctaccaacaccctaaaagttaacgcttccaagtacaagcaactgaacttaaaggggaaggcccagtgagggtgattgttcaggacggtgtggagggacccactgttacagattatggcaattttgaccttctaaagctaattccaatctcagtgtgagcctcgcacatctgaatctcactggaggtggcagaaggagcaaggctggcttccatgtagaaaagtcgagtgggcgatagagtattgattgtctccagaaacagcaagtaataaactcatcagagaaagaaaatacatatttttgtggaagcaagaaattgccaagtgaaaaaaaatgctttctaataaatcaaaattaaagctctattgaactatgtaggacagtgcaggaagcccttgattctttctgggctaattcatataaacggtaaacgtacaatttactgagttttttttttttcatggattatttcaggtaaattctaccaaatattacctatatctacagagaagaaaaggtaaaaaggtaaagagaagaaaaaaactatatccacaactgacttttatattttatagcttataacgtctaaatggtagaaaaatgattgataaacaagtatgtgtagaagccacgtcagagccggggatgaaatgtcaccctagatcttaaggaaagctgaaggcagatgaaagtctggatgaagtcattaatgaagctgaaactgagcctgagaagtatgctcgctagggaaccttaactaaaaaacaacatcaacaacaaagaaaatcagtgataaataagactgtttcttcactcgagagttccaagcaagcgagactattaaagaaaccacagtagcacttgcctcggtgcagcgtgagatttccacttcctttccgcagcttagggttattcagcgagtgccggcaagttgaaatatcatttctttttattagcaccaccgtaaggggtgaacctcggctaatgagagcaacaaagctccctccaggttagggcttgttaacacggcacacaactgttaaatgcatcactctttccacttattagtgagataatattagccgtttctcctccccccccccatatccattcatgaaactgtcatcccattgataactcattaatggtaccaaagtgggaccaaaaaaacctcagtagctgcttcccttggggacgattttatacacggagaggatggattgtcttctaagcagctatttggcttctgaaattcctttcacttacaattcttacatgacgaggaaaatcaagggcacgtcttatctggctcaaacttattttaagactcgtcaccataacacgtggcttcaaggattactgactcccccattggcagtttgtaaatcctctgtgtgagacaacatcactaaagtttaacatgtttctgatgccttaactcagcgtatttcataaatcttcgtcaagacaattattgtcagctacaacgcaattatccatattcaatttgacgactcaactggaaatttacttttttttttcctaataaagtttacaagatgacaacagtgaatcagtgccgattagttgctcagtgggtactaattaattaagccaggtaaatttaggtccatgctaaaaaccttgagaggaaagcagatctatgcatgggattctttgtctggggtgaagggaacgaacccttctgtttccttacttttctttctatttcttttcttaatttctcccagaagagaa

SEQ ID NO: 110 - DNA, 1675 bp, Mus musculus
atatatatatgtatatatatatacacacacacattatatgtatatcctgcctttctacaaataacttgtccttttaatttgttgttatataggactaactgtatgatttttaaacctataaatatacatagaaagcaatgtcctaaaacctgtgcaaatataataattacacataattttttcaggtcttataactgaaaaacggctggtatcagagaaaaaggatataatgggcagactcactagcaatggtaagagatctagccacttgaagacaattcaaggcaaatttcctaaaagttgagtaattttcaagctgatacttggtgtgacattggaagtcacctgttgtacatctccccatggcccactgagtttacagatatgacagctgtcctcattgtgtaaatcacacaacacatctatgaaacttttgtagatgctgaaagagccctataaactgtttaactgattaattccatgtcaggcatctgagtctagtaggcccttttgtttttaattctatgtacctcacccagctctaactgagaggtttaatagcatgagcaaaaattcaggcttgtctttaatactgaatatcattaagatgacatcaaaattgaatgcaagaactatcattaagcaaacggtgttctgcaaaagacatgataagtcaagcgtctgtaagatgctctgaaagacacaagtgtggacccacgtccgtttggccctgtgtatcatcatccctctttatgcttctctatctaccttcatgatgatgcctctctaattaagaatctacaccatgactttgcacaaccgagtcactgaagcacaactcggcagaaagatgaagttaggctcacatttaacacaagagaaatatttacttcaatcctctgccatcctctcacggatttgtcactgattagatgagatgggatgccacaaacgtttttgcagcttttaagagggaaaaaggcatcctttcgataaatgtcttcgtgttgtgctaccagatgtctttctgcagcctctcatgctttctgattttatttttgtaagtgtgagaacagggaaaatgccagccattgtagtcagtcagcctgagccccagcaagcgctgcatcgtgcgatgtactcttactgggttttacataagcactgaacttggagtacacttagcccctagggataccatcagccactgctcacaccaaaacctgtgtttggtcaggtccatcttgcaggtagctcacttcaaaaagtctttttagtttcaaaacatatcatcacccaccaaacagattgggctaaggttctaaacactctctgctttctcctctttttctttctgatgttccaagtcttaaagacatttgatattaatgattataatagataactaggcatgagaataacagctgggtgtttttaggggcggcaggaatttggtaagaagctaatttcaaagcttatcataagactactcacactattagttccacgctgtggtcatttttgctaaatattttgtggttccggtggaatgccaaaaggaattttctgacaacctcaaaatggtgccaaaatctactctagatgacaagaccacttaaggttaataaagatcttctagactgtgcacttgtggctctgaggtgctaagttcctc

SEQ ID NO: 111 - DNA, 1550 bp, Mus musculus
agccctagctgtggaatcagtgaaagaatgcataaagaggatgtggcacacatagacatgcaggaaaagataaatggtggccctgggattcaacatggtaaataaaccagacaagtgcattgtggatttttttgtaggcagccaggcgcctaaaagatggcgccggcctccagtacaccatcaccgtaaacaacgccactgtacaggccagaataaactcctttccctttacattgcttttgtctaaatatacttgaactctatcttaagataggtaactttatcttgaatgaattttctgtttcaggtattttcaaatgaaaatactttcaccagtgtatttaatttctgactttaacatcaacccacaacacccattcttccctataaacagaaatcagattaccagtgcgatgatacctaccagtaatctcagcccaatgagggggttagcaggaggatcttgagttcaagactggcctagttatctggctctaaaaagaaaggcacatgaggaggaagtaggagaacaaagtctcatccatgtgtctttatgatggctcttcccgcagcttcctctgtaatacagtggcacttacctcttgcctttccaaggtcgcagagctatggccaaaagtggtcactcaagcttactatttcctaatagcatcgccaagcaaaagaagtctgcttgtgccaaaacttgtgtcagctccacgtgtaaacagtgatgttgctggtaatattcagtctgcacattagttgatgattacagctgagagttttaaatgatgagcacctatgtctccatttgatgacagtaatgactgcttatctgggatatctggcttagctggggcatccctaagccacagggagaccaatctttatccatcagaggtatggaagtggggttgctcagccaggctcatccatctacctatgtctcatttgtctacttagtagcttcatgtccttcctctcaatgtcattagatctcgttccctctgcttctccttacagtggacacgatggtatccatccccagagtatcagcaacattggacacatttattatgatttttagatagagaacacatgctctttagaaaaatgctctatcctgcacactctattgggtaaagaaagactagagaaatttcaatttaacccgaagagttcctccaaatgaagtggaggcaaaaagcttgagttttcacatcaaaatacgagcctttctggcacacaaaatagaaacgtaacaacattttgttcaacaaataaatctgtgacttgccacactgtatataaggtattctgaattggactataaatgagatacggcacactgtgagaggcttcgcagaaaagcagagcgaaaacccttgggctttacaaagcagtgaagaggggagatccaacgagtctgttcttaataaagcagagatcccaggaaagagaatgaggcttaggaaaagagtgaggattaccagaagcgggcaagaggaaaatgagtgagagcctgagaaacagtcaatcaaatgcctgtc

SEQ ID NO: 112 - DNA, 3650 bp, Mus musculus
tgggattcaaagcacatttcagacgctccaaaagtaaaagatggatgggaattaatcaccaaatatttcttagagaagaaatgacagagtggttttaagatcctttgaaatgtcggctctgctcattacaaagctctgtcctttcactttgttaccagaaaggaaaggctcccgttgtcctctgaccttctgatttcatctcagaatcgatcaaatttatttcagtctctctgagtttggcccgataagaacaatggcggaccagctaatgacgagccacactttcatgtttaaccaggtcacaaaagtttgagtaaagtcatcttcatgtatgaagatggtactctaacatgagatctggttctttgtaattaacataatgagcatcaggaaagtctatcctttcctatgatagagttttcagagttaacaagtgagatttggagagagacgctatttgaggttatttgagaagcagagccaggaaaatcctggttgaaggagaggaatagggagatatacatgtatttctcatatgattatggacaataagaacaagtttcgtagatacctgtgctgttgtgtggctacaaaaccagattgaacttgggttacacatggtgtcatagaggaagtagcttttggtgctaacattggaactgcttttactcagagaactgcaaagggttggtgaaaatagattggctatttgagatgcacatattaaagacttgcagaaagtgcaaggagcactttctggctttactttctgaaacatatccataccaaatcgcatagaccttgccatagaccttgttctctttctttgttggtcatacaggagattgaatccaagaccttccatataccaggcaaggactctataattgatctctgtttctagctgtcttttgacttcttcttttgagacgggacctcactaggttctccaggtttatttcaagtcttccgtgtagcccagagagtccttaaatttgtgattctactgtttcagttttccatgtagctaggttgacaaatgtgtgcaatcaggcccctggctgtttcattctgctcaccaaggagagctgcctccagttccaaagtgaaccactgatcagtttctcaagcccttcctatttcttcagatttccagttgtttcaatttcgtctttttcgaaggtttcttctattaggactggaaagatactggttggtaaagtgtaggctgcactggcatgagaattggatctaattctcagaacccatatgaaaaacgtcaggcataggatcttgtgtttgtcttggggaagtgtcacaggtgggtccccacagtttgctggacagttaggctagtgtaccaggagagttccaggttagtgagagactctgtgtccccaaaaatagagtggttggcacctgaggaaggtaccgtacattgacttctagcctctcctcagacatgtgtgcgtatgtgtgtgtgtgtgtgcgcgcatgcacacacacacacacacacacacacacacacacacacaccacaccactctcagcaccactacctagaatgtgaatgttctccaaattctcaccatggactttctctctcccttcctaatagctttaatgatgctctaacatcttgtacttatgagctatccacagacacaagaccctgttcatcctttaccactaagtcatctctcctacctccttcatggtgtttgctagaaaatatggctctcatttgagtttcagactactcagctctgattaataccacagccctaaaagtgccttttctttttctataatttggccaaggagatctttctacaatgccaactggcagtttattcatttcttagcctcccctaagccctagttctcactctgccagtgttcgctgtatcctttatggcccttaagatcagcctttgcttaccagtgtagccttgtttttccatctccagccaagtcctatgactttacagtccaactgtttggtgcagtttcgagtccctgaatatgctgtggtcgctctcatttctaagccttgtatggccctttcctttgggaaagccactattttctcttaccttcgtcaatttctttgagcatctcagcacagatacgggctatctctctggaagtctttccatacttttcagtgtaggttatgacctctttggggtcacccacaatctcaatgcctccagtaattgtgaatctacttctctcaggtcacaagcacccctttcatttgaagatgatacctcacagaaacgtatacccctagttatagaccaataagctaaggaaatgttttcttcttcttcttctttttaaaatggcatctttgagataacaagggctccaaccagggcaggagtaagagaatgaaagagatacaatgaaaatcattttggaagtcacggtgaccctatttggcaacttcatggtatttttgagaaggaataattagaaaccatttgaagatttttttttctttttatagttcaaatgaatggaagactagagttatttggccatctggtttggacaagcgacgaagtgtccatttttggagttctgagtttaagatatctataggacatctatgaatagatgcagaggagattttgctctatgtagttatcaaagggaaattggagctacaggagacaaaattcaggcttccccatccacaaagtaccattacagcaagggtcctcagaaacgtggcttatgaatgatgctggaaaacagggtggaggagcagagagacagacacagggaaagctgcagttcagatagcagacgcagagggaggtcatcccaagggtccctagcttgttggtgacttctgtcctgaagagtatttttctctcagacacccccttttgctttgaaagcatttgctcttcagaataaagcaaagcaaatattgaacgtcctgttgagattcccctaaagtggaacggtccccactgttagctagtccttcctgtttttatataaaggagaataaagcactggaaagattgtactcagacttgtgtgtgattctgcaaacacgatagatttaaaattttcaccagggcaattatacaacacaatattcttgtgctcagttatgcatctgttgaaggaaaaattggtgccattaaaagaaaatataaagttcttgacatttatggttgactgttgagcttagttggctcaggaaatactaccttcctatttcctacagctacaaattgcaaatgtcttacactaaaaaaaagcaaagttctcagttctaaaggtgcattccaaacagcaacctgacctctggtgttttcaaatcatccttttgcaactatgggttacacactttcagaagatgtatgtaataaaggcaataacagcggcactgcactgtaacaatccgtgctggtaattgtccattttgtttatcaaaagtatgtgctgttttgcaattactggagctctcatcgggtgcatgcatggaactgcccctgctttcacattgacttttctttccctttcagttgcttcatgttcctgtgtggtaacagagttttgtaggaaaacacagaggtgtggatgagattcatagtattgccaggagcaatttgaaattggctagg

SEQ ID NO: 113 - DNA, 1525 bp, Mus musculus
cacacgtatcagaattccagtgggactggccctagacagaatcctgggaagacttgggtgagcagtgacagatcaggagcaaatctgaatatacttggaagtcaggcaatggtaattcaaagaacaggaccacgcagaacagactgagtgtaggctaccatccaattttaatccagttaaaggaaagagatttctggatatctggacctaaaggaggactaagtaaaggcaggaatcttgagttaaaaatgacaaggctgtgtccccatgtgataatcaggataggtgatagaactatacatgctgtggttgccaatgattctggcagtatattaaatggaaagatctggaaggataggttgtgtataccaaggactctttacaagttcatggaaacaaggaatgagagacagagcaccgtacccagcactacacaggaaggattgcaagtgtgccaaaccatgctggaatgttacttaacgtgttgactgatggtaagtatttaagctgtaacctggtgtgaaaagaagccataggtactgatagaataataatggatgaattagttttttattgtggctaagtgtatgaaagctaggtaactatataaataaaatgcattgccctggtttagaagctgaaagcccaatattggacagtgctgatggctaagccactgatgaagacctagtggcaaatgacatcatcacattaaggacacatgcaggggcaagagatgccatggccagatcctaggagaagctggggagctgagggttgcacccttcataatatctctctttcatgtactgaacagggagtctcttcagaactgcctggttactttctgagagcagtgctaacattccctggaggacttctctttaggcccatatcttaaagctacatagaacctcctatcatctccacactaagaacctaacctagcatatgaagtctttggagacacactcaaaccatatcacaactaaagcaatggctgtcccttttataaacactgaagccacgttcacctgacacgatcttttcccttcagatgctatctccaagtttaaaggagtacagagaacgcaggaggatccaggaggcagttgtgcctttcttctgaactacaagaaataaaaggaatccagataagagtccatgtgaggatcacatgcaaactctgatgttaagagctggctattactgtcctctgtctactctaacgtttccatggagatttcagttaggatggagacaaggcttcttagcattcattcaggaaccttcaccacaagccttaacacaaatccattgagctcctcagcttcaggagagttccctgcatcctttacattcctagtggccacacctcctacacaaaccagctcagttcctaaatacattctgtcttctgcagacatttacccaggagttcctgtgcagcagcacctggctgattatgagttagctttaaagagtatggtttttgaagtctttgaaacaagtattgattctagga

SEQ ID NO: 114 - DNA, 1600 bp, Mus musculus
gaaagaaatccaaaggattaaaatgctgcatatcttctttggaagactgctactgaccattatgctgggcattttttaacacaaaatccagcacagaaaggagaaatcacacagcgacatctgttgcagaactgaaaatttgccgcttcgagatggaagcaattagccccatgtaagcacctcctagtatcagagtgtgtgtgcgtactgacacaaatatgaacctgtgtacattcacattccaacatacatgttatacagaagcttacatatttaaagtaatgcactagaaaatgcaacattagagtgccgacatgctttaaaaaatgatagagattttcatgaatatagaacttttgacaaaagataaccacgctctttttaggcaattccattgtcttcaggtgaagctactgaagcccagctgaacggaggctgagttagctgtagatcttggttggagacaggtcccttgatatccagccagtggaccttctgttcttcctcctggcagggatgcccagagatatggatcatgggacaatacttggctcaaactattttgtattctgaaggcagcgagattaattgtttgctctaggtaataagcccatggatcagaaggagtgacctctgggaagaaaggaccagctcttggtacctttgcctttggtgttgacaaatgattctgcaacctctggactttatctggcagccactgcgcggatgtcatccaaagggccttcatatgggagactgcaggtctgtgttgctgtagtcagtcacagaggcgaaagctaagtttcaggaagctcatgctttgttttttaagatttcatttgtcttttcttaagtctagaacaagagccttcttcggttttctttgcaggttctcctttgtcatttgcagagaaaaagctaaagggaaaatcttctttttcttaaagggaaacatttttttttttccaggatggcttttacattggccttattttctctcctttcccctgattgtggggaatttcaagtattcacaaaagcagaaagaacgtcctattaactctacgtgcagaccatccagtgccaacacttacccaccctgccttcatcgtttgcccctctgtgcttcctatttctcctggattattttaactaaatcttgggcatcctataatttttccacagttccttcagaatgaatttcctcacttataattacagtatcattatctgaattatacagattctcagctggatatgcagaatcttgcctgctcctcttgcctttctgaggagcggaatgaagggttggctcagtgggtaatgaccaagcaggaactagagaggcaaagtgcatgcctgcttgtgccgaggagacctctcctgcggtttagtttattttgagcaaggttttgtttggatcggataagatgagtttattgttgtgtagatatggttgtataaatatgcagtaattgtggctagtcttcactgtggtctgcacccttggtgaaatagtccatttccagtccttcccataatgattaccctttacccacagacttttgtagggaaagcttattttagtttgatggctatg

SEQ ID NO: 115 - DNA, 1500 bp, Mus musculus
ttttgtaattcatattttatactctttcactgtggatgacctgagacacctggaagatccctggtcgtcatcctccttcgccttttttttcttgtcggtcctcacattaccctttcagggagttgtcttcaaactcatcaagttttcttctgcaccctgtaaatatattcttgcaaccacccacacatatgttcatttttgttttatgtttctcagggctaaaaatactgtttctttttttatcacttccataatctctctgctgagtcccggtttattgattcagattgtagtcaaagactggaaggtctttgaactatttataggagctaccttcaactccctgtctgctcaggtagacatctgggtcatctcataccttggctgctttgatttctggactctggccacatttccctttttatttgctagtctagttctttttaatataccctggacattatgagtgatgttctgtagaggctccagatcccattattgttccatttccctgatgtttgggatggaacattaaggccttgcagatgtgagtcagacaatcagccattgaccttcatacccaatcctctgttattatctcctaaggaaccatggttcatatatatatatacacacacacacacacacacacacacacacacacacacatatatatatatgactgatcacttaggacagtggttctcaacttgaggatcacggcccctttggcaaacctcgatttccaaaaaacatttacattatgattcataacaacagcaaaattgcagttatgaagttgaagtagcaacgaaaacagttttatggtcagaggtcaccacaacatgaggaactgtgtgaaagggtcacagcatcaggaaggttgaggaccgccgacctaggggatgcttatttgattcactttgtcaccaagagtcagcaaaccctaagatagttatcagattacccagccttcagatagttaacagattacccagccttcagatagttatcagattacccagccttcagatagttaacagattacccagccttcagatagttaacagattacccagccttcagatagttatcagattacccagccttcagatagttaacagattacccagccttcagatagttaacagattacccagccttcagatagttaacagattacccagccttcagatagttaacagattacccagccttcagatctgtctcccttcagggtctcctgcaggcttgaatgtagggattttgaggcgggtctagagttgacacccagatgcatctgtccgtgctagcatcttaaggctttgaggttgtaatgagacagggactggagaaatagctggcattggggtcacaactgaccacccttctacctatggaagggagctttctttgggctcctacctgctttgtcttcctaaagagcagccaagagacacccaagaagactttcaggatcacatacatgatccacgtgtg

SEQ ID NO: 116 - DNA, 1500 bp, Mus musculus
ctcatttggaaagttggaatcgtggttcagtcaactgttcttagggctaagccatggaagcctgtggcaagacagctcatccagctttgatttctgtgatggtttgaaagtggttggctcagagaatggcactatttggaggtgtggccttgttggagtaggtgtggccttgttggagtaggtgtggccttgttggaggaagtgtgtcactgtgggcatgggttttaagaacctcatcctggttgcctgggaggcagtattctgctagcagccttcagatgaagatgtagaactctcatctcctcctgcaccatgcctgcctgggcgctgccatgttcctgccttgatgataatggactgaacctctgaacctgtaagccagcccttataagagttaccttggtcattgtgtctgttcacagcagtaaaatcctcagacagtttctgacaaccatttgtggaatccatgaaagctaaatcgacaatgcctagcagtttcctggtgataggcaaggcagaagattccatgattttccatatctattaatttctatatcttttaataacatatctattaatggatacgggtacaatgagaagctatgggctataagcactgcacactttcgtctgtctgggttggtgagatcaaacccccagggccttgcacatgaatgtgcaaagcaaaccttctgtcttcgagctcagcctaggcctttcataagcttgtcccacctcttcagcaccccacccccactcccttttgggcttatcacttctaggaagagtctatgtcaagtgctgctgggttttcttccccttgacttcctcaacagacattctcaagtatatttgtttcctacatactatttatagaggctcgttctcagccacttcaaaactggtctttgccctgtcagtaacagcagctggtctgtcttggtatgtctgtcaactcattaagagccaaagaaaaccacttgaaaaccttctccctgttgggaagttggctactgatgtttccccctcgtgtcgtcagttctctgagcagctttggaaggctaataacgctgtttgttttctctggacacatttcttcagctgcagcaatcaaactgatttaattaagcacactcccgggtaacagcttgccttgtttggttagcacacgaccaagttggaaattcattttctttgcaactccgtcatcacattttagttttgggaaaagagtctgctgtgcggagatgtgccgctgaaggctctcatcctttgtgctcactgcttttccgtgagctggaaagatggtggcttgcatcatttattaatactgttttatcttagtttctttacattccatcattaattactttatacgtatgtgtgtcagtataggctgtgcatgcagtgcccttggcggttagaagagggtggtggattgaagttacagatggtggtgagttaccatgtggctgctgagaattgaacctgaaatgaaaa

SEQ ID NO: 117 - DNA, 1500 bp, Mus musculus
ctgaatgaagctcagtgacagaagatttatttaataagcaaaaagctgtagatttaattctcagccactagaaaatggggtactttattatttgattcaaatatgcaaacacagcagaatctttatgtcatataagtcatttcatgaataatcacagttaattttttcagagaacctcagcaatgtatatatttacttccatccatcccataaacaaccaaactcaaacactattgcagatgtcaacaagagcttgctgacaagagcctgatatagctgtctcctgagaggctctgccagtgcctgacaaataaaaagtggatgctcatagccatccactggacggagcacagtgtccccaatgaagaagctagagaaagtacctaaggagctgaaggggtttgcagccccataggaggaataatatgaactaaccagtaaccccagagctccctgggtctaaaccaccaatcaaagaaaacacatggtgagactcgtgtctctagctgcatatgtagcagaggatggcctagacggtcatcaatgggaggggaggcccttggtcctgtgaaggttctatgcctcagtataggggaatgccaggaccaggaatgggagtgggtgggttggggagcagggggaggggttaaaggacaggtggtttttggaggggaaactaggaaaggggataacatttgacatgtaaataaagacaatatctaattaaaaaaagaaatgaaaaaaaagaatcaggaaaaatgataattctatacaaagaaacaactgtccaatagtccatttactttctctaggagatgtttttgatgacaaagagagatgactcagcttcctcctgtggtcaaaaatgggttaaaacccctctaaatatttgctgaaatgttcccagctaaatattatctatggtaaatagaagcagacatggccagcttcagggagaatagaaatgtaagccaaccaacagtctcagtataaaacaatgtttcataattgaaatgctccctgaaattcgtggaatcccacttgccctaagtagagaatttgttctggatcaggtgtattgctagttagttaatgtgggaagaagtgatatggggagcccttgttagttcagggcttcagatgggccttctggttgtcttcaaacttcacatcattaggaaagcttgctactagggaagatataactctgattttaaaagttggagttgatgaccttatgttaacttattccacaaaggaagaacagggactatcattagctgggctgtgttattctgtattaaataagcattatacatatctgtgctttgtgccatgttttgctattcttcttgaaataaaaacagctttagccatttgattgagtctctaagtcttgcagttgcactcagtagaatacccacacaagctgaatttcctaacagaaaatcatagaaccggagagaaaaaaggaaaaattcgaagttacctggccacaca

SEQ ID NO: 118 - DNA, 1925 bp, Mus musculus
aatgtttaaattgattctgataagtggaccctcttatctcctttatgttcctatctctaccaggaagagtgttacaatgaagtcttagaggtctaaaaattataaaaaagactgttgctaacagacaaggctttcaaatagaaaacaagtagttgaatgaagctatccatcacacaaatacctatttaaccatacagaggaagcagttttgaatggtttgagaataaatcattgcacgttgttagtggagtacagctaaagaaaaaaaaaaaactttgtagaaaatcttgagctttattccatacttttttctaaaccaaataagcaaggacttttatatttactatgttagatataaaaaatttagagaagaattttgttccatgagaagtgaagtgaaaatagcaatagatacaagaaagaaaaaaaaatcacctgtttgctgaaattatccaggagtaatattcctccccacagtgccctctagtgtccagattctgatttctgaaactattttttccactataaaggaatcatggttccttgagaaaatgagagattctatgccctgggcagaaaggtacaaggtgaatctagaaagactagtgccaaatagaaacaaaatttctgttaacagattctactagaagtttgcattaataaaattaggaaggacttccattggccaaagttattctaatttgcacatcacagaaacagcaatgcttagaattgagggaagtacagtaactccccaagacgctatgcctccatgacactacaaagagaaatagtaacacatgattctaaaataaggtgaacagaatacaatgcatttctatagagccttgcatctcactcatgagacattattgattaatcttttctctcaatggagaatagaagaactaaaatcgtacatacaggaattgaagggcatttgggaaaacaggcaaaattctgaaaatgtcactgttgttaatgttcttcccaggaggagaaataaacaacatctattgcttcttctaaggttcccaacaacaaacagaggtgcaattctgccaaagttcactctggggaacaaatgagttctctacaaatgggcttccttacagaacttgggttctggactatttacaaggatgtggatgctcctggcccacaacaagcaacacctgcaaagctgttacctaacaggcatgagggctccccacataagacatagatggagccctccccctcccaggctaccctggccttttcactttagtccctccctgaggccatgtgcaattgaggcagagatttatatgacaggtggtagtaagtagaaggacactcaggtaatgtcttgtaaccagttctccctctccacaaaccagtgtaaacagtcagtaagtccagtaggagtgattctttgttcaggctagtacagccaaactctgccaagtggtggctgcttggcttggagggtagtcattcatagtagtccccctgaaactgagatttgaaatcagataaaaaccaaataaactgcctagaattcagttctgcacaaaattaagtatctttaagatatgtgcagtttcaagaacatgaatgaatgtaaaatgtctcagcatatctcaggatcccatctgcttccaaattctttagggtaagaaaaatgttaatgtattataagattttatcaactggaatggaaacggcatagctaatccatgatgtatgtaagtgtaaccgaggaagggccatataccactgatcactcacgtcttgagattatggactggtaaaagtataaatagggcccaagattccttttcagagttgtcatgtgaatccagcagccctacaagcctaaatagcttggtggtaaaagtcattcttaagttggcataatttttccttacacagaagcaatt

SEQ ID NO: 119 - DNA, 2875 bp, Mus musculus
aaacaaactccaactagtcagtcattaaaatgataaattaaaagaatattttatagcatgaggtaatataatttgaagacagcagctttcaaacattgtatgcacacagtaatcacaaatatacatggatatataaaactatacatgctatataatacaggaatttgtgtgtgttcatgcatgtgtgagtggcctgtagtctatacaaatctggctttcagaaaggaagatgcctttatatggccagtagttgaagccacagaaataaatttattaatgaagagaggggacagaaaagaaaagacaaatactgaaatgggaaactggaggtagagaaaacaccaaatgcttaaggaggtatagaagaaaaagtaagcaaaaagaaaactagtggtacagagaagagaggaagtagtatcaggaaaattaagacaagccttggttttgttgaaaaaaggtgaccaatggaggccagtgctacagaagaaaaaaaagttaagtcctgaaagaaactgtggattctcaccggcaaccatagcagactttagcaagaggaatgtaagggttttcataaggggagaagttgtaatttaaaaataaaaaggttgaataattaagaaatgggtgaaaaatgaaggaaacaaaagttccattggcttgtctgtcaaagggaaaaagacaaggaaatggaggcgagaaacagaatgccaggtggcatcttttaggatagagtcctgagatgatcaacatacccttgaaagctcagtaaaaaagagaatatatctaccttcacagaacatcgaggagaggcagaatcagaagagaatggcctcccacaatgctgagaattcattaagaaaggatattgtagacagatctggaaatctagaaagggagtgcactcttgtaggcttaggatgcttcagtatcatacaacaaaagggggaagagagagagagagagagagagacagagacagagacagagacagacagagacagagagagacacagagagagatctagtctatttaatacaattgctaaactctgcctaacctgttatttttgtggtctgcccctcgcccacctcctctctcacctcacctctcttctccttctctgtctctccctccctgtctccctttatccctctgctttttagataagattttaactcttccactctgcagcctaggctggcctggaattcaatgtgtgtcctaagctggcatcaaacttgtggtaatactcctgctaccaggttgtaaatgatgacattataatcctaatctactttatatggctatccttttatttgcttgagataggatctccagtagctcaggctgtacttgaacttgttatgtagtacagaatgatcttgaacttcaaatcctcctacctccatgtagcttctgagtgctatggttacaatcatggagtactagaacagcacttcttttatttatttatactgtatgcaaatgagtgtacatgcacatgcaaaggacaactactaatgttccccaggacctatccaccttgtgttttgggatctctcactagcctggaacttgtcaagtaagctaggctagcccccagcaaagtccagggatccacctgcctctactttctcagtatttggatttttaagtgcacaatacccctgccccatacctgaccttttaaaagtagtttctggaaatcatttctcaggtcctcatgcttacaatgcaagcactaatctatctgcccagcacatttgtgtttcttattcaacaaatgtttccttccttagcttgcctgtccatgagaaaccttttgcatgagaatggtgtgcaatctgcctgttaagttggtaagcatacagggaaaacaggcctctttagcaatgtgaatttgagtttcctccctcacttttgtcctgattatctctaaagtcttctccttctccctaaaatactttaggatttctcctgtatgcagaaaaaaaaaataacagcgagatttacatttcggccccttttccaagaggtttccaggtgctagatgtaagcagaagatcttgtgttttttcctttagatctaaatagtctgaatcccagtattgctcatgggaactgtttcaaaggctcaagtgtcagaatcagaaaggaaagaaatgtgtgggtgggaagttctacatgcaaacttgtcatagtcttctttcattttcagacctgaatatgcatggatgcagaaattatagcttattcccaagtttttattgtcagcatcaaatcgaacacaaatgtcaagaagataagattggtatatttaggtgaaaatgttcaagagaattgatcattcacttaaatagtctctctctctctctctctctctctctctctctctctctctctctctctctctccatctctctcagctaatgagccctttaattgcctctgagtatacttttaagttcctgggataaagtacagagtaaaatctcatttattcaatttcactacctttagatttatcgaaacttctttggtgattcctttatatacaggctacaacggaatgacactaaagaagaaatgttgaagtggctcgcacatcaaattaaaaagatacttaggtgagaggatcttacagagaattaagaaggccaatataagaagagcaaaacagaggaaatgggagctgataagcattaggagggtctggtcacagaaatggtcgtggttggactatggtagctagtaagggaaagagaaatctattagagtaatctgaacataggagttacatctagtcaaatatacatttgaaaggggtgactacatggagaatagagagaaaaggtgtaagatggaagtgcagag

SEQ ID NO: 120 - DNA, 1500 bp, Mus musculus
cacaataatcttctgtatgaactatgctaaattatagcataatctaatggtaggacaaagtactattatgaagaacacatgggacttcagctcccttctggccagaacttggccactcactgatcaacttagcatatacaatgttcttaacttcttcagatggcatgtcatgaagtttaaatacatgaaatattatttttctttcatattatatctttagaaaagtaaactcaatgttatttttcaatgcaagtaatatttccttttacattggatagtgaaataattgtttttgtataagaattaaatattggtctgaattaaatattggttacatagcatttaataaaacccctggtagatcatggccagagaactatattatcttagtagctacattttattcaataatattaaaggccaaatacctcacttacttccagtgtcatattaatggctgtgtaatgtttcccagaatactatggactttcgtaagtttaccgactctcaatttgtgataagagatgagcatttgctcatttcactagttcaaaaaacctaactctaccaacatttagttgtataaaataggcatactgtggaatactgaaggtcaggaatgcacgtagagcataatgagcctaacttgtccataacccagatatctgcagtcatagctgagcatgccttttacagtaagggactgggatattaattctgtaggatcctgttctgaatccttttgctcaaggatttggcactttgatgggaaaggttgataggcttgtcttgcctccaagcacttgcaggcagtctttagcatggggatctcaggataattagactggttaccgaccaagtgagaattttaattgagctatcttctctgtgaaccagctgggaagtcttggagctagctctcctattacatcatattggttacacctagccacatggctagctcagatttaaatggagagttggattccacttctcaatgatattcaataatattaaaggccaaatacctcacttactcccagtgtcatattataatggctgtgtaatgtttcccagaatgtttaccaggctctcagtttgtgataagagatgaacatttgctcatttcactaattcaaaaacctgacacaatctccaaaatctttattgcctttgaagagcaaagaaaactacttatgtagctttttcacttgatttttctaatgcatatataaataacccatggctaggataaatactatccttagccaatacatggcttcaatgattggtcacttctaagaatttagaatttatttgggtaggatgagatgagcctaaaaacttaaatgcaaatatgggtggagagctagataggtacatatagatacagccatctttgctctttgagttcatacaaccaaagatcaggcccattagaaattggtttaaatatttcatgtcaagggcactgacaaatgaatctacaactcttcagat

SEQ ID NO: 121 - DNA, 1925 bp, Mus musculus
tccctgcctatgcttcagatatttcagagtaacacattcacaaagactcctgtttttaacctcaccttctgctttcaaaccaagaaagtttcctgcttttctcgagtttcattaaattgtgactccatctgtgtgtgaccctatagtttagataccatacagaaaggcagaccagagacttagccgtgctctagtaggattgtggatttgaagtatgaagagacagagcctgagtagaaagaagcctgtaacttagagtgaaactcggtaggaaagtatgctggcggtaaatgttcacagaatactcagaatgaaaatatttgtagcaatgataagtatatatccattcagtatctctttctatgaattagagtgaaaggaaggagtgaagcaagaagaaaataggcaatagctcataaatagttgcattactatcaggaaagggaataagaaatagattgatttaactgagatcaatgctagtgttatatttaatatgtatggatgcataaattcattgattataggggagaacaaatggcaaggaaattaagaactgccattctgtgattatgatttttactatatgacgtctgttgctatgataatttttcagcaataaactaaatcaatagatctgttaatttaaaactgtattttcctttaaataatatttcattcatttatcaaaacttcataccttcatatgatgcactctgataatattcatttaatcactatcgccttccaactccacctagtgtccccattacaacttctgcttctcaacttcacgtctcttctccctgtctttcttaccaatactcactggagtccaattaatgctttccacacaacattcccaagtatgttgggtcatccattggagcaccttcaacctaccagtggctatatgctcaatggaaactagctctacctccttcatcagccataaattaaaagtagtttctcccctaagagttgaatttcaagggtgcctcccctagccatgcagaaattttgactagcttgctcagttcttgtgcaagtaaacacagtagctgtgagttactgtgaatatatatatatgccatgtcagtattcctagctctcttccccatctgctggctcttaaattctttctccactcccacctcctggcaagatgttctctgggccttggatgatggctgatagaaggagatgactcatctacagctgagcactcatagatactcatgcagtactctttcaccagttatgagtctttgaattacttttgataatcttgtataaataatgtgcaaatggaatggttattttaggggcctgggatatggataagcagaaaagagctcttacctatcacagaaaacagaattcatatctcagcacttaactcaagtgactcaaaaatgcctgaaactctggctacaagggatccattcccccttttggtctttctgtgtatgttacacacacacacacaccacacacacacaccacacacacacacaccacacatgaatactcacaccaatgcacacatgaacacacacaccaaaacaaccctaccctcaaactaatgcaaatattcatacaaattatgaaagaaaatattttaaaatttttaatgatttaaatcaattatatatttttcagactctaaaattgctgtcatttcataaattttcagaattatatttatgggataaggagtggcacattgcattggataagggtgagtgggggagttaggtaaatactgtgttcttgtagcattattttacagctttctcctggatatgtctaaatatgggagctaagaaatatgtggctgttagtacttatacacctcatgtaatattttagccaaaatgctaatcaattataccttagtctgtgataagaactatcctagatgg

SEQ ID NO: 122 - DNA, 2000 bp, Mus musculus
tgctggctaggatacttctttgactttgttcatctctccaggtctaggcagaattaattaagttattacatttctattgacttgcctaaaggcagatggcacaggttctttgctctaatttgcaacttggactatgggacctcaaaccagagtggactagggtaccttgtttacagaaggagtcacttttggaaatatggctgatcagctaggtataaaactattttgaccatatatgtgaatgtcatttttgagaaagagaatatgttgggaggataaggaagagcagaaaagtcacagaatccctcaggcaaaagtttaccttgggaattggaagaagatgtcaaaaatagcttatcaaatgcaaatgtcctcatagtccagaatacccatgtgttctgagactttgagttgtgcttgccagcaatcagagcatttatcttacaaattgtttggtaatctctagctctatggatgaaagtggattttctgaggtaagcatggttaagagaagttgatttaaaatttccttgagaaaaaaaaaatgaacatcggcttgagtttttcttgtcagtggcttttctgtaggctcctaagcagcagaatttgtattaatccccggtcaaatttaagggtgagtctatatttccctaattcaaagataaaatgaaagtttcttccttgacagagtatctatgtcaaagattcttcattgaaacctttttgaacctagagtttaccttgaactgaaggaaaaatctgggaaacattaggtaaaatatctaaggttcagtccataatatcagcaagttgtgtgggattcctcgacctaaatgaatgttcaagcctgctttggacaaactggtatgatcagaggctccctttgcttcagtgggaagatgtgatgcctccttaagcaaaggtagaaggagtgagtagccctggggagaaaggaggtgctgatatccttgtaacaggagagatgatcagagtataaaaatccccataatattttgagcaaaaattaaattgcttaccttagctcatgaggtcctagcattgccacaccttctaacagttcttcacagcctggggtatccatatccttagctgaattagcaagacaacaaatatagataccatgattcgtgaaaagcttaggattatgtcctcagcatgattgcctcctatgaattatgttcaaccaaccagaactgagttagaatgatgatttcataccatgtcatgtgactatactcaaggaagtagcataaggttccaggattggcctcctcctcttgatttctgtgaactttgagcagagggagcaatgctccttggttagaggtaaaatatcccacgggttcccaaatggaagggatttttatgagagccctttgggtcaaaggtgtacattttatgaccttgatcatcacaggaaggaaaatactataggtttggaaaagagaaagtccctcaaccctgttggacagtaggggagttgccctgttcaccttctgtagaggaggttggtccaggcactccaggcctccacatcttcagagaactctaaaaaattcttatctctgaggactacatgcagatttgacagcaatctgaggtttcttctgacaagtcagctcaaagtccctgactcttaagctttgagacttcaggcacccgggtcctgatccttggacagaggtaattaggtcagaggatcagaataagaagcacttggtgcaccttagatcaagggagtgtatttgtcatggactagatcagatctagtaggtaggtctaggtcctcaatgatcagaagaatcacataatactctccatgagatgaaaattatatagcacattcttctggctacaattgtgagctactcttaatcagaaaggggattcttgtcatgcttttaatcacaggtgcatagatgatgcttcaatgtgcatctgaggcagctaggagtgcaaattgtaagtttgatagacag

SEQ ID NO: 123 - DNA, 2625 bp, Mus musculus
aaaaaaaaaaaacaataaacaaaaacataacctgaataaagtatcccagtcccaggaagataaatatgctatgtgttgacttatatgttgatattgactgggctggatagttttttgtcaacttgccacaaagtaatgtcccctgagagtagggaacctcaattgagaaaatgtctccgtaagattggtctgtgcaggcaagactgcagggcattttcttaattaatgattgatggggaggatttctgtccattgttggtactgccatcaatgtgcttgtggttctgagttctctatgagaaagcatgaaatcatggggaacgagccactaagtagcatgctgcagacactctgggcccctatgtctgcgtggaaaggatctctagtcacaggtgggcaaagcgttggatgaaatgatagacagatacacacaggagaggttgtgtagaatctgaatgtaatgtgtcaaattgagcatcaaactttttataaagaagagaagagtgaagttgggtgacacaccagcagggtacaaagaggttactggtttcttacagaaaacagaggaatacaaacaaagaaggtctggcaggaaccacctgggataaaattctttgttaacaactgggatcaaaaagagctccaccaaagatccacttaatcttagaagccagcgtcaatggtttcgtgcccttgctatagttcctattctagtctattgtatagtccaccttccccctaggctattgtaaatatgtgtatatgggtgtaactcagctatctatagttctaagtatgtactctgcttcctccttaggtctcaaacttccttcttcctagatgatggtaaattcctgtgtagggcagtgacttagcttttattcaaagtgatagtataataccagaggcaattctgaatgtcactgaataggcaacattcttactgaattccaagacaatggtcagcacaaggactttctaggacattggaacactggcgaaagcttagctatgtcagatttcaatcttaaaaagcacttataataagataacactaaaagagagcatgtggatccatacaccagactaacacgggaatagggtatgagtatatgggttaatgagaacgccaaaactccagaaggtgagcttctgtgaaactctttgcctcatgagcgcttccaggcctctcggcctgtcaagctgacttgactggtgtgtgtggcagcagcacccatccacggtctctgtatcagctcctgcctctaggttcttggcccatttcagttcctgttctgtctgtattcaatgatgaatagcaatgaagaagtgtaaaccaaataagtccttccctccccaacttgtgcttgggttatagtttttggtgacagcaatagaaacattaagacattcaacattacataagtgatggcctgtctacaatctgtagatccagtgaagttaggtatagatgaagggacttgggtgcatacatggatgcccatggtatggtgaaatagaatggatttattagtggacaaaggtggacaagaaagagaaaatcaggtggcatggtggagggagatgtggttgaataaggaaatgcaggaagagatagttgaaagagagaggtatttaatgaatgatgacagaaagggggaggaactggagaggatgggaggtagtaaaagaaccgtggggagtaaaatttggggggactgtaagcagggtctattaaatgagaaattaattttatttttaattttactagaatattaagcatggcagaggggctcccaggaatgtacattttacctccaaaatactgggctttgatcgattcttggtgaggtgaaccacttaaaagctgttaccactctgtgggtaacaggggcaataatgataatgtgtacattttacaataagactttacatgatcctttaagtcagctttatacaacacagtattggtattggttagacagataagtggtaatcgtagccatgccagctaatctgtgtttgatcctcaagttgcacatggtagaaggaaagacaagacattatgacatgtacttttgaattccatatgtatgttatacattctgtagcaaaatattagatagatagatgttgggtgctgtgcaaaaggaacagcaaaaccattagaacttatggaatgtggcccagaagatagcccaagcatggtggatgtgcctgggagaggcagagccctgaggaatgtgtcctgaggatttcatgctgttgaggatttcatgctgttgtagagtttctctcttcttgctgccctcacatcacatccctcataatctatggattgtatgaaaatttaaggggggttccagcccctcactgggcaatatcattgccacccacagtgttagttagatttaacttcctcaaggattgcagctgatgcagaacaatacttcaaacacgatcttggaaaaaattactacgaaaaacatgtctttttttttttttttttgcaaaagtcaggctagtgttcaggtgatgattatttccttgtacccttttcccccctctgattcctgatatgatttaagaaaaacatggttaatgaacagatgtgcaccctgagga

SEQ ID NO: 124 - DNA, 2425 bp, Mus musculus
tggtcactagaaccccaaggcattaagaccagaaaacctggaggaaacaagagaccaagggaataaaaacatcaacaaaacaaatcaaaaaaccatgcatctgacaattacatatgtagaaatcagtatctaaacctataataatctcaaaattcaggtaactagaggacaatctaagaacacactcaacaacaatttgggaaaactgacagcacttagccacagatgccttactgtagaacacactggctgttccatcacaggtgaagcacaagaaaatgatcttaaatccaattttatggagaaagtagatgtctttaaagaagaactgcataagtcccttaaagaaatagatgcatgcacaatgaaacaggtgaagtaattgaataaactgtttaagacctgaaagtggaaatagaaacaataaagaatgaaaaaagtcgctaggagagagaaaatgtaatgagtgactttctgaagatagtccaaaattttggacagatgtgatggatctctgaattgcaaggccttcatacatttcatttgaggattcgatctttcctctaagtattctagagtataattttccctggcatatagcccatcctattggatgcagatcaacaaacatgtactctcttgtagtaatgctatgtaaataaattaatgatttcttattactttatataattttatagaattactaaatgtacataagtaattttgagccctttattgaaaagctgcagttgaagttctgtaagccttcttgtgtcacagactaattgcattaggataaaatgcaggcttagaacaaatttataatcagagaaactattccttctataatagatgtgaatgcactatctgataagtattttcataaactgagaatggaaaatttctaggacgctcaaagacaaaagataaaatattgactagatttatctatacaaaacttcaaaatgaatgagacactaggcagatgattgaccccttgacataaaatttatttaaaacttgtatgaacttgtggagttactagcagctaatgaatatataattaataaccaatcacaatggacttgcaggtaaacattcttcctgacattccttatttgatttattgacttgtattaatgttgtgaacttgctagtaccttttataaaatagaagcttggaataccatatgatcatgtatcctgagaaagtgtaagaattgaatacaacaggaaataggttccaccttttctctctctcctagaaataaagtcgaaagccttcttttgaagtgagtactttttcttgtgaatgtgaatttctctggctacacaaggttaaagaacttttagcactgagcagggaaggcactgtgtcctaactcaatactccactattaaaccagaggtattaataatcagaggtgggcaaatttaaccacaaaataatccagaaagttttaagcttccagaagccatcagctttcaaccatcagggcaattagaaggaaatttaaacaagtgctccatgtctggagcacttgtttgaagtttcttaagcttatcttcccacctgaccttcagtttgtcactttcctcttattccactcagaaactcattatcctctcctgagagcagccaattatgtaatgaaatcagtgtcttagaagtcaccacctccagcccgtcatctgctttcagttcctcatctatccagaaatagtgtttacctttgaacctgtccatgggatttcttcttcaggatgcactctgcattcccagagcatccttccttgactttcatttaaaattcagctacctgcttcctccattagtctgtcagtgttcatacttaagtttccaagggagttagtcaaggtagagctcccatgcaaacagtccattagtgcagactcaggatggtctctttctatggacaattcattataccatattaatcaggcctgcaaattgcttgaattgacctcagcaataaatgatacagattttaaaatttaaatttaaaataaagattttctagaattcaatgaattgcacaaaattccaagtaaatggggtacaatgaaaacagagctaagatgaaggttcatagttatgagtgtcttcataagaaattgtagagatctcatactcaccaattaacagcatgtcagaaagctctggttcaaatagaagcacagtcaccaaagataaatagacagcaggaaataatcaaactcaaaactaaaatcaattaaaaaaatcaaatagaacaagacaaagaatcaggcaacaaatatttggttctttgagaaaatcatcaggatgaacaaaccttttttcaaaactaactaaaaaaaagagagaaaaaacacacaaattaacaaaattagaaataaagagtaagacataacaacagacacc

SEQ ID NO: 125 - DNA, 1800 bp, Mus musculus
ttacatacaactatacagctatcatgctcctcaccacagccattttaatatgcttccgtggaggcaatttatgttaccagaatttttgtgtaactttgcagataaaatctacataaatgtgcaggtacttatgtaaaacatactttctcccacattcttattcaatgaatgtaccatatagtctaccttagagatcacctcatgtgggacacattgaactttctctttctcttacatgctgctgttcactgaatatgtgtctatctccctgttgaggatttctgttcagagagggtatgtatgcagtctgtttttctgtatccttgcagatctttgtaccttggactctggtgctacacataatactcagtaaacggttgttaaattaaattgctcaaactgttgccagattaatcttcctgaaattctcttttgcatatggtacccccactcacatacaaacatcattaacttctaattgcccacagcacacatttcacattcaaggacctttagagtcaagcccaacttttctttccagagtaattgctactcccaagtatccattgttttaaccaacagatctcattggagatttgttataggctactataaatgattgtgtgtgtgtgtgtgtgtgtgtgtgtgtgtgtgtgtgtgtgtgtgtgtgtgtgtgttagtgttagttggtcggtcttactctatgtcttcttttctagattgtaggtccctgaagctgagatgatatcaaatgcttatatttatccccaggacagtgcctacaactctgtaatgctcactaccttcttcatgggctcttaaatgtctttcttcaagtcctcttccctcttctcccttcccctgagcctggcttgccccaggctgaacaataattgcctagatctgacatttccttgtagcagagatagaaggcagttgatttctctaatccagttttatttttatatcattcgttcctcattcaaatcagaggaggatagacagaagcagtgatggggtcaaagcacaaaacaagcatagtttctgggagcaagttttccttccacctttaatacatttgtctaggattccatttagttaaatccccaaacactgacttttcatgtgtctcaaacaatggagactgctttgagattcacatcaaacaccagtatgctactaccatggctggccagcacttcaataaagcacagtagtacttaaatagtcccaactctaagatgggaagtgttataatagctaccacttactgagctccatatggcaagtgacattccaaagctttctactcttcatttggttcatcctcacaaccatcctcagctaagctctattgtgcatattttgtcggataaggctcaaggggataaggcgagatcaagttgccattaggaagtgatggaggtgaaatttgaactcaggctgcatggtttctagaatgcatattctaaccagaggcatattttttcctcaagttttcaaaagttttccccaagtttctctagtgtgtgtcacttgcaagcttatatttatctcctgaatcatgaacacctataacttcattgttgcctccattttgtttgctttgtctttaatttggtccagaaaatactgtgatgcttttctactgagtctcttcaacatttcttgttactagccatcactgtctttctacatgtggatgggccaaagtgatgactcatcagttaaaagcacttgctgcttgctcttgcagaagatcccagttcaattcacagaacccacatagcagctcataac

SEQ ID NO: 126 - DNA, 1600 bp, Mus musculus
atactctccagtaaagttctccacactcttagcttcttctatgggtacattgataatatatgtctccacactggcactgaacagcactccctctccactagaggcacagtaacccccatctatccacattgactcacaagtactgatagcaacccacccgcacattcaacttcagacatattgttctgaacatcttatgtgcattcacaaattgacattttcgtagttacacactttctcagtggtgtataggctaagagaacattaaccaatcccacacaacagtggtgagagtggtgagctttgcgtggtgtgattatttgtagaaaatcatgccgtaacttgttatctattttcctcagaagacggtaagggaaagatctatttccttaatgctgggccatgaataatagcacatttatgtttatgttttatgtttatgatataaaactgttgttggttatacacatggaaagggcagatctgcttcacttaggcacggcacatctacccacatatattaatactctgttaacctggaacacttcattctacagaggaatagaaggcaattctctctttgagaaacctgtacccacacttagatgtatgggtaccctgtgtaatcctctttcaattaacccctgtgcttaaagtgtatgctaaaaatacattttaatagcatccatctctgcttcattaaagagaggaagaaagggaaagaaaaggttaatgagatagttgaatgataacatacgtttctactgtgagtcggcccacacatatgtagaccccgctgaaatttcaacagctgttactaacgagtccccagaggaggtttctctgtaggcgtaggtaaagacaagctgatggaagttccttatactcgagacagattgcagatcttctaagagagtcgaaagaaacacaggcccagaaatgagccagaggaacatgaacttggatctagagatttacaaacacgagaaaagcccacagtaatctcatttgtgcatggcttcctccactggagtctttctgggcacaagtgagtgtcaaataatgtctgtaccaccacttggtatggtgcggagcacaagtggatgtgaagtaatatctatgtggtatatcttcactcaggagcatcaggcaaccccctgactccaccattaagttgaaaatgtcttggacagagtaagtcccatcatagtactttttaaaaattcctaatggcagaaggctaagcctagaagaactacttctgtgacccaattaaggagctaaaaggaaaagctaggcaggggcatgttgtcagtacagttctagtctctccctcttcctcatcttagaattctataggctccacatagagtcagagccagagaaagattaaaatatctgtgcctttgaattactttttttcatttgttcatgaaacagtcataaaaggtaacaatcttgaagcttggaatcaggggtatctttattgggtcatctagtggtcttcagtttgtaaaagacttaaagacccagaagtgatttaaggaaaccacttgccaacataaactttctcatagacatcttgctcaacactgggctg

SEQ ID NO: 127 - DNA, 1725 bp, Mus musculus
tttctgcattaaatattttataaatatttttataaaaaatttataagtattcaaacctgattttactaagtacaatgaactgaaaatattcacaacatcttgaaattgattgtacaaaataaaattaagtagaatctttaatagttccaccaaacctaccttgtacttttaaagatactttaaatgtgcattctaagtaaatataatgaatatatatttgaaaacaccaaaatgattctaaataaatttcatatatctctatctatctatctatctatctatctatctatctatctatctatctatctatctgtctatctatgtcttgatttgacatagttttatatgacaaactaaatcatgaagtttttaaaataacatgattaggttaagtttaaataagcatttgatattattgacaacacattatcagacacctaattgatatgtagcataaactcctagcaccacatttcttcttggtcttttgaaatatttaccgctattttaggacgagtcaccaataaacagaactaaacaatggctttgaatacattcataaatctgctcttgcttatatttcatttcacagtcctactctaaggattatctgagaattccagaaggacaagcatcctaaatccaggcattgttagctttatgagcatgttaaacaccaattacatcatgcaaaatctttattgcaaatgagccttagccactaaaatatttagcttcccgttcatgctgtgatcaagtaatgtgagcatcatacaggctgacgatgtatggaaagattgcatgttgactgtcagcaggaaaagccttgatcaaaccaatgcacgtaacattcctcataaatctcaaacaattctgggagtactggatacttggtgtgcttgctctttttcactgcaaatacatgtttgtttacttttgtggttattgttctgttttctaaattaaatcctgagttaaagttcagtgatgcttggtctctggggagttgtggagctacttaatttctggactcacttttaaaacactgctatctaatggcactgtcctaccctaacatcattcacatccctcctgttccaatactgtctgacattttattttggtgtttcaaaatatatattcattatatttactttgaatgcacatttaaagtatctttaaaggtacaaggtatgtacagtcagtttcaagaagttgtgaatatttttagttcattgtacatagtaaaatcaggtttgaatattgttccttgaagattaattctaatcagctttaaatactgtaattttctgttccttatttatcattaattttgagaagctttaaatattgtaatgctctgtgatcattggtaatgagttggagtggcagaaagccaaacttgcagtcctttttcctagctcgcacatcgctatttcctcaccttaagaatctatctcgattcagttctcaaccaatttcttattcttgtttatcttctgcttgcaaaagcaaccacagaaacactatttttaaaatgaaaagttaaaaaaaaatccaagcagtcaagcatgtgactaatcctgagcaacacatcttaatttaaactttgactcaactctctgaggaagttactaatactcagacttccccattctttgaggaactgccttggattccacaattgacctacagagttctggagtcagttttaaagggagagat

SEQ ID NO: 128 - DNA, 1700 bp, Mus musculus
agggtcttctgaaagccaaactggcttcagacaatgatggtagaatctcctaggaaaaaaatgctacttgccttacttatggtagatcattacttcccaaaaccaaacaaatcctggtattcttccatgtgtgttcctcaagacagttgttcatcagataaaatatgaagaactccttggacagagttccagctgcgccagttctatggcaactcagtctaaagataagccctgactctctgactccttctaacttgctttcagagaatttcctgatgcctggggtgcttcatttgcacatgcactttgtaactaaaagagtagtcctcagagaggagtcagagcaatcattttaattagcagcaacttgaagtctgttcttccccaggccccagtaaagcacatgaaccaagagtgaaatgtgtaaaattttgccccaaaggctcctcaactggcagctgatcaaaacgtgcacaggctataatataggacaactgtttcatacttgagtggatttttctgctgttaattacaccctactaagaggcaaaggaggtccaatagccagtagaattatttctaaattcttatcaacagcactgtgtggtctaccctgaaaccacagtcaacagaaaagaaaaaagtccatgtgatttcagaagacaaacttttttttttaagtaatttacagtgaggaatctggctcttcaaaactagctataatactccttgctacagaattgaaaaaaaaaaatccttaaatctgtaactttaaaaaaaaaaatgtacaggagcaatacaagcattgaaaccatgaagctcaggccagcaagataaaaatgacacactttcctccccatctgtacacctttgagatcggattttcagtttagatgaagttatcttcattttgatttgattcttttgtcttctcaggatgatggctttctactttgttttcctttcattttcttcggagggggtcttaaaccaatcaaaccacggaaacaaaatgccctgtggagggtcggtactttcttgttttccttttaaaaggcttagacagctggaccttggctggagaaggaccagaaagagctggcttaagacttaagacagtaaaggcaaaacagtaacaactgcgctctttcatgcagaataaggtttctaaatgagctcagcagcattattcttttgtttcccagaaacaaggtgtctgctgctattctctcagcaactagtattattttaaagatgctctttatacttgcaagtcagatggtacttttaaaatcttctcctcttgttaaatgccacgatcgaaaacattatataaattcagagcatgtacaatactatgcacaatttgattgaataaaaatagatctgagagttatatagttagtgtctacacaattccataacaacccatgaaatatgaaacattcaggcagttaagcaagctgtcccagctccattaaaccaagaatgtagcatacagataaatcatttaaatgcttcattacactgtttttgcatttgctctggtaacttttcttcttggcagtaatgccctgaaaccactgattctttcaaaatgttgcatgtatttctgagtaacagcaatctctttaaattgactttcctacagctacaggttgattggcatagactttgactatgccacatgtttcaattaa

SEQ ID NO: 129 - DNA, 1725 bp, Mus musculus
gtatttggggtgagtacatatggggaaaatttctggctcaactcaatactactgataatttagattttctataagacacagtgtttcctattaaatatccctttattcttttgtcagttctgagaataaatgtcaaaattaaagaaaaaaacataaaaatgtgtcttttgaaatcaacacaggagataacaagtgttttcaggacacttgaaagacataactgacattttgatatatgaataggagcataataaattcatggtggaatataagacaacatttataacataatgattccttgtaattaatttcatggaagatgcatgttcacatgaagtctagacaagcttccaggcttacttcatacatttgtatttcacaagtcatgcaaatcatacaaatggcttctaacacagtctctaattattatatgactgcctaaactatctttactatcacaataaccagtattaaaaaaaatccaagtcatctcatgaaaaatattactgggaagggttttttctttaatttttaaatgtattcctctttcatataatacatactgactacagtttctcttccctcctctcctcccaacctctcttctcctagatccactcctctgtttcccttcagaaaaggccaggtttcccagggatatcaacataacttggaatatcaagttgcgctaagactagtcacctcccctcatattaaaattagatgaagcaactcactaagaggaaaagggtcctggaagtaggcaagacttagtacaggggaacgccagggccaagaagtgggagtgggtgggtgggggagtgtgtgggtgagtgggtgggggacttttaggatagcattggaaatgtaaatgaaataaatacctaattaaaaaaaagaaagtaggcaagaattatttaaactcaaactatcatttccagtcataccctgttcaaatattttaataatcttgatattcacaggatgttttgttttgtggatattttcaaatacaaggcttactaaaagcaggaagatttcaaatgcaaaactcttttccattcttgagatcacagttttaaaaaactttgtgcaaaggcaaagaacacttcactgcatatgcctactaatatattcagagcatgaagtccaaactgttttgcagcactctagcatatccatatcagtcatcaatatcaacagaactgcacacctttacagagataaattactaaaaaagtatcaggaacttgaaagtgtcttaattgtatttggtttgttgtagcaagaatttataagttcttggttgtattacatttaatgatttcaagaacaaaatttcatttcagtaatctagaaaacaaaaaagattcttagtaagagaaaaactgtagggactaaacacaagtattaaagtagttacatttcaaagtataatatgatttcttggggatgtgatgacaggtcttaaattctaaccatcctcctaacccaaattcagctaaaaacattccacaggcctatcataataaaataaggtgttacaattaatgacaaaaccattgcatacttgcagtgattagcaaaaaatgtatttcagtttcagcaagtctgccctaagtagatatgtgccactatttatacacacacttatatttatacagctgatcaattattatgcaccacaacatttatttgctcaaaattttcatgccgtgtttaaca

SEQ ID NO: 130 - DNA, 1550 bp, Mus musculus
atatgcactgatggaaatgcttcccaaattcatatctccatatgaagaagtgtataaacttaaatgagaaatgagactccacatttaaataattcactaatgcatgcactgctgcatataaaggggaatttctaaaaaaaaaaatatcaaaatgttaaatctagaccaaacatatcccagcacctgggaagccgaggcaagaggattgccacaagttccaggccaccttgggctacactgttagttccaagaaagcctgaattaaaaatgagaccctatctcaagaaaataaaaaacaaaaatccaaatgctaaaaaaattaattatcaaaaaaatgaaaaaaacaaaaaggaaagattttaagattgaaagcaaagtggatgctcatacagagagcttaaatgcagactaccttcccacttgcctctgtaaggagccaattcaaagccacggactctgcctgagttacagctccagttctaaatgtcttgattttgcattatttttttaatttgaaatatgtggtcctgacacaattatcagctggtgagcgacctttgacattttatcttctcctctgtcaagaaatttgatgttgccaaaaataaaactttaagatctaaagttatctgattctgaataaaaaatctttttgaatcagaaaacaactaaatatctcaaatcttgctggtgttgtactaaagagttatataaaagatcttcctcctatttcagatctatgcaagtggactgctttgttcattttaaatgactcatgttattatttgacatcaatttgttatactagagtatcatactctcacactaactgccaaaaataaaatttcatattagcacacttttgaacagccaaacattaaaatcctattaaaataaaggagatcaccaccaatgctgtgaaaatggaagaaaagggtgaaaatgttaacagataagaaaatattccccagctcacttctttacaaatttcctacaagcttatatctcagctacagctcaatgttctattataaagtaaacggaaatgtaaatcaccctgcaagaggagctgctgtcgttttcaacaatgcaactgtggctgagagtctctcatagattcctagccagtgtggagaaacaggttgggggaaaatgcatacttagagggatttttccacctctgtactgaaggtttgtagtgtaagaatattacaccttcaaaacagaaaatgccatgtaaagtctggttcttcttagatgtagactatctggaacacaatgcatttaattcacaatcagtcaaccttctattcttcatttatatgagatgtccctgcaatttctctcaatggaaaccttaaaaaaaaaaaaaccacctcagggagcatactagctgtatccctgatttaagtaactccaagacccttgcataaacaacaaaatcagaaccctgacaggggtgcttaaggagtccctaaggcattaatataagactaagcagtgataaaaataatgcctccctggggaagaaattttatttctgaatattt

SEQ ID NO: 131 - DNA, 1800 bp, Mus musculus
ccttgggggaggggagccctaccacttcctgctgaactactgggtactagaaaaggaagagttttcagttgtgtactctctaatgagtccattggaaacttctaaacccatgatcacacaaacaaccttggttgaattcaataggtcacaaaacaaaacaaaaatacacgaatgtggaaaagagatgggggtgagagaagattgataggggtagtaaggaaataagagtaattaggatgcattatatacatatgtgaatggtcaaagaacaaatttaattaataaaaataatacttaagtcacagtatatctaacaacccagtagttcaaaatttttcattgaaaaaataaatcttcaaaacatcaaaggttcatctctattggttaaagtgaaagtcaaggtttttcgtgtcggcggtagctgttgtggagtcacattactcagaactcgttcagaagacactcctctggatcgtttccttgtccattgttttacagcactgtctattcatgcatgctgcaaggtggtgttttctaaaaaacctagaatttctcatagtttccttttggttattctcaagcaccaagggcattcataaaatatttatacttatcttttcttgtagattctttacatgtttttagaatagggaccaagtctaccatatatttctcacttgcactaaagcttagaaaatggtctgcacgtcagagacatctgttaatttgagacaatctctgttaaaaaagaaagatgatcattagcatcatgtcatttttgaaaggaagagggtctgaagaaatgtctcagagattaagaatgcttacttcttttgcttaaaacctggctttcatttccagcacctatatcaggatcacaaatagcggtaaattcagttctggctgatccgataccctcttttgacttctatggtgttcataaactcatgtaggtacacataaatatatacatggacacatagatacaaacacccctccccacacacacaaagagtaaataaataaatgaatgaatctttaagggaaaaacagaaggtggatagatgagctcccctgacattatggcataaacttgatccatctctcctctcacacaaggaccagctcagttgacaaattcttttctggagacaggatcgacattaacttatttaatcaacttctaaggcttagatttctaaccctgagccagtctctcttaatctgtactttcagcacagactgccgattttcacagctgccatctaccaggtgctgttaacatggatgtttctgaggctgttcacactctaaatttccccaaagctaaatttctcacttagccctgaaaatatcagctctgtattggtctctgtattggacccaggctctctattggtcctgggtcaagagaatagtgatcttttcaatgaacaataatggataaatgaagaaagaccggcaaagtctttcatttgtgtcatacaagttgcaaaacagttctgtagcattttccaggtgtggcagtatgaataataatggcccccataggcatatatatgattagtcatcagggagtgacactacttgaaaaggattaggaggtgtggccttgttaaagcagatttggcctgttggagaaagtgtgtcactgagtgctagggtttctctctcccctctctcctcttctctcctcctctctcctcctctctcctctctcctctctcctcctctctctccctctctcctcctctctccttctctctcctctctctctctctctctctctctctctctctc

SEQ ID NO: 132 - DNA, 2150 bp, Mus musculus
taggaagctgtgtaatttttgggaagccactttaccccttttgaactttagtttttatctgtagagataatgctacccccttcattgtatggggtgactcttaagtgagacggacatagagctaactgtgtgcttgacaattggtgtgcttcctgtggtcatttgtattattactgttgtaactatcaacgtcacacaagaacttttcataggcgtctttgtgttgcatgcatcgtatacctaatgtgccacaggttgcagcccagcagaggtgtttgcagaagtgaattaaggttttcttgttgatgatggtgagtgattacaagcaaagactctgaggaagagtccaatctttggaactattgtcctgtgtgctttaatttcaggcttaaaaatgtgaagtcaaaaaaatcttttaaaataaaaactccatgagtaaatgcatctcactacttaaattgagatatttcaggaaaataaggaagatgatctttacagctactttgctaaaaatagacttctgctgtaaaactgctctcatatatgcaattgtgaggccccattataattctggtgattgtgttgtcattgtgccattatgaatttatgcataacaggtaatgtacacacacacacacacacacacacacacagagactttacttctctgagaacaaagtatgtgggataatttgctatgctgcagtgagttgggttttttgtttgtttgtttgtttgattttggacatggatcatgtagctgtgttatttgggaaggtcaatggtgttgctacttctgttgtgaatgttttttttaaaataatatattagagaagtgatttcaatgataatataccaacatgaaattgatggcttatttgtaaaatatttccccaccaattattgttgcaatgaaagatgagaatgctccttattctccttctcaaatgaaatccaccttttctgagcctacactgaacctgtaatacttatggcaggggttaccatagtaacctgcattgatgtcaccagctcaggcttctgacttcattgcataatgcggtagaaagtgcatttgcagcagaaacaccctgcaaaggaacaagtatcttgattcacagcaaagaggacaaagaaaagctgcaagctctaagggttgaatgctggattgtgagtcagatcgcctgagttcttattttaaccgtgcctctcacttgttgccttgctttgagtaatgtttacatgtgtgcactaggatttgaagaaaaattatctcctgtctgggatggacagggcagggaaatactcagagtaccacaatgtcttgtttattagaaatctaaataaagctaaaatgccctaaaatttgagaaagaaaaataattactaatgttctatagcacgtaggtaaataactagctcagaaagagatagtgaagtaagagccaccttgctaggctttctttgtttaccttgctaaaacagcagcagcaaccacaacaacaaaaagatgaacacttcagtgtttatttcagtgaaagaaagcagaaaactcatatatgagtttcgctgtatgtaactgtgttcatctgaaggttgttctgtggcattcaatgtgaagtcaaacattaatgtgtctattaatttgtgagacatttccaatgtttatatggtgcccattataagaattagttctcaagcttagtatggcaatgttgatcctcattagaaaatgagggaatggttctgctaatttaaaaaagtcttaaaagtaattgtgtaccacttcaaagaaaaagtgaacttctccatttgtttgtctaacctattcatttcatccatctcatactttttattatacactgaattacagaattgagataagaatatttttatttgaaaagcattaaaataatcagtttgctcgtcagagactatggtgaaataagacacagcctttattttttaatgtaaagtaatatgggtaaacatcttaataaagggagctatccataccccatccagatactcaatcctttcaaattatctgcaaaattttactgtgccatgaaacttcattatttctaatctgtgttgattattccccaagaatacatcatttttcaagtcttgagaaatttttagttaat

SEQ ID NO: 133 - DNA, 1850 bp, Mus musculus
attttaacgaagaaaggtaattacgttttctgagagcttttgagttgtcatctcaaaaagaagagttacctcttatagtatagattcagctgtgatttttacagagtcatagtcacagaatgatctgcaatttctgcatctaatttattattttattattaaatacaatatgctatattatgccagaatgcagttaattatgtcttttactcaattgattttaatcactgctaggttgcttccattttccttcttcttagaaggaacatcagtgacttaagatgcactgtgttgttgctgagtattaatactgattccataatttagttatagctcatgattgcttgtttatttgtgtcacacatagtaagtaaggagggaattgccagggtggatattattgcagctggatcttcagtgccgcctttatttgtacatattttgccgggaaaggtgtggtagaataatacaaaacatatgctcctaagtatctgttacttatttaggaaaaaaaaagactgagtttcaacatgacatgatgctttaagagaaggcatctgcttctctaaatagcaggcttctgttgtttgcagaagttcactgtgattgtgcacgtcctactctggacagcttgcaggaagcctgaggcacaaatgcccactgctgcatcactcctgttgaaaatggtttctaagcatgacttacgtgcagatcggaaaaatattagtaaagtaaagacagaatgaggtctcaactctcatcttagaggctctgtctcattcagtcattggaaaagtccagtctaccctcctcattgcacagcggtcatagatgactcggaagcttgatgtccattgaacatcacttgacagtgtccattgtataccaccactctatcctaacccagtgctctgctgaccacaagtgctcttcattaatgttgtccttattactcaagccaacaaccatttactgagaagccacggtgtgctcgcagcattctcctgtgcaccagagaagcaataatgagaaatagctttgcttctgtcaacatgtggttcacacctggacttttgctgacctcctttctgcacaaaagcttgatcagcaaagaaagggaggtttcagtagacatgcttaaagaaacatattttgagatgttttgatgattttttccaagaagtgaaaatgagctaattctttaatttgtattatgattaaattcaaatttatatttccattaaatttataccacacacagacatgaatgagattcagattgatgagtaaatatattcattaatgcttaataagtgaatgatggttatacatctctatatctgcctttggattggctattctttaattctgctttcaattgggaatatctctctgagactatttgtaagagaaaatgtaacagcttacacatattttctatactacagagtttaattaaatagcttttctgctgaaggacgtctttcttatgttttatgtaaatatttgaaggaagcatgataaagcatgcccactttaatatgcattagatggctttacttatctctttatatacttttaaagatatactagcagcattaatattctttcacagctggatctatggatcagtggtagagtgcttgcttgccttgcatacacgatatcctggtttttctagtacttctgtctccccagcaaacagacacaaacaataattgtaagctgtattacagcactgatagtgttggtaatctgttctttttgtattgtaattctttgtttatagaatttacactactgtcttttcattctgttagatattattaagagacttcctgagttataac

SEQ ID NO: 134 - DNA, 1500 bp, Mus musculus
cccaaacccgacaaaaccagtctcacttggaaactcagctttctcatctataaaatggggataataatacctgtcctgacctttccacatagtttttatgaagatcaagtgaagtcatttatgtgcactgtcaactgtagagcatggtgcagcaacctggggtgtaatcatcataaattatggtagcccagtgccagagtttcagcttttatggcttttaaactcttagaactctcttctcagcaagtataggctgttcagcaaggagtgtgtgtgtgtgtgtgtgtgtgtgagagagagagagagagagagagagagagagagagagttcttccactagtcatccattttcaccacaattgattctgaccatgagtttatgatagaaatcatctttgatcaatttttagcttagctatgcacatctttcaaaaattatacttatgtaagagtcactgttaatacctctagtatcctaactacaggaaaaatacttgtgaatcttgttattttaaagaaatttcctggttcagcattttctcagtgcagagaattacatgtgcctttggatgcagtcttatcaatgacctagagagggactattgtgtctgtatgaagtaagcctgagaaagctgctttggaagaggtcctggcatatcacccttctcatcccttaggaacttacaactcatctgaacagaaccacttgccttgtgtttgtcttcttgtctctagttcaaacttaattttctcttattattattgtctactgggaggagactcggagccagtctgtgttaaggcttgccatttctttttctagttttgattgactggtacccttcagtgtctaactacattacaattgcaaactgtactccaggtctgtttttctctctcactggttcccttatatctgaatttccttgctcgtgagatgtcattttgtgtctggaccgcccagacgggaagaggcaggtttcgctgctgtttggtcattggcatgtgtgttgctgacagctcttctctttgtgttcatgaatgtgaatctcaaaaataaatcaataaatcaatccctctgctcctctgtccctcttccacacccctcccacgccttgctggtaacaactaagccccacatgcatattcaaaaatcagaagcttttggttttcatcaaatatctctaggagctgctttatatatgttcttaaatactagacgtatgaccagtccgctacccaaatctaagacaacccctttgttcaacattgatgtattagtatgtatttcttggatcctcaaatagggtttacatgctatagttccatgtagagaaagtgtgttggctcccactaatgtttgtcaactgccttttactgtttctgcccgagtgtgtttctgtgtgttttgacagagtaggtcatgctgagtgtgagtcggcactgtttccatttcctagacttgttcttcattgaggggaggacagggaattgctgaag

SEQ ID NO: 135 - DNA, 1825 bp, Mus musculus
agaagcaagagcgcgagaaaacaaaaccccgtccctattaaggagaattatccttcgcctaggacgtgtcactccctgattggctgcagcccatcggccgagttgacgtcacggggaaggaagagcacatggagtggagaaccaccctcggcacatgcgcagattatttgtttaccacttagaacacagctgtcagcgccatcttgtaacggcgaatgtgggcgcggctcccaacaggatacaagaaaagcaggctaaatatgagctaaagagtgggttagggagcagcatggtttctggttcaagcccctgtcttgaattactgctctgacttccctcaataatggtctgtcatgtggatgtgtaaactgaaattaacactttcttcactggtgggctattagtctaaaggttttaccacagcagcagaataaaaggggcagactgaggggttaatggtaacaacatacctgagatgagcaatagactacaggagagaaggcagacatttagcagaccaccatctcatataaagagtcctggcagagtagccaagcctgcccagaataatctccatatagaaattatgtaattttcctaaaatagaatatctccacaagtaatatttctaaatgtcactacaggaaactcgctgcctttattttagtctgggatctcagaaagaatatgcccttctgttctgtaagagtagatttcacatattaactttattggaataaaaaccacctaagacacaaatgaaggtgtgcctggagggtatttacaaaccagattaatttaacaggaagacctgccttgaaggaggccagaaatacacctacaggctggagtcctatgtgtaataaaaataaaataggtatagctacagctagatagctggactcctcttatctaatctgcctacatacaagaaacctccccaaccatagctactagctgctcataccaccataagcccatctgcctccatacatcccatcctgtgctgtggtgcaccccatccctgcaaattatgaacccaaataagtccttcctctcttaagttgctatggtaacaatgatcagaacactattggcatcccttgaaggtatatttctatgaacattcaataaaaatatacatcctgaaccaaaattctaaatacatgcgtaggtggcaatgccactggtgtgcaaggtatgatctctctgttacagttagatttttgtaagatttttcgtccttccataatcatggctcctcaaggggcattatttattaaatttctatgtaattcgggaaatacaatttgactgtattggctagttgattgcagagtcaggctctcagagcttttctttgtcacccacattgtcactcaggggtagataatcagcccaaggagctgaatacataaagatggcttgaggtgatccatgggcttggcagcatgcctgctctactatgctcccaactcttggttagtgcagtgtaagggcctgaggcaaatagaactcgtatttcgattttcaggtaattgatagtacctttcagaatctgcactgtggcaggcctctgttacatgattaaaactgacatgaatcgagaaactggatcttaggcatcctacggaggtagaggcaggcttaggtatgcctcttgacacagcttttcatcaaccttattctgatcccctactttttcatgatttccaatataagccaaggagaagcatcgtcttgctttgtgtgtatgtggtacatcatatgacggcgaagtttaagtgcaaaaatggtcagaagaaaaatgcacttgatttgtcaa

SEQ ID NO: 136 - DNA, 1975 bp, Mus musculus
gggagcaaagccccactttattgtggatttggtctaaagatgcttgtatgatgttaatctggtcccccaaaattgtgcaagaatctgtacacctgcatgtaagaaactgagggaaccctgcccagagttggttttaattggtaaataaagttgccagcaaccaatggctgggtagggagacagaggcaggactttaggattcttgggcaaagggactgaggagagggagtggggacagccgctatgcctggagaggagagagacatcacccctgagaggtgcaggggacagagagacagctggcatttaagagccagggaagagcaggcccaagccctgctccccctcccctcgactgggtctaaggcaacaaagatggaatatagattttattaagtaataagtaagaaatagggggaggagggtgtgttagccacatggaggtttggaagtggcccaaccattgagctattaaaggcatatcaaaatataaaggctgcatgtgtgtttaactgcagatggcgggaggatgcatggcttcctatcgctaatgctgttcactgacttctgctttgtatgtgactttcctattatgtaagtctcatctggccaggatcgaaatactctcttccaaagtctaagagttggcaggtatgtctgactcagagctcaggtgctccaggggtgccacgtggctcctggggcagggttttgtcagtgcattatagaaaaatgtatgatgtggaacccaccatggagggagctcactggaggctgccctgatgcaggtgttccattgtgcaaggccacaaggctccgggtctactcagtgaacagggccaggatttgatgctaaattaaccagaaataaactaaacaaacagcacctggctgaatcgctggttcagtaaactccctttaactgttaagtggaattgtgtgtgtggggggtgtacagtcatgatcttactctttaatcatctcttcagtgtctgtcagagagctaagacgaattattgccatgctttggtgatacttaagagacactgtaacgcagtagaggacaaggtcccaatcttagttgggtggccttgggtgagttacctaacctttctcccctatcagtaacgaagctgatgacgatccccgccatttatgatttctgtgcggactgagtgattcagatgccagggtggtacgtgctaagtgttgtagaagtgctttagatggccagccaaagtgaatctggcacattccattcatctccgaactcgatgcggctgaaatcagtactggtcccccccttttcgttgctatggttactaatgcattaattgcacggcttgacaggttcgctaagacagtagcatacgtgtgaacgccgggcgtttttctggttcccttcctgttgctgtgataagataaagcaacttagggaaggaaagagtgaagttggccagtactttccaggtcatagcccctcattaaaccgagaagtcagagcaggaactgaagcaggagcttgaagcagaatctgatagagcttgctagctagcttaaaggctcacaaatagctactttcctgtacagcccaggacagcctgggcaggaaatggtgctatctatttgcagacaaatatggtctgggcaactactccaccgagatacccttcttagatgagtctaggccaacagttctcaacttatgggtctcgctcaccggaaaacacagatttctgacgggcttaggagccctcaaccatatgcttatttttcgttgctacttcataactgtaattttgttactgaatggtatctcagttcctcagatcgctgggaatatgtgttttctgatggccacaacccacaggttgagaaccactgctctagcctatgttgacttaaaagttaaagctaactaggacaggccttgataccaccttcttttgtacaatctggcactgcatttgagagc

SEQ ID NO: 137 - DNA, 1700 bp, Mus musculus
gggggggggaggttggggttttgatttttggactcctggtgtgaactgtgtttcctggcctcgtagcttccacaagcagctggtgcgaatgttacccccagccaactttatcatgagagataatatatataatttttatatataattaatggccatattttccatggacacttccttctgctctgaatactcaaatcactatctaccttgcattcctcttgccaaccattcccccaccatcatctacctccatcattgagtcagaagcagatagcattgcttcatctctgttgtatcttctagaaaggaaaaagaaaccaagaaaatgtttggtggaggcgcagtatggtgtggggaaagggggtcctctgtgggcccatgctgaggaacccctttcccctgaggtaccagccatacgacggataatatagaaatagagtttatttagggcatggggagaggtgttaagagggtagtggagacagagaaagggagggggagagagagaaaaagagagagagagagagaccatgagcatgtgcagagagaggaggagggggcaaagtggagagaggtaactgtggggcggagcctagaaggaacaccaacattctccatcatcatatgaataagaaaaaaaaaatagtttacctatataaaaaactgacccacgacagaaagtcttgtcactttctaagttcacgcccaaggagagttacagggtatgaatgaaggcatataaccaccgaaagcagaatgcgaccagaaacaattcatttttatctatattgaacatggcgaggctgacagacttcccatttcttatgctgcttctaagtacatttgaaaagctaaaactgccttgcgtttctctttgagcgttatgacaggatgagattactagaggcacctgcagtgtactgcgctgacacaaacctgagcattgtgaatgttctccggaggtggtttctggttacttggactaaacagttttctgtcggcattctgcagtgctgccgcaagctctgagcgcttccaaagtccgtatcatcaacagaataattaccacgtccccgccttccattcgtgtgtttgactctgtgctcactgccccttgtaaaggatatcgtagaaattccagtcacagaatcaaaacacttaagtcaaaatagagcctatttatcaatcaaaagcagactaagtttttctacttgattaatctgtcagtgttttattgcattaaggtaaatgctcttcatagtgggtgcttgatgaaaatgtcattttgcaacatctactgtaaaacaccaaaacacatgttgagcatatttaaaagtctaatttgtttaaaaaattatactggagagaactatatagaggggacatttattctgggtagtaaggggtacaattaagtaattctaaaaatgaaaatttatgcatgtattgtttgtaacttcttatgcatgctttgagaatcactcaatttcagaaaaataagaatatgacacagtttctaacatattcacaagcatgtgtttaaaattattaaatgagcagatgaacactatttataatctattgtaaagaatgtaaactatatagtatgattccttcttacaaaacaattgtaaacttaaatatgaaaataaaaagaaatactaataacttggcacatagtctactgatttaagataatc

SEQ ID NO: 138 - DNA, 1550 bp, Mus musculus
gagtagttaaattatatctaaagctctctagtagactctcagctcctttaagaaaatgacaatagacttggggatatagtccaatgggaaaatatgtgcttagcatgtttaaggctctggagaatgagtgggtgggtaaatatagatgtatgtatgtatagatgtatgtatatataaatggatgtataggttaatgggtgaatagatagatttatagatgatggatttatagatggatggatatatagatgaataaatggatgtataaatagatatatgtatgtacgtatggatggatgtatagatgtatagaggaatggatgtatagatggatggatgtatagatggttggatggatggatggatggatggatggatggatggatggatggatggatagatgggagaattgacaaatagataaataggccaagcaccctttcataccactgttaactcttctgaggtcagggatagcaacttagtgtttctctacaattcctttcttggtgggtggggacactgaagttgtcaatgaaggcagtgatccacaaagaggcaagaataaaacctctgttcagatcgacatcaccgtcctgtatcagacttgaggagcctggtaccaggtggttcattgtcagcatgtttaaaacagtacaatttgggaaaaagtttccaggcaacaatcattcctattccaggtttccaggcaacaatcattccgattccaggtgcagaataaagcttaaggtgtgagcatttagaaactgctttatgaaatacatgtgaccacgagggtaggttccatagctaaaaagcctagattctagtgtggtctctgactcaggacagagattcaacaggccacagggtacatgggacattcccccactaaggagggcttctattacctgtgaggtagggagggagagtctggaataaacgttgtgggggatttaagtgaggtctatctctatagcaaaagggtgagatctgctgttgctgctgctgctgctgctgctgctgctgctgctgcagatagcaaaaaggtcaccgggccgtcaacaatattcactcccagccttctagacagtgaaaacaggtattttatctcctccattgaggagaggtccctgcatgcatagcgctcttgatttctctagcaatctctgggcaaacaagacctttgtgcccccaaaactttcacatctcaaaccttttatttacttgcttatgtccttagcaagaaaccctcggggctcctgatgccaggcatgtgatagggctgagggtatagtcaggagcaatgctgtcctgtcctatgccgtttacggggcttcacacagggtcagtgttgagtcgatgttgtcggaatgtttctgcaaaagcaggcaactgcaggggtgggtgtcagtctttgaggaatccacagctccaaacacattgacttggcatacgcacaataacacgcttaccaattcacgggttgacattctcaacagagactaaaaaggaaaaaaaaatgcagtaccctgccacaaaaaaataca

SEQ ID NO: 139 - DNA, 1925 bp, Mus musculus
ctgatggggccatgagtgttgcttacattgatacatttgaacagaatacaacagaacatatcaacaacccctaaaggctcagatgaaacaacgcatctataagcattcaaagaaaatatatgcaaccccatatgctaataacttaaggtgccttgggcaagtagattcagaattatcagccttaaagattcacaagaatttaaacccaagaccctactgtgctcacaagtaagtaattattcctccctcccctttgccttttgcttcatataagaccgtgagaggcaggaggcacctaataataggaattataggctctcttcattcaccctacctccaccttcagatgcgtgtgagacttaaggctttggttggcagttaaatacaagaacaatttttgttactcttgacagtacaacatgcttttttgagcttatgggggaaaaaaggtttttcttggaaatcttagctatagcaaatggtgaacaaattaaactgtgggtgggggccagtgaagaagaccatagaaacagaaactcctgtgtgcagctctcaacaactttaaatagctaaattcccaacagttattttatttaatccttggtttctggggatttttttttatttaaataacttacattgtttcttgagacagtttaaggccagctaagtgtataatgtgtcactttgctcccaatgttgtcattgaaatgtctgggggcattcctagcattgaaaggagaattctgtcagcagcgtcaggtagaagcatttccaagttctatagagaacagacaaagccaggatgtttcctgtgccaattagcagttttgctgagcaagaaggaagtgtgtctaaagatgtctgaataagaacccagcaagctcgggatttaaatgagaacagcgcagcaagcatccttgggcttttggcacccatgcggactacagtaaagagttcccaagaaggtcatccaatcccactgaatcctggggattatgtgggagggaagtagccttatggcttatttgcttcagcacatgtccacgggaggacatttgccagtgcccggcaccatgcagcttataaatattttccagtgattttatgaatacagcttttcaaacgccagacaattggtgcgaaagaatacgtttcagtgaaacctatgaattgtctgacaattcaatgaagctgcgagtgtgtacttggaagtaacagatgtgctcacgatctgtatttggtttatgttctggggacaagtttttgttttttagctgaggaatatttacctgatgatttgcctgtaacagtggctccatttagggatctgagtctcctcccaggcttttagtgaaagttaagcttcgagaaaatagactgcattatagtatagtcgccatttcagaggttaaactgttacatttattttactataatcctcagttcttataggtccctattcattctgaaatataataatgttttgctttagttttttattttcaatctgttatcttcctatgtgcaagttcattttgctttctccctttttaattcttaaactcacctgcaggtttagttttcctcttctatgaaagaggcttaacatatctcttcagattacagttaacaatacatatgtgcatgcatataaatatatacatatatacatacatatacatacatacatacatacatacatattatgactgatgaacaaatagaaaacatcaacaaattggtaagcactcagtaagtcaagcaatgtagagtaacaagcatattgaaatgaactagcaattcttgagaagggggagaaatgctagagacaaatagacaactaaaaaaaatcacaggtttagaagtatgttccctgtactcgctggttttgtatgtcaacttgacacaagctggagttatca

SEQ ID NO: 140 - DNA, 1575 bp, Mus musculus
ggcatacagcaaggaactgaagtaagagctgtgagctatatcctgggccttaggcaccagaggaagggggtggggagctagagagacagagacagagagagagagacagagagagagaaagagagagctctcaatactgggccatttaaggactcttgaaacctcaaagcccatcccacaaggccacatctcctattcttgtaggcctttcaaacattcccactccctggtgaccaaacattcaaatacttgagcccaagggggccattctcattcaaaccactatgttatatatctttctaccacgtaatctaatagtcatcaaggtgtctccatcaggttgaaacaaacacaaacaaacaaacaaaaaaagcaagatctacagatctggaaatgttttaactgagacaaaatcaccaagcagacctttacaaatagtctgaaacacaagagtgctttcaagatgatgtagtgttcattaaatacactgattgcaaaggcaatgctgattcttggcacagaataatggaattgaacttggtgtcagagaaatgtttaggatggggtgggaaatagaaaagggatttatccagttcatctcccatcatcatggtcagccctaagcctgacaggaaggactgggacctgcagcaggtgtggcagtgaaacttagctgccaggaatggcgaatgtaatctctgccagatcttcttgctgctttgcctagaaattgtggcaaggggcttgaaaacagtgtttccatatgccactgttactggaatggttccttagatagactctcttgtcatttctcatatgtaggaactcattagacacctagaggaagaacatatggagcggaacaattgtgctattggtagaaagtgctgcataatagaggatttgtattctgaaaggtcttgctgtaaacagctcactggaaacagcgatggctgacttttcatgcagtgggtacggacatcattttcaccatcccgagcacaggcacagacattctatttggaaacaaactcttcagtagcctcctggccagagggggtgttgtctcgaattaccatttttctttcaactctgaaaggctaattaatgagctgtgactgcttttctgctcttcaggaggaaggaggcatctggatcccagttcatctttctgacagaagacatacacctttaaaggcaaatgctttttagctcatgatacggacacgaaaatctgcagttggaaagacctacctagggctcactttaagttcatcacctggtctagttattcatggtccagagtcccagttgctcatccctaaaacaggagtaatagactcttaacttagaagtggtgagatgtcggtgaaataattcatgcccagcaagttcaagcagggagcagagttatcacgagcaattattgttgtcattgaatagtttcccaaccaatacacttacttaacaactatttcatcctgttagccacaaagggacagacagatcttggaaatgtaagtttctttaccggagtgaaactgatcagagcagacaagaatgtatctaaattaa

SEQ ID NO: 141 - DNA, 1700 bp, Mus musculus
tttaaagatttattttgttgatatgagtacactgtcgttgtcttcagacacaccagaagaggtcatcggatcccattacaggtggatgtgagccaccatgtggttgctgggaattgaactcagggcctctggaagagcagtcaatgctctcaaccactgagccatctctccagcccccaagaaactttttattgattctttgtgagtttcacattctgtgccccagtcccactcatatccctgtgtgctcttgaagcttctcacctaaaacacaccacatgcgcgcgcgcacacacacacacacacacacacacacacacacacacacgcacacgcacgcacgcacgcacgcacgcaagcacgcacgcatatgcacgcacacgcaccctaaacaaaacaaagcatggaaaatgtcttgtcatggaagttgtagtgtgttgttcacagtgtcccacactatacacctccaatcacacatcttcacttggaaaagttcattgtagtgagtttggtttgaggtctctggcttttgtgacaccaccaatattgaatcctcaccgggatccttctggttatcctgtcacttggtgtcatgaggatcctcctgctttggatcagcatgaccagcctttttatgtgccccaacagttcatagatgatgtaaattttggactgtatcaactcaaagtcctgcatctgagcctgagtaccactcaggtacccagggcctctgggtgacctcctctgtccataccgtatggcgtgggcttctgtgtgtctgtggcccgccagcgctgcatggtggagggcagctctctgggcatcttcccagcccctgtgtggcagtcagcaggtctttgaatgtctactgtctaaccactgccaccagcacagtcctgggatactgtgatgacttctttgtcactgacctcagtactgcagccagaggtctcagcccaaagcaaatcagggagaaatctatctttctttctctctctctctctctctctctccctctctctctctctctctctctctctccttccttccttccttcctttctttcttttggtactttcttcattcacatctccagtgctatcccaaaagtctcccacaccctcttcccccccaggaagaaattatctttttaggtttatttatgtgtatgagtgtttacttcaacacatgtacatgcatcacatgtggcctggtacccaaactgatcaaaagagtgtggatcccttggagctggagttaccgatggttgtgagctactgtgtagggactgggactgaacctgggtcttttgtaagagcatcaagtgttttcagccactgagccacctctccagccccaaagggagatttttttaccatggagaaaatctgcctcttcctagagaggcaggtgtggacctagtatgggagtgttcaggatgtgcgtttgggtggttattccaggaccaggaagaaaacagcttctgtttccttttggtattggatggcatccagagccttgtggatgctaggcaggtgctttcccactgaggtacatacactttaacctgaaaacaggaattttaagaacaagagtatgagcaggaagaaaaaaggagcataaatcaatagagagatatgtgtatcacgcatgtgtgtaagaagatacgattggttttgttaactctgtaggtgggagtt

SEQ ID NO: 142 - DNA, 1900 bp, Mus musculus
acaaaaacagactcagataaaactgcacactaattaaacattttaaaacagtacctaaatacactttaaataacttatttttacttgaataatttcttaggctggggagatggctcagatgataatgtgtttgctacgcaggcatgaagccccgagtacagagacgcaaaatagcccaatgacacacgctggatcatggattcagatctaagtaagtatagctgtaaagcagcaggctgtactctcctgggcttgtgtagtactgacagtcagaacccagagaaccacaaggggcataagcacagaaccagttataaaaaggttttgttacatgtatcaagagattcaaagtagactttgtgtcaagggccatgcagaaggaacaaatggctttagaactcatggaattgaattcagcccactggttaccatagctatgatgggtgtgccttggagaggcagaacacgaggactacatgtcctgaagactccaatgctgctgtggagttttgctctgtcgtcttaatctaagaattgtacgaaaactctatgggggctcccagcccctaactgagcagtatctctggcactcacataacagaacttgatctctctcaagcaccgctgctgggatacattaatgattcaattaccacccttggaaagaacttagagatgtagcttgttagcaatgactaccacccttagaaagcatttggaaaaacagattgttggtgaagataggttgagatgcttttgttagtggctctgatatagaaaaccttagggaacactcttcctggttgagctagggattgtttaaggctagaggataagaacaatagtaggctgactagcactggctaaagcaagatcaagctgacgattaacttcttgtactcatttttgccttcagattactttttaagataaataataagaccactgatcctttctttgtaccacaaattgctgcctgccagaaagagaagctggctgagaaaattatcctgcttgctactttgttaatctgtaagttgcttagttaaacacgtatgtgggttcttgggaataatttgttttctttttttgttacatgtactatgtaatgcttttcatgtaaaggtattaaggaacacactgctttttcataatcattcactagaggaaaaatagaatgtaatcacattgtaattttatattgtttaaaaggttttgctgggatatataagctatgggagaaaaaataaagttggagcctgcttgttggagctttgctccattcatcaaatgtgtgtgtatatatgtatgtatgtatgtatgtaaagtagttggagcttgctcttgctcattagaacttgttgaagtctgcttcattcatccagtgtgtgtgtgtgtgtgtgtgtgtgtgtgtgtgtgtgtgtgattctccccccccccttttctttcttttttcactgacctcatatggccaccaaaggaactcttcattggcctcccagggagcattctcactggccccagtcaactgccaactctacaccctgcctcagtgtaccctggatgtcaaagctggtctttgacaactttgtcctgtgtgtgcaatgctggtgagatgcagcacagtggctgcagtggacagtgagccctggtaagatgcagagcagtggctgcagtggacagtgagccctggtgagatgcagagcagtggctgcagtggacagtgagccctggtgagatgcagcacagtggctgcagtagacagtgagccctggtgagatgcagagcagtggctgcagtggacagtgagccctggtgagatgcagagcagtggctgcagtggacagtgagccctcattttttttcaatgacaaatttacaaggattcagacaagtccta

SEQ ID NO: 143 - DNA, 3275 bp, Mus musculus
ttcttgttcactgttcaaaacttctgctctgtccttagtgggatccactaggtacctgtgagcccaggagccgcccctcagttgtctcctttggattttctgctgtgcctgttgtgtctaaaagtcctttctgttcttccattatttccctattttagagtgtaatgtcaaaaaagggggatccttaaacgaatagctccctattctccataatgacctttcctcataataaaaatgacctttcccctcaaccctaaacatccagaaacaaaggcagcaagtatactaaatctgttaaataataataatgaaaaaaggggagaggaaaattctaggaagaacaaaacagaaaccagcagccaagggtgagccagatcgagctaggtcataggaggccactacggagcacctaagatgcaccgtggtttaccttgaggttctgaaatcctatggtctgtacatgctacagattgttttagatatatgtgtatatatatgcttgtatgagggtagatagataaccttcaattaattatcttttcatattttgcaatggcttgaaaggcaggttaggtctgttttaaaagttcactccttagaaatctatgttgttggttttccaactactgcgtgttgcagcttcagtttgctttattacacagcctgagcctctgtggtgctggctccctgtttccagcgtaggtgaatgcatccaaccgcattttttttttggtaaaaccccgaacaaaagctgttttgttgtcctcccgtggtagcgtttttcgttgcgtggttctttcccaatggtgactgtgaagtggcctctccgtgtaatgccttttatccaaagccaggagacttttatctttttaagcatcggcaaagtaaggtgtttggctcttacttttattttttaagtcatttttagtgagaaaggggacctcgctgatgggagttgggaagacttactgtacaggtggtgagatgggatgggatgagaatcaggcacctttgagaggttggtatttgtcagcgaactgaggaaagatacctgtgttttcagttggctaccaaactaattccaaaacaaatagaaatatttccctgtgccttgtcatctataggtgacaatggatgcctcaccagattaaatatccactcagcttctccgtgtccccatcgtgctttcgcgggagctcagagtgcagctgtgcagattttatacacagtacttattttaattcctcggtatacgatgctcttagtgtaattagattttgcatcctgacaggcagaattaatggtggatacgatatccttataagttgagatatcttaaatcaaattgggaacggagaggggcacaaatatctggtgataaatcacagattatgtttgatttacatggtaccaaagttaaataaatttgttgagagacagcttcttcaggctccatcgtcttccgacatcttgcaaccttctgataaaatattatttctgaagctcagcaagcaatgggggcctggagctcagcaagcaatgggggcatggaactttagaccccaagactaagacttccacgtgacatttcctagcctgaacccaaacccacttgtactaggaaggaatctaaaaacacaagtttcccactgtggcatgcattactgtcactgagatttctcagctaagtttctgtaaatcttggcataccagtagaatgtatgtgaacccctggtgcctagtatgctaaggatttttttaaaagccctgtatttgagaaaaaacttaataagcgggaatacagcaaatgctattattgcacattttaaccctaaatgctccagtgtgagtgggcccttcctgaaaccatgttctcccctcctggtaggctcttcaggaagtctgaatccaacacgttttaaaggttgctaagacatggggtgaacatgagacttctagtgtaccagctggagcaggaagtgtgaagtagttgatttctttcccctggggtgttctgtggataaaactgtttatttaaataccattttgtatatgcaataagtccacattgtatatattcataatggttgaagtgagaaatcagaaagaagtggtggcaggaagggaggactagataccatttcatctgcaaaaataaggagacaaagctgcttatccacagacattgggagcggggctgaaaggtaccaggattatttgggagtgtcctcaaaagaaacagaggaactcctgagcacctcgccccgagagttagttatataccctctccccgacacaagcatgactgctgatccctgtggccatcattatggaatggctactcccttgtccccgggcctagcaggttccagagtattttttttaattgtgaggatttttgctacaattagcagtgttctttcaacctacttggggaattatattttgagagaatgctaccattgaaagccacgatctctattcagtgtcttcctgagcatctcccaaggcttgcccagaactttttgttgttgttgttttgtttttaagaaacagacactagaatgcataggctgtatcccagggctgctaccccagcacactgtagacatggtccttcaccagtcacatttgctctcctgcaactcactatcctgttagcccactatcatttattatagcagggaatcagcctttggggaaggagtcctagttctctgtgttgtgggagcagcagatccctccctccctccctccctccctccctccctccctccctccctcccaaatgggaaaaggagccaatgcagttcacaagggtcattgtacttaagtaaccagacttgactgaacacaactctatgattgatccaaatactgtttttcctttctgtcacatggcaaaatctatgtaaggaggacacatgaatctactgcattgttcacagaaacaataaagggcaaattaaacaccatccccaacatttcttctaatgcagaagcccctggatacctagggggctgggtgtgtttttgaataacaaggaatatggtacacacttatgctgtactttgcctattaggtctttaagtataaatagtgggtcagacaaagaggtttggaaggacatacaaaaggcctcaggggcaagtgggttcctcacaatccacctggtcacagaaggcccctcagtccaggtctccactgctcagggtgggctatatgggaagacagctgagctccagaccccaggcctcctgcatcgtgaggtcag

SEQ ID NO: 144 - DNA, 1875 bp, Mus musculus
agctaaggtcctaggtaagccacccagccagtaatatacagatctgggtacccatctttctgatcagttagaagcactaggagacaagccggcaaaccgccactaccatgcaaggagattgacaactaccccgtggtatgcaggcgggacactggtagtaataaattgtctcagatgtgactcaggctgctgtaagcctttctgaggatgttgcacaaagccttagtgagaaaaatataaagccctttcttttcaaatctcccagccttgactttctgcaagggaggcaaggcaatacacacattaaaacaagaacagcaagcatctttacatacacacacattcatgaaattcaaagggagaaagaagacacttcgatggcatgaactatgtgaacagtgcaaaatcctggttgcattaaaggataggaaatcaagccagctaaaaatataacaaaaaaatgtttacctatgaagtgaggtaacatgatcacttaaatatatatatatatatatatatatatatatatatatatatatatgaaggtttgcctttgtcattccttagaaaaacagctaactgaatccacataggactggcttattgcaagacattaagttttacaatttggcctcagataaacatgaagaaatagttaagccaactgctttgaaggcttccctgacttagaattagaatggcttgctatcattcacaacgagtcatcttcgtaaaagtggggcatgaatttaaccaagcacctttcagtttagtatgtaagcaacagtctttcccagctgcaggcgtcctccagtaggttgtgtaaatagccaccagggaagtctacattcaaggctgtttgctgctttcgagtgctatcgttgcagaaaccaggcacatacatggtctacatacagatttgcaggagaagcacacacacacatagaataggaatacattcatttccaacaaagggagagaggaggaggtgatgacctttgtggggctcaggggtggtatgatctggcttcagcacagctttggttttgaacacaacacgtgtgctatgcactgcacgtgtcttcatgccacttgacactcaccagaagatggtgcctgaaatgccgcagcttgagtctgtccccatgtgtgtcattaactgcagtattttactgcacatgcaaagttttctgccctcacacgaatgcacagctttaattatagaagcgacatttagagtttctctttcactgctcctcaggagacaagtattaaattagtgtatctatggattgcactgtggtagaacgctgggcttaagtttttatttaaattgttgctgtgagttacatttttaaaaagtccattaaatgaatttcagcttgggattaggacagaatttccagcaatttctgaaacaatctttaacacacttctgctgctttgatctacatgcttatgtgtgttctaggcactgaagactggagaaacaaaatatagatcagctctgaaaagtgttgaatgcttagtgtcctgcagttttaaatattcagtcaatattactgttaatgcaaacccaaaaagcacatttacatcgttgtacatattttacccttgtctttaataaatggttaaaattgtatatatatactcccaaacaattttagcataagtttaaaaagaatttactataagtgattgtttgagttatagttcagggtcatatgcttgtatatcccaggctgtatgaaaacttttcacgtggaaaggggtgagctcagaggttaagatcctggacagtgggttaggtggatgactcagtgaggaagagtgtttcctggacaagctaggagacctgactttgaagtccagcac

SEQ ID NO: 145 - DNA, 1525 bp, Mus musculus
ctggtctgtttactacatagaacaggctggcctcagatctgagtagtctacttgcctctgtctttcaaatgctgggatcacaggtgtgagccagcatgccttttttttttttttttttttttttttttttttttttgtcctttgagtttgtcttttaagaaggcaattataacctgcccggaaacaatgaagttctaacccacagtagtaagtaacagagtagcatgtagtagccacggtgtgtacagtactacacagaatgttgggaagaatttgcaattttgttgctctttttactctttggagagtaatttaaaatatacttcaaagagacaaactagcataatggtccccctgcacctcttgtccagtgtcaacaatgactacattgtggccagtatttcttcaacttgtcacttttgggtgaaattccagtcatcaaacccttcgtccataagtagttcaggatacaactacaaagaggagagttttgaaccagacattaaaaaaatgaatttaataaggcattgtgtaaattttaagatttgttttataataacattacaatgttcttcaaatataccaagcagtgtcttcacaagccacagaggtgagagtgccatccagtacttaatggctgaagaaagcttgggatgtaagagaatcttctccatttgtgttcttttaaagaagtggaaaatacacagaaacagaaacatgaatacttgcagtgtgtagctgactgccatgaaaggtggagaaaaccctgtgagggacatcggtaagatgatccacagtaaccccatgaaaatttcctaggctctgtaatgcatcaaaattccaaaaagaaagtcacttcaagagcctgtgaaagaagactgccagaaacgtcaagggctcacaaacgcccagcgtcctttttgtttatatggttgtgatataatataaccagcagagggcagcagtgcagcagtaacagcagcatctgtgtaaccctggctccgcccagtatcaatcccgccttcattcctgacagctcacaccggtcatcaggcctttctcctctgaccactccaaaggtgagtttggaagcacagaggagtaaaggtgtctcaaggatactgtttctcaaaggatgtctcatcccaccctccagtggattgtggttgaaaactcagttaaaatgataggttttgctgtctcagaaatgttgattacatgttaaaataataacattgtatttaattggttaaaaaaaaatcaatctctctcttgcacacatgcacacacacacacacacacatcttgctgtgtagccttctcataatcctcctgcctaagcctcccaaacgctgtgtagtgattacatgtgtgaaaacacacccaagaccccgttccttttttactttttaaaaaaacacatgactgttagaatataatttatatatgttgcctttatctgtctgcacgtcagtggctatcaatttatctgtattggacatctctgctctgaaaactacggatg

SEQ ID NO: 146 - DNA, 2450 bp, Mus musculus
ataccacactgtgtcacccactgactgttgggttatagtgataccatttccaaacatcacatgatggcattggagatgagcaatttcaaggcaaaatgatatatgagtatgaaaatataataatgtcatctgggaggaaggctgctgggtagaagaacttgccatacaaccttgacaccccgtgtttgattgccgccaaaagttgtcctctgacatccacctgtgagctctcgtgtgagcgcacctatattcacacacaatatattacacaaacaatacgtgcaataataataaaacgtaaaagaaatgttgcctactaaaaatatactcacaaaaaaaatatatgtgcagggaagagatttagctcagtggtagagtgcacattttgcataaataaggttctgtgttcaattcccagtacgtcaaaaagaacagtaaaatcaataacagcaacgcgtgtcataaagaaatccatcaaggagtgttttacacagcgctcagggcacaaatcagttctatatggaattcagctcataggactgggagcttcagggaaaaaaaaatcctcaaagtatccttgtgctgttttaaagaaagtagctgacctaacagtgttaggatgtaaactgtgtctcttgggaaaatgggacattgacaagacgatcctatgattctatgccccgtttctatctccaggtggagacctatgctttaagcagtgcgtgttgcttccaatcagttccataacatcccattccccgttcatacctttctttgctataattctgatcggtaccatttagggctcagtcgcctggtttctttccttgtctgcgtttctagttcaggtattctcctcagtgtcccatagtttgagctaagatgtgaggactctcagctgagtgtaactatgagtattttgaactcgactttcctccacagtcctttgctgttatctgtggctccagactggtcaaatccctacttcgctcaaaatccttctaagggtccctccccactgaatttagattaaaactcaaacttttcagttttgcagaggacaaacaatggtgcttgaaatcttccacctcttctgtaactcctccacggaaggcagaaggcatttcatgtcaggcactcagcgtgcgagcttgctgccaggcatgggcatgcgctctccctaccatcgccaatacacagcgcgctcgctcgcttttatcatctgcctgctcttgtttatccctaatgctctctctactcagtgttcacttccactggaatcttcttggcccctgctggcggcttggagccctgcttctgtctgtcatgatctcaccctaatttaaaaccttctatcgtaattatctgtttaaccaactgtctccacctcgctctgtgaattggtggaggtagctttgtcttgtgaataactgcagggcaagcccagtgttagtattttctaagtacctcatttatgtttgttcaagggatgaattaatgaagggacacaaagagaaacatattattgatcccacggggcgtgggggtggggacgggaaactgtattcccctttcactgataaggaaaatcggtttttaggttggacatggggaggttagacaaggcagatgaggatttaagatgtgaattcttgaaaggctctaggccttattttgaatcataggatgatttgactggatcaaagagtggtttggcaagcagttgtttgagaaccctgaaactgtgccaacatttctgagctgatctgctcaagagtgaatccatttggaggaaccataattatcatgtgcgctagccacctttataattgggaggcgaaacagcacaggaagagaactgtacatgacaatgttgatgtgcttcgggcttgtctttagatgctccatcttacaaagatttgatctgcagggatccaagcctttcaagtgcttcagcctcggacttgtaaggtatttggagacagtcaccctagggtgtggctctgcacagttgcgtttggtttagcccgacttctgaagctagccagattccagggactatctagtatggctgcaaaaccagccgggcatttcgctggccactaaacagcttgtgatgtcctggcaggagtggcctctgcagcctgtttcaagatcccttttggctgtttgtcaggaagcctgacctaccccaaatactggcagcccacagcccccacctacattataaacacaaagaactccatccaaagccagtatcaactgttgcttcacataaaacagttcaaatcataatcattttaaggattctctttgtattttcttgtttaaaacaatttaatcaatgtctcttaatcagagtataattgctaaagagtatctgtgagatttttgtttaatttaatctttccaaccttatacaagggtaaggcctaaaaaaccaaaccaaa

SEQ ID NO: 147 - DNA, 1825 bp, Mus musculus
agaagaagaagaagaagaagaagaagaagaagaagaagaagaagaagaagaagaagaagaagaggaggaggaggaggaggaggaggaggaggaggaggaggaggaggaggaggaggaagaggaggaggaggaggaggaggaggaggaggaggaggaggaggaggaggagaagaagaagaagaagaagaagaagaagaagaagaagaagaagaagaagaagaagaagaagaaaagaagaagaagaagaagaagaagcatctaaaaattcttattgttgtctttatgtgtacatgctacaaatgagttgatttcaaactagctctcctaggctggataggtagttcggtgatacagcccttgcctatcatgcatgaagctagtcttcctgaccatcctgtaagtttttctgcaaaaacagtttcaaattcctctaaaatcaaactggctttcctctgtcctttctctcattttcttttcccaacctgcttgtctagatgagctgctcatctctgacctgtgagaaaatagggacgggaagcagagtctctgttgagattatgggtaggttttttttttttcatttttatttagcctttatttctttatgtgccttttacaaatatgatcaaatataattcttttaaacgcaccatgattaatgttgtaatgtgtcttaacagacccaagatcatgtgctattatttcctcctgcctatgcatagagtgatatttactttgcaaatcaaatcagcacgatctattagcacaggtgattttcctctttttttttttttttttttttttctaggacttgaaagttctgcagctgctgcttcctgaagaaaatgaattcccacgcaggtgtcactgccaaacagactgaggattctgctttctggactctcctttagctttcagttctacttactcggcacttacatatggaaatttaagggaggaatcctcttttgccttcctccctttccccataatgtaccctcaacatcttttgaaatagtttcagatatatatcctgaaactgcgagactctgtaagcctgtgattgttgccctctccttgccagagaaagggttgatacgatgtgaaaaatcatcagtattcagcagcgccatcctgcttttcagagctctaacaaaagaacggtcttgaaatgcagcctcagctaaaaaagaaatgtttaataatacatccataaagttttaattagcatatcaaggggcaagactaaggcatctctgactgtgatattaaaagtacccctaccataaggaaaagcaggaatcggcccattggggtcaaagcgtagatagatagatagatagatagatagatagatagatagatagatagatagatagatagatagatagagagagatagacatataaacacatagatacatagagatgaaatattctatgtatgtataaagtattttatatgtacatattatatttatgtatactaatattagaggaggataaatttatgaaagaaactactgaaatatccaatgtccttcttctcaacagtacaacaataggctgttgctcttaaacacagggtacctgcttgggagaaaaggagggatgaaagaaggctgagcctctacatttgcagaaaagtgtttcctaaatgattctgtttaaatctgacagaaactcagagccaactggttggaaagtcattgtttgttcctttatcccaatcagtcaagataagatccatctaaaaataaaataagcatttattaattctagaagcgtatctactcaattttgatcatttgacttatgaaaaatgg

SEQ ID NO: 148 - DNA, 1525 bp, Mus musculus
acctattctaataatcattcccatgtaaagtattgttttaaactcccagagactatttctctactggactgtgcatggacacatgagttcagatcaaaacactgcaatatcactgagtctgaactttcaaatctgggtgattctgaattattcattccacaaatattcactaagggtcttccatgtgaggcaccaagacatacatcacagagacatagagacacagggatggatcagggccagcttttatgaccaggcagatgtgctctgtgcttcatcaccacaccagccagcaccagacaaaacagctctgcatgttcacaatatccaagagagctagaaattgagctgtaggatcccatttaggtatattatcttgggtgattgcaatttctcagtgaaaaggacacagacatttatttagcctgaaccatgtgccaacttctcttcccagtttcatttaagactgtgaagaacatattattactgctttttttttttaaactgatgaggacattgaaacccataaagaacaaaatgttcccaatgtgacagggtaagtggaaaaactgaatttgagtccatgctggcttctttcctcaactgttggctgtcaggatgtgcagatgaagatgtatttagaagagactggaagacagtagagttacagcacatctcagtccttccttctaggctgagataggagatgaagaggtgctaatctcctgtctcagtccttcatccatggagctgtcatatggctatcatggtgacctgttcctgcactgtggtgggatttctagagctaaaccagtaggatccagttctggactcagtagtacagcagaattcctgctcacacaataaggatggttgctatggtctccggatagttggagccctgatcatccttacctcctacatcgaccaagaatacagaatatctgagcaattcaagggtaaacaccaaatagcagaaagaggcaggtaccattgagtgcaatacgaatagtgcccaaggccagattaatacacaccttgcccatagtcatctctgagaagtgttagagcattgcagtcctataatttatgttacactatgttaatatctttggaatacagaaaagagtggattgacaagttcacttagagaaaatcaattgaattccattgacagattagattcgtggtccattcggagcatgtgcatggggtgttaaggagcactgaacccctcctatggtgagttttacaagcctcatcaatttctgtccaacaaaacactttcatctgtgttattaatttaaaattccagaatttgatgagttaggtcatttctaaactcttggacaacttggccagcacaacttggccagcacatctttaatttaattaatgtgagtaaaggaggctcagtgagctgccaagaagggctgctcagttataatactcacagtggggaaaaggcttttatgggcatccattggcagcacccacatcggcagtgtcctgaaaagagggtgat

SEQ ID NO: 149 - DNA, 1750 bp, Mus musculus
ttagggatctttgcttggacattggctgtaacattttccatgtgtagcctcccccaaccttgagcaggctggctcagacctgctctgtcactgtcagctagcccacctagggtggaatcttctgacctagaaaaagtctattgtcctgccacatttgcagctttcctccaaggccccattacctgctgagaggctaaacctgttctcctgacactgtcctgacaaaataagatcctggcatggtagggggtgggatcccttccccctaactttaccttggcttgttatttctctcacagtttctcccatacagccccagcctcccttttgggaacctagtttgtttagctgccctcagctacaggtggcgcccaatatgcggcctgaacacagaaggaccaattgagggaaacactgtcttggtggagctccacagaaaacagaagaagatgtatccctgcacaataagcaacatacagcattaatgttagcactacaaatgtcatcttttgaatgctgttgtttgcaaaggtgcaaaaagaatacagtattggcccagtgctgataacaactaggggttgaccgtggaaaacgggagtggaaaattctaaagacgcatttgtctgcagtcaagaactgcatcaggcaagaggagtagggcttaaaatgataaaatcaaataaaaagagtaaaatacaaaagggggtggtgagtgggagatgctagatatacaaatgacatgagaaagagagaccaagagagaaggaaaatggattttggagctctcccaggaacagagggaaatttggagatgtactgctttctctttggcccatacaggagacatccataattctggttacatcaagttctctaccctctctgtattgtctgtgtttggtgcaccagtctttccatgtgtcaattcgtgtctgtttttgttttgttgttgtctgaacaactgttgttctatgtttcatgttgaataaaaatagttaaaactttatctgctgactgaatctcttgattcagtctcagtttgcacagtggaggctgatttaagttgcctcacaccttagccaggagtcaagcacagcaggatagggcctgctgaaatgctgtttttaaaaagaagtctgcaacttcttagttctaaggcaaataagctgatagttgttttttccaaaaaattctctgcaattgtgattattgggttcagcaaatggcaaagtgtttcttatcttgaaattattgctagaaaaaaattctttgatttgtctaaatttataagattcatgtagtcacttcatttggtttctgactggtcttaaaggtataaatatgctgtgcatgtcttggtcttagagtattggcttataagttattgggtatgattaaaaaggtataacatagataacaagaaagttacgttaaaactggtaactcagggttggagtcattttaaacaacagcacgtggcatgtacgagcccaggaaacaaggcctctaaggatatttctacattgggatactattttatgtgattcttatcctaaaaactagacttataagagataagagttaaaacaatatctctttcatgaaacattaaaatttatactgtcatgcattcatatgtatgatttggcagccaaactttgtaatgtgaaagtgatgtttctggtattgattttaaagagaataaattgtttaaaattgggttttgctttccaaaaattatagatatatt

SEQ ID NO: 150 - DNA, 1500 bp, Mus musculus
tcctctgtttctgggaaagccacctgtaggtctctgtttacaggtcttcaacatcacccttggagcaccgtcaggggcacacaatggttcggcatggctttcccatttataccgctattgagataaatgaggcattcatgggaaataaaacagtaaatgcatgttacacgtcggttcataaaagaagcacggctattcatccaaaagagaaatacccacattgaactcattagagaaattatgaaaacaccattttgtcacagtcctacgcagctgggtctagtcgaggtgagtggaagttaatcagtcataagcaatcaagaaaatgccccgtgggctatttcctcatagccagcagcagcctacagtgcccatacagaaaccaggcagacagtcctcagaggtgctagggtagacaaggcgggacttcactggcctcggagtccttcagtctaaaggagatggcctgtccgtgaagactcacacaggaaactcaagggtgaaaagcagagacttaaacctaatccaaaacaaaggattccacagcaactgttggtactttcagttcctcagggaaatgtggtttgggaggaaagacgcacaacacgaaaggagaaagtcagaattagtctaggggatgtttctaagtgataaagacattgctgtttttaaatcaaagttggctggaaaattaccagacgatcatgggcactgataaatgtcccttcggtgtgccctccatggcaactatggaagaaaaagtaataggggaagggggagaaaccacatgatgagactgagatgagactaaaatgaacgcttgtcttccatttcacagaaagaaggaagctttgagagaagggacgtggggactttcttcatttagtctggccgctttccatctacagaatgccatcccaaagattcattctgatcgtctgctgtctcatctgtcgctaggtgggtctgtggtggctgtgtctagaatggaagattctagaggatgagagtatgaattattcatagataatgcagttgtatttgtggggcaaaaggagaaacaagcctctttgtgctgactggaggagtggcaggcagtttgccgtgttgcctgtggtgttattggcagcatctcgaggagcctgcttaaggctatcctatgacgtcacgggtaggcatggtaccctctgccagtatggaagacatctggaggtatttaccaatcagtgcatgttgaatctggcctgttggtgaagtccagcagaacactacagagcactgtcattaggagaataaatgtaagtaaatataaaatatatgccagggcatcttttaatatccacatattaaaatgttgaccttttaaaagaatcaattcaaaagtggtcaaatattatgtagattatgtggcaaatgactgaacctttgtaggatataaaagtattgtttcagcttagtgctttgtgtgcacatagtatataaaactttggatgaataaat

SEQ ID NO: 151 - DNA, 1500 bp, Mus musculus
gccacacactcagcccccaaagtcgtttcttattaactgagttcagatgatcccaagtggaaaataaacatcaagaaaggaacatgcatggatcagagactgtactttatatattctttgcttgtgttcctccccaatgaagcattgggaattgtggattgtagcattatgtgcatgttgcagaatagaacatttaacacttggggctgggaaggtaactcagttggaaacttgcttgccacagacatgtatatgtgaggtaatggatctcctataagcctagtgctgggaggagcagagactctggggctttgtggcacagacaacctcgcccagttactgagtttcaggacctagtgagtcaccggatttcaaaagctgttaatctaaattgtgcctaagaaatagcaaccaagtttgacagccaacatcctcaatcatgtgcttatatgtgaacacacacacaaacagacacacacacacacacacacacacacacacacagagagagagagagagatagagagagagagagaatttaaaattgatgctcagatgattcttgaaacaaaccatccatttggatatctgtgaagctaggatctgattcaagtatgcctaactccaacatcatgctattttgtatatctcagtgttccttactggaaagaagcaccttttcagctggtcagaccgattaaatcaaccaaggaggtgaacaggggcaattctcatgaccatatcacacttcccaaaatgaagaagctgagagattccatcacatgccccaatcacacagcttctagcaggaggctagagaacccatccatctcttatatcactcaagttctttccactatgctggagctccatattttacataaaagctatcagtgtcactggacattgaaattaccttcaacacattaaaaggcagttggttgactaaagccaccaggcagtcacatttgtagctcccgatgacaatcctccctcctttatcactttgcataactcatgacatttgaagccattggtgctcctcataacgtaccttttctcttgtctgcattgtcttgttcaacaaagggaaatgccagttttgacaactgatgaatgccacggtgagcttctcagaatctcttcaagttgttttaggaataaagaaacattcactgaaacccttctgtcaaccctcagtgctcgctcatctccaccttttgttaagtgccgccctccccacaagaaatccatcagaacattggcctttgaatctttagctttcagttgaatgttctccaactatcctaaactttgcatctctgggatttcttagtatggtcctaagagacaaagaacatttggtattactcaattagttgcaagtcattagtaatggttaattaacaatagcattctctcttttcctgtgcttaaggcaagacctggctagcatcaacaccacttcccagtaagttttgcctgatgtttccagatgtt

SEQ ID NO: 152 - DNA, 1550 bp, Mus musculus
atatcactgaacaatagtttggtcaaacatacatatacatatacacatatagatacaagcatgccatagcatagaggacaatttgttgcaagcggctctctttttctcccgagtgagacccagagactgaatactggtcttcaatttcgtagccttactttctgagccatcccaaggccacatgcttgtcttctgtttactctgctaaacactcagcttggctctgaattttgaaatcattaacatagttaagattgtaatgaacaccctccatggcttatagcacacacacatagtggtttttcaatgggaaattctacaaggaaagctgtataattaaaatgcatatgtgcacgcttatatttcctggaaaatgcccactttcctaaataactacaccaacgaatacctttcccagaagcaatgagacataaattgccacttttcttcctttttaaagatgactgtttcccacgtttatctgctttgaatttttgagacaggatctttcagcctaggcttcctgcctctaccttccaaaccctgaatgacaggtgtggttcaccatgcctgtaccatacctgtggtcatttttcataaagagatctgtttattttatgggaatcacagacctcaaataactcatgtaccagcatggccaatagctctgtcaaatcatgtaggaggtgcagaggttctgtgttcataaataaactctaagggaaccaggaatgctaacacacagactgtcacatcaaagggagagatgtataacctattttctgcttaggaggctggaagcagatatggttaattagcctggtgacccttatgctatctgtgtggccaggctatgctggatcctccctccgactctcgtcttgagtttgtttttctcaatctttagagcccacctttctagacgatgttacttgcactttataaggaatttcaacatagtcatatcttaagctttgtggtgcacatgggactgagttaattattgccaggaaattatttttccaaattgtcctgtgcttaaatatgcctattggaggtcagcgtcttgaagtctgcaccaataccagctaccgagccacgctgaatctaattgccttcttgatcctcgatgatcaacagtttgctggctgtggtgtttgcagagacccctgcaaattcaaatcctgtccttgcatatgggtcctcagagctcactggtcagccaggccagaggtcacttgacattagccaatagtctccacagcatatatgggcacacgttcctatgcacatgctgacactacacacacaccatatgcaccatcaagtcactcctggccgcaggaaattcatttctgttgattctctagcatacatatcagaacaagttgtgagcagcaacaccgtcacaagaacaagaggcgattacatatcgctggctgtggggaggaagatggcatcgcttaaatgaaaagaaacatgtaaatcaaacattgtgggcctccctccgaattgattagaataatgtgagcatagtctggtcacttccc

SEQ ID NO: 153 - DNA, 3750 bp, Mus musculus
actactatgaccagagagctctaagttggggaggggcctgcttttctctggggttgcaacaaagcttgcagaggaggccttgagccagtattgtctgggtcctccaactcaattacgtgaggtctgggatcgtgagaagatggacagacagacagacatggccattcatgttgggtttggaacagggtctgacatgacttcacatctctttcctagtctccccatatctcctttacgctgccatgccctctgacaaggtatggctcatttaatggattagatctctccagagtagcaccaccccaaatcataacagaatgagtgccccttgcttttcaatggacacgacttccgcttcaaagtcagcttagttttgtgggcctcagatcagagcctgggtgggtagaggctgcctggttctgcatacctccacctccacccccaaccccgacgacataggcatccaggctgttctctgtgcactttgggccaaatagtgcatagcaaggaaggctaggctagagggcaggggtctccatgtccaaaggccactgtgggagaagtgaagtgctcagagtgagtctcagtggaccgagtttaagacttgggtttcgctgccagctgtgtgacaggcaagccagcccaactctcatggtttctgcttccttgtggtagaatgggggaagataacaggccttggggtatgcggccattaaagactttgctgatgtgggggtaggggggagcaggccactccttaggaagggttggtcttggcaaggttggggacaggacctgttaatccacgggcagagccttcactgtggggtggggacaggaggcagggagaggtgtgattcgctttggagacctccactcatttccatcattacaaaagcattaaaaacaccagtaaagggttcagaacggatgccagtttagccgaagtgcagcttcctctctgtgatggagaatgggctctaccatgccatgcgtggctgcgcccagtaagacgaatggtaagataacaagatctgcgtgtgctcatggctgttggcaaccttagcaatagctctggattggatgacgcataaccttcccatggtcagtgggtgaagagggctgaaaaccatccctgtgggtgacattggttgacaccaagaagaaacaggatttggggcggtagggagatggttgttgttaaagtagtgcttgcaagcataaggaccgaagttcaaatccccagtacccacagagaaagctgggtgtggcaacacatgcctgataacacctgaggggtggagacaagagggtccctggtgctgctctccaacatgcatacccaggtgcgctgacacctgcacactcaagcatacacacacacattcacataaaataaaataactaaaacattaccagcagctgtcactttctttccgcagagtctttcgtgaagcactctcagcaactgtgagcctcagttttctcagtctgccaagtagaatgactcttggtccatctctcgctgggctgccttggggaccgcaggactgagtgctgagatgtgggaaagtgtgcagtcctgtccagtcacacagaactgaggggattaagatgtggcgtgtgggttttgctggcaaggggcgattcttgggatttgccgaatagcttttaggtttctgctttttaaggcacaggcacagatggtgactttctgaataagactctggcagctcagaaagtaatagagacaagacaagagggattgcagccagttaaaaaggaaaggacagaggagagacagttttaaagggcaaggaagccacgtcatcccgcagaggactggtcccagagggtataagggacttcaagcccccaaagagcagaggctccagccgacacatgggcaagtgagctggatgcatgctttttgaaagtgtatgtggctccttcatacatgaaagacttatttagcatcgttagctgtgagcaaaatgtgtacatccaagctatgtagagatttatctcatctgggagtcaaggaaaataatagcaaactttggagcataggagaggaaagggtcacttttatactatgagttggattataaactagtccagccactgtggaaaccagtgccaaccttcagagagagggggagagagagagagagagagagagagagagagaatgaacatatatggttcagctctgccactcctgagttcatttcctaaggaatacagtcagcataccggatagagatgtatccatacttactgcaacactacacacagtagccaacttagggagtcagtccccatgtccatcagtggaaaatgtgaaatatctgcacaacggggcactagtcttccatagtgaaaattaaaatcattttgtttctgaaacaggataaatagtgaccatgttgaatgaaataaactaggctgagagggatggatgccccatgcttctcacgcatggctctaggtggcaggggagggaggaacatgcctataaaacacggctttcagggtaaaggataaggagagggaaaggcaaggcaagagagagctacagagacaaatgggatcacaacaaaactcaccactgggtaaaattaatatacaaagttagattcctgagatctactgatggctcaggaaatgtatcaaatgagacatttttaaatgtttcaagaacccaagctctttgttaccaggtctccctctctgtctccttgggtggtcagagcaggcagaagttgacctattctcctaatcctgcccatcatggccgtcaggaagttagttgcttgatcacctgtcttatctccaggagtgagctaggaatcaaatcctgggatcaacactcttatagcgaataactagaggacggtgagacgctcgctctctcgccttctgatagtgcccgtgaatcaataagaaacatttgctctttccttgcatctttccttctttgattattccttcatcaataagcctttctgctctaggatggtgagtgagaagattggcaacccctctctcctgaaaatcagtaataaaactaacaaaacagtaaacagggttgtctcggggctctagaaaggaccaaacttagccaggtgtggtggcgcacgcctttaaccccagcactcgggaggcagaggcaggtggatctctgagttcaaggccagcctggtctacaaagtgagttccaagacagccagggctatacagagaaaccctgtctccaaagaccaaaaaaaaaaaaaaaaaaaaaagaaagaaaggaccaaactcacactttctggtaagactgtaaaatggtgcagccactttaaaaagtttatttctgaaaacaaaaaacaaaaacaaaaccccaaaacaaaaaactaagcctaaatttactgtctaacccagtatccactcttctgtacctacctgcagtggttttctctcatttctcactatgacagattatcaccaagagggtcgcttaaggcagtaaaaatgtcttatcttacagtggtggcgtggaaggtctggcaaggcctccttggtctaaagtcaggtgtgagctagcaggctgcactgcttgcagaagtttcgggaagacctttttccattttctctgccagcatctaagactgcccaggtcctgcttggctctgggccttttccaacttcaaggccaggcctggtgggtcaaggtctcctcccatcatggacttttccttccatact

SEQ ID NO: 154 - DNA, 1625 bp, Mus musculus
ctcttaagaaacagatccaaagctcagatttatgcttctttacctccaacttcactccttacagggacagccatggcctgagctcttcgaagagaaaccaagactctccgtccttgtttttcccattcagtgatcacatctttaacacttagtacttgttagatttccctatttcctgtgtcttttgtcactattctaagactgagctccacacaagtgtattgtagttacagttctgtgtcctatatgacttaactatagctcctgtgcatgacagctatagattctataaaccacaaccatagctcctgtataccacagctatagctcccaccaacagttatgttccatatataccacatttcaagctctcatacacatatctataactcctatataccacagctatagaacaagtataccacagctatgattcatatataccatgtctacagctcctatacaccacagctatagctcctgtatatcatcttagcattctgcctaggctctgcccagcagttacctggcaataaccaggtaggcctggcttactataaaaggggctgtttgccccttccttgctcttttatatctttgactcttttttctccctgacccctttctcctccctctctccccatctcctttccccttctctccatgtgttcctgtccagtctctcttcctcctctcccttctcctcctcccccctctctctttctctgcctctactcccttctcaacttcccttcccatgccgctaataagctctattccatactatatccatcgtatggctggtacctcataagggatgcctcagtatgggcccagtgaggcatccctctcaccccaccattcctggctctatcaaacatatcctgcttccttttttataaaacataacatacaatagctatacctgtgcaccataggtatagctcccacacaccatagctatgattcatatatactgcatctacagctcttatacagcatcactatagtacctgtgcactgcagctatggcttatatataccacatctacagctcctatgtatccagttatggtttgtatatatacaatagctacagctcttgctcaccatagctacagctacagctcctgcccatgacaactatcgctccattctctgtcctcccaatcttctaggtataatctcatggctaggtcattatcttcagggagcctgttgcattccacaaactgcacatcactgtgtgtgcagaggagacatattcctcactctcatgaggtttctttttctggtggggatggagataaccttccaagcaggccacggagataagcgaggtgcctaccttgccactcctcccactgtatgaccttcaaattaatgttccttttctgtaaggtatgtacagaatatcttcctaagaatgaagtagtaatgtgtgttatgccacaatctaataaactaaaggaaagagaccaatgcagacaagtaggagatgtgcgcacgcgccatgctgaacattagtgtaccagcgagtctgtgactgacagtcttcagagatgatggataggagatggtgggcacttgctgtgggaaccactagtgcatacagttatatccat

SEQ ID NO: 155 - DNA, 1700 bp, Mus musculus
ctagtattcaagtttggaatccgggactgtgcattaaaacgttatttattatttatactgggtggtgtgcacctttaatctcagcacttgggaggcagaggcaggtggatttttgagttcaaggccaggctggtctgaatgagctccaggacagcccgggctatacaacgaaaccctgtctagaaaaagcctatgtaccctatgtgggcagtgtctgtagagagcagaatagggtgttggatcccctgggactggagttctagtcgattgtgggtgctggggcttctggaagagtaaccagtacctctgaaccatttgcttaccccaaagatacttttaaaaaggttgcttttgctttttatgtggggttacttctgtttctcctctttgttaatctggactcttgaaaaaattatgtagagacttaaatttctgcttggcatactttctatgccagccagctggaattcagtctacatatcctgccaaatattgagataaccatagcataggctcttaatttgcatggttggtttcatagccaataaatttttttcgtttgcttaaagctgtattgagtgtgtgagctttctggggggtattatcaggacattctgagatttgattttagaaccaaaggtgtttttcaggaaaggggaatgaatagttctacttttgacagttttaaagtgggctgaagaggtggctcaggggttaaggatgcatatggctcttggagaagacctgtgtagcttccagcacctaccagtgattacagtcccaggggaaccaaacatctctggcctctgtgagcacctgcactcttgtttatttacccacacagaaggatataatatgaacatatttttttaaagaaacatgagctacaaacttatctgaggtgatagtcttaataatatcaggaagttagttatttgcctataggtagtgagtgtttgtataaaatgtacttgtcatttttcaagttttatgaaaagtagttaagaaatctgtttctagttccagctttgtgctaagccttttatatttcatagccttgtaaagctggcttaattcatattatataaagtgtaaagcatcattcagaagttggataacttgaattaaatggaatagttgtgaaacacccaaattgctcttttcatattatagtctggtattgttatattctggtagggatgaacttaacaggattttagaataaaacagctgtcataagatagatttttaatttaaaatttattttttattttttatttttggtttttcaagacagggtttctgtgtgtagccctgggtgtcctggaactcactttgtagacgaggctggcctcaaattcagaaatttgaggccagcctgtgcctcccaagtgctgggattaatggcatgtgtcatcactgcccagttcataaaatagattttatcttgatgttgaagtgaattacaagttctcattttttttctatttaagtaatttttaaaaaaagacttatttattttatttgtgtgggtagtttgcctggcatatacatgtgcaccgtgtgtttgcctggtgccatggattccctggactacagttaaagacagttgtaagctaccatgtgagtgctgagaattgtgcctgggtcctttagaggaacatccggtgttcctaaccactgagctatttctccagctc

SEQ ID NO: 156 - DNA, 2100 bp, Mus musculus
gacacaacaccttagaatgttttgatgccaatcaacccgtgtgactagccagagagcacatttcagacggttaaagaagtgacccggagaataataaactcttaagccacccgatgagaacatgacatgactgcatgtaaacaggcaatatgtccaatatgtaaacatcccatctccaaacatcctgagttagcaaattgaccaactgaacaaaatgttggacaggacaccgtgaagggaaacggttgccaagccaaaataaatactgtcgtcacgtgtgacatttcagaaagacaaggcttcaagagaataggagatgaagaaacccttgctagtaatgaataggaagagaaacccgggatgtttaagaaagacaaacaaaagcaaaggcagaattgatagcaatagtggtttaggagtgtgaactgcgtttcaggaagcccgcagggtactggctcaccttcggacaggatagctacatctgctgtgcctccaagttcagaagggttctgttgcctcaaaaggcaataggacccaaactgcattttttttttttcctttacagaattccaggactgaggagaagatggtgaggtcacttctaggtttgcatttctgtgacaattcatgttcaggaagatgtttgcatgcacgaattcagaccctgttcattatcagtgtgaagattacttcaggaacccctgagttccagggcaaattctgcttgcagccctgtgacttatgacatgtgacttgctcattgcctcagtatctcaagttccttatataatgtgatgtaaaataacagagagagccaagtattctctaagatctttagtatacttaaaaaatctgtttcagagtggaacaccacactattaactgtctaaataatcacactcccttcctcccaaaaagcaaagcaaaacaaaaaaaccaacagatacagaagcaactctgttgtcggggacagagcctggattatcttccagaaaagaaatactttgcctgaggaggggatctgacatctggcaccgagcggctgcagcggcagggcattgcagaattgttggcttcgctgggttgactgctcatggtttcctgatttaggtcaccatggatactgctgctctaacactgtgactatgtaagtaaaagtggtccataccttacgtggcatattgggcaggcataatggtggtctgttgtacttctctgaaagagtgtatctgtgtaaaaagcctttactggatatgccagtgtctgtgtgatgctatggagcaactatacattttttggctgatgactgatttatcaagggtttagaggaagagtggaatatctataatattaaggtaaagattgatgttgtggcaaacactacaatacatagtgatacagtcatagggaagttttgtctcactaatagagaaactagcatatagtttgccttcatgtgaccattcaaggaccaaggttcctcctatgctgtggctcctgttattgacaatatatatgttccaaggttgctatagcattttggatgacaccacctgaactggaataggcctggagaattgtttggaaaacactctagcaaggtcttatgaaccattgattaacacccaatcaaatagtcacacaaaactgaagagtgggaaaggtatcctatcgttatacaaagaataaaacatgttttgggaggagccttttaacaatacacaataacttaaatattattttctatttttaaaaatatacataagacatagggtacaaatttacaaaaattctgagtcgaattgtaagcaaaactcaaagaaattttgtagttagtttcatctacttggtacgtgctatattcaagatcctcaggactaagctgggtggtggtcgtggcacacagcttaagacccagcacttagaaggcagaggcagggggatctctgtgtttgatgcctacctggtctacagagtgaatcctagaacagccaggggtacacagagaaaccctatcttaagacccccccccaatctttaggactataatccagtgcttcctaggtaattatcataatggggaataattctattcttcac

SEQ ID NO: 157 - DNA, 1750 bp, Mus musculus
gagtgattttaatatcaaacaacagggagtaaatgtctgtgcatattaccagctgaaagaagccagggttacaaatctaggtactgcatgatttcaactgtgtgatatcctggagacattatttttggagtcagttaaaaacattatcaatgcttgctatgtcgtggtgaggaaagagtttaggttgcgtgtacagaggagtgttagtatagtaactgtactgttaggaaggatgggtggggtcctttgacatttgccatcaaccacaaaattaacagccagactgaactttgagtgataatgatgtgtgtcgtgggtcagagtgggctcgtcggttttcacagtcgtaccagtttggtggggataaagaaactagggagggggtcttggatctctgggacagggttatatgggaagttggtacacttgagactgacatttgctgtgagtttaaatctaaaaactcactaagacttattatctggtaaataagtttagggatgtattattgctaacttagatagagaggggaagggagttcattgtatatgtttacaccggtgtttgtcttctaataatccagagttactcagtttatgtgtttataccttgacaacttttgagagtttttgcttttgtatgtaacactttgatggatcagccttttaatagtatctgtagtggtatcttggcacttgctacttcccgaatgcatcatcagcaacagcacgccttggtaacttatgtcactgtgtttagttttgctagaggattctattcttagcctctttccgtttgtaaaggggagaataaagctttctatgaagaagttggcattttggcctggtccttggtagcctctgtccactgttacctaggattacagtcagtcagtctcctctattgtccttgctgaagcatggctgttccctagaggtcattagaacctatagaacctacaggttctgtgcatcaatgggactgagtctatttaccatgtccagtattatactaggagcttattaggtttagtaagtggtggttgtaaaactaatgactggttggctgagcaaataaggctacatgaatcacagaaataaagtgaagcttaataagattaataacgcactcaagcttattggcaagtaggatatctatatcttaaatttagatatcctgacaccaaatcatgttctttttttagttagtaactacgctctcttctagaacagcccttcttagcctgtcggtttccatccctttggggtcaaatgaccttttcacaagggccacctaagaccaccagaaaatacaaatatttatattatggtccatatcagtagcaaaattacagttatgaaatagcagtgaaaataatgctatggttggatcaccatagcctgaggagctgtgttaaatggtgtcagcattaggaaggctgagcaccatagtggataggagagtgtgtcacgctgagttctaaaatgtcagatgaatgctcgtgacagtacattgacagtaacagcacactaggttagggactttaatgcctttaaaagtaacttagcccaaaccatgatgtgtaatctagctcctgtccagctcttagatacaagagtatcgattgctcaggagtcagttgtagccaagagtctttgtttctgttacttttgtattgctgtgatgaaacaccatgaccagggcacaacttccagaagggagggtttatgtggggtttatggatcccgag

SEQ ID NO: 158 - DNA, 3100 bp, Mus musculus
aggtagatagacagatatcacatatgtagtatttgtagtaaatacaaattagtatttccaaccttgaattttagtattcctatacaatgtagaattttggctgagatctttatattcttcatattctctctctctctctctctctctctctctctctctctctctctctttccctggaaagaataaaaaacaacaaaacaactttggggatatttaaatgcaaaatagctccaaattattaaaaatgtcttcacagttttgccgacatgcatttagccatgaggtacagagaatgaaatcagtgatgcttttcttgatccagaatacattttcattttgtctttcatgcactctagccagatgagtgggcagctattttgaaggttgacaatctgctccaagtcttggaaaacaggcaagtcccccaagaaagaacgaagagatttgcgatcttaattcagagtagggagaacacatgagttttagtaataaaccaacacttgagagagagaaaaaaaacccctagcattgctgtttattgatgttgtaatattggggaggttgttgagtgtgccttcgtctctccacttttagtatgggttcatggacatttcccagagttgtgctgtgatcggtgagcacattaaatacttagctttgtacctgacacatttcctgacccccaacacttgtatttcccatgtcctgtgccctcttctccactgctcatgcttgtttttttactatactgactcctttttctatcctgaaacaaagagatgactgaccgaccaccctgacttcggatgactatgggaaactgtggtaccacaaacacaccttgttggggggcagcatgagttagctattcatcactattggacaaataggaacaccctgggtattactaaatagaagaactgttaggggaaatgctccatcaatcccagataccccaccacaaagccttgtgccatcactggaatctgttgacctacttacgaaatctctaattctattcctgatagcctataattaggatgatctgaaatagcccgaaaacattccgtgccagcatttatccccaaaggcaagtcgagaaaccttcaataaggccttttctgaaatttgcttttgagtcaacagatttggcaatattttaacttgtaggcagacagaaaggagaaaggaaagaaaagagacaactagacagaagtcagaacgggagatgagaaaaggggaaggaaggaaagaagatagaggaacgggagggagagctaaatgatctcacttttgtacatttcatcaaaatgtagagcaagctcttgcccaaatttattagcagttatctcagatatgtgaagaaaggttgagagagtcactccaaataaaacaatcccaataaataaataaaccaaacaaatctttatgtcaacacagcttctgcttttgcgtttggctgtagtatgagaaaaaaaaatcactttgaaaaaagcaagcatgaatagaactgtatttcaaccccaaatgtccccctaccctctcccccccgcccctgacaaatagagcttcagaaacgcaacacctatcaaatatttcctcagaaatgccagattgctgggattttaaagagttctacttttttttcttccctttttgacatttagacagattgagtttgagagaggaagtgactcggagtccagcctgccccgcaccactgtcagaggaaataaccgaagcaaaatgaagtgataatatactgtagaatatttaacagaaagagtgaagcaggggcttggggggtggggagtggatggcaatctgagaatatacaactgatccccaaaatagatgcagtctcctgtgcccgagcagatgccaactacagaggatcgtgaaacggtagaattaccttgctctgtgggctgtgtgttgacatatgaacaccgactccccaatagtcagaggagctggctcttttccctccagtctctgttaggctttgtcacagagcctgccaacttttccctttctgtatattcgtcagtgaaagagctggtaagtgaccaccgtaatggctgcagcatgttgctgtgtgggtcttgacagaaaactacaaccctgggcccttctgtcacagcgtgaatgaaatcagaaagtccaagggaggatattagcaaggctctttccattctggagaagactcaaggcgataagggacattgagatttcccacccaaggaaagagtcataaatagggcgatgaaggaaaaacacaacccccttctgcgagtttaatgagaaaacggccacctcctggggaatggggtagaaagctgaggtgctgtcttaacagcctgcaaaagttgaaacattgacaaaacaagctttcttcatctgctgaaaacagggaactgttttaaagaaccccccacctcttattcacaaaggagtagagactgacacttggagaaggccgattttttccttttctctatgtgaatagttgaaaactttctcttttctttcctggaaaatttctcctccatctatgtgctgaccttcctgatgtatgactgactctcttttacccaccaagtctggggcaatcaccaaaacagaggctcggggacagtttcgtcctagccctcccccaccttcatgtctcttctcaaatcctcttctcttcctttcttccttctgttcccccctccccttttttttttgcattcaactcaaggatgatcttcaatatcttatgtcaaggcaaaacaaaaaatcgggttctagaagtttaaatggagaaattactgggggggaggggggggattacaagtgatagctaacagaagcctgcaacaatgtttccctggatacccattcgtttaaaaatacaactaaatacaaccgagttttccactgaaaactgatttctagatgatagaaggatgtgactttaaaccctgtttcacattcctccagggatggtcatcaaggaaaagacactaagaggtggcaagatgataagataaagtaatgtgataagatactaagatgtacagacatactgcaattggaagaatggttcactcaaagc

SEQ ID NO: 159 - DNA, 2450 bp, Mus musculus
tctggctctcttttcctattcactcctctgctcccaaccgaagatgaggtagatctaaatttcctctgctgatccctttgctgggtgactgtgcaagaaagggctttctctttgcaaaaactggcaccacacatttatgtgcattgggtatcaagctgttgttctggaccacactaataattatcttatttttttcaggatgccataaaaataaaccagtaagataaatatgctttctctggccatatcccaggaactcatgacttgtaggctgagtggagatacagaacagaaaggcatcagccatcaagacaacagctccctggagaaacactgtaaaggatggggtaacccctgctcccccgagttggagtttggattttgaaaggcaaaacaggacactccattccagtgcttggctgccaaagcctgggactgctgctgccaagtatcttccaagcttggtgtgtgctccagctggagttgaatgtttccatctgtacaactgcaggtggttgtataattagccacatacatttgtagcactgtcgagtgaagaccagtaatgaacccatccttgctttacatctgtggggtgttgcgatggactgggaagggatctgttcttaaaataagtagatcaaaatactctcttgttctaaatcttctcaggttattattattcagcacttgccactgaaatctgaatgactgaaatgacagtgaaaaccaagcttgatgtgtgtctatggtctctgcttgagatgttgctgcatttttcagaagtctcctggaagccacttgggttctctggagaaaactgcacagcaatagatcctgctgtatttcccaccattctgctttgtgttaaagggttggcattggccttgtaggtaacttatttcttactcttctagaccacagggatacacattttccatctgacacgtttgccaagaatggaaaataacttcaatgagatatgactcaggtagaaaataattaagggggctgaggaaatgccgcagtgggtaaagtgcttgctgtgccagcctaggaacctgcgttttaattccaagaacctatgaaaaatcagtcgtgatggcacatgcctctaactccaatgttgtggtggcagagccagggtcctaagagctcctgaccagtcagtctactcagaatagtgagccacaggcttcgtgagagaccctgcctcaaagaaaacactctgaacaaacaattaaaaaagacactccaacttcagcatctgctactcccatgcgcacacgtgtgcatatgtgtatatgatgcacaaacacagagacatttaaaaaaggctaaaactctaaaagtaagatgatgccatcagggaagattaactaaaattatatttgactctaaaaggaggattaatactgttagggaagatagggtttcagttaactacaggcaggattttggtatgttttttccccccttttcctacagctacaggtttctatagctccatgcaggaaagagaacttagacccagggccttgataatgaggtaagacatacgttagggtcagagaaaagacaatacatctatccacttgctgctcgagttgccttccagtttgttcagagcagggtaaggaagcatgatgttaggcatgtcctgaaaatgcctgggaagattgttctaatcgacctgatacctgtgacttctccagcccaattctagtgtttttttttttaataattatatgggaaatgtctaaatgggaagatgcctcctagaatgacttttgatcatcatttcaagtcagattctaaaggctctgactgctgctttcatctagtttccagccaatggaaagctgggtgagttcccattggtagtaaaaagatcagtgctggctaccagctcactgattgggatccaagcaggcatcatatttgaaataagacttattacagttttcaacaaggacagagtgacaatgccattgtgttcttttacatttgctgaggcatctttctaatcattcttaggactggacttaaggccttctgtttgataaagggaaggactgattttcaagagagtccagaggtagaagccaggcctttatgtgcacattgaatatcctaggaactcagggcaggatatgacatttccacatttggcatctcacatctcctggtaccagaactgctcaggttctgacttgaaagtttttcactccagtgatgaaaacatctatttcccatagctatgggggaaggagttcctaagtctcttctgaactggagaagagtaagacatgagaccggctagaacttcactttgagcaaagacgagagggggaatttcctgaatcccctttgccaacagcaaaggcttgaaaatcagatcgagacttgaacaaaactgggtttgtcttttccccaggttaggataccaa

SEQ ID NO: 160 - DNA, 2200 bp, Mus musculus
ctctgtttcacacaaataggtcattcaaaatggcagaagtatgtttagggccattacaaaatggttagaaaaaaatctgtcctaaccccaagtcaaaaatccatttaatgatttttttttaaatgaaactccaatcagccactcaagtattggttctaaaaagaaacactctaacgcaacacaatgtaaagatatattcatctgatacatgctgaggagtgatggtaggaaagtattaagtttgtgttttctgaaattaagccatcatctttccaacacaactgcaatctacttttgtggcatacaaacactgacgttcacaacatagaagcctcacgtctaagctgaggtatttcggacagtgtttgttagtgttgcatggtgtgacagtatacactgtgtaaagtgtgcatgtggtgtctccagagccaaggttgccgtgaagttgcataatgcaacacaggtcagcctgccagaaaggactccgattcactgagagatggatttggaattgatgtttggtcactgtgtgttcagaaaccttttattgttgacaaaacttttcttagcctccaattccttctatctcattctattttgttccccattatccaattttgtccaattctctcactcttattagcctctagtggccattttatactgtctcttatgaggtcaccagctttaactatcacatatgaacaagaactcacttttgtattttctgttttaaatttataacctctaagatctcatcaagcatcatttcacatctgaaaacaattgacacggtgatgtcaagtgtcttaggacccaaatctagtcctgctcccctcttcataacatctggccaagtcaaggccattcagtgttttctcatccctggagcagatggagaccatgctgagatttacagattatctgcaacaagaagacacccaagtcaacagagtcaggagctacgaggctgaggattaatctacaggaggactcaggaggaaaagcagggcagggagaccagctgggggaaacagattttttgagcgtcttctgacagaatctaaaaattactaaccttctgcatgtcaaagatatttcttgtcaacacatgtgaaagcatcatgctgagaggaagcccaagtgagcagatgggggagtatacagactcagaagttgatgctggagaaatccctgctgacaacctcccaaaggcaggcccagagcaggtcccaataacctcctatcctatcccttccttgtccctgctatgattaaaggacctttctggtgcctacagccttctgatctcagttgaggtaaatcttcctctttggaaacccaggtaggtgcagggccttaattatgtccttgttctcatgatctcctgcccctatcttctgtccttacctctttcctctgcatctttcgtttcctatctgactttccacaagcccccgttgtccctgaatgattgggagtcatttccctctgtgacaggcagaacttgctcaggacaacatagcagaactaaacaagtcaggaggctataatgacacaaaatctacctttccattaagactatgagattcctgcaatagcatgtgccctttaagtagagagagaatcctcatgtactgtagaaattcacagttaaagatggcatgcacacagaatgtcgcacgagatggtgagaaaaatagtgcgtaaaatccctgtgtcattttgaatttggactgcagtttgattttactgttcctggggccaacaaaaaagaaaaaggggagtagggcgaggggaagggagaaggggtgagaataagaaaggcaaatgaaatgaagatgtggaggaagcaaagtgggaaggaaggaggaaatgggagagaaacagaagaaagaggaagaaagggagagatggatagaggggcacaaagagaggtaaggaacaaatgagaaacagaggaaggggaagggtagagagtaaggaagggaaggaatagagagagaaagggagggagggagacaaatatgaaggagagaaagaaacaaaggatggggaagagggaggaagacagagaaaggaaagaggagagacagggagcaaatgtataaggagcataattggacatcagattattccagaagaggtatctggcagtgttgaggctcctcttctgacttgttcatttgaaggagcagct

SEQ ID NO: 161 - DNA, 5425 bp, Mus musculus
gacatcacatccgaaacaacagggctccagtcctggaatcctgggcaggaatcttccatcgagctgccttcaataactagaagcaggcagtaaaggagaatggggacgaagatgagctatttaaaaagtagagaggggggactcaggaacaaaatggtagcttgcctatagtcctagaactctggagggtgagacagggaaaccctacctccctcagaggactctggatttaagctcttgcaatgagaatctttgcctccataagtaaggtggaatttaattggggaaggcaaatgatttcaacctcttgcttcttcatgcttgtgcacacacatgtatcgacacctgtacccacacatgtacgtaaacacacatacaccaaaaagaaaagaaaaaacgcggaagaagagatatagtggctattttcgccaacttgcctagactgtggttgtccaaaagcatatgaggtatgtctaatgagtgtttctacaagaaaccagaatttaatcaggaaactgagtacaaagattgtcgtcccccatgggtgctgccctccagtccacggagggtcagaatatagaaaaataaagagacaacaggtttgtgtgctcttgctgagctgggcttgggcattatcttctcttgtctccagataccaatattcctggttctgaggccattgggtctaagttacatctgcacaatgagttttactggcttaatcacttgataacagtgagtcacaggccatcaattcttctgtcaccacctcagccaatatgacagcaactctttcaatatagctctgtatccttgggtgtctctctgcatagtcctgatcttcatgggaagagtgggtgagaagagataaaagaccagagaaagcatgaaataggaaagggaaggtgagggttgtcatggaccacatttgtcttgctctcatctcaccataccacttgacatttgactgaacatgtcacatttcttaatctgtctatttttgaaatcataaattctgtgagagtgaagacagttctttattctaattcattcccagagctgggcataacaacaggaaaacagtggctctttggtaaatattaagtgaataatcatcacatggacagaccttgggtctagaaaattatggagcagataagttgtctctggcttggatcagttagtttctaggtccattgaatgggaataacaaggtttttataggattgtgttaagaactattaaaatcattctgtcagcagaacccagaacttggtaagttctgcaactgttagattctagaccttaactcctcaccatcagttcctcacacgaggcctgtcctgtaaatgagttagcattacctcatatagtctaagtagatggtactatcattacaggtgattttattttagaaagtgacgaccccttttaaaacaaacgggattagctggtgtggtggtttgaagaagagtggcccccaaaggctcatatattggaatgctgagtcaccaaggagtggaactgtttgaaaagattagaaggagtggccttctttggaggaagtgtgtcactaggggtgggcttgtttgaagtatagaaatccatgcaaggcccaggttcagtctcaagctcagtctcctcttcgatccctttccctccctgcctctagccccactttctccttctacctccttccttcctttctgccctcccttcctactctgaaacaggatgtagctctcaatcccttctccagtgccttgcttactgccatgctctctgctaggatgataacagactaagcttctgaaagcctaaccaaggccccagcgaaatgctctcttttatgagttgagttggtcttgatgtctcttcacagccatagaacagtgacaaagatggttggatttaacaataattatgtaaaacacacttctcaaaagtcaggtgatgctgaaatacacagaaagtacatgcaagtgctactctagcctgacagcaaaacaaaaccatcgcagcaattgccacgctggtgtccctcttcttagggacatgttccattcgatgttgtccatatgtctttggtatctggcaccatgtactcaagcagatgtctttgcctgcccactcccaaactgttcttctgtttctttctggccaagtatttctgtttgtttgtgagatggagggaccatgtgcttcaaaggaggtccttcctagtctcagaaagtaaagaaggtcacagctgttctacccttcttgctaatctgcatgtggttaagtctgggcaataagtcaggaggggcagagtgagggccagttaagattttgtagacttgcaaaagagatctgtgagaagagacactctctttcctgtttctaaatgtagcaacagacagatatgacatttggaatgctaacagtcgtttcaaccaccaaattcccagtaactttaacagaatcactgagtagccaatgggggacatgactctagcaaggattcctattctatggaataaaaagtgaccctaatgtgcaagtcctctgtggatggaagtcaaaggcatcctgaactctaacatgccaaccactacctctttactataaacctcactgttgcatgcagatatctctaaacaacgagtagataataacaacctctataagtctaactactcccttatacagtcatttctcagtattcaaggaggattggttgcaggaactacacaggcatttaaatctttggatatcgaaccccttcctataaaatgacagaatattttcacataacatacatacccttcagcatgttctgctacctttagattacatctaagtaagaataatcaaaatagttgttatactgtattgtttaaggctgcttgtaagcaaaactgtacatttctactactgatgcatttgttgtcaatattttccatcttctgtgggttgagcccacagaagcagaacccacaggcgcaggggaccaattgtacttcatgaaacacattatacggatcatttcattcttgatgctcacagcaaatctatgtggtcaaaatgattaaccctattttttcacatgagaaagaaagaagagaaaaacagaggaagtaagtggaggacttagaaggtgacaagggtctattagtagcgtctggcttttcttccacagttccaaaccccagcattcatagttgataaggactccaaaaatgtgacaagaccaccagctgtggctcacaacctgcaaggtgagcccccctcctccctctattcaacctcccagctggtccttagtgtttagcttctcctaattaccttgattctcgaatctgaaaaacaataatattctctaatagcttcctcctataattccgtggagcaggtcccctcaatagaaagtccttaattttaattgcatattatgttccctttctgagggcagacagatatttattcatccagctaattgttctggagacaaagacatggaacatatcacaccaaattaaggagctgttagttgttgctgcagttaggacccagctttcccctgcttttctttctggtatctcctgaggaaatcttggcatttattttttaaaactatttttttttttggctcaacccagctatgattatacagaggccaacaaatcctagttgtatccttactggtgatgataaaatgattaagacagatatgtagatgtgtcagatctatggttctacagtgtaagcaggagcagtgttaaaacagtacttattcagtactcacccaggtaatatggctgagcatgagaaaattcagttcattctctcatcttgtgcaaaatctcattgagcagagactatcactattgctttgactgatggacatcaaacaaccaagaactatactcaaagtctatataacatcgtgtgggttttaaactaaggtgagacctaaatacatgctttaaggctgtgaaaaaaaatggtgagccctcccaacatcaaaacatacacatgagattgaggtgaactccttaaatcccatttcattgacatatttaccttcacagacacgatggaatttttccaaacatgagtggattgagctaaacaccagaatctgggtaaagagacactggtgttcacacaactcagcccactcctctgcatccaagcagtagaaggtgcagagcccatcctgcacccaccctgctcccttcaccatctcccactctcataaccatggctgagtgatttgtccactacatttaagaggaataagagccagtggtcgttaataggccaggtttctcagctacaccactaagaatgacagcctgctttaagtggagtggttataagtagcatcatgtcctatagagaatatcagggttctttacttccaggcccctataaagttaaaagagccagaagtggtagaataaaataatgaagatttttctcgtggatggaaaattccctggaggcagatgtcagaatcaaatggagtagcttatgttataaactgttgggggttggggggagagaggggaggaaagggtggaataaacataagaagaagaaagtaggaagaaggtatctcatggactcagactaacaaaaagttccagagcttcggccttgcagagggcactgcaatctctcacaccgcaacctgcttccagaaggttgtgagttcaagagtcttcttccaacccggggagggatcaagcctttcttattggtgcttggatgctcttatgacccatccaaagtaggcaagggctatctcttcaaaatgtctttcaggatgctgcagaacatcttgtcaaggtaactcctgcgaacctcaccaacagccagcaactaggacccattctttcagtgagtacttactgagcacctactgccaaccaggtgcttttctagctgcttagaataatcagtgaatggccaaatgccacaccaccagtgttgatgaaccccacagctcagctgtgaatcccagaagtccagacccacagagtaccatttcctttagtcaggtgatgccccggatggttagacggttgtagaggccagtggtggggacaggggtcttctgagtcacacaaagcaacagagaattgaggactgaactttctagacatgagggtagagccctgctgaacaatatcacatctccctatgagcctgggagtcaacagtgagatccgtcaccatcatggcccctgctccctgtgttaccaaggcaacagcagtgtcccagccacacaaattatcaatgcagtaacacctcttttgcagattgtactgtagagttgtaaatgatgtgtacttcaatattctacaggtttctgatgttatttgttttataagagtcaaatttcctaaaagaggctagacccaaggcacagaggta

SEQ ID NO: 162 - DNA, 1600 bp, Mus musculus
ctcaaaaccccctttttccacctctccaagtacctccctagatttcttaagccatcccatagaaaaagcttgggttaaacattggcaggctttcccatcagtgtacagcttgcctgcctttcagttttatcatgagacactagatactatcccctcttccctgtaccgtacattttaaaattttatttttgacagttgtgtgtatgtaatgcatgctgactgctatcacccaccctcttctatctacagtctgccaccccacccccaacccctttccaacaagtcccttttccacattggtgtctgtaagctttgtgtttggacccactgcgttttaccatggccacctgcaagaacatgggtgtggatctgttcactggagtttggtgggctcactagttgctacacaaataaagatgatgacactcctttcctcctgcatctgtcaacagccagtagagcccaggtaagggtaggtcttcattagtcccccagtttgctcttccaggccaagtctcgtgcagtcagccagagtttctgtgaggccccgattgcaatgctgtagacatatccaggaagaatagccctcttccctgtcatctggctcttacattttttttcctttcctcttgtttcctggacaatagggtttgtaatatggatatccagtttaggactgagcacacagcagcagtcatctattcttagcaccccgagcagccacgagcctttgccttcacctatatttgctgtaaatagaggcttcttcatcaaggctgagagcagcactaatctctgtataagcataaatatttaaaaggcacttgtatgacatgagcattcagtagaagagcctgtagggcctgtgatcttcccagccatggatttttgactgggattacaccaccaggtatgtattcctaactatagtgcagggatcagatccagaaagcagtaggttaccctaacaatggatgtgttccagttgcaccactgtggctgaatggtgtcatgaaatacaaggtccataactgcataaaccattgttgtcttttctccttcaaccgcccagcgagcacttctctgccgtgataaggtgggagctttgagatcagttctggcttgattcctctatatcctgcagccaaagtgtgtgaagtcttcagcagtgggtcttaccctcactggttctggtgggcagccaagaacattggcaataccagtactggccagtaactcattaaaaaaagtcatttcctacatcatgttggcattttcatttggtcatgagaaacatgagtgcaaaaggtagagttggttaggtattgtttctgggtgtggtaccgttaatcttcaggactctaaagccagatagataccagtatcctgatagtgaaggcgactagatggacctgtatgatgtcttatttttgaattaagaaccaatttggaatttgaagccactttttaatacttaagtcttctcagttaaagtcttctttccatattattaatgtatgctcacttattgcttgtgtcaaaaactagatagttgtgcttatctggaggctgtaggttaatatgctgttctgagaacatg

SEQ ID NO: 163 - DNA, 1550 bp, Mus musculus
tgagtgagtagtactctgatcctttcaatgtaccggtgcatccaaatccaccctgtctcaggcaatgtctgctgactctgtactctgagaacatctttcatttacctcttctgtgctgcgtgcatctcagaagctgtatttactacttaatagctctgtctgatcaatctctagcatgcactaattacttcataaacatttgtggctttttcttttctttttcttgttttgtttttgtttttgagactggtcttactgtgtagcttatgccagccttgtctttttgattctcctgcctcagctgcctgagtgctttgagatcaggcatgtgcaaccatagccagtagaaaaactggtaagaagacaacccctgttttgttttcattttcagtgtatgtaaagttttattattttatgtgtatgggtgttttacctgcatgtacatatgtgtaccgtgtccatgcatgcagtgttcacagaagccagaagagggaatcagaccccttgaaactggagttacagatggtagtgagcccccatgtgagtgctgggagtcctctggaagaatagccagtggacctgggtcctcaggaagagtagcagtgatcttaaccactgagtcacggctctagcatccagtccctgtgcttatggagtgtatacatattctaatgagcccttagagatcttcctgggcttgattatttattcaccttcttttggctggaccaaatgtgatggaggttacagaacagctgatatcagtccaatagcatttaccttacatgaactagtaattgctcatgtctctgggatgaggcagacctatgagcaacagtgtttcaggtgaagaaacagaggcaataaagcttaaagcttaacagcatgaactcatacattagaatgcctgggtttaaatcctggctttagtgctaagtaactgtgatagtcagtaaattactcccatgtctctttacctgtttcttcagtaccctaatacattttttttaatcaagtaataattgcaaagtatataaaaccctacctgacaccaataaaagtcctatatactcctttaagggattttatcattactttttgataaatgtgttgtgatttggatctacacatttctgattccaaatctggagggcagcaacttgcagtgtattgctctttggcagtgagactcagcctcggaccataacttagaacatcctactgtttttgacagtacttgtcaccaggtggagagattagcaacaaaacaaagaaaatagagaatgagattgttaaaaaaaaagccatattcttttgttttaatgcttatcttggtgcatttgacataggtaaataaaaggtttttggctttgctatgttgcactgagatttgggttctagtatgaccttggagaaatcatgcaacttcttgcaagtaattctagaatagtagttaactgcgaagaagtctgacgtctgtggcagaagttttctgcataatttcatgttaaaaaacccaaaaccacaaaacctctttctttgaattttaa

SEQ ID NO: 164 - DNA, 1725 bp, Mus musculus
acctaattgtctttcaagcatggcctctttttttttttttttgtctggatgagatagactgcctggccagcaagctccggtgattctcctggctctacatctaaaatgggattacaggtacacaccacaccaggcttaacttttcatgcctatattggaacctatgtctatactcatatttgcaggcaaatgcattactgactgagacatctccctagaacccaagtcagagagtttgaagaatcttcttcctaaataggacttagaatcaaaacattataaatttatttataaaatgagtataaacacacttttcccattttttaaattggaaatatctcaaaggtgatgttatcatgaagagtcataaatagtaagttaagcaaaagacagtggacacaacactttgctgaactggcagtggaatagagggcaaagacaagcttcttttttgttttttaacttcaattaatatctttgggagcaagcagcacattaatacatcttgaattgatgctatattaggcaatgcagtaaacatagataatgacttagaaactacttccctgaaacttgaaaaggttacaaatatggactcaaatcaaaatgagattaaactggagagaaagtaaactcgtacatctgggaagaaattgaatcggcttcgaggtcctcctgagaaatctggtggaagatctggagcaagcgaggaagctaaatcaaacgaaatttacaatataatgtttgagcgaaaaagtcagtgtggtgggagctgcaaagaggagaaatcttacaaagcaaagaagaaaatgaaacaggaagcggcaatcaagtccattcttacgggtttggaggctgctagtccctgtgacgtattgacaatccagccaactagtcggaaaacgagggtagttatttgagaagaaaaggctttaataaacaaaatagattcagggaacaacccgaaggcccacagcgagccctgcaaagtgtgttgatagtctctgcagcttgtgctatttgataattatttgctttggcctctgtgattctacctcccccgtcctcctctctcctcatatctaccgccgctgcccctgcccagtttcccacatcttttgcctgggtatcactacttagctggtttactggctttgctcatgctgttgcttcagagtaaatgactctggctaccaattccgtctaaagagcaaaacccataaaggcaacaactccaaaagtgcctaatacatttgcacccttccgttcttcagtgtagttcaagtgctagctcagctaactgctgtggatcccctctgaggttagagctagttctttctcagctgtagctatgctattgcttacacagactgtgttaatgaggtgtacactccacctggtaaatctgaagcttctttgtaaccaaaaacaaaatgtcatttatttgattcattacttcaattttattttacaactagccactctaccttgtataccaggggcatttaatacatgtttattattcgattaaaagtgaaaaactgtatcattatttctagaagtggaattcagctttgccaagagaccaaagttagagtgacccatggtccaggcacacacacacacacacacacacacacacacacacacacacctggagatggcagaagaaattaacacttagtgagtgaagattgctgtttgccaggctctacagcaggctct

SEQ ID NO: 165 - DNA, 1575 bp, Mus musculus
taaaatcccactaaagctccatctacattgtattgattaacttactccccatttaaattatttactgtagaaaagattagttaatctgagcactaacctgaattctctatgaaggaaccattgcagatttttttttccatttggtaatccttatttagactggaaaattaaaaataaaacagcattaataaagctaagtcatttcttattaatgcatgcaggtttatatgcaatttaaaagatctgatggtagattaactttggggatttgcttgaatctttaaggtgctctttattattaaatggagtttctcttgcttatctaaggatgggcttcagtttgctttcaaatctgaaaatatgaaaggatcataaacgtacattgagtcagtgctaccaaattccaccagagctagtcttaagagtactttaggaagatgtatattgatttttcagaacacaaagatcttccctgagcagctcttcccggctccattattggcaggacagtttctacggaaggattctctgacatattatttctgcactgacatacttacagatggttccactgtagctgaactgctgaggtctctctcagcttaatcaagaatgcttattttacacttttaaaagcatatcaaatgtgaagcaataataattaagcctcttatttttatgaagccttcagagatctgtgaaaaaaggcaacatgtagtactttgtaaatgtcaaatctctttacagaaatgcgaaggaggtatttcaggctgtcatctgttcttcatgctgcctactgaccctcattgggagctaccgattctagaagattctgtgcccactgaaataaatagctcactcaggcacaaagcaagatgttggacaacatacaggacagcagcacccactttaattctaccatgcagtgtgtttcataaagaaatgggaactagaagcttagacattaaagaacagttgcagttggcaggcaaggaaggtgaatgcctttagttccactgtgacaaatgacaagatttggaacaaggaagctgtgtttcaggcatgtaaaaacagaaaaaggataatactttttttttttttttactatcctcaagaaggaatatttaacatgaaaattaaaagtagggttgtcccaatgccaagtaaatttgaggagtgtaaagaatgaagctggaattagaatgtttatcaggtatatacggatgtgtccccatcaacatctgatctatgctctggactgtctcatgtaaattcaagatccggagctaaaactgtccattgtgtttgcctggaattatttaaaaatagcttatcatttacaaaaatatcagttctacatgaaaatatatatgacaactccagatataggccaaaatcatgattaaggaagcatggtacagataggcaaggtgacacacacctttaataccttggcatgccaaggcaggtggatctctgaagtcctaaagctctgtcatagccacattggttactggctacactggcatcatcaaggaaattcccatctggtcattaaactcatcaaatatttca

SEQ ID NO: 166 - DNA, 1975 bp, Mus musculus
gcggaggaaattaaccatgcaaaccttttataataaccctgttccttaaatataaagaagagaaattattagcccacatctgaaagacatgagatgagtttttaactatagacatgttattcgtgtccattaaagttctctcaactcagaagatatatttatttgcctatcattctgctcttgtggaaaagacagaaaggagagaaaagaaaggaaaagaaaggaaaagaaaagaacagaaaagaaaagaaaggaaaagaagaatagagaaatcattatatcactattttgaaattatgataaaagtggatatacaaaagtgtttttagtaaggtagaattcctatagagtataataatttggattttatctttaatgaactcttagagttgatcctatttcataaattactgtactataaaataaaactttaaaaaatttttattttagctccaagaatgatttttgttttgttttgttttggtttggtttggttgttttgttggtattgctaagctattcatgaaattcacctttaaggagggctcctgttcatttttagctccagaattcttcacgtctcaaaatttggcttactgtacattttcaaatactcttctgtggaaactaaaagacgatctagggaaatctgggtaaattccatcacagcaatttatcatatagcaaaccaaagggagataaactaacggagactggacaggacttgagtgttatgtttaggaaggcaaagcttttacacgtattttcactatacttccctgtgcctgccattagagatgatcagttttgggagctcttctctcttctcctcacatctatttcaccactttaatgttctggggtttcagtgctcccttcctccctccctcctgttgtgacaagcagctgttgaggacaactatggcattttgctgtatcgtttaatttttcaccagagctttatgtaataaatctgctgtcagcctgcttttttgtgtcactctaagacacacgaggaatgaagctctgaggacagtaaaccatagtacactcatttcttcatggctaaaaacaatggatcaacagctaaatgaaaccgtctgcctcttcgacgttgcgaaatccatgttgagcccttcagcatgtttttatcacaataccaaacaagctctcacctgcataaaatagatcggctgctctgcatcagccactcagttctgcaggcatcttaatcaaaactagcaactcattctaacctggaagttgctcactacagtaactggtccaaagacaggaactaaatctcagttactaatagcagaagtaaacatgatatttatttatttttatctttctgacatataaaatgcaaagtggatttggagagtaggcaaaacagtggttatacatgtcaaatacctgtcctgaaagccaaagatatcagtcaactccactaatgtcgatttcatctcctgcagatgctttttgacgatttctaaggtcactttcagctccaatgaggtatgctactctaaggtcttaaatcacatagtgcttctaactcacatatacatgacttacagcaaggcactgactgtgcaatgcaactcagtatgctcattacagtttgttataaagagggagaagtttaaccttatttggagcacatggcatagagattaagcaggaagtgcactttacaatatacttgcaaagtggtatctgtcctcttctttctctgtatgaatttaataccggatgcaatcagcatgcctaatgaagtgtaaacctcacacctgcctcggcatgctacatgctacccctcatctcatgacgcgtctcccttccgtgctttcattatcgatgtaaattgtttaataagagtgatcagttaggaaaagcactgtctacatttaggccccaatgtgacaaagtctattcttgtatgcagtgttgagattttccctgacaagtc

SEQ ID NO: 167 - DNA, 1675 bp, Mus musculus
gcagtgctgagagaagggaagcatcccgagaaataggtagtgacttaagagattgttgctggagccttcgggagaacagaccagaaagaaaacaccaaggggcaaattggagtaataaagaataagacatcatcaaaaaaatatttttataagatagtaaatgatgcaaaataacttgttctcctgagatgtaagaacttttaacaccgtgtcatccaatccttagagactgatactgttaataattgacttgggggaggtttaacttttctgttaccagtttgctgatactgctgtttttcgctgcaaaatggcttttgggtaagtaacagccttccatttcaaatctgtctgccctgctgacgctttctgatcacattgcttactcagaccaggtgtttcatgaatccagctttaagtgccagtaatgaagcaccttggagggcccgcgtctcagcgcagatggatgtagttctgaagtacgaagtctctggtgtgcagaaatttggaaatctaaagcaaagagcaaatagttttcttgtgtaatgttaatgccttttctcttcttctttcggaagtaggcaggcttcgtgtgtcagaaatggatgttatttttcctgcattatggcaccaagggaagatctgtgagcctgcgaagctttcgccctcattatgctgtatatggggaagcactaagaaatatgaactccttccgcgctgcagactaaaagatttcatttcatctggaggggaaatgtgccaaagaggctgaaaataattcaagtaattggcaaagagctgtactctaaggagccttttggtgtaatttgattttgtgccttttaggggagcaagtgagatgtgatgctttctggccccgagaggcgagagatttttaaacattacagaatccttcaggtagacgaggatgaactatgatgtcaaacgacaacctagaattatatccttaagatataataatcacaataaagacagtcctccgctgagttacagcaagttcctcgctgtacatagtttgaacttagaagcagccttacccaagagttagatgcttccagcctacaaaatcacagaactactggtaagacccgtaagtactgaaaacacagaaagaaaatcatcaactcactcagaaccatccatgtatggatagacattcatggcgttatacaacaatgaccctacttaggcaagcaatagatttgtggggtagacaagttggtatcagcacactcccaactaggttgcatcagcattcagtcttatcagggtgtttctgcaagtgtttgatctttttcaaataggagcttagatctatccattttcaatttattctccctcccccactgcaaaggaaaggacctctgtatgtaatatttcatggttagaaaatgtaattttcttccaaattattacagtggtgaaattttaagcacatttaatacaaaaaaaagttaaacattaatatttttctgggatgttagtggaagacaaaaagaacattaatatcattcttgtggaaacaagtctattttatttgctaaaagtttcataagctgagacaaagctttgctaatggacactgtaagaagacataaacatgttaaactcaatgacaaatgtatagagggccaattcagagtaagtactctaa

SEQ ID NO: 168 - DNA, 2250 bp, Mus musculus
gtttagatttttagcctgtaaagccatctgaaaaccatgtcttccactctataacctctctctcaatgttaaacaacaagagtttgattatgaggttaaaactagatctcaaccccatcacaaatctgagaatgagttaaacattacctgtatataggaagcactaaacatagcatctcaaacttaaacaattgtagagacagctgacgacctggacagccccccgccccaattctttaaaatgttggagatcagtcttcagccatctggcccagattcatctgttgacctttcgaaagcaggattatgaaagaggaatgtttaccctgtgttggcagagctaacagttgactattctgcataaggtgtccttttcctggacagtattttgactgcagatgaaataagcaatttctggcctgtggttaccttgccccaataagcaacttcacctggagataaagatactcatgtctaagcactcccattgtgtagaaccactttgcaaggtcttgatcaacctgtctactgagtttgaaaagcattagaagagacattctattcaagccattagtacatgcccattaagtagtctcagggtttggtgataattgtcattcagatggatttactaacaaggcataatagcaggtatcagaaaaagggggagtgcctaggtcaagtcctttcatatttatttgggcttcccccagccactgaattttggcaatcaataggcttatagtctgggtagttcctattcctatgcagtataatggaagcatgtctaaaaattgccagcaatcctggccaatttctggctggaaaaaattaactgtattccttgagtctattcctatggcatatagtgtaattcttcagggtttcccaatttccaacacaatctttctttttttttttttttttaagaatgtcaggcagagtttattttggctgactcatggtaaccagatcttatatagagagggtgggactcatgtatcacttcagaaaatgcttttaagtttagtcttatatattttacagagaaggaaaagagagaaataacttcatgaaggataacacccaagaaagcaaatgatcaaggcagctttacagcaacacacaaatctgcccaacactagtgtttactagtggtttgttggtgttaaatagccatggaggctactggaccatagaggggctggagaaagtcagattgctttttgttattgttttattttattttattttattttttttttccttttttttttattaggtatttagctcatttacatttccaatgctataccaaaagtcccccttacccacccaccccctctcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggccaacacaatctttcaaggatagttggaatcttccttgttcctggtacttagggcacctagctgcagagtatatatagaattttaaactgtttctaacttggaacataagtccccacatcttaattttcctggtataacaagactcttaaagtgtatatcaataagcaaatattaaaatagaatatggattgctggtctgtagccacattagctatcatcacattccctgtatctgtcttcccaggcccaggcctgacaattgtgggcattggatggtaatcttgtatttataccaaacaagagtcaggagaaggtagaggggtattgag

SEQ ID NO: 169 - DNA, 2775 bp, Mus musculus
tagttaatagaagacagtgcttcttaagtatattgtccatttttggaagatattacagttaattatatcattctgatctcggtggaaggggaacttgagccaactggaaaagctgtggtcagcatttttgaattctactcttaattcattctaagatctcatatatatatatatatatatatatatatatatatatataatgtatatattatgtatatatgtgtctatacacacacatatatatattcatatattctgatttatctttctaattctgcctttcaatgggagagaaatttcagatatcctgaacattatatttgtgtggtaaaggtttccagttgttatcttcacagtgtgtcatttactttatataaatgtataaattgcattcccatttcacagggaaagaccaagctgcttcaatgatttctttgagctcttcaaactaatgtatatattcagagtcagaattaaacctaggtctgtctgactccaaagcctaaatacaaagtgctatagctcttctccaccccctccttcttatattgcactttataacaattaatattagcctttcttacaaaagaaggatcaggaggaggaagaccaggaggaggaggaccaggaggaggaggaggaggaccaggaggaggagaaggaggaggagaggcagacttttggagcaatttttaaaccatttcccttgcaggctgggaatgactggctcataaaaagatggcaaggtgaaacttcagtcagggcaaacacctgctatctacctagcatggcagctgctacaagtttagcaaattcctcattggcacatgacttcatctttgatagccttttccctcagtgcagaacaaaagagaggttggctctaggatcagctaaaagtgagaaacctgaaattgactcagtgttttgagccagggtcttaggtgtgaaggaagctttggcttttctggcttgccttgtcactaaagggttggggaaagaagtattgataaggaagcataagctaatctgatgcactttaaactgagacattcaggagaggcctgggtttcagtgttaattctttacagaccagttagtgactgactgatctcgccatccatttaggtgtcagcacttttttatatgggaaattgagagagccaggctaagaaatggcagggattcttgtcagccagcaaagttctcttattggtgtcaagcaagattcctatgcatagcatgtgtagtcccaatggatttacagtagatttgaacaatgctactgaaaaacactgaccataggtccctaacagaattactgcacatgaatcctagctgccataccagaaatgtgttcattaatctgtgcatgcacatattatgctcaaactttctcagtattggggtctgcctccggctcattcactgcactaaagacctactttaaatcaaatcaaattatgtttctatgtacttcttaatgctgctgttttcaatcccttgtgcttttataggaataagtttaattaacatgcaaagtattagatttcattgttgtatttcaagaaaagtctgtttatgtggatgcttctctctgctttgctcctctgtaccccatttacctcctgtgctttacacctccggtagtctccgccttactctgccatacatgcctgctggacccctctccttccataactacccctcagtcccctgtctagtgtcatagtctgtaacttcttcccaccctcttataaaattatcgggtgagaggaatacgatgcctgtctttctgagtctgagtcaccctgcttaatacagtattgtaaaagaagatattaataagtggttgctctcctacatccttctcatattctttctctcagctggtctgaggaggtattccttgaggtttcaggacaccaaaggttagtaataaaagtggggttggaagtcagggtaacgtgacaaatgtgactgatgcctcccatccccttaggaaagactcccttcccctttctgctactttaaggcatatgataatgagttttctttcatcatttcaactttaaatttttttttattacagctagactttaaaatacatttgggtaacatctggtacttttaacccactggctattgcatcctgattagggcatgttgcatttaatttcgtcttagaattgatcagagtatgtccaggactattttagttatgttcagacatttatgggtgtgttaaatataagcatttttgaaggtgacatctgaaaatggcaaacttctaggtctcccaccccgcccccaaatcatgaattacacttccgtttcttctctgcatctactttgaaattggagctcttagtcccaaggtgggcctcaatagttctaatttacgaatgtcatgtatttatttcagaacaaaaatactaacagaaaatagggtagtgggggaaaacatcaaggaaacgtgtggcagcttattgggtaactgttctctcttgaaaaaccctcgcctccatcgcgtatgcttgggcgagtctcttggagaagcgtaaagctgattgcagtcattcagcaaagcctgaaaatgctgaaattagatttaaccctttttaaaaggagcattttgcaagctcatttgcaggaactatacagcatctcaatgctgagctcctgtctcctaagtacattaacaacatcagagaacacagcacacgagaaccatacataggagcaagaatatcttggagaggcgacacataaaat

SEQ ID NO: 170 - DNA, 1800 bp, Mus musculus
aggtgcagatgtggcatgcattagctgggccagcctatgagcagagagcaaagagcttgtgctggaaaagaacaaaaggagaaccagtttgtgaaccacttaaggccctgctttagggttatctaactctacgggtaggggactctattgtgattttgtgtaaatgacggcacacatagtattgttgaaagtttaactgtgacttcagctgtgagcaggagcaggaaggagcaggaaggagcaggagcaggaaggagcaagaataggttgaggtttgctacaaaggaaaattttcgagtttacccttggattggcatgattgaaggaagccttggaaccagtgtgaatgccagatgctgtgtgtgtatgtgtgtctgtgtctgtgtctgtgtctgtgtctgtgtctgtgtctgtgtctgtgtgtagtacagggggattgaacccgagtgttggcacatggcaactatacattatactacgcagcaacatctcctgactcagatgtctcttaaattagccacaggaaattcaggaagaagggaaagtacctttttgcaggagatgtgatatggttttgggtgttaaataggaggtgacggtgctgtgttaaagcaaagatagctgacagtcccttagagctaaaagcctgagtgaaaagccattgtatagagcatgcagatgctgctcctcggacttaaattgaaactgcagtagtaagcaaatgtcttagagaacattgtaccagcttagaatatgagaccgagccctgtactctggacatctccagtgactggaggaaggtaggagaaggacactgccagaaatacaaatgaaatggaatatactcgggtcaacacagcacattggccagaggggaaagaactaagggaagggatcatagaaatgaaactatcagggtgatgccaaatgctataacattcatagaaagccaagaactggtccctggcttgaagcctgctggtgacgatcaaaaacagactctgaggactgaagagtgggtgcggtgagacagcagattactatcagtaacctgcttcctagggagatggtggtcaaatgcagtgctgaaccgagaatagacagctaagtaaagagatactagacggccttgttttattgcaggcagaagtgaaacactggtggacaaaggtgaagggaagccagtggcagtgctgagtggtagggggcagtcaacgggactaatgctttcctgagactggagctttttaaagcactgatgatctaagctaggatgtaacgtggattcctttagcagtattgagagatgcaaaagcttgttaagatgcaggcttgcaatcctttgttttttgtgtgtcagtggggagaggagaggtgtgagtcccctgtgagcagtggtagaataaatgggcagtgtgcttttgctgcctagaggcgaatgaagcaacaatggatggtcaggaaaggcctgatggagaagtgattttcactgagcacttaaagaagggttagattcacagaagtgaaactgggggcatgtcttctgggaataatatattctgcatgtgcaaacaccagtcatttagaaagcaaagattcttggtgactgtagagttctgactttattctattctatcctaatagtaacacagcaaggagttttacatatgaccaggcttcaggtactgacttttaagcactctgtagatactcttagccagcggcacaatcaccaagatccttaatgtttttactaactttatagatgaagaattagaagtgtcagtttgtaccagccgc

SEQ ID NO: 171 - DNA, 1525 bp, Mus musculus
aatcccttctctgcacacttgtttggactcatcctgcacttaaccagctaaagaagctcgagacatccatggaattattaactgtttgtcattttctccatttcttttaaatagcaggagttgttagcctgctgcaggggaggcttactgaggagaggcttagcctagctccatcgtgcatgtcagagtaactacggaagaagacaggccttcaaggaatcaaatatcagctgttacataaaagtaaacgggacaacagaaagggcaatgaattgtttaggacatctgttctcaacctgtaagttgcaaccacttgagtggttaaatgaaccttacaaacacagacacacagacacacggtatcatgtatataaaatccttgcattatgattcacagcagtagcaaaattacagttatgaagtagtagtaaaataattttatggtggtaggtcggcacaacatgaggaactgtagttaaaggcagagctaggaaggttgagaacaagtctagggtgaacaatgtcaacattaccagagatctaagaaattcaaaggataattatatatcaagagtgtagtttcaagtaacattgctaagttaccacccactgtgctatctgaaactgattgtcttgaatcctggggtaagtagcacaccctctttctgatcagaaagcactcaagcccatgaatcataggtaaagccccagtggagtaaacactacaagcaaagatggagggaggtgagagagaagacaggataataaatataggtcacttggtctggttctagttcagcagtccataccatgctcatctatgggctatgccaatgcaaataacaccaaaattaagaacatggatctggatgatattgaatgtttcagggcagtacggcgatagagtataatactctttggataacacagaatattatttctggactagagaaatggttcagcagtttagaccaggactcaattgccagatcctacatgctggctcacaattacttgcaaccccagttccagggatctaattccttccatgggcaccaggaagacatatggtatatatgtttacatgtaggcaaaacatatgcatatataatataaaataaataaatctgaaacagaaggtcttgtttcaaatgagtcatttgctcaatggtggaacatacacctatttctcaaaaatatttaacaatttgcatagacaaaggcctatagtacttggctacatggttctatttcctattgaaaactaaaaaatataagttaaaagggctttttccacaaagtcagtaactatcctagacttgattgcacttgcagtttgtaaatgtaagaagatgttgtgggatgagcccatttcataaattaaaggggcatagggaactgaacatagacattagcatatcagcatccctgcctcagatatctttagtatctaatgttttgcctctaaggatttgtactatgcaagcattttcctggttaatgtctcaataagaaatttgcttgg

SEQ ID NO: 172 - DNA, 2625 bp, Mus musculus
tgtcatttaattctattaagctgtctgggatttttagaagaatggtcgtctcgtgtgggaaagataacagattgagcacggaagggacttttctaaggagtagctgggacaggcaaagactgggcggtaggagtaacacctctcatggtggttcgaacatttggtgttaatctctaggcagcagcgagtgacacaaatccagttctctatatatgctatgcacttcaggttctggttaaagttcccataacagctgatcacatatgtacgattagaagttattcagttacctttcatatcaatagagctaaccccttaaagagaaagagatttaggaaaggtttctgtatgagtactaagggtagtactcatgatgtggcctagtctggtcttagacttccagaaccatcctgccccagactgcccagtataattatagttaagaaccactctgtcggggttaaatgcctattctagacttcatatattcttcaatgcagactaactttaacatggatgctctgaatctaaaagcaaattcagtgtgtgaattcttttcttcagaaaccatgcatttcatttagtaaacataaacagtgcactgtgcaatcatattttccatgtatgggttactaatgcctaccatttttcttttcttgtgtcaccaaggtctgtggtgattactcattggcacacaaccacagaggctggtctggctttctgttggctgcattaagagaactctatggaacatttaaatggctggcagtgtgtatttgctttcataatatggtgagacttgtgtttacccttcttttccatgttacttgaaacccaaagagcacatacgttctcttaaataaggtactcttatatgaattagtaattgaatgcataataggtaagcgctgcagtagctctatctccctgggaagggctgtagtcatactcatgaagatcttcctggagactctagaagaggttaggaagggagttgtttggtgtgtccatctctgcaatccctcttagctgttatttgtattatttcttaaggcatttactccctacagactcggtgacagtgtatataacatatatttttcaagtttgggggtgtcagtataaagcctattttaactctttccaaaaggaactggaatgctacaaattaaataaagtcctttgcacttcttgcataatgtaaaaaaaataccatctgcaatataaatctgttgactatatgttgcttccagtattttgaacatctacacctgtcctactatattcagggtgagatctttgcatatcacttagtgtcctcctacacggtgtgctttgaaacatgtgttttcagatatggatgattaaaatatcaaggcagtgaagcattatacaaagacaatttctttcaaaaaaaaagtgtctatcactcctctagtttctatcctagaaggctgtagagtattaaatagtgaatggcaaatatttggtttctggaaaaaaatgaaatttgggttagtagaatttatgcacattagagactggtccagactattttaattgacaaggcataaagtgaacatgatgctatggtgaagaagagctaggattttgaagaccagtgcctctcctgaggaatggaaagccaggacaattggatccttcccgtgactcttatcctttataactagaccattatctgaaaagtgttctggtcaagcacattaagatttatgagcccttcctgacaaatgatgctcagggaacctggcccggtacagagaaggaaagggcagagaggctctgcagggtaagtgaagtaactcctttacccatgcttcgttgatttaaacagctcagttcatattttttgcttatgaaaatcccggtcacataccatgaacttcctgtctcaagaaatctgctctcccgcactttccatgttttaatgtttgtattcacatctttgccttttaagttcttctctcctcttaaaaactaaaatgattataagcaaaataaagaccatgagccattgttcaaaaatcttactcaaaccctttagtagaaaatacatactgcttatcccttgccttaagggggaatacttaacaatttaaatcttaagggattctattactaatgtacgtgtagaagggatatgtgaaaagatattggagtagattttactctgtatgagtaacttaaaaattttttttctaaatttggcttgagagtagagccagagcaaatcctttgcttctttttgtacaatgtccttcactgcccatatagacccagagaagttagttatcttgactcaggtaggtgttgagtcatgagtttggaaatcaaatcctatacgttgaaattccctctgaagctaaaataaagctttaggttgacacgatagaaaatgaatataatattactaagagatactgaatctggatataggtttcagtatttaaatgcactaaaaatgatctattgctcctaacaacaatcctgaataaaaagcaaagagattattgtccttaagcagataccattatgtaattcccttctacatgtatgcattctgaagacagaaatcatgttcatttttatagcatcaaaatgtga

SEQ ID NO: 173 - DNA, 2800 bp, Mus musculus
caggaaatatttatgaaatgaatacaaagttaatgtgaggccaggacagaaagacatgcgcgtatggaccaggtataggcttttctggtcagtacagggcagcctggcatacctagggaattatgaatatgaaagcagatttagaatactccaaaaaggaataataataataagcctagattgaagacagaagtttgcttcacaaaaatggtgatggtgagagcaaagaactcagacaatgaagtatttccttacgtttagctacaaccttaatcatgtaaggagacgcagacagataagcaagcacactgtgcagctgcctactacaggaccatgcctgttcatccaaaatgccaattatatcctccccgcaggagagaagaatatcacacactggctacttttcatttccccattaattttaattactaaaattgaatgtattattctacatttaaagtttcatattatgaattcctgctgagaatccttccgaacagcattttaaacaattgagtatttcaagtctttgttaaaacagaggtaggcaagacagaacactacatttcttgcaaacctgcatttattatacattgccgttatgctcccaacctcatagggaagagacagcttttgaaaccccaaataaatactttgggagattttgttctgaagaaagacaaggcttctccagcaagacagttgaacggaaatactagccatccctgtcagctccgtaaccctccccagatttgtgacatgttaacgtgtttcttaactaatattttggatggttcccacagtcagcattagggaaatatggagcaccacccttttcctgtttctgaacaccttgtccagtttcacagatttcttcagcacagacaggaaatacaaagtacatgtcctggtagtcacaccaaggaagcctccatttgcatagccttcataattcaatttaatttttttttttttttttttggtcaagagtcctgaatgcctcgtgtttgctttaatcagaatgttgacatttacactgaagccaatttctctttttctcctccgtgttttgtttaaccacgacaagtgacagcaaactggaaagaacagactttttaaattggctccctgcccagaatgcatcatttctcctgaagctttctccctttcaatgcattgcaagaggaaatgtgaaaacactcttccaacatgagagtgaggtgttactgcttttagataaagatttgtgttgtattttaaaactagattgctgtacagtttcaagctattagcaacaacctattacactgcggctctgggtcctcggggagatatgtttagtgtatttcagtaattcacgccaaatagaatactacatgagaaaatatctaatgtcaaaagtatcggcatcctgaaagcagcaggaaacaagaagcaagcatggcttcactcaccaggtaactcaaatgttttctctgatctttccaggttatgccccaaatggtggaggggaagtcctgtctgcaaaatcagcatgcaggtaccttatctatcattctgaaaacacttcaccagaacagtcaattgctgggttccacatttgatctttggtattttcatgagactgaaactttgtatttgaattcaaatttgcataaatatcagacgtaaccatttgaattaagagtttgaacatgtttataagaaacttggacaaaactgcttgaaataaaagatatgtcccctcatggaatttaatctgcctcaacagagggagagcaaagggaaaatacaggtattgaaatcatagattttatacattaaaatcatagactcatctgctagacatttccagaaatcacagaggctccactctacccatccataagcctttgcaatatgacttcccttgtcaattgctggagagacaaaaagtgtctatgtattgggtaggtaattcttccaggctttcttacagcctacctgagctgggatccaacacaagaatcctcaaaaaatacattcatggtgaaaaccagtcacctcaacaggaatctttcaaattctgaatcatgatttattaccaagacctcaacttaattgcttatgaatgtcattttgttcactgagaaagcacagacctaaaaataacactttagactttattaactaagttttctgtgcgcagggttttagtcatagtggtgtgtgtgtgagtgtgtgtgtgtgtgtgtgtgtgtgtgtgtgtgtgtgtgtgtttgaattttctaaatacacaggctttatttctcactgaaaatgaacaaaaataataattgctaattcagtagatttggttgagactgtccccacttgtttcctttttgttaaaataaagaagctgaaacaatgtaagaaatgaaatataccttgtatgtctacttggattggcatatcaaagtccactctttgccacttgttagaaatgcaaactccttgaggaaaggagtagtgatacaatcctaactaacaaagtggttagaaaattccactattgccacctgcaagctccagactaaacaagctgagtcaggctgcttggggcaagttcagtggcaactagaaatacacagcaaaactcaaaaccaaacaactaacccactaagtaaacacaatctcttggaaaacaaagtcatgttatcagttgctacaggggaatccatcaatgtatttggctgagaataaagaggacacaattcatttaccagctagagttttagaaagcgatttctaatagaagatgatatgctttttttcttgg

SEQ ID NO: 174 - DNA, 1625 bp, Mus musculus
ctatgcagttcctgaaaagagtttaaggaactatggtaaaaatctctggttaaaatggtactgctctctgtttttatattcagaattgattataaacaaataaaatgtctgttgagggaggtatttgaacataactccccttaccagccatatttgaatctataaaaatagcaagaacagtttcttgccaccacagatttaccttggtaatttgtttatttgttatgggaaagaaagtatttatgaaaacaaacagatgaaatttagtttacctggctattgaagtcttctcgagttcagatagaaataaaggttacacactaccatgcatataaattctcagatgttaacaacagtcataagtactttttaattgaactttatatcatatattatatgaaacatttctcattagatcctaacaaaacctctacaatgagaccctgaggtttagagaagttaaggttaacatagatcatatttgtaatatgtatttcctgccttgaagggtttctgtgtcgatggatcatataacatctatctggctttatgcttgagcaaagttcattagtttatatcaccaatgagttaacagttgactaggagatttggggcagtacttctaatgcagatcgttgccatgctatctgaaaactggtatacacatgactcaaattttaattgccttgaccatcgttcttctggcatttgtaagtcatgccataatcagcacaaaaataccagatggagtgctgcgttttcagggctgatgaatagctattcaagggaaccacctcctaagattcagtgagaatcccacctaaagcctgcagtggtgtatgtggataatagaaggtgttcaacacagatgatttccttcgctcttcccgttcaaatttcaagtctatgaacatgctccatggagacgtgctctagcttcagaaaagttaaaccagattgagcccaagtctgtgaatctgtcctcagttacccacacagagcttctgggatagagtctcttcttccagagactcccacatagcattatttttatggatttgattttctaggttccacagatgcaaaaaggcacaagatttcatagtccaaaaaagaagtcagaaaacatctgaaatggagcatggcaaattcctattttcctctactccatcgaatatctaagtaaaaataacatgaacaacacacaagtacaaatgcattaggcaaaagccactatagaaggtttcttctgtcttggtataaacacacacacacacacacacacacacacacacacacacacacacacacacacacagacacacacacacacacacacacacacacacacacacacacttatcaaaatggcatataacacgctttagttgtagatccagtatgaacagaggaaccagatgaactctgatgtaggacacagcagcactgatgacctcctggagaaaagaaatatttgactcaactatcttgaaagtgtaaatcacagactatattgcaaagttaacttcttgtttagtagcttgcctagtttgtgcttagggagttcacagggaacttgcttctctctctgttatgtttataatatttttcagtactttagaggt

SEQ ID NO: 175 - DNA, 1525 bp, Mus musculus
ttctttgttttgtgtcccaggtaccctgccagtgcctgaccctggcactgttcatagggagggagttcacagggaggccagatgcccttccagaataagggcagccatagacttccggcaggctgtcagcacccactcagggcagtagaactttgagcaggtggacctatagctagcttgctttctagtaaggagccggggggctgggggggggggggaagaaattaaccttctggagaggcagagcatgtccacttgcccttctcttcagttttgcctcttccttttcttttcagccaagacagctgagatggtaaatatggtagacatgctgacacgtgataagcgtgccagaatccacgccatcacatgtatgtctgtttatgtagaaatccgcataatgtgatttggtttccccaaatagggatcaccgacctcatctcataaggatcttttcctcccagtagtgtgttttttgagctctaactaagctgataacatatctatggatataggctgatgtatatatatatagcttgatctactagctgtataatcacctaccttatgaatgttataatttgtcctatcttatcgaaaggacacttgtgcttgttctatgcttatggcctgtgatggccaatactggccgttatcttaggttgagagacatgtgggaattagtaaggcatgcctctgggtgtgtttgcttttccattcagtggctcccaaccttcctagtgctgcaaccctttaatatggttcctcatgttgtggtgacccccagccataaagttattttcattgccactccataactaattttgccactgttatggattgtaatgtaaatatttgatatgcaggatacctgatatgtgaccccaaagaggtcgtgacccacaggttgagaaccactgccataggcaatgcgttcacgaggtctctgacctaacattgatttaatacaatgaaagtgggaaatggtggacccatataagttgggaccttgttggagggagtcacctggggtgtgccgttgaaggggtgtgtcttggctctcatcctttctctcctttctgctctctctgtcttgaggtgggtgagctgttcctttgtactccgtgatctttgtcattgtgttctgccttgtccaggcacagagacaagggaccctgggctgaatcttgagatgtcaaggccctcagttttgtttatgttgattatagcttatattagttactatatcagagagccaggtagactggcacagcctataaccccagcacttagcagggagggtattgaggcatacaaagaccctatcttaaaaaacaactaaccaactgtatattaccattagacattttaattgaaaatttaaaatattaattcattacaataaacaatagtaaccccttcccccttttgtttttggacacagggtttcatgtagcccaggctggcctcactgtggagctaagggtgactttgaatttcaatccttctgtgcccattttctgag

SEQ ID NO: 176 - DNA, 1775 bp, Mus musculus
gtttatgctgttaattgcttgaatctgtcttaaatggttagaatcgtggagctgtaaagactgtcatataagcggttttgtgtttgttttgagcttaaaattgttccttttcgccttcctctgtatgataaacaaagtaattctctaagctttacagatcaaacatttacttctaatggtaaactccatttttatattgggagtttgcaacttggttcgggccatggaggcctggtggcctcaggcctgtgtgatcactaagcctgagtgtaagaaggtctgttccatcatccaagatgacaggtctcaagttgcctcagaagaagcagagtgtgttttgaaatattcttcagtttacaaatcttgaaccaaaatgttcttggccagccaagcctttatatagtctatatggatgctggttaaggcagattcttacagagacagaacattgaaatgaggataaggtaggagaagaaacagccccctttgctttgttttgtattttatgagctattttttttttttattatgactaggtgttcttcaaagttaattagatcatgctaagtgttagagaagggaatacatattattggctttctttgaaaggttattttttttgttacagttttcttaattacactgattaaatatttcaaaattggccaccaaatttcgaagcttccatgcgagttactcctcctcccaatgcgtgacccattcagattgagtgtaagctaggtgtttggtcataactctatgcttaagagagacgtaagacaagtgactctttgggaagataggctggcactttgctgaaagtaatacatgtagctgtacagatacacgcatttctttgtattagaccaccagacacggcaaaattactgaagaggttgtcatatttactttcgtttcaaaaacaaatagaggcccagttaatcagcatatcaaatacccagctgtgtttagaaccagttcctgccgatagatttctttaggctggtaagaacgtattttatttaaaggtacagtcactcagttgttcagacggctgcttttgtactttctgtgtgacaattaacatgtaatgaatgactttctagactgctattggtagtaattactatatgtagtttattagctgcagtccattgttggatgtgcctgtattgatttgttttgcaaacaacccttcacacgtgtggcagcatttgggcattactgggtaaagaacctgtttcactggctgatgttgccgttgcctctggaaacttcggcttgtacattcttgtgtggtaggctacccctttgatcagttatcctaggtgatttttaaaatggaagcattttttttttcactctaaactctgacccttagggaaccctaaagaaaaccacactctctttacttatttatttatttttgcaaggcgataatttgtggaaaattgggcttacaggagtatttagagatgctctctattttatgataaagtataaggatcctgggaaagggttaaatatctctttcccaaatcatacaggaggttctagctaacacagggtattaatacatagaccccaccgttctagacacagtggctgtgctgctatgagttaagggctgacctgctcagtcgttatcaactatatacttgcaatgggaaaaacaacaacaacatatagtctaccatttctgaaaaaaaaaaaaaaaagaataaaactgagatggtgttggatgggcatcataatcgggcccgcttgtcatcgca

SEQ ID NO: 177 - DNA, 7125 bp, Mus musculus
ttttatggcaccaactcctgtccaactctggaactggagtcctggcctatgaaatgtaatagagagagttattcactcagtaattaatgttagaaaagcacctactgccagctaaaagaagtaataaatgtgggtcgtcaggatttctagttaagcaataacacaacgtctcaggtttgacacacatagccctttttgtaaaacattactagtatccactcagtgtaaacagaagccagggtcttcatcaccacatgcagtttctagtttgatgtcaacaattaaaatgtttatgggaaataatttgaagatagggatgaggaagcagagacgggaagagtcgtaaagaatatgttcagaactccagcaacacagggccggaaaggaaacagggtccaaggtgtgacaagtcctctcatatctccagagaagttggaaatccactgataattaattatttcgaatatacacacacagtcagacagacagacagacacacacacacacacacactctctcacgcagacacacacagagacacacagacacatagatgcacacacagacacacagatatacatgcaaacatttttctttttttaaggcattttattagatattttcttcatttgcatttcaaatgctatccccaagccccttattcccttccctcaccctgcttctcaacccactcactcctgcttcttggccctggtattcccctgtactggggcatatgatcttcgcaataccaaggacttcgcctcctattgatggccaactaggccatcccctggtacatatgcaactagagacacagttctggggggggggtactggttagttcatattgttgttcctcctttaaaggggttgcagacccctttagctccttgggtactttctctagctccttcattagggtccctgtgttccatagttacagagacaaagttcagagctgagacggaaggaaagaccattcagagactgccccacccagggatccatcccatatacaactaccaaacatgcagacatttcatgcagagagagacacagaatcgcatagatacacagacacacaaacatactacagacgcacacatagacacagacagacagacagacagacacacagacacacacacagacacacacacacacacacacacacacagagagaaattaggaaggaccttgattacataggtgaacacctattcaagaaaaaactagaagtcagtcatatcctcagccaggcaaaaccagtccaagtgtgtgattctatcaaaactccgagtagcagcaaaatgggatgaaaagcccaggaagtgccttgtgagttagccctggcttagttcctgcatgtgaagccaagaggaaaaaagacattttcaggatgacatcttccttttgaaacgctgcgatagattttcctggagagaataactctatagcacatcttgcctagatgtctgcggtgagccctgcgtcgtgctgacagcgtatctctcagcatcagcatattgttagcagattagacttcggtggtcttaaaaaaaaaaaagcattgtcaatgagaagggtgttgttcacccttacagtgctttatagcgtatactaactcccgagacacggatggtctctctggaatgggtcccaggcagtggaattatagatgtgtatttttaattcaaattctgagataatggcttcagggaagctgacaatgtagaaataagctgctaaaaacgtacagtctaaaaacagacacatgctctctttgtcccctttgtcctggcacacgtaacctagaatctggaccctgaatttatagctcatttgcatatgcagcaccagttggcagcgctttgaagacttcagcagttctctacacatcgctgaagttggggctgccatcaaagcccggcttcagcgtggtttgtttctcctgccatttccaaacgaagtcatgggcttgggacctcttccaagaaggtccagaaaggaactttatttttaccccttttcttgtctcatctcctagatcattcaatgtctctaaaatgataactaggtctcatgtttagtcaatcccagaatgccgaaccgtgatctgggccacactagggaaaccatgtacggaagagcatgggtttcagtgactctggtggtgattctcaaccttcctaacgctgtgacccgttgacagttcctcgagttgggctgaacccttaaccataaagctaatgttattgctacgtcacaactgtaattttactactgctctgaattgcaccattaatatctgatttgcaagatatgtaactcctgtagaaaggacctttgacaccccttccccccaaaaggttgagactcacgattctagaaggatttggcttctgttagtgccacacagtgatattcgacaggaagtgagaggagcatggcgcacaagttctggtttccagaagcttctagtgtctttcaggttaagtctctggactgaggaagggtttgtatttttattttccatcttccttctgtgtccccctcaaagtcgctctcttgttgcttcccaaagtgcacctgtgaactgatacaccacatttactctttggccttgcattttaggaatgagtgacttcttaatagtaagaatggtttattgacgatagtactccaagccacaaggcagggacgggagctggcagggggtgatgaggaggtggggtgatttgtttttttaattggatttttttacgttaaggttactttttctatgtgaaggctcacatttgaaagctgacaaatggaagacagggaagacctctcacccaactccatttgcaaagtcacccactctgtctatggagttatccgacagtttcctgccctatcgatgcatacatattttatacgtgtacaagtgctccatttcatgaaaagttagtctgagccaccaagaaagccacctgtgacaagaggaacttgtctgtaagtggacacttgaggccgggactcttacttccaggcaaaggttctattttttgcttctcaatggtggtttacactttgaaaaatcaggaaatatgaagtctaaagtcaatctcagactgggtagggaatattcactgctgacgagtctagagactagtctagagaactctcttgtagtctggcttttttatactgatgagctctgatggagatcaaggaacctctttagtctgccatcatattaagatccaagggatgggaggtaaaaatcatatctgggtctggacgatccaaccaattaaaagactcgggagcgttatggtcatcttttctgctaatgtgccctgtcctcgggggctcttgctatcatgcagctgaagattcaatgggaataggtgggaaatcaggctgtatttcaagtgatttgccatgtgtcactcctttcttgttcttaagcctcaccctgaataccaaagtctcaagcccaacccacctccaggaattctgttttcagagcttcaagtcagagctgagaactcttcctgtgggtgtctcttccccgactaaagggtaattctgatctcagctgaactcagaagcacttggagaaacctggctttcatggccagagttgattttttccccccttcgtaaatagaatcaaggaaataatcaaagaggaaatagggtaaagaggaagaagaagaggcctgggggagatggggggatgggggtgtggtggcatacctgtgggaaggctcctatctgttagattggcaggtggatagcccacacggtctgcacttcagatgagattgttgttccggttgagcaggtgttctccttatcctgtctttgtcttagtagccgtagtgtccattagatgacatgatggttctcaaaatgtccgagtctccccgagcttctgtcccagacatcacagcttctgcttgtagcaaagaagccagtgggatgctccataatactctcagccacagaacactcaaggactctcaataggctgatttttgtctctagattcatacttagctctaagacacattacatgcaaatgctctaagggaaatatgcccagattttcgacacaggtctgacctctgtttagactattagtggcggtgattcagaatccacttggccttgaacgatgaataagtaatgcccgtctccatttcctaggaaacgggctctctgtgtcagctcgggctcctccaaggggcttccctaggcgccttttcctggtgctagtgactatattgctgttgtgtggggctgctttggggacactggaaacaaaggatcggatgaccgttgagtgtgaagtgaggacagaaggaaagggcttcaggtgatagatttcagcagttgtcagtcttgctaggtgtacgggatccttgtttagacagcctaaggtgaaggaagacatggcagcccctagcttgctgcacacatcgagggagaggcctgggctgcattctttgacactttgtgccctcttgtgttcagagagtcgctttcctttggtgcatctttgaccacacacaaacacccgaggcacagaaggaaggatgaagttctccataattgtgcacctgccactgctaatgtaggaagtgaaaacaacaaaaaaaatgcatcccgtcccacacagcacagaaatgctagccaaaaaaaaagagaaaactttcaaaaatgccacgaaactccttttcagcccacacccttatgcagaccgcacgtccgagcacctggaaggcaggacaacacactcacattttgcaagctctgctgctcagggtgcaagcagggagatttagtccctgaccctcagtgtccagaacctccagtgtatgcactgtgtgtaactctcctagcattactttgcaggtatagtgaaattatatttttcataccagcttatgttgtaggctgaatcgtgcctcttttcgtgttgcaatcccaataccctaacctcagaatgagactgtgtttggaaataaggtttataatctgataaattatgataaagatcactgaagagagttctagtttagtgggagaaaagtggacacacatctacacggtgtcagtgccccatgaagtgggtattggagcctacgacatagaacaggacccaaaccaggattcctgaatccatctttgctgtgattccaggctagttacatcactaggaagcagggacgcggacactacttgtattttaaacaccacgaaaccctctttacctctcctgtgcttagttaagaccaactcagcaacatcaacttgtgggttcctgtccctcttcttttctggttactcccaacagggcctttggcacttactccatactgtgtgtcctgtgtgttaaccatctgaaactttcttacatatgataatacctacttttatcatatcttgtggattctgcaatttcatgagttgaagcaaggctcaactgcttctcttctcttctcttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctccttccttccttccttccttccttccttccttccttccttccttcctttcttttcattcttttctcttggcatttaccaataagtcaggggatgttcacgtgggcactgtttttgttcttctccctgcattgataacaccagagaatggttttagcaggcagaaagactggtgtagagggaccgaaaaacctcctttcttgcctgacagtatgatggagaaagatgtcaggtggagctacggactgaagcacttgagtttctgcttaatgggaggaagggcaagatagccagggataaatgaggtcttaacagtgggactcaccaaaactcagcccaagttgtccctgattcaaggagatactgcaaaggccttaccacttagctagaagaaaaacttttaagttaaaaaaaagcgtttaaaaacagcaacacaaacttttcttgattaacacagaaatttgcttgattaattctgactcttggattctcaaggttcagaggtggggcctataaagaatccctgcttttattgcctgggcaagtaagcgtctcagtttgcaagagtttaacagtgaaggggctccttagagtcaaagctttctattcttatttaatccccaaatacaatatgtgtgtctgtgtgtgtgcccctgtgtgcatgcctgtgcatgtgtgtgagtgtgcacacacctgcctgtacttaagacagaaaaagaaaagggagagagggggaaaagaaggaagagagagagaaagagacagagaatgaaacagagccctcaattactacacactgcaagcaaatattattaaggtaacaactttatgattatttttactgtataaattttctattaatgtgtctaggatggccacacccaggtttttatttagatgcaaaggattcaaattggagtcctcattattcagcactcctcagcccccaggatcacctgtttcaagaatgggggtctgtattggtactctggtacacgagctgtttgaaaagaggcagtgttagactgactgtacattttagaattgcatgatagagtatgcatgattatttttcttcatgattcaaaactcattacctgcgtgccacacaatggacctgcatcccaggcatcctaagacccttttattttttattcacttccctgcagcacacaataggctctcgtttctcatgtgctaccgaagccatgttctaaagtgcattaacaaacttgaattctaaaacagcctaggatttcctagccatgattctagaccctagccattaactgttgttctttatattctttgaaaacatcccttcacactacagattctggttgttcactatttcttcaaatgtctcacacttcacagttaccctggctgcttgtattgacactcttgaggcctgatgcaggaggagaaaatgtacttaacgttcctgttagtactaagctgaaagtggca

SEQ ID NO: 178 - DNA, 1525 bp, Mus musculus
ccacctttctaaactacagaatgcagtttcacttgagaatagatagctttttattgaaacaagcaaaaaagcgtcttattttgtacgggacaaaagagctgatggtgacattagtaagatgaaacctctgagtccatctctttgtcatccacaacttcgcacaaacagttgcttgtgtttatctgcagtccagtggaaccacagtgcccacacagagctgtctccttgcttctaagaatgacacaaagactctcaaagattgtattcgaagtaaggcacaggtaagatgcacacagattcaagggctggagagatggctcagcagtaaaatagtgtttgctgtacaatcttgacaacctgggttctgcccttggaactcaccatggaattagggaattgatatctaaaagctgtgcacacacacacacaccaccaccaccaccaccaccaccaacaacaacaaccacaaaataataacgatgatggtgataatagtgatgctgatgagacaaataaaaggaaaacaatagctgcaatatctcttcccactgtgttcctgtgtccatttggcaccaccaagagggaggtcaatgcccatgacagccttactgtgtagagagtatccatgatagacagagaatgagaaaaggaaaatgaaacccacccagctctagggacttcaatcaggctaaagttaatgaaaaggatcctgtcttttcccaggatggttaaatgtctgcaccaatctcagctagagggatgagcaggtgcggggaggagggcagccagaatttcatttaaaaggcaaaagaaagaaaatgttctcatctccccagtgaagcagggagctttcctgggggccctgctcagaccaatctcattcccaacacatcgtgctgttctctcaaacagttcacattcaaatgctagaagatgacccgaccttccattttttttaaagagccgcagtctcttggcataaattcaggatgtgttttagtctctctaaactcaaagaaaaagagctggagaaagatgaagggaggtcccagcttttcacagaggagagaagaacgagattcactcagcttcccatgcagagagggtctgttctcttgtttctccgttctttctgaatggggctccgtctttggctccctcaccaaattactgcaatactgtaatcaagaagcccatgggccacctaagtctgccccttcaacgtgcagtcttccttccttaaaacaccacaggctctaaagtttcccactgaaaaaggagtggatagcacacttctcttctcctgccccagtcttcctctctcctggtcactaagcgaaggatgcacctcaccagggtagacagggatggccatatcccccacagactccttggctgataatggtcccttgtttgggaaaggatttaggatcaagacatgagtcattctgaaaatcagagcagaggggttttagtacagacatgacattggaaaaaaattaaatcccagggggtctctgcttgg

SEQ ID NO: 179 - DNA, 1650 bp, Mus musculus
acagagtaactcaacaagcagtagattaagttcctgatttttcaagctggggctttcccattatttatgacacgtaggggatgatgttttgcagttgtgcattaaagcaaccactctgtctgccaggacttccgtgtcagcagcacagagacccaggttgcttctcttgagcaatctacatagatacttttgattatctctgagctactgttactatatccaatagctatgcaggaacagcctttatataaccaaccgaagtgtcagttttcattttgattattttgcagttgtagaaagctacatatgtcattttcaaccagagtcagcccataaatagtgagatggcaaaattttgctaataatctcactcctttatacataactatattacagtctacacaaattttaatatactacctaccagccctcgtcatgcttgtattctttttacattggcttcaagtgttttacttaatgtttctaagcaacaagctaaaataggcagcagtttattaaaaggaaggaaaattattactgcttatcaatttagcatggcgtgttccaagtattgactgaatgaaacctaagtggcatgttttcacaaatgtatttttgcttttttatactgtattacaatatcctcatatattgcagttgcatatgtcagaacgaagattttcctcttttatttatgatattgataggaggtttaattaatcactatacttattggttctctcatttgagttgaactttaataaaagccatctgtgagaaaaggcagaaaaccactctctagaaacaatgctttgatatttagggacataagagcagctgtgagctgttatttttcttcccttaatagctgaatgtcacatcctgtaatttggcttccattcactgatatgagcaaaggattctgcgacttcattaacatgcatgttaacattctgtagttttcatcagtcacgttacctttggaactaaaaatagaacctactgttggcctctggtgctacctcactggacatcctcccagcctcagcgttactgtctctcttatataagactctcctactcttaggctctgccaaaaccaagttctcttactaacttgtatttcactgttctacctcagcatggtattaataaaagtgagtgggtataaaaatgtgcatgcatataggcttaatttgtgaataagctgatttatatttgaatgaatctgtttgtgtttaatagagggtgtttatagccagattggggaaagtgtgtgggaagtgatagaaaagggtaattctagtgaagaacaaggaaagatggaagagtcacaaaagatcattgtaaaaaatgtccctcgctattaataaaaatgtttaaacataagaaattatttttggaaatatttaattttacttgataataaattaagtcttaatcaaatctttgtttatagtacaaactgctagatctttaatatttgcataatgagaggtataaaataattatagaaactcagaaatgtaataatctatagtctgcattttcagcatcactaccttctcacctcacatcactgaatagaacatcacatagtacatctctagacaagcaacatcagcatcacctaggagcatgttagaaatg

SEQ ID NO: 180 - DNA, 2500 bp, Mus musculus
atgctcatgtactgcccccactagacagacagctccaggggggtggcgtattctctgggcctcagtctgggcttacacttactactctctgtcattacacatctccagcatccactgcctggctacttaagtctgtatgacctgggtctgatatggcatcttcctgtcgatttgtctccagatgctccaaggagacgctgtcccttcccctcttggtggccctacgttacccctacagggtgccgagtgatttggctaaaaaggtggcctcccttacttgacgcttgctgctcatctgtcctttggtgtctactagaatcctgtgagcgtcccgtcacatgacttgtgaccactccaccttgaaaggaggctggtgagtgtcagcaatcaaaataccctgcccttttgattagagaaggaagcagtcattgtatcttagagcccctggaggaagccctgccttctttaacaactcaacaggatcagctgtagctacaggatgagcagaggtcaggctggctgtgggcttgtgctgctccaacagtgtggaatgaggagagggctgggcggatgtaaggaggggttagaagttgatgctagagtcccactgtcccctagcccacatttgtatgtatttaaactagtctaatgtgcagcatacatacgtgggagcagttccactttgatttctttgtcagtcctggggactgaacctacagtgtcaatgcatgctaggcacgtgctctgccctgccacatactcaggtttgaatgattgctatccttctgtaacaggctctacctggcactgcaggacgtcactgctttctgagtagccaggaacattttgattaataaaatgtggttgccccatctgaattcctgtacataaattcaataggaatttcccttctccgcccagctagctcacaatttattcctctaggtatcacagtcctgaggcaatggcatatccaagtttctgtggaatgtggacatccagccttgaaccaggagcatgaggcaggatagccacattcacaacttcagtacccaggagccactagccagaatgcagaggaagcacaacgggaccaggctggggaataagagcctctgagactaggatcttacagctccgggtgggggtgtaggatagaagcagacgatgttcccagggctagaaacatcacacgtcactttcagctccactttcatttaccagtgacagcttacagcaacagttttaaatgcggaagaaatgctgaagaaaacaaaaaataattagttgccccgttaaagtctcctcccccggctcatttcattagaaaaatcagtggaggcattaatggctgtctctgtctctaatgagctttattctaattaggctcagacattattatttcagttgggaaagaggcctggtgggtgaggagctgcagagtgtgaccgcccctgactgctgctcagaccacattcaggaagatcccgctgtagcagtcctgggatacaggacttttcattttcaagacagaacgtgtactcccctgcccgcctccccctctctttactccagcaccggattcattgtagctacaccaacatccaccatcagcaagggcacatcagaaccttttaaagctcccatttcccaaactttgtctgtctttggtacttagaccacttcagtgatcctcttctccacaaggcagtgacgaggagacgggataaagaccttgggatgcctatactggccaggccataccaaacccaggtcccagagggaagactggcaaacttcctctggcagggccagctagtagatacttgaagctctgttccttctggcccctgtttcagcatagcaagtgcagcttagtccccacaaaacagcagttttcaacctgtggatcgtgacccctttgtgtggggtagggggttaaatgaccctttcataggggttgcctaaggctattagaaaatattataattcataacagtgtcaaaattacagttatgaagtagcaatggaaacaattttacggttagggtcaccacgctgtgaggaactgtattaaagggtcacagtgttaggaaggttgagaaccactgccataaagcatccatatcgctgagtatggtggtgccaactatcccagcactcaggaggcagaggcaggaagattatgattttaaggcaagcctgggctccacagtatgacactgttttaaaacaccatcaaccgtgacccctcaaaaaatactctgtggctaccaaaaatgggatttcatatcacttgtcaaatagtgcaaaatcttttttgtcccttcgccggccagctcttaaacacgtaaagaccactctcttcctgtgggcaggaagtgtttcaggcctagaaagcgcagcagtgatctgtcccgacaccaggaggccaacgcagcttttgccttaaggatcagacaccagagctgatttctaccctgagagctttgccatttct

SEQ ID NO: 181 - DNA, 1950 bp, Mus musculus
aaccatactagtgggaccttctattaatcagccttaccagagagctgggttctctagatgttacaatgggcaaaagaagtactgatgaccaatcatgcccaggatatagactgagttatctttctcaccgaaaggttgaaaaaagacttctaaaaatatatatcaaaaacgtaggaaaagccagacagtatctcacacctttaaccccagcacttgggaggcagaggcgggtggatttctgagttcaaggccaacctggtctacagagtgagttccaggacagccagggatacacagagaaaccctgccttgaagaaaagaaaaaaaatctttgcacatatatgtcaggtaattaacgagagattgtgttatttttcttgctttgatgactgtgcaggcttgtttggattatattaacttacaatatattgtgatatttttcatattaaatagttatctttatacctgattctgtattcacaatattgaaaaatatgtctccacatgagtctcaagaccatagtccttggatatcataagacatggattcaccaatgctggtgtataattattttcagacatgcacaaaaatgtataataaaatagctaaatttatatttccaatcacaggcatttgtcataaatgggtcacaaaaagtactacttgcaaataattttagatagactattaataattacagccaattttgaatcgacttgcaagtattaaattggctgtttattttcaaatatttgcagggaaaacaggtcagaaaaactccagcatcctttgttctgtgcacactcattccaggcttgtgcccccactcccaccccccagtatcgccctacttgcccctggtcccccaagcagagcaaagaaatcgctggagtcagacagatcacaggttttataaagccatgtgaacatagtcttgggcacagccgaggaggagagagaatggtgatggggagggtggcagacagagaaaattccgaggccaatgccctgtgtggatgagctcaagacccctggtctcatctctctaaccaaaacttctgtgaggatgactgaaaagacagcccagcagtcactggtcctacaggggacccaggttctatttccaagggatccagcaccctcttttggcctccaagggcactgtatttacgtggtacacatacacacatactggcaaacagtacacataaaataaaaataaataaatctaaaaaatcaaagcaaacaagcaataacaacaacaacaacaaaaaccagggagccaagtcagacacctccatttgcaaatgatagctgtccacagcttgtaaaacaattttaacagcccgggcaaggggaaatcattaaagcggttttacagaacgaattctttagtatcaataaatgtatagtgccaactaatttgacactaagtacatgccaaagaaaaattattctgctatcagcagataatggataatatatgtgtgtgtttcaaaagccaagaaactgtttaatgttgctataaactgtttaatctgaaatcctacatcagataaaactaatagaaagtgcatgctgattaagccaactcctgtatcacttctcaagcaattctatcttctagcaatttaccattgcatcaagcactggctcctattagaacatagcatgttaagggttatgataacagaattaacttaaatgactctagcatagcttaaaatgtaacattgtctaataatggctgtctcttgttcacttattcattttcctaacatttactaagagaagacttttaactaagctctaagttaactgattaataccttgaaaagatttctgagccataacttaaaaaattaaaacagaaagagaaccctcccattttaaaaaggttggaaatcagacatgataatttgaacaattaaatattaattgggaattct

SEQ ID NO: 182 - DNA, 2325 bp, Mus musculus
aaagaatggagattatttccaatcatcctactatagcatcaggactgaagaatatggatcatatgattcagggtaagaaaataagtccatggaaacccagaggagaggctgggctcctctgagtaagtagggtacctggcttcaggatctatccctcccttccaggatgttctaacctgatagttgtgaacacagctctctgataccaggcctggctgccctgctggaccacatcaattccacagacctgggatactttgagaacagactgttgacatatctctcccaatatgcgcttgtttggaggaaaacaagaagtcttgagtgacacattttgttcttccttgctcttcttttagccacatcttcacagaaactctgactcattttgaaaatagcaaaatagcagaaggatgttgctctaggatccactggcaatgtttggagctattgttttgctctgctttgaagcaaggcatcttgactggtagcagttctttagtagctttaatagacaatatttagatgatgctatcagtctctttgggataattttttaaccaaaatctccaagaagaagtagcatagtggtcccacctttgagatacgggaccatggatgaaacatacttgaagaaggggatattcagaccttggggctttcaggcatatgtttgatcctgcttttgcagtcttcatttaaaaattaagagtaaagaagttagcgatgcttacatgactaaatatagtatgtttattattcacatgtaggcagtgggacagaacaatcaatataagttgtcaacactcagtatgaaaaaaattatcaaatcaggacatggaagcactcttaagtaaggaatgttaaagagtccagatgatcccagtaatcagcaccaaatggagagcattgcaagacggtaagaacacatctaaaaaccctgtcacaccgggggttcagggaagcctagccacagccatgcaatacgtgtcacacattaagcaagctctactcacttgctggagaaagattgaagcctggaagatagcagaagtcacatgtatgacctgacactcttctgacaccctatgtaaaaagagtctgacagtgaagaataaaagactacataaagctcagccctaaatgcaacccatacactgtaccccttctgcctaaggttcaggaatcatggcaggcaatgaggcaagaaagtctataagagccagagagagtagatggctacaagaaatcagtgtgctccagacataaagagtagctgtacatgtgaacccatagcagttatagcagtatgcacaagagctgtgcagcctcaaagcagccaaaatgttagcaagaacaggggacctgtgtatgaattcccaatgatagccaagttgttattggcaattgctagcttctggaggagtgtttgttttttgaagggtgtagcccctggtaagtcaacatgcattccaagagaaggccatacatccaagaatagtcgggcactacacattcatctcgatggaaaaagaaaaaaaggcccaaagttggacagatggggaagagggtaggggtctgagaagaggtgtcgggaggaaggatgaataagtgatcaaaacacactatctgagaattcccaaagaactaataaaaatattttttaaaaatgagttcagcagcttggctcagaaaacatactcctgtgaatgattgaaagattaaatgatctgagatccctcttcaggcactataccatgaaaaacaaaagtgataacttgtcaggaaaataataatttgttctgagatccttgttttgggccacgtttttctaggcgtagtataagtacagtctatagtatactacagtatactatactatgcataccagcctgcttattattttatagtagattaattctttgctatgccatggctcacgttatttgggcctttctctgtcttttgttatcataaatattcctctcttaaacatgctttggatgcttctgttccttcccacattacagctttagggaagctattgctaatgttgtatcttttccttggaatctgatagaactgaggttgggtgggcaggatgacaatcttcaggaaagacaagtgacaaagctattttcaggaagaaatccttggatcacatcaaatcaattttatatcatgatccaggtctgatcctctgtaactgatgtatctatttctatatctatatcatctctatctatatctccatctccctctctgtcccctctccctcttcctctctctctcccctctttctccatgtatatatatatatatata

SEQ ID NO: 183 - DNA, 1675 bp, Mus musculus
tgtccaggggcaagcatataactgggtttgtcatcacaaccaggcccttagtagctttattttttatcagatgaattatagtgatatgacagtgctgtgtacacaaagcccttacctcttacctaagaaaatgtcccaaagtgcaagggtaggaaggccagcaattcaggcactctaaagagatgctacaaagcacttccatcaagttaaatggtcctggtttattgcagatatacacatatcgaatacaacacacatattaatactagtatcagttggtggggggcttacaacaaattccctgtggatagaggactctgctgcaactagaagtgagcagtcaggatgatccacactttgaagagaggattgttgaatttgtgggcatgttttaaatctgcagcctaaaatatttgctttttattttaagattaccataaaaagtgggccaacttttattttcttccgggctccagtataaagaatatcttccacttagttcccaccccacctccacccactcccagttttccattccagactgatgcaaagctaaagcacaagctgtcagagggcctcttacctgtcagggagccatgcgcttgtcaggggggcgtggacttgtcaggggggcgtggacttgccagggggcccgtacactagggggtggggggcgtggacttgccagggggccacgcactggcggcgggggggggggggggggctggacttgtcagggggcgtggacttgccagggggctgcgcactagtcacggggcagcgcactgatcagggaccctcggacttgctgcacacagtttcttctcattgacctctcaccgactgaacagacactcatccttcccccaactcccacaggaggccttgcttatcctcaagctggcagctggcagagcaagagaagacccgcagtcctaagcttactagaagctacagcagggaaatctgcagggccgttgacagtcggtcggtcttgtacaaagactgttttgagaaatgggacaactcagatagatggagtacatgctggcctcacttaggacatgcagatcttgttgtgggtgcccgccattcagcattagtcaaaggataaagttccatccatcatgacgcctgtcagtgagaccaggccctctgtttgggagaggctctctgttaattacttggagcgttgtgtgtgtagatggactgatgctctcgagacaaccaagggtgatttgtcctgctgtgggtggctggaactatgggaccaggaagataaagaaagctgtgtctcctcacacccacaaaactgtgacgccaccctacccgattaatggactccaccaagatgaaggctgtcaggtttggggctgggtgagcacccataattcagagctggggaagggagcagagacaggagcccccctgaagcttgctgtgtaggcagcctccagtctagaacaagacagacaagtgataaaggaagataccctctattgatggagtctcctgacttctatgtgtacacgagtgcatttgtacctacacacgtgtgcgtgcatgcacacacacacacacacacacacaggcacacgggaatgacatgtgcacatggaattctacagactgtcaaaggagccaccttcgggttaagacagcaacagtcattaaa

SEQ ID NO: 184 - DNA, 2050 bp, Mus musculus
acagtatctaggcaaacatcttgcgtcatcccttcgcaatgtttttcccagtggctgatttgtggtttttgatgttcattcctcagcctgcaggatcgctacccatctcccaacccgtctctctaagggagtcttgtgactaaggaaggtatcttcagaacacagactgacagtctgcctgactcatgctttggaaaagtgggtatcagggcgctaaagtgttgttgccataacactggcagtggttggaaattcctcatcaagtttgcctccaagcctgttgattctggctaagcgctctagcaaaaaagtgagccaaggcctttaagtcatttgggagatatgacaggcttgggtgtttggtaataagacaatggaaaactttggtatccatacagaaactgcagcaattgcttttattagtttaagcacctgattgtttacatatttacccattgatttataaagttcccatagctcatctccatcatttctaaggagagatcactccatagtgctgacagattcacattagcagtctctaagtaggcagaacttaattttgattctgagtttggagaaacctggcaatatgttttcaactaggtgataactgttctagttaattgaaagagctgaaatataacatttgaatttggactatagactataaatgcttccacgtcaggctaccaagttatatacaaaacatggacatataatgaaggggccacgtgctttcttaaacaagacacatttagtaacagtgtcaaaattacatcctattacctgtgttatttaaagtgagagaaaaagtgtgccaccttctgatgaatgttagtctttcccctagatctgcattaattatagagtctgtgtttacaggaaaagatctctgagggatttcgaactgagattaagcttgtgtctgagtcacaagacctacagaggtcttccactagcctgaggtctgtgttaatgggaactctgctctctgctcttcattccataagcatgggtaagaggcagggtcacagtcataggcagtgggactgtcatctacaacagtgctggcctctatggagccaccctttagagtcaccacaaagccgcctctctgttcagagctgttcctaggcaacagacgagaaacaggcaagtacaggattctactcagctccactctgctcctcatgggactcctacgatacaggacaagcttcctgcatggagtgcctgcttgagtttgtgagggaagcagctgacttttgcaagtaaccttcatggcttctgaacaagcacctgccccgacaacccagacatttaggttgccctcagcaacctgcaagcaggatctgccttacctgggtgcgctctgggctcagatactcatttaaaacctcagcaacggtggcaagacgaaggtatggagagaatgaaactcatgaagtacgtgtatataggcatatatgcattatgtgtacagatatgtaaataaattatatatatgtatataatttatgtgtctatgtgtgtccccacgtgtaaggaggaagcgcacgtgtgtgtgcaggcatcatcatcagaaggccccagatgttttgtagctggaattatagatggttgtcagatatctgacacagatgcttaggaaccaggctcaggtcccctggaagacctcagcaagcattctaaactaagccatctctccagcccctagagaggcttaaaacatattcacactttggtttttattacttattaaattttcatttcgagtccatcgtcagcttggtttaagaggatgtacaccaactgaacagaacacaaggagaagaaaacaaagggccagggtctggggaattccaagacctatgatggtgttctaatggatactcagagctgtgttgccaaaagtcaacgtgttgtctcctggtggggcataagggtggagcaagggcaaaatgaccaggcaatctgtctgctgagctggggcgagccttcatttcaggaagacgttgcctgaccttaagaaacccagccgcgtgct

SEQ ID NO: 185 - DNA, 5275 bp, Mus musculus
cttaattctaggcagagccagctggaaaggagattcctatgccccaatttccaaagcagtgtgatgtgatagtaagctgccccatgctcacatatcagtctttttaacatgtacaaagacccccccccccaccaaagtatatattaaacttgttagtttaaggaacggcagaaagtgtagactctagtacttttctaaggaaagagtaataagcaaacagaagagaatacacagttagaaagtagcaactgttgggtcagtaaaagggcttaaccagcgacggggcttgtcgccaagcctgatcacctgcgttccatccctggcttcgcgttcagatgtttagtctgttatcatcatgacaggaagcatgatgacatgcaggcagacatggtgctggaccggtagctgagagttctacatgtgaatccacaggcagcaggaagagagagtgagccattaggcctggcttaagtgaaacctcaaagcctcaaccccaaaccccccagtgacacacttcctccaaaaagccacacctcctgtgagtctatggggccatttttattcaaaccaccatacacaccaatataaaagaagtaccaagggagtcaatgaagttccctaatggaaacactggatagtatatagacatgctcagacatctccgtgcttctggagcccagttctgaggcttggaagctacagtgctaagcacagactctcagtcctaggaaatcattgttaagacttaaaccctttaaaagccccatgttgatcccctgatcccaataggatgggaacccctgcctgcgagatagattcaaaagaagttatgattgtggggctctgaagatttcttttaagggatggggagaccagagcatacccctccttctgcctttgaggatggcaagacagccacctgcaagtcaccaaggttagagcctgtctgcacttcatctggaactttctagcctctggtccagtgaacacagaatactcctgttaagcttcccactgtatagtgatcgattccagtaccccaggtagtgagctgggaagttctggttcctttggaaagtcagtatgtcaaagggatgcttttctgaagcggacacaggtgagaggatgttttactaaaacaaacatgtaaaaggatgcgtgatgaaggatggattctttgctaacaacatgcatgccttggtctgccttacgctgcattgcagagccctgcttgtcaagacttcatagaaagaaacacaccaaaaaccttaggtggcattctggggcttcttgccgcatctgcagacccagattgattggcagagtgatgtcagatgatccagactcacctggagttttgctaagacagactcacgtggtgaggcaagacctgtgagaggacacatgatgtttggagggagtataaataggaaccaatggacagtggcaggggcttgcgtagcgagctttgcaatgcttcttggtctcaagtctttgctgctcttcactttgttgagagaggcacaaagaacttctcctggagtccttgctggtcctaaccattcctgctgactcagcagaggcctagctgtctttctgctaggttgtgccatatctgctgactcatgtttgctatcccagcagtactgaactggactgctggtatattcgtgaagtgtttatgagtagatcgagctgccactgctgactcctgtgaactaaactgctgatttcctgatgctgcagattggatttgctccaaagaatgatttctaaacaggtccacttcccccgtatcctggtaacctttcttttccacgacctctggtgggtggtgggctacaagggaggttaaaacactttcgaatccatattaaatgtaggttttgaaaaatctaagctacaaggcagagtaggagaggcatcaacattgagaaacaggcgctgctgtattgcacatttaacaatgtgggagcagctgcacaaatcagggatggaggaattctgaagtgtatgcaacaggtatggctgttataggagattcttggggtgtgttctgagaacaggggacatagagagagcttccatcttcttagagaatataccacaaaaattgaggcctggagagatggctcagtgactaacagattctgctattcttgcagaggacctgagttcagtccccagctgttagcatcagaagctgtttatagttagcctcagaatccagcaatgatgtcatcccctaggcaacaaggacccttctgcatctgttgccatggcaacagcagcacatgcctcacctgcatcacctgggtcacctacatcacagcccagataaaagacaagaggcctcatctctctctttctctttctcacttcttacccgactccccccttcaataaaggacttctcttcatgggaactgtgctggcttggtgtgatctgtccaggaacaagctgcttttcaacaaacaccagcagcccccatgatggctcataaccctctctgtaactctacttccacaggatctgataacctcttctggtcttcaagtgctcctatacatggtacacagatatactcagacacacatcacaggcacacgctcgcacgcgcgtgcgacacacacacacacacacacacacacacacacacacacggaggaaatgtggtgtcaaggccattctggggtggtctcagagagacgtcagaaacacattgttgaatggagtggtaaagagcctggatggagtgtgtctgtcttgggaattttgggtgacaagtagaacttgaaagtgaacagatcaaatattttgctaaaatttctgggcagagtgctagaggagtggtgtggtttctcacgactttctatacagacagcttctaacttaggactttttttttttttttggcctaggatattttgactttttggctttctgatggtgagaaatcaatatccattcagtggaaattgtactttggatattgatcctttacctcagattggcaacatggagcgccaaacagcagcaggagctgccggctggccaatgacagaagtaagaatggatgccccactgggtgctgtgttgctaagctaccatgcccgtgggctaaggtactcagttttttgactcagggtattttcagcttacaatgactttctcaggaagtaaccattacagtctgagatccacctgcatgggtaattgtgaacacagagaaaagagttcgaggtttagttactaagcaaaaggtgccagcatatgaaggtttcagatcaagatggcaagaaatgggaggatacattgagacagaacataatggtgtggctcctcaaccatgacatgagtgtgggtgtgagctgaggtcctaacattgctcctctctacagctctgcatctctgcatccagctttgcatctctacagctctgcttggttgctgccttgactacatctgaatgaactaaaccccaagcagctgggcacaccactgaagggtttttcttaatttaatctgaaccttttgaagtaagaagttccacgtttaatctgggtcacaccttctgctggcaacattctgctggacactggggggcgctcgctctctctgcctgctcgctctttctggcaagaccattcctttgtggcattagagcctactttttcatgattcttccaaaaactagatcagctcaggtatctggtctcatgcacagtacaactactggactttgcactggtagataactactgcagaaatagctgggccatagtttgtaagccatgctagtaaatccatatgtactggctagttttgtgtcaacttaacacaagctggagttgtcacagagaaaggagcctcccttgaggaaatgcctccatgagatccaactgtaaggcattttctcaattagtgatcaagggggaaaggcccattgtgggtggtgccatccctgggatggtagtcttgggttctataagaaagcaagctgagcaagtgaagggaagcaagccagtaagtaacatccctccatggcctctgcatcagctcctgcttcctgacctgcttgagttccagtcctgacttcctttggtgatcaacagcaatgtggaagtgtaagctgaataaaccctttcctccccaactgcttcttggtcatgatgttttgtgcagaaatagaaaccctaagacacctatatagatatatagataagagatagatacatgtgtgtatacattctatccatacacacagaaagagaatgatatcccaccagttctgttcctctagagaactaatacagaagtcaggaatagggatgaaactgcctgccagccttaaagaaaacagacaaaaccaggcaggagggaagaaagcaggctgctgcaaatagccagtgtgcattgagaaaaccaggggcccacagatcagagctgcttctcttcctgcagctacaagggaaccagctgaggctgccaacaccggacgaccaatgtcttgcacagtcttttgtgcactttccaaagctttaagctgaaggggtcaggtccatcctgcagagctgtgaaggtgactctactaccccagtgagtctaggaggtgagcatgctgctgccttcctgaaaaaaagatggtttctcagccatgagaccccatgtcagatcaggtgtgaggggctgatgtgaggtctgaggtcaggcttgggggtgcaacgctccctctgagctgcttctgagcagtgagggaagaagagagatcaaagtctgaatatagcagtggtccaagggcacagggaaaggatggcctccttgaacgaaggggaagaggaatatggtcctgaagacaagaaggatcttcaaagtccttgggagaggggtgtcaggttgaaccactctggggatactggttgtctggaattaggagccatgtgtggaggtggcctgttccagatgtaagtggtagaaatatttacttgtttggcaaagtgtgttaggaaaatgaccagaatgccaggaacaaacaaacaaacaatcaaacccagatacacttttgtttctgagagaaaatgctgctttaatcaagattgacttgaagaccttaacctcacacacacacattattgacactgttgcctgtcaaaaaaacaggaaagagatttctgatcagcaaattcaggccgggagggatttttaagtaggctttgctaaaacttcactaacaaataacccaacatcacgtttacagtttatcagttcacaagg

SEQ ID NO: 186 - DNA, 3150 bp, Mus musculus
gtacattcgatggaggtggtttctaagcttctccttccataactggtgacacttgtgtgtctatgctcctcgttttgatgacatataatgagggccttttaggccaaatttttttccaacctactttaataagggttcaacctctcctcttgcccaccatccagcaaaagtagtggaagagaaaagtttttaggatatgggggtagaggacctgtttatcaatagttctttgaagtcaagcttgacctttgttgtcagcagcaaacaccaaatatgactcagcagctacagaccaatcctttaggtaggcagacaccaggcatgaaccagcagcttcagtatagtcctctccgcagatggacagcatgcacgaaccagcagctgtagttccatcctgaagaaacctcaggctctcaaccagcctgaggccacagaagcagcaagatgccctgggaatctcatgaacagttctttggcaaggttttctcaatggcagtattgccacaagtgcagctcaacgacactatgtaaggcaaaccaatatatgcatgttgttagcaaagaatagcaaggtagagcaaaacaaaccaatgtttctgctcccactgtctgtggggtcatatttatactccttcgtcactgatcctttcatgtgtctgctgtagcaagacatcccttcacctgtatctgcttaggaaaacattctttcacgtgtctgctttagcaagacatcctttcacctgtgtgccccagccgatcatcatttgtcataactgactttccaaacaaaccagaagtttccacttaagagccttggcttacatatgcttcctctgactctggcctgactggttgaggccccattacaactcactcacgtgtagccttcactcaaaaggtagggctggggagaagtgcgcagtaagatggtaaatgccctgactccctggtaggcctcccataaccccatgctggtgggaaaacttctgctttacctctgtctctgatgattggaagtcctagtacaccacatgctctccactgttatcatggaggatggtctcactgccactcgaaggtgataaatgcccagatggcttggatgtagagtgcatgagctgagatggcatctctgccatggtgttcaggggaagggactcttgaacttctttgcttctcctttagcatttggtcaaagtaggagggccggttttggactagctgaatggttgcttgtgtagtcttctaagcaggggattttagttttctttttaagctatctgtgcaccttcttgattccagttctgggacatacagggcaacatgaacaccctggctttcaccactgtgctgtttctgaagtctcaaggtccctagctttgcctgctttctgctatccaccttatgggtattttaaccattcattatatgtgctatccagggtgtctacttgtgctgggaagagagaatagaagcaagtgtgtttacctcatcttcctggaagcataagtccccttagtcagttgtgctgtgtaggaacagctggtagggtttactgatgtattagatgtaggtggtaacataaggaacactgagtaataattctttttcacccttagcaactagaaaaatgaagctgcaaatactggagattagaaaggctgggcaagctttgcaaacatttgagcatgctaagtgaatattatgtcagccctgggattagagtctcaggttgaaggcaggaaatgtacagttagccatcattgtatggcagcggtagctttaaagctttaagacaagagggaactcttttcacaatgtgggcagatggacaggtcagtgcaagaacagccctggagtgttctgctaacacagagagaagagcaggggccaacccagggaacttccagtgggaagcttagagcttagcaccaggacaacagaaaagactatttaataaaatgcttcacttcttgtatttctttatttttattattattattattattattattatcattattagatattttctttatttacatttcaaatgttatccccttccctggtttcccctctgaaaaccccctccccctgctcactaacccactcgctcccacttcctggccctggcattcccctacactggggcatagaaccttcacaggaccaagggcctctcctcccattgatgaccaactaggccattctttgctacatatgcagctaaagccatgagtcccaccatgtgttttccttgtttggtggtttagtcccagggagctctggggttactggttagttcatattgttgttcctcctatggggctgcaaacaccttgggtcctttctctagctccttcattggggatcctgtgctctatccaatggatggctatgagcatccacttctgtgtttgtcaggtattggcagagcctttcaggttaagctcaactagaccaactagactcttaggccagaggctcaattctgggggttccaatgagtcaggaaaagccacctagttcccaaaggtcagttgaaaagatgaaaaaaaaattcttctcagcacagaagaaaagaagtagaatcatgactggaagtccatccctctggaagactaagtaaactctacagtgatgtcctgagtgtaggggtggaggatagctggtggtcttggtcaggtgacagtttgattgtggtgccgtggtgggtcagggagtggcttgtcttcggtaagaaagttgctgctacttggtgaagagttttgatttgtccatggacatttgcccatcagttctattgttgaatttaagtcaccacaggacagagtgacagagcaaagggccagtgaggaggacagggtagagagggctggccatcagggttaaggtggtgattgatcagcagggaggagacggctgaccatttggtgatgagtgattagtggaggaatctgcttgttgtccatgatctggagcagaatatcataaggctggcaattgaagttctgttgactatgatgtcccttcgaatcttgaaaataatttatcctcatcttgatatctgtggccttgaagagagaggcttatcgtctttaatgctagattgaagagtcagtgcttttcacaaagagcagtgattctcat

SEQ ID NO: 187 - DNA, 2225 bp, Mus musculus
ttttcagactgcaaagactacagagtccacatttaaacggtggctttagagaggtagaccacaggtagcttaagaggccacagtaaggaaatggttggtctcattcaaaccataaaaatactattaaaataggcattgtgaatagtcatagaaacacatttagtattcagaattcttcccttgtttttattttatttattgaaattttcttacatttcaatgtcagattatataagacaaagaaataaaagttttctttgattgcaaattagtccataggctatgatgaaactaccacccacaattctgttatgatgattcatccccaaagcactagtcacccttcttcaaaggatgtctttgcaaacagaagctcactttagtatcattagcttttttattcttactttcttggaatgctcaaggctttcttcagcaattaaaaataaaacacaaaagctacctatgcctaatggttttgaaaaaggaaacttatccaagatattcaactgtgtgatccaaaagacattagcaacaaatctttttctgaagtgccctaagattcatttgatgccaccattaggtcccgtgatattcacaataacttttaacttgggcttcttcaagtttaaaggagaaccagaaacatatctaatttattcagttcttttgtcaagtgccaagacacatcttgaaatttcaggaagctgggctaagtgaataaaaagaaaagatcaaagactatgctttgaattttggtagaaaaattaaactgatgaaatttaaataatattcaaaataagcaagtgggaatttttgtataggcataacacaagcagtgaatactgaacactgctggaactgagagtatatagtgttcaaacatgagttggcttatacttatatttggaggattaagtgggaccattggtactgaatatatacactatgagaactggttgtagccaacttcacaaatggaaaaagccagaagtgttgtaatggacgtgcagcctcgctcttagcatcagaagcacttgccactacttgtccagcgctcagtgtgctgcaatgtttggagtttatccctgtggctagaaacttatataacaattgcttcatgacagtcttagcatagcctgagatcaataggagcagctgtttaccgacgaggcagcctagttcacaggataccactttactatagggcttagaaacatgattctatcttcctttgggacagccaactgacataagcaaattaggcgcacatcaactaagttgtgcttatgtaattatatgccaacatcaggtggattttccaggaatattgagcatatttggtcatgtgtatatctgaactctcaaataattctatgaagcggtttgcatcatatattctttgttttatatttatatttattatttacttgtataatatgtccaacttgatatgaaagtaagtagatgagaattctgcataattcataattacaatttccatagtatggttcttttagcttttcaggcactgaaattggcatggggatacattgcaaaggctgagcttgtaggtaccagcaatgttcaaaacttgctctttggaagagagggcattgaggaaaaatgactacctatgatcaaattaatactaagtatgagactccaggctgaagcaagaaatatggagggagaatgatgtcgtaagaacaaatatgagattagaaaccaatgatcaaaattgcaaagaaaagagaaattgattgagaaatttttggcaatgagataaaatgaagtaatctacttaaaaattcagggtttggacagcctaagatagcttatgatttcttgtgagaaaataataggtttctttggaatgaatcaaagcacttagtggcatattatatagacagcaatgtgagtaagtctaaatgtcaactgtgtactctgaataaagtggagcaattgtgcatgttggttttttttatcatcagggagggcttttgagtaattttttacttagaaattgctcatattttactgtaagtcaaattcataaaacttctcctagtagagatatttggcaagtacagctttagtagaaaaactttaacagaacttcatttgtaagagaactatttctgaagttccttacttgtgtccagccacacaaataatgtttgttttcttcacagttacctccttaatacacctcatcttctatg

SEQ ID NO: 188 - DNA, 2025 bp, Mus musculus
ttcatctttttttttcaaaactcctttcaatgctgtgaacagtcttttgctagagtagttgcatggttaattttaaaatacattaactattttccattcataagtatgtagtgtttcacttatttctttaataactaaagatagattctgtaaattcagatttccattaagtcttggaaccaataatccagcaagaccatttaacattttgaatattatttacctgttgtttaaaacaggtcagtggggcaaattgtaaatattcataaatcactgaaaatatatgtaattatgagtataattttgtatcttatagtcatttagtgatttcctggtttaggataaatattatctctaaagaactgtttcagcattatatatatatatatatatatatatatatatatatatatatagttttaaattattttacaattttacaacattaattctactagaaaacattcattttctagcacactgtctttgtcataagtacagaaactgaacagagacttttttcatttacttatttctgtaaaaacttgatcccagatggaaggtaacttggaaattgattgattttttttttccatgagataaaatggtataatttttaaacatctcagttgcagaaaatctcaagtatgatggaacataagaatgactgcactatctcagatatctaacttatgtacatctttggcaatttattattattttttattaaacaaatactacttcaagcctatttttgatgtttgtcacatgtcggttttgagaacaattggagagctgttttaatttccagcctgtaaaaaaaaaaacatttcctttaggttaactcaccattctcaattccttggcctgaaaaggatcacatacaggaaaagtacaatatataatgccttttaaagtgtatgggtgtaagcgtgggtgtcatgcctgtgcagttgtggccaagcctcttctggaaatggctccgagtgtaatatgtggcaaggacttgtgtggatatttgtgaagaatctgccggcctttcctgaaggaataattggtttgcttttgaattgtgtttgcctttttttagcttcgctactggcaatttttactttcactttgtgtgtaacagatgtttccccagaatcagaaaaagaaagctcagaccatgattcattcttgtgtgtctctgaggatcttaggagcagagcaggtcacactactcctgtttgttaataatgatgatatggttgagtctaggtgcatcagctaaagtccagttgttctctcccaatgggaacttggtttggaaaataatttgtccagcgacctgttccaaacaacagatgatatttgaaaagttagaaagactttgctggattattggttccaagacttaatgagaacattcggaaccaggtaaggatgaagaacctacttaagtcactaatttgcccagagccctgggtgttagaggaattagatctcctgatcaggatatggagagacgctaggtgccaataattaagtcagaatttcctgggtatataatccatgaaccacaatcgctgccaaccatgattacttggttgtgtaccaatgtgctgggttagatattaactgcttggtgaagctgtgcttcaccttcttgatacagttcattggttagcaggaaaacaagggaattgaggaggagaaagggggaaaatgcagtgtgtacgtgattgttgaccatggaaatttcttaactttctcataaagaaagagaaaatgaatgtaaaccttttcagctgtgaaaaaaaaaagatatataaataaagatggcatgagttatctcagggcaagagtgtggaaggaaactgcagttcttggtccaagtcttctttcacccccttccacacacatttctttaggttcttaacaccagtagaactggatttcggcacatgtggaagtttgaatacaaaatctgggcgttagttctctcctcttgtgatatatttagatcatcaggcttgcatggcc

SEQ ID NO: 189 - DNA, 2225 bp, Mus musculus
aaattttacttttaaaaccacaaatcgtcacatcgcacactgtaactctgaaactcagacacttgggtctttagttgcatatttagagggaaatgtaactgtgtttaaagtagaacaaatgaccagtgttaacatcaatagatatattttaacattagtgttttgttctttttctacatttaaaagttatggaaacagacatgagtagatataaaacaaaacaaaacaaaaccacaatggcttgaacaagaaaataattacccacagcaattgaagcacatattaggggatgcatacagtagggtttcagtctttccaacacttctcaccaatatgcaaaagggcgtactcttccatgatgtgcacattcaagccatgttctccaattgggttttggggtgatattagtaaattctcactgtaaatatcaatttccctaattctacactgcacagttttcattcttaatattaataaaatgtaagcaaacagacaaggttttcaaactatcatctgacggcatggggaatttcccataggtggaaagaaataacgttttcaaatgttttcttctaatacatgctttgtccttgaaccatgtacatcatgaccaaaagcatttctcttgctgcttcttgactatgttttcagctggttataaaaagtgtcaaggtttctttacatattctcttatgaattatccagtggcttatacttttaagataacattccacgcaggtgagatggttactgccaggcctgacaacccgggtttcatcccagaggctcacccagtggaagcagagagcggattcacaggttgttctttgactccagtgtgcatctagctatgcacacacacatgcacacacacggagatacacacagagaaagacagagacagacagacagacaaagagaatgagaaaaccagcaaaaccacaacaacaaaacaactagtactctccaaatgaggcgcatgaaaagttttcatagaaaaattaatacaaatctagaatattacaactggagaactttgaaggagacagcaaaatggtacacggtggaccacataaggtatccatagaaactggctcaaaaagctacaagctgtgatggagatgcctcagcctgggccaggttatggtcatgcttaccactcagacacttgatactcagcaaggtcctgagggaacttgtgcctacggatagatacactgtggtaactacccttgtgtgccacagactggagccatccactctctcctgtgtggatctccagatgcacggctgcttcgcttgaaatcaaactgcattcttcctgagcaacaacctcctctgaagccttgtcccttagcgtttggaagctgctgagctgcacataatcaagccttcctcggagttgtttaaaacaggcgcattatcagagtctcatctctctgaaagcttcagacttcattacactattagaaaaaaattaacatattgtacctgataagcctctacacagccgaaatcctcgcatccacactaatgctgactatgccagcacttctttctgattaaaagtaagttactcaaagttaaaatatgtgctctttttctacttccttcttgagattaaaaaatcaaccatgaagttgttctgacgataattttctttcagtaaactcaagcaatcattgtagcatgacattttgattctgattttgaagggatttgtgaaagaaaatcaagaggcatgcttatcatgggtaacaaggacgggaaactggaaggaatacagtgatcccgggctagtggcttagtagaacattttaaataggctgctctaatgctgttttatatcatctgttagtgcctaaataccattaaggttgagggatttgtcaaaaataaacgtatatagacatttgagcgagaatagcatttttacatttttgaaagcaggttttatctataattacgaataactatgtatgcatttgtggcagagccaatttactgatacctaattttaatcatcaaaaaatttaaactaacttaaaagactggaacttctgtgatctgaaaccaagagttgcaatggtcttccaagagtagactattagtcaccactattttacaaagcaaggtcctgcaactttatgttaagaaatgatgtgaacagcacaggactattgatttcaaaactttaaattaatacggttgcacatatcacatta

SEQ ID NO: 190 - DNA, 1900 bp, Mus musculus
ttttaagaaaattgatgtattttatttgaatgtttttcaaaaaacaggtaaacatagttttgagagatgaagaaatttcatatttaattcaatttattattttcattaaaagtttggaggttttaattacccaagacatctttccttcctcaccttaaaacacacacacacacacacacacacacacacacagtgcttcttggtattagttggagatacttctataaaaaggacaaatattacctcattagccagaaaacctcttcactcatgatgctatttctggtaagagtgaacatctaagtggtaatcttaggcccatataataatttatgaatattatactatgtcttgaatgtgatatttcataatatatttaatagactattgttagactttttctacttttaaattttttgatatgcaacattactgtgataaaatctattataaagttatttaagtttttctttcaaagaaatttctacaagtggtgtggttgaatctaaggtattttcaagcatatgtctacatatggtatacaaatgttcatggcactgttataatagtcaaaaacaagaaaaagtacaagggtatgcataacaactgataaaagacaaaagccatgtgatcataaagtggattttagtatattttattagtttttaaaaaaaatgtttttaactgaaatagaattacatcactttcccttcccccagacccttccaggtataacaaaagcagggggagatttcaattaagaacacacttggagctctctgggccaagccaagccgtcctgagcagcctgctgtcccaggggttcctccattctccagctgcctttcctccacctccaccagactcctgaaccatacagacaggagcatgttgtcctctgagagactccacccagcagctgactcagacagatacagacacccacagccacacagtggatggagcttggggactgttacagaagaatagaaagtagtgtgggccctgaagaggataggaactccacaggaaaaccaacacagtcaactcacctagaaccttgggactctctgagtctgaactgtcaaccaaaaaacatacacgggctggaactaggcctccctgcacatatgtagtacatgtgtagcttggctttcatgtggatcctgaacaactagagtgtgggctattccaaaagctgttgcctggatgtgggaaatgggtcgccttgtctggcctcagtgggagaggaggtgcttagcctcacagagactttaagtgccagggtggagggggatacccacctgctcagaggagaaggggagggggatgggtgaggggttggggaagaaaaaataaatttaaataaaaggaaaacaatttcatacacctgcaagaaggaatttcaacaagaaagcagggtgtttcagttagcaggcaaaaggatacattccattgtgatcatttaaatacatcaagtccaaagaaaaattattttttttctttataaattcaatcctacatgcaagtctaatagttaacggaaaggtgataagtcagggaagggtgcacaggaggaagtagacgaaagggagacctccgagagggaggatgcactgcttatggacacgttctcagaaattaaaattattaaacgcaacaagtccaggttaaactttcaagtctccagtcacctgcatgattagggagagggatacttggttataattaatcacacagcagattggcacaccatggataacgagctgctcaacactgccctctgctgtcagtgccatgctagttgctctcgggtgtggggagtcactgactttagaggagtcagccgagagtacatggtacatgcattgacagctgtagctagaaataaactcttgat

SEQ ID NO: 191 - DNA, 2125 bp, Mus musculus
ggacaatggaattgtgctgcttgtacagttagccactggctcaatgtggtaaagaaaaagtgaaaaagggaaataattcaggtcacattctagtgtgctggtacccctgctctgggctctgtgtgtggactctgccctggagagcatggtaggtgagagaggatcccctggattctcagaactcagtgcctcctatccctgagagtgtgggaacttggctatgagtcagtgttttaaagtcgtatacctaatatgtatactagatagatgtatgcagggctgtaaaagaaaatcaatttcccatacacacacacacagtaacacagagagagacatagagcatgcagagagacacagtacataaagacatacaacccacacatagacatacaacacacagcacacaagacgcacatacacaccaataaacaaataacaagtgaggtggttttttttttttttaatttttaagggaatagtgttccgtgacaatttttctttaagtcagtgatcatctgatcccaaagacgagtctctctgggtcacagtgaacagaatctctagtccattgctcattgctatactgaagacccaggaggcagaggccaggaaacggactgaactgcagttttcaccagaactgagggaaagcgtattcttagcttctctccacctggcctagagaaatgttgccatttataaacagaaagaagcaaaatctaggccatgtgcacatggaggtttagtggtgaggtaagttatcagagccaagtctcctgggaacccagttcctcccgggaggccggttcctgtgcaaattctaattctccagggctggagtagaactacaacagaccaaggctcttccactaccccacctgcctctacagacactcacttcataagtatagacagtatccctatggatacctgtgggaactaaaatggggcagggggaaagggggagggagaatagcccacatccggccagagttcctcctatgctctaggcaggcagacggggagggctgccaaacgctttccactcagccctgggtgggcatctaagccattgaccccactcgatggggggcggggggtggacaaggggcagcccctgaccagaggtagggctggggaaacaccctgtacccccagggttatgggagagagggctgagggagagaggttcccacgcaggcgagagtacgcgcagatgaacagagacagtctatgattttagagctttattatagaaaggcagggggaaagagagaaggcaaaagagagagaagaaaggctagagagaaagagagagtaagagagggagaggaaataagaggagaagagagggagaggagaggagaggagaggagaggagaggagaggagaggagaggagaggagaggagagcaagaggagaggagaggagtgagagagtgaggagctgcttatagcgggctgctttatcttactgttgctaggtgactagggaggagtttagcccaaaggtcagaagcttgggacactgcctacatgactactaaccatgcttctcttgtgggggctgggggggggaggggtaacttcgacaggagccttgagttccaggagacatgacagaactccttccgtcccatgtaggtgaattatcaccaccgggccccggggttcagacctcagctcaactggaaaccagactgtctgtgtatagcccaatgccccgcagatacatagcagaatgtgatctcatcagtttgggagtttcagcccgtccttttctgatccctagaagttaggtctcctgggaaagctaaagtgaccagtagaccatgtggctgctggaaggtacagtggctttgcttctctgcagagaatggcagaagatccaaacaagaggaggctgacattccaagggaagaggaccacctggatcatccctgtgacactgaatgacctcctggaactgaaagccagctaccccgaagccccactcgtcatggggaacaccacagtgggtatgtgttatctcggatatggtttagcttagacccattaacctaagcatctgtgctcctctttaaactcttggtgggcacagcttgtttctattcatgggactcag

SEQ ID NO: 192 - DNA, 2125 bp, Mus musculus
ttcatgtttttcacaagatgctcacacaccacaagcattcagggaattcctagatcactctacatttttcctaatttaacatcatcttcaagggaaaccacatggctttgccttaggatcattcatgtgacatattttgtatttataggttcggttataactaagattacagtgggttataatgacaggatcccactctactaactgcactaaggacacagagagaatggataaaatgagtttattaatgctaaacaaatatagaaatacttgcccccaaaaaggaaatattaaataagtagttattcaataaacttgctctttccagtataatacctccattacagacaaataagatcttcagaacactcgcctcctcaagggtgctcttgatattcagttaacaatatttactttttcttcattcagatttacgtggaggaagcccctgtgctgactacagaagcaacaagtgagcagagaagcagaagcccctgaggagtgtgtgtgtgtgtgtgtgtgtgtgtgtgtgtgtgtgtgtgtgtgaacgtttgcaattaaagcaagaaaaggaaaaaaaaaaaagcatgcatttgccaagtattgaagttttgaaagaaaaatctgcccccaagtcatttgtttctctgacttggaagcacaagggactccttgcttctagttagagtttctaaggttctaaggaggagcatgaatagcatatctgtttctcagcggaaaccaggtttccagaacttcagccatgtatttaacacctctgtgaaatgtcaatcacaggtagtcatgagaacatgattcttccacatctgctttcattcatgggagatgttcttcaaataggcccagataccttcggtaccttgctacagtggtggtgtttttctgcaagggcgggtattttaatgtggttaagctgacagagttgctgactgtgagtgttgctgaatgctgaggagctgggagagtgggaggtttgcttggcgtgcaggaagcaggacttgggagctggaaatgtgaaaccaaaaagaaagaaaaccagccaatgggataactaccattgtggctgaacctgaggactctcaacggcaactcaaacagactctagaactgacccatggtctgagatctggtcacatgatcctcctcccttccctccctgtctccactcagtgtcatgcttgcctcccctacagatgcctctcagcctggtgcctttctattttctcctgcagccataacttctagcacatttaatcccaccttttcctctgcttcgtcaatagtttggatcagtgcatacaggaacactacactgcacatacaggaataatacactgcacatacactgtatgtatatgcagttatatgtttatctacattctatgcatacacaatgtgtgcatttaaagtaaactgtagtataatacaggacacctggactttatcactcagctgctgctggtccaacctcttactctagccactgatgtagtattgagggcaatgtaggtcctaacatctttgcccagttccagcttgtattattcctcagtaatgtatatgtgacctgggagtctagcagtgtgaggtcatcataaatgagtggagaatgggagttcatagatgaaaaactttgtcccatcattctctaggaagcactgaggtgcacagcaaagcagcttcagaaggtcctgaggatccagcagttgtgtgtgccactgaccaactcgtcacctaggtacttatctcccctccttgactttattcccttcccccagcttggttttgcttctccttttggacacatcctgctccaaggtggctttgaactcttaattctcctaccccagtctcctcagtgctgagattacagcactcaccaccatacctagctctccatccccacttcaacatcctggcccatcacctctgcttttcaggatgccaagtaaactttctttgctgtgatttttcaaggaaaccaataactgagatctttctaagctaaatccttggtgaaattgcatacaaaaatgagtatacaaatatttaaacaaaaaagtttaacataatatttaaagtcaagtcatatattgcttgaaac

SEQ ID NO: 193 - DNA, 2900 bp, Mus musculus
gcagaatttcgtgatggagggaagttgctcgccttctggaagccagaaagcagacagagatgaacagtttgggtataagacttctaagtcatggcttcagagtgactcattacttagccagccctgcctcctgagccccggattagccactgacttatgtatggattaacccaccactcaagttaacatttctcaactcaatcacctctcagcatcaccaccagctgaagatgaagccctcagcagatgaatctttgcagacaccttgtacccagcaatagcaatgatctctgtgggagttgtgcattggttacattggcattggttatgatgtgctactcactatatgtgtctgtctgtctgtctgtctgtctgttaactcatggattatttgttgactgggttgggacatgtatatcccatggctataagcaacttgtgtatgcccaatgctttggctcttaatactggcaaaccgcatgactttgggctccataacagctctatgtgcttaactcttcttatctataaaggggaggacaaaattaaaaccccaacctcattattgtgaaaattaaatagacttgctcttgtagagtattggaacagtgcctggattgtagcaaattctcaatggatgtacgctggtgtggttacgaatggcatccagcctctagtacgcgttcagctgtgggtgcaggcatagaatccgtcagctcttctctaccacacaagagacactccatagtttttctttatcctttgccctgagaaattcaggtgctgtttctatacattgaatcactgtcctctggagttgggtagcattttgtatgaccaccatggcaagtcacagatggtgtcctgagacatgtaatggaaaccctcaagataaaactgagggcactgttcacgaagagcccatgaagaaccacagtgttccttccttccttccttccttccttccttccttccttccttcctttctttctttctttctttctttctttctttctttctttcttgtttttagcttgctaataatttctctggcttgctgttttgtgaacatttgcttttcctcgccatgccccgttggtagatttccagtctatctttcaggcacacactttctttttcagccagttgcgttccccaccagccttcatttaatctttgttcacatcccttttgcctacatgagaaacagagtttgatgtgagtgtcaaatggatgaaaggtttctcctggtaaggcaagtttatgtgtccttgggggtctcccgcaaaggtacctcctgacctatatgcactttattcacagagctttgaaatttgctcagcttgctaacaagtcggagaatatttacagagcagagatgagtcaaatggggaacatgaacagatggagaagagccagttgttgcgcttcaagtacatttcccacgttggaatgtgtcaatgcctggcggtgcacactgcctgcaagtcacccacatagtataaaaatgatttcacttactagcaggcgcctttgttttgccattacataatcataaatgtgccccaaagagaaaccattagaatgtaagccagggcaaggagccagccagacgtgagttctagccctattacagatcaggacctaccatgttcctacacatcctcagtggcctttcagaactaggacagggacatgccgtgacgccacttttgtctgatggcttgtcttccatctaattgtctggcgagccagattcccaagcatgttgggagggatatgggagggataattgacattggtgccctgaggtgtccagagctatcccaacccatttgctgtgcctattccagcaaaatcactgctcccagaacagactcagcacagcttgaggaaagcctgaagaggaaccctcaccccgtttccacccccaaggccttgctgttaatctccacaagccaaaagagcaaattgtcggtgatccacttagcaggctctaaacacctcagctgcatcctttcggaggaaggaaatagctttcagggatagacgcatctcaagaaagttggctacaaagtggatttctataaacgagaattccattttctcttggctcccattacaaaattggaaaatttgtcacactgggggaaagaagtctcacaggagatgaaaaaaaaaaaaaaaaagaacatttgggatgaaaaggaaattaagaaaaagctatcgcattggcacactctccctggaatacgctagagccagctcggagccacaggctgggtctctgtacctcagattgtctccagcatcaggaaaaaatgctggaattcattcatggaccttatcagcatcctctacctctcccctcttctgctgcaggatttccctcatgattgacatgattgcatttctgtgttcttgcctctcacacagcttgctgttgttcctccatactggttagatggagcattaggctgaagcacaacattttgatgttcactctcttacttattggaccccagtttgtatctgtgatgatgtgatgtggcttacaggcaaaaatgggacatttgggtttagggcttaactctacccgtttcatcttttctttgcatttcaggcctaattgtacttatttgccctaattaagtcagttttgacatttttaatgtcacgggccataatgcgaaataataaatattaattgatttttgttggaagagcctgagaggtcatctagcctacctcccacccagttcaactcctaacatccccgttcctggaaacagtttggcacctccacatcaactctgaaaggagctcctgagaggctgcctggatttcctccatgaacgggtccatgagatgcccttatagagaataagttcattgagttt

SEQ ID NO: 194 - DNA, 1875 bp, Mus musculus
ccactgccttttaaggacatcctaagactttcacatttttactcttaacaaacacagtcactctgctgcaaaggagcctaaatacagctttcccatttgcttgactaagagctgtcattgctaggagctggctgagtgtcactctcaggatgactgagaacagttaagttcagccacccccactccctgcactattcgggttttagcacacttcaccagagtgtcgctgttaatgattctgtgattctatgaaagattctgtggtgaaaaaaaaaatctccaaaagctggaatgacttaagaacttaaggaaggacatgggacgagttttcatttctcagggcttgcagtgggtaatgttaaaaaaaaaaaaaaaaaaaagaaaagcataactgtattgaatttacctgacctgagcaaattggccatgttaacaggaaccaggaataatagcaacaatagcaatagaaataatgtcacagaaaatacaaggatctttcataactttgcatatatcgagaacagtggtatgagaacaaattctgagatgatatacttttagttcattttatgtcgatctgaacttcacagcagatcaactctagactccatactcactttaaaaatataggcttccaattcaaatatactttgacttacataaatgtgatctcctatattaaatcttgagtacttgtgcattgattcaccaaaagatggcttgtaatagaaccaggacctatgtcattgacatggactgggtgagaagctgtgttgcagctgggagctggctggcagatctttcttcatggcatgggcatgtctacccttctctggggagggcaggcaagcatggttatagaaggctgggtgcaacaatcctaactcagagtcaatttgccctgccatggattttcaggcaattaaggaaatggagttgaaaattaagtcacagagatgttcgttgggctcccagcagggtccattgccccttgccttttgcctttcttgaggatgatgtatcattggttcttcgataggatctgcatggtccagttctcccttcccaatgcagtcaacaagggtttccaagaggagagatggaaggcctggctcatctatttctaatcaaatgtataatttagaaaatgattctgagataaagggaccataactaaggatgtggcgtgggtgggtgaggggtatgcaaaagaaagacagcttaagaaatcatagctcaagaggtcagaagaatattcctgaaggcagagttacttaggtccccaaggacaagaaataccttactaattactttatttcttaaaacagtgcaaagggtttattgggctgtagttataacaacgtagtttgatctatttgaggaaaagaacatttttacactcctctaccccacttctaattttaacatagtttctgaaaattctaagaaaaggtagtttctagtgtcatgagatggtagaccactgtaattttgaattttttccctatggaacaattttatatttatattatatttgagaaaatataataattactttgctacattaactggtaagatttctaatgattcacatcaggctgctgggtttattataaggcctactatgtaaatctaattcctattcattttaaaaacctatctcaagtgtcagtcatgatgcctgaaactgagttcaacagttggattttgtgaagagcaatactatttatttaatggtagtaaaaaaatcaagcaaaaacaatactgtatttggctcttactataaaacctagtagaatcaggaaaaaaagcttaatatcataaacaccatagactgtggcagcccattagaaggactgcattgtatgcatgatg

SEQ ID NO: 195 - DNA, 2025 bp, Mus musculus
ttttgagggtggacatttctcccacagcccattccaggcaaatgggttctgtgaaagatttgtattctacaaacaaagctaaatgctgcagaggctcacctcagagagcaaggtgttcggaaactatcacttccacgatagccatttctgttaaagaaattgattttgcagtttttagcttcttgtatattctctctcactttgtatctccacccaaccttcgtctccagataagaggttgttatttattgcctcttgccagcgataataatggcagatgatgctggatgtgcccttgttaaaagtcaacagaacaattagctcaaagggaatacacactcatctgagaagctaacttggcctccatttccagtatctggttatagtgagttcattaccttatctccaaagaaataaatattccaagattttttttacattaagtattcagtcaaagcaagcgtcttgtgatcactacctcgtatttacattgcattaagcatcttattcgtccctacaacaacaatgactacaaaataaaagtcttcatgctcattgataattagatgtttgcttcatttggacttcctccaactctcttctgctcagatacagctctttataattaattatcctcttgctgaacaactcaaagctgaagtctgaccaaagtacatctcatcccacacagatgtcctagttattccacaaaaggttaattaatcataagaggtgcttcagagcaggaggcactggaagaaattcagaccgagttgctggcaacgcagagaaactaccagcacgcccctagttattgagctcacactgagagactctttcagtggaacaaaaatccaactgcacagaatggctggtgggtataatatcctgctctacataatggagcttgccacttcccagtcactgatgattcagaacccccagcctgcccgtgggggaaggtcagcactgtttgtccccatttaacagaggtgcctgaaactaccaaatcacaagggcagaagcagtctccattgtccccctccctttggctgtctgtcatttcatcacatggatgagccctcctctccaaccagccagtctgcagtctgccacctcccaaatgttccttgtgctctcccaacctggagtttcagtcaccctagcccctatatcctgggacagccttgcctgcattcactgttcagccaaagcctataagtcagccaagaccaagttccaatcacttcatccataagtctgcatccagaacgcttgaactcacagaaagcatgtcttcttttgatcaggaacacttccttggaaaacaaaaccagagatgctatttggctcctgttgaatgtctaaccttgagcaaggtgtgtcgtgattcctgtgcacatcactccttcctgttcaatacaccgtgaagaatttactgagttttgctatggatattatctagaatgaggtatgcaaatgcctgtcactttgttgcaacttaacatatatttctttgctgaataattggctgctcttatgcttcggttctccttccttcttcttctcttaacaaaagatgtgacagtcacatctgacttgaagtcatcgttctctgaagaggaagaaggcagttccatttgtcctagaacaagagtgtcataaattgggaatttgaaagatttatacagggttacggctgtggctcagtggtagactatatgccaggtgtgtacaaggccctagttcaattctcaggtgggcaaaactataaaaataaataaatataaattagtaaataagtaactatctatgacaaaatacaggctatgagaagaaaaattttgtgggagcagatgacatcagatatcagattctcaagccttgggggttcatttgtggtcctggaggtggctatgaattgaacaatatatatatatctagcacactggtccttactaccacatgtgggtctccaggagattgctctagttctggctgctctccctaaggccgggtgtccct

SEQ ID NO: 196 - DNA, 3125 bp, Mus musculus
gcagaattaagttggctttgttttatttttattctatcattctgctggaaatatgccataatgaactgtgacaaatcatattaatagtcttttggagaagaaattaaggagactatgatgttcagtctgtcaataaatgctactttttaaggatttatatttttttattttatgtgcatgactattttgcctgcatgtatgtatgtgtaccatgtgcatgccttgtgcccacaggggttagaagaagacatcacatcccttagaactggaattatagataattgtgagctgccatgtggctcctaggtactgaaccaggtcctctgcaagaacaacatgaggtcatagccactgagcctttgctctagctttgcaatttttattttttaaataatttcttgtatttttcaattagcatacaaggtattagatgctattgttgtattttcaaatgttttagaagattctactcagcatacctatctaactcatatgtgtgtgtgtgtgtgtgtgtgtgtgtgtgtgtgtgtgtgtatgaggaaagacaagcagggttttgttttttgtttttttttttttgtcagtgattaacaaaattaagacaaatcttctaaccaaaaggcagtgaaggagtgcctgggagccctttccatccccaaaccctaggatccaccagtgaactcatggttgtgcatagcctgggctggtgcacttgtaagtgaaacttcagggatagttttctggcaataagcaggcaaaataatgagcattggagggctcagttcatttctcctttctactatcttcctgcactttcacttccacagtaagctgataatagcatagatagagttactctcagaaaatcaaatcttataaaacatgatcaaagatagactgtgctacactgaaatatgagcatgaaacctaacaaactttaatttccttattacttatgtatagtgggagtatgtacacatgattataggtgcctgagcaagccagagcctcccctgtagctggagttacaggtggttctgaactatccaacacaggtactgggaatcaaacctaggtcctctggaagagcaatgttctctttgtacatgttaagtagctgtatcttattcattcttctgtctcattgttaaagagacagtactcagtaagtgtggatgactatttgagtgcatagttaactaggcaactgtgggcatccccataggtaagggtttgactaacagaaatacaatcatattccattggcaagatggctcactgggtaaaagcacttgctaccaagcctgacagcctgagttcaatgcccaggacccatgcagtaaaaggagagaatagacttccacagctgtctcctgacatccacatatgcccacacatatgtgcatgcatacacacaaatgtacacacacacacacacacacatacacacatgccctaaattgcaatcaaactttatagaaaatatttttaaaatatttaatatctttagtgccctcaatgctacagggctaaagggaaggttaagaagtctccaagtgcactccccctctctctagctgagtgagatatcttggctaatactccatggaaatgggccatttggaaagtaaatctccctggggccttacaatcaacttttctcatctttttaaccctatctattgggaaatctctgtaaaaacatatttcacggaaaagataatcggatccagtcaataccacatggaaagatataatagccgaaaataaattattcacttccctgccttttaaagagtttgctgtaagcacctttgacagctgtttttgactgtgaacctcagttcctccgctgccctggggcatgccagaacgcctggcttctgtgtgtgtctcagccacttctgcagtgtgctagcccctactgcccgccccttcccctcctgtctctgtctgcggtcggtcgctttctgatttgggttttgctggtgagacttcctcaagcaacttccttccccttctccttgctgtggcaatagtaactaggataccaaactcgttagaattttcagtaaaatgaggttaaagaaaatcctaataaaggactctctcatgagtaaagtccatgaggtttaagacaatggttatactgtagatgtaactgtgggctccatctggggcctgtggctgtccagcatctatttggctacttatgggctagtttttatctcttttctatttttgttctgaatgggttagtatgaaataattgtactttggcaagatgaaacatggctatatttaaaaagtgccatatctcaaaatggcataaaagaggtatcctcagctctagaatcaaacctgtcaccaaagctgggcccctcccaacacatgtccccacataaaaccagggctgtgaactatacagttcaggaggctagaacttacttagtatgtgtggaaccctgggttcaatccccatccctagacagttactaggatgtagcataagcaccattagcaggtaaatagcagatcatctataaaatgaaatactctatagctacaaaccatgaattatgcatgcatacatacatacatacaggaaggggctataaactgatcactgtcaagaggagacaggagtattgatggaaaatgcttcctttgggttcctcaggaaagacagtctgaaatatatctcatgaggcttctgaggaggtctcagtggaatctagcacaccattctctggtggttataatagtaagtgtgcttgtgacaggatctaaaggcacctaggagagaagcctctgggcacacttgttaggattatctggacacacttgttaggattatctgggcacacttgttagggttcagtagattgggctaatggatttggggaagaccgaccctaagagtagacagtactattccctgggctgggtcttggattgtctgaagatgggaaactgagctgggcaggagaatacattgctctctgtgtcctaaatgcatctgctttcatgccttcctgccatgatggagtatcttcacccatcttcaaatatctccagactgtgcactgaagtaaatctgtccttaagttgctttgtcagaaatt

SEQ ID NO: 197 - DNA, 6450 bp, Mus musculus
gtgctctgctcctacctaggagatatggaggccacactggtgtcctgctggtaagcattcaccccattcccccctcttcccttcctctgcctatcaccaatttagtctcctactttgtgaaccctaaactttgtctaggctctgcatacatctacctagaccacatgaaacaggtacacagccaaagactgtaatggtaagcttatttgatatagccagagccacctaagaaccctgatcctatgcactgtagtttccttaaatgttcaatcttttataaatattcaggcgtatatttaatcattttgatgttttctggttatactcaatgttttctatattcactccttaaatttcctaataaagtaactttatatgccttaaaaccctcttcacgtgtcatgttttcatctgctgcattgccagctctctgtcccctgcactgccagtctcattcagagcccctcattcctgtcctcttcacactgaccccagcccctgacatgcatcactgttagaaaagagcagcccatgtactgttgccagggtgacatttccccagcaatgtctgtgtccttgggtctcccctacacctttctaggtaaaggaggtgggaattggtggtattggtgggttttgtttcttaatttgcctaaacaatgaaaagggtggctgaaaggaaggggggcatgtgctgcttcgaccctgtaacatttggcagtttctgaagagactgggaactttggctagccatgcagcaaaggtgctatggcagggagtagggtgggaggagtgggtggggcttggagatgtcacatggctctggccctagctggtgtctatggatcacccctctcatctactgacttcacaggcaaacctcataggcaagtctcatgaaaggatagagagacctgcatttcctcccaacccaccaatgctctgaggtcttccagaaggtggagccttactttgatgtcattctaaatccccttctgagccctacttaccgaccatgcaagagatgggcccctctccccttttgcaccctgactctagacagttcagaaaggaggagaaggagtggggtttctttggacccttctttctgggtaagaatgcttccatttttccaacaagcctaaagaggctggcactggccagccagtggtggtgcagtttctttaatctcagcactcagatggctgagtcaggtgaatctctgagtttgaggccaacctgatctataacaagttccaagacagccagggctacataaatagactctgtcttgaaaaaacaaaaaacaaaacaacagaaaacaaaagagtctgagtctggtgcaataaagaaatggaaagaattagtgaagtcagccagatggaagcccagagttctcatgctctgcccactctgcttcctacaccataaagtgttttgaattcagaactgtcccaactttccacttcctcctcctccctccccccacccccgtttcccaccctcccaagtttcatgcatgcatgtgctatcacattgcccttctctaccatgtggcctttgggtcttcctgtattagaagccactctgtaactatttcctcatctcagagatagttctgggcacacatgagcacgctacagcttttgacagcaggtgacagctgttatcaacatctcacaaatataatgcttaatcttgaggaagagattgctttgtgttctttttgagacagactttcatgtagcccaggctggtccctaactccctatatggatgaggctgaccccaaacttttgatcctcctgctgttatctcccaagtactaggattataaggatacaccaccatgcctagcgatactcttaacagatcgtttcctttcaaaataagggtctactgccactgagctacatccatagccacaagagttttcttttaagttgctctcctagattccaaggtagatgcataggagacattcctgacatggcgggactatagctgcttttcaaaacagactccttatgtctcctatagcaaaaggcataattttagctggtatcacatcttcctcttaatacgtcctcttctttggtctaccccagagaagtgatctctttgttggtttccttagtaacaagatgtcctagtttcattcttgttattgtgataaaatatatatttaaaaaaaaagcaacttaggggagagaaggttattttgcctcacaattctaggtgacaacctatcttagggtttctcttgctgtgaagagacaccacgaccccagcaactcttacagggaaaatggttcattggggttggcttatgtttagaggttattaccttgccgtcacggtgggaagcatggcagcacacaggcagacagagcggtggacaggtagctgagaattcagacatctggattggcaggctgcaagaagtttgagtgagccactaggcctggcttgagtttctgaaacctcaaaggtgaacccccccctccccccagtgacatacttcctccaacaaggccacatctcctaatagtgtcacttcttatgagccagcaggtaccatttttattcaaaccaccacacaacctgtatttgcaggggagtcaaaatgaaaggaactttgcaatagtcacatcatatccacagtcaagagtgagagaaattaatgcatgagtacccactactctggtcatcttctctaggacaaccaggacagtcttctacagacatgtccactggccaacctgatcttgacaattgtttactcacattgttcccaggtgatgattctagacaaaactaaatatcaccaccacatgaggtaatatattcacttttattacgatctcatgaacaagaaataatagatgatttatagatactctgcacacacacacacacacacacacacatggctatgaacacacacatagacatatctatgtgtgtgtataaataggtatgtaggtagatagattttttttttttttttttttactgctgtgaagagactccatgatcaaggcaagtcttataaaggacaacatttaattggagctggcttatagatttagaggttcggtccattatcatcaaggtgggagtatggcagcatccaggcagagctgagagttctacatcttcatctaaaggctgctaggagaatactcacttccaggctgctaggatttccaggcagcttccacacccatggtgacatacctactccaacaaggccacacctcctaataatgccactccctgggctgagcatatctatgtgtgtgtgtgtgtgtgtgtgtgtgtgtgtgtgtgtgtgtgtataatatttccccctgctctctcccactgatgtgtttatctgctcaggacctagaatgagtctcaagcccttgtgctctctctgggctgagcgctgcatgcagaagatgacaggtgttggctcctggctccttgctaggttcccaggttgttgagaagacaagcgcgtgtaaagtattatgaacaaaaacttcagtaagacttgctgagcttgagagttgtgcatgggtatgaaatcccatctccatagccaccgagctgctcccatcttgaagttcttgtcttagtttatccataggttgtgtccggtatatagcactcttatcatgatgtataatttactttcagaaaaagcatcaaaaattcaatagcttaaacattataactcgtcttggcttttctttccagcttgactactcactttattggataaaacttgatgctgtaggcaaattgttttctttctgagatctacttggagatactaacaatgtctaagttaagtggttccacttgctgattttgtgtgtcaacttgacaaaagctggagtcatcacagagaaaggagcgtccattgaggaaatgccttcattttatccagctgtaaggcattttcaaatttagtgatcaatgggggagggcctagcccattgtgggtggtgccacccctggactagtagttctgggttctataagaaagcaggctgagcaagccagggcaagcaagccaggaagcagcacctctccatggcctctgcatcagctcctgcctccaggtccctggctgcttgagcccacatactgacatcctttggtgatgaatggcaatatagaagtataagcagaataaaccatttccttcccaacattcttttttggtcatggtgtttcgtcacagcagtagtaactctaggtaagacatggtctcaccagccctgctatgggtgtcttagaagtgttatttcctgtgccttttacagtgactttttaaatcagctattatcatttctgtcagagaattaaggtctagggagatcgaggcacagctttctggagggggaaggtcaattcatgccggacaatctcagactttgtcaaacacccttgacccctagttcctttccacttcctcctgccctgttttccttttaagacgctgtcaaagctcttctttcaaaaaagccttacagggccaaatgcagtgggcacacagttttaaataacagcatttgaaagacagagacaggcagatctctgtaagccttaggccggccagggctgcacagagaatctggaaagactctgtcctcttattacataattggcaggaatttgccacctttaagtcatcaataacttcaccagccatcaccttgaggcatctgctaccttattagacttcatgtctttccttccttctttttctctatttcttttttttttttcttattagtttagtgtacttgaatgcacatttcttgcaccatctgtactatcttgcacagaatgaggttttggcaaatctttttgattggatttggagcttcccaagtgtcttatttttcaaaatagaactgtaagcatggaaattaattggtaggtgccccaaatagcatcccttatgtattctgagtagcatacatcccttatgtattctgagtcacctttcgctggcatgctgatgcatttgagccatgatttatatagatatttgcattactaacaaataggctgcatgtttagataacaaatggcatccagtgaccttggttttataggttgtctaattggaggttgagattttggtctgtggccataacgagatgagttgactgctcacaggaagataaatcagagtgcagacacatttgaataagctctggccatagtctaatgatatttttttggatataattttggataaagatttagagctggaggcatagttcgtttggtagagtacttgcttagcattcatgaagccttgagtttgatcctcagagatgcattaaaacccaggcacggtggttcacacttgtatcccaacactcaggagataggggaacaagttcaacctcattctcacctataaagtgagtttgaggtcagtcttgtctgggctatatgagaccctgtctaactaacaaacaaagcaaactaaaattaatagaatcaacgttctttttaagtgtgagttatgtggtagtctggtttcatactctgaataattatagggacacccacactgtcctatgagggaaggcattattattaggattaagcatcaaagtttcggatctctgggtagccttcagtatactgcatctgtagtttctgtctgtcttttattagctttctgccacccttcagccctgtgaaatgactaacacacaccgtcatgtcacattcattgaaacctgtccttttctgctctttttttccctctgggtatcatattagcatacaggaccctctgttctttcccagtggagaggcagcagcagaatactttttttttcttttaatgaaagagctctttcagccattcacttctaaaacacagaaaaaaaccacagagttactgattgaggataaaagaaaatgtaattccatttccttgtgagtctaatcaaaagcagagcctctgaatggcagcttcaccactatccagatacttgcaattaacaaagaagacttggaggcggagaaccagttgataaagttctctacactttttttttcaacttgacttttcataaatatatttgggacatgtatacaactcatagaaatgcacatttccaactaattgtatgggtgattggtacaaaaagtaacaaatgtacagggcaggaagtgtaaacttgattcacttattaaaattggaagagggatcagtgagccacaaatgttatcccttcctccatggccatttcagggagggactggcccacattaaggctaaactctgctagtgtgggaattccccagtgtctgactagatttagagacatagcaaagtgggtgtgtcagatttggggggatcaagactaggggaccttgacaaggtagatgattcctgtgggtaaaagagctagctgcaccagcata

SEQ ID NO: 198 - DNA, 3475 bp, Mus musculus
aaatgccttaacatgttcgagtcctactgttatagagataaaaattattctctttactccttgtgtggagtagatggtgttaaatggagaagatttggggttgccatctcatatgagtaatactatgcctctgtttggagttatctttctatgatgtggacccggtcaccccggaatttacaagaaccaatgaattgctgctagaacaaaaatctcataatgtctgacccagctgtggtattatgatatgtggcattatgataaaaatatcttttacattgtaagagactgagactttgtatagacttcatagtgtaatttactggatgtacctttaagagagctgaaagtagtctctatattccagttccttatgactcagtgttagtagtactttttttctggaagtgttggttaatacacactggctacatgggtcagatcttctggaattttagttgcaccactgaacttgctatttggatgtcatgaacagctcattttaatggagtgaaattgtttgataccaattttggtacaaaagagtgggggtgtcctgtaacaggacttaaaatgtggaagaggttttgggctttggtaatgggcaaaagccagaagtatttttgaaacattgtatatctgtttgacaatggtgacagaattgtggactttaactacagagctggagaaggttccgaaggaagctaggagtcgcatctgtctatagttgatttagatgaagagatctgggacttagagctgataacattcagatgacagttttggacccaagtttggtgctggaatggtgtgaatacatttagtactagggaaggacactggctgtgtttccagcccaggacaagtgttaggaagcagagagctgagcttgctttttgagcccactcttcctgtacttgtttacggtattgggagttgaacccaagaccttgttcatgctaggaagttgctgttccactgagctataacaccacacctttttgtactttctagttttgagagaggatttaagtaaatcacctaggctaggctaggctagccttgaacttgagatcctcctgacttgacttcctaggcagctgagattagtgattgttgccaggcttggctaaagggaagaccaagatgagtgcccttatgcaaaccctaagtcatggagaagaaactaagttagacacacagagcaaaatgaccaccatgtgtagactgatgtagagacaggaatgacatgtctacaagtgaaagaacatgaaagactgccaggaaacagaaacaggaagccttggtactcagaggccacataactctatgtctttggactttgaatctttaatactatcataaaataatttatgctacttaatccaactgatttttggtactcaactatagacagttagggaatggacatagacttaatacctataattgaaatttttaatgatttgcacaaaatatgattatctttacaacaataaatgcaaaagctgttcagtggtaaagagcttgcctagcatgtgtgaggccccatgttcaatccccagcatgcccccccaaatgtcccaattttcctattcctatactttcatcattgctgaatagaaatagaacagatgcatctttatttatatatgtggtgaaaagtttcatttgtttttgagctacccataaatatcctcaattaggtaatgcacattggctgaaccccatatggttgtttgagagcttagatgtttttacagaagactgaagagcaagtcttaatgactgcttactgtacgaaaggcaaaggggctaaggagttgactgactcaagtgccaaataaaaacttgcaaacttctttatagtcattgctctatttacacagatttcacacctgagatagcaatatgtattgctaatgcttttcttgatcattcctgggagatctgtgtaccctgagaatgaagatatctctggtgtgggctgctgatgctggatgtcttttcaggtttatactttcagccactggaggagcctgaatgctcatagcgtccttggcattcagagactctctggggaagaaaatatgagtgagcaaaagggagggaaggagagagggagggagggagggaggaagggagggagggaggaagggagggaagaagacaggcaagcagggaggaaggaaggaaggaaggaaggaaggaaggaaggaaggaaggaaggaaggaaggaaggaaggaaagaagcaagcaaggaaggaggtagaggaagaaggaagaatggaaaggaagaaggaaagaaggctgggaggcaggcagccatccatcaggtagttaaggtgggcttgctcttactcactcctccacttgtatcctgtctccctcatcacaatcagaacggtgacatggcctggtcagaaccaagaatttgacacacaataacatcttgctcaaatgctaagtatgagtaagttgtatagagttttcccaatataaaacttatcttttcacaactggcattatcattacagaaaatgtgctttgaagaagggagaggggtagaagttagctcagtgtgtagaacctgtatgtatccctgggcttaagttcaaggacttcttccattttttttttttaagcagcccatgtctgttgctcagctttttgtcactgggtaatcatctggtaaaggggaaaggttgttctggttcacagtttgattggcatgctgcctagggcctgggttgaggcagaacatcatggtggacatacatagcagaacaaaaccactcacccaagggtggaaagtgaaagagtacgagaaaaggcctagggtcccacaaactccttcaaagctgctcccttagagacctcctatcagggccatattctcttttaaaaaataaaaataactgatgaaagtcatgatattcagttcaggctgaccttgaacatgtgatgttcctgcctcactctgctcagtgcagatgagaggtaattactcccttcctggactaggcttctcacttcttaaagattctccaatcttccaacagcaacactggctgaagatgaggcctttctacaagggcttttgggagactctcaagatctaagctacatcattggttttcttctagaatcttctcttggcaaaggaattgttttagaagttttgttggaaatagatataactcatactgagtctgaaagcaaattatgaggtaggaactggtgaacaaatgctaagtatagaaatcctctcttttgaacatgttgcatctcaacaggctatttgaaatttattttaactctacactgaatgtgtcacaagactgtctacccctggtactgtgtgaaagactgagttatgactttggtttcttgcctggagggcatatttcaataccaattgttggcccagttcccaggtacgaactcactgggacttgtagggaggggttgggac

SEQ ID NO: 199 - DNA, 2550 bp, Mus musculus
atcgcggtattcaattgcagttttccatcccatttactgtcaatgattgtgggatcgctggcacagttttcttattgtgcctaacactaccatgctctcttacagaaagtgagttggaggctaggagacaggcctagcacctccatcagaggttagctgaatatctttgccattcattcagctgtcttgttgctaagagtgaattgggttagtattctttgctttctaaatgtaaataatgaaaaaaaaaagtaactgacatccagactcttacacatttataacttcatacagctcttattaatagaagactgctattatagcctgtatgaatcatatcaacaagaaaagagaagtgctctcgaaagagatctcaaaatgtgcagaataaaaatgcccatgttagattttttttttaataactttataaactcctaaatagccaagattcgggaaacctggaacttttcttggagactgcatttcatcttctccagagaaagcagagcatggaattttcctgaggtttagagatgagcatgtttcctaattattaggacaatagagccattggcgcagcaggtctgtgttgctgcctcattaaatgctgctgggaagagtgagttgagagcagaaagtgagcaaacccagccatggttgttatgtaaagactgtcttgctgttaagtaacttcggacacactagttttcttgcatgaaatatggcaagagagccaccacggatttccaagagaaatcttgcaaagttagtatttcttgcaaattatacttgtaaacaaatggagctttcatggggattatgtaggaggagtgaagcctcagagtgtaaaagtcctgctttcctgtgtctcagggaggaaacagcaggttgtaggtttattagctgtttctaggcagagtggaatggactgtgtcctatatagaagagcatcatggtgagaaatgtcttcccttgggaaggattatttaagctaaaatgtgtcacctaagagaacagaatggtttcttcttcacctactttgagatgagagtagtacttgacatgtttgcttgtaatctgcctgcactggattctccaactcctgatgcatgtacctcaactgtagctatgaaccaactacaagatctaggcccagatgctgctataatctggatctttagcatttagagactgcgtcccttgagtgatacactggaagaggccatgtgacatttagcagttgacatagtgagaattgtcagagaccatcccgtgagaaagtgagcccttcataatctccctaacaggccaaatgaccttgtactaagagctggttatcaccccccttcttccctattcctttcttggcacctgaggctgtaaaagctgaattatagacccctcttccctatctcttcctgagttcccatgccatccaaggacatgagttatgcctgagcccagcctgacccccccacccccaaggctgtcaaggaggatcgatgttccagagataagatccagagtgcctgctgcctggcgcctgacttcggcccccatgtcagcagatgcccacttctttgttctttgtataattctccctcgacccctcccatattccccgcgatgtatgctttaaaaagaaggcacctcagcctaataaacgagaccttgataggttaaatctacttggtcgtcctgctctctttcttttccttccatttccttccaggttcgaggtccccctcgcacccacgaataactgaatcccgcgggacgggatagagaatctttaaatcatgaaggtttttttgaagtagatggtagtgtctttttcacttttcctctttcgtttcctggggtgaggaacatgtgcttttctgctgtgatatagggaaaattaccaacagtgggtcccaccgatcatgaaaagataatttaaaagtctggttataagtgaactctttctctctctctctctctctctctctctctctctccctctttccctccctcctttccttcttcctttcttttttctttctttctctctctctctccctccctccctccctcccttcttcttccctccctcctttcttccctccctccctcctttctttctttctttcttttattctttctttctttctttctttctttctttctttctttctttctttctttctgtatgagtgctctgtccatatgtgcacctgcatgccagaagagggtattagatccctttatagatggtcatggaccaccatctggtttctaggaaactgaactcaggacttctggaaaggcaaccagtgttcttaactgctgaaccatctcactggcccccatagaatacaatcttggactcaggaacccaatcctgtatcttcctccctccacacagcttcccaccccacaccctggaccattattcccatcccacaccctggaccattatacagcactgcccagctctatgggcacaaactggtgtatattgaatatcatggaaacacaaatcatgtctatctaaatatgtaagttttt

SEQ ID NO: 200 - DNA, 2150 bp, Mus musculus
ttacccatctacaaagcaaaataaattgaaataatgaaagatcatagataacaggcagagagaaaaaataatttaaaaggtgtgtttcatgaaatagcaatttcagtagatgtaatgtgcagtgacacatataactgaaggtttttagaaatgtggtgtctctctgtctttgtgtgtgtgtgtgtgtgtgtgtgtgtgtgtgtgtgtgtgtgtgtgtgtgtgtaaaataacaagtatgtgatggtgtgtgcatataatatgcatgtttgtgtgattggtttgtgtgtgattgtatgtgtgtgcatggaaggtgtgtgtgtatgtgatcgtgcttgtatatgctgtatttgtacgtccaggtgtgtgcctgcatatgtgtgtgcatgtgagatggatatttatacctgcatatgcacactataatgtgctgcaaaatatataaacacaactctatgtggccatttgcatttaacaatctttagattgctatcacccaagcagtgtggcaaacccaaatataaactaacaggaactggggcaagaacatgaagagaccatctgctatgaaaacaatagtttgatgtgacaatctagggcttataagaatgagatgattttttttaaaaaaagaaagaatccaaatactgttaaagggtcatttatttactgaacagaatctcacaaatatacccagactagacactttcctactttgaattaaaaaaaaaaatcaccagggtctagagtctctctctctctctttctttctctctctctctctccctccctccctccctgcctccctccctccctccctccctccctctctctctctctctctctgtatttgtgtgtgtgtgtgtgtgtgtgtgtgtgtgtgtataggaccagaatattttgtgaaatgaatgtggagaaagactggagggaaggaaagccatttaatgggaaatcctccagatttgtgtgtggtgctctgggttctaagtcagtggaatccggggtgacaactgactgatgagagtgtgctccccgcacccacccatccactccgacctcactccctccagcatccccattcctggggcatcaagtctctacagaattaggctcatgctctgccactgagatcacacaagacagtcctctactacatatgtttcatgggccatggaccggctcatgaatgctctttggttagtggcttagtctctgggagctctgaggggtctgggttggttaatactgttgttcttcctataggattgccaccccctttatctgcttcaatccttcccctaactcctctataggggtccccagcctcagtccaatggttggctgtaattatctgcatctgtcttagtcagctgatggtggggcctcccaggacagccatgctaggatcctgtctgcaagcacaatatagcatcagtaatagcgtcagggtttcatgggatggattcaaaattgaggcagtcactggatggcctttccttcagtctctgttccattttttgtccctgcatttgctttaggcaagaatgccaaaagtaaaatgagaaactgcaaagaacatgattgtgaagagtgacagcagtcattcctagtgtccatggtgaagagcccagaccataagaaaaatactttgtcagcagcaagatgaaattatagtcaatattataactatcacagtgggtttgcttgtatgcatcttggggacagccagagcctcccaatatcttcagggatgttgggtcaactgtggcccagtaatttaagcactgcaggaatgttgatgttgaaaggaaagacgaggctcatttcctgtatttcctatgtggtacagagaggagagcttgggagcaattccattaaacttaacttaataagatggttaatttgaggaacacagcagcatcctgtcatccagtgttgccaagtcttggtgttgataacagcctgatggtaatagctatcccatgttattctcttcttggaagtaagtaattttactaagtatcacagcagacaagaccactccataactgtgatgatgtgaatccaaaagggaccccaaacaaacccaggtcatgcactctgatgaccacccatacaccaggtatccatctctcctgagccttgctcaa

SEQ ID NO: 201 - DNA, 4150 bp, Mus musculus
aaatattgatttagtgattattaaataaacaaacaaacaaacaaaaataaacattataataaatattacacttttcacctagaaattttttcaaagtaaatttcaaatggattaaagatttgaatgctcaactcacacatggctataataatattaataaaacctggagagtgaaagccatttgagaaacaaggacaaaaagggggaggaagtcaagttaattatgtaaagctgaaatataatacatgtaaaaacagaacactctgtgcacatctgaaaggcaagtgacaaagagaaaatacttatggtcttgtcagataagatttaacgcagtcaaactaaacagctaaagaaattagtgtgagcatcctagcagaaaagtagacacagctctgaacagggtgttcacaaaagaaggaacacaactgataagaaatctgtctctaaagtcttcaactcttagaacagcagatcttcaaactaaacaattaaaaagacacagctgcgtacaggaatgataactctggaggatgtatgtccagacaaggacacagacagtcatgtcattaggtatgaagttagcatttttgttttgtcttgctttgtttttccttggagaacatgacatgtgtgtaaaaatctgttctcctggacccctgagtttctagtcctcgggaattgtactaaaaggggtgagagtgggggtagtgtacatagaaaaatacacgtgtaaagacattcctttcattattgtttataataaggaaacattcttaactgccaaaaaaacaaacttaagatgagctaaaaacaaatcatggcatttcacagaattgactacaggacaaccagtaaaaacactttagaagtaaaagcactggagctagaaagatgtctcagctgttaagagcacacactgctcttccaaagaactcatgttctgttctcacccccacactgggcagctcacaaccacctagaattccagctccagggatataatggtcccttctggcctcagtgggggttcctgcacatatatgcacacacacaccccatacacacaaaattataaaacagtaaaatatttaaaggtgtaattcttgatataaaaacacatttattatttacttattcattgactcttgttaaaagtaggctgcaaataacatgaatattatgatcccatttgtatccatatatatatacacctacactgtattccataatctatacatagagcttcaggaaaactctcagatgtcaatatgttaatgaagttattttccagcagtatgatgctaatgggtacgttatttcaataaccttaaatcttctaatttcttgcatgctttttatttattactggtaagacagaaatatctggaaaagacccaggaatctcccccaccacatttttgcctccgccgactgatatataaatgtctctctgtgtttataagccatcagataaacaaaaccatctgcaagtcattctctggagcaagcccatttctcagtttcaggacaacccagaaggaaagcacaggatgtaaaacagagaaatagggggggggggggaaataagatcagaagttggtccttccccagccacttggctgttggcacccttccccaagggtaaacagctcaggattcccagaaaggactagacagtggactctgcaagatgctgtagggtgtcgaggtggctgaagtgtcccggaaggagaggtcaagactaagcaagggagcccctatcagaggatgctacgtgtttctctacagagcacctgcctcctccttctaagtacagccttcccccaaactcatagcagagggacccttcacctttgttgatttaacaacgtaccaaaaatatagaccttgtgttcttttcttatgtacatgtatgtgtggagtgaatgtgtgcgtgcacatatggatatgtgtgtggttatgaatgctcatgtgtgtggacaccagatggcctccttgagtgctgtccttcagtcaccaatcaccttgtgttttgagacagggtcatccactgacctggaacttgccatgcggctaagttagctggtccgtgagcttgcctgtctccccttcccagctcagggaggaaaagtgtaccacctcactcagcttttgtatgtgggccccagtgttgtaactagctcaggtccttatactttctcagcaagcactttacctgctaagctatgtccccagtcctcaccttatcttattctttagtctgagctctacagggaaaaccaaggttgaaatttggaatattctggactcttgtggtttcagacttcctgtgagaatctgatgaaaactgaaaccctccccctcagcacacacatccaacataacatcttatgtctacttccatagatctgtaaggtctccaagcacatgtgtgtgagatcgtgaaaggcagcctgttttctggttgaactaggtttaaatcctgggcactcagcaggtaactgcaaggaacagaaggcatttgcctgccatgttcttagacaccaggctcctgacacaaggcctcagctctccataattctgtgtccttcagtcacatagggcaatgccccaagcccctccacaggtagaggacttgactacagatcttcattttaatgaggtaaccaaaggcctgaagggcttagccaattaagcttcccttcccagacactcactccttcctgcaaaagcctcgggccctccctgagaaagtggggtacagtttcactcatcacaactatccaccataacaataaatgctttaaaaccatggactgcctcttctcatcaggacggggcaggggggatgacaatggagcaggtcttcctctaaagagcccagcctaatctcaagcaggaggcctctctgcattcccagacgcattcccagccaacccgcctgcccaagcaagcctaggacactctgatcccggagggacccagccagatctctcctcccagctttcccctttggccccgggccagccccacgggcctccactcagttctcagctcttccatggcatccagcagcgtctacagtgcccaagagctagaacctgccacccctggcctctgtgcagcccggggaaccttgagccaactcgtgaagatcctcgggaacctcaggctgcgcttccccagccctggaggctgatcctgcggcttctcacagcctaatgcctgccccacctggggtgcacgcagtcaaacttcccgagggcccccacttctaacccacacatgtgggtacagcacggataacaaatcctattagcttgggtcccctgatatagacttaattccctgatagtgttcagaagccaccaagagacttgagtgaacccagttcctgtgtctgcaactgtcacagcccactccagtgggtgttcccattatgaccttgaacccttcctccccaataccaccaattgtctacagttctcaaaattctgttacatttaccacattcaataaaaataaaacagtatctgaatggagcttgcacaaaagacacactcctgtccccttcacactacattaatactaccactttcaagtgttctcttaagtgcctctggcttaagcttcaaagctcctactctggaaatgcacagggatggcagttgcagcaaatctaaatgacaaatactcacttcagaagagactttaatgacaacacagtctattgttttaaaatagatctcattgaaccaatgcctcctgacattttataaaggcatccctgtttggcagcggttcatggcagagggtttggggtcttttaaccttggcaaccacacagactgtgtggtgagtttgaaagcatgctcctagatcactcacctgtgaacccgggtgcacagatgcacgtgccattcagcccctcgctgtcacaggtacctccattcagacagctgatgttagcacaggggtccttgtacagttcgcagtgtgttcctgcagagaagcaaacaggagagggtgactcatggaacactctctggttcctatggccttcaaaagggaggtgtttcactagcatgtggctgcactggggataggttcatggtgtgtgtgtgtgtgtgtgcatgtgtgcatgtgtgca

SEQ ID NO: 202 - DNA, 2975 bp, Mus musculus
caggcctgaagggatcttaccaagtgctgttcccctcacacaagaaaatatgaatcactctgacaaagagccacctaatatccctaaggagaagtaccttaggaaatgtctgaaggttcccagaagatggtgatttacccagagtgcttgttgtgtgagcacaaggctctgagttcagatcccaagcacccatgaaaaagcagggtgcagtgtcacacatctgtaatctcagtgctgggggcagagacagagatgggtagatctcaagggatcttgtctagccagtctacacaaaatggcaagctctaggtttagtgagggatcctgactgaaaaagtaaggtgatgatctatacaagaagacatccaacatcacacacagagagacacacacagatacacacacagatacaggaagacacccaacatcaacctctggcctctacacacacagagacacatgcatacacacacacacacagagagagagagagagacagagacagagacagaaacagagacagagacaaatatacaaagagagaaagagaaacagacaggcagacacgcacacatacagagaaagagagagagagagagagagagagagagagcaccacaagaggccatggagggtttctgacaaagccatgcctttgagaaagccaatgtatcatgatattttcaaaaagactatagtgtttataatttaaaagataaaataaaaatttactttaaaggcaatgaatggaggaaatggcatgaatggatggagaaaggaagtcagtaggccatggccatcttctctcaaatggccatgataataataggctgcactggggattgtgaacaaccacactgaggttccatggccatgaccatggcaccctgggctgagataaggcatgtattgcagcactgagaatgtctgaagtccaaacatacaccaagtgcagcctcatgtattgcccaaactttagagttagggatgaggagaactcttaggtcgcgctctcccgcctggccacctgtctctcgtgcctgtggagaccctgctgtggggctgtgactactgctgagtctatccccacctggagacccatctgaaggcttcgtgggggatgatggcacactcctgtgacattcacttttatatagacccaagggaagattattaacaggacactacgtatataattttgtatagatggtgcaggggcatcttctaatgtttggatccagaaggaaggcacatgcatcataggaagcaagaatatatcttagaagtagatgagacagcacaagaaacatcagggaagagatcgtaaagcctttctgaataagtaacaaatgggtggagaatgcttactgaatacaaaagcacaggactcgctctccaggaaagtcccaagcagctcaggcacatcaatccttgttggagcttcagaatggcatcagcatctccctccagaccaaggctgctgagccagattctgctggtagaaaggcccctgtggaaccgacatcctttacaaaccataaccgatcccaaactgctgagacagctgccgtcctcaccagacaatcacatttatttacagacagaagcaaagaaagctgagtcattcaaaacacccagcccagtctcatggtctgacatatgaatgtcaatgctgaaagggccacgtgttcagagtggaagctggctgcagggtagccctgtcacaaataatacccttgcatgtagtattctaccagtccaagatcgacaaggcctcttgccttctcatgattcctgtgggctcatggttcctgttactatagttgtgtgtgaccatgtggtaagcataattgttcctaagcctatccctcgttgaatggtgtgatgtatagactccagggaccggacctaggctgcagcctggaggaaatgagtcacccaaaacaacagtctagcatggttagagggatgaaactttttccgtgagattctccaaggacacggaaacccaacaagggaagatggcgttactgccttagccgctggtatctaaataccagcacacaacagcagtgctgccaatgctttggcacagtacagatgcataagcacaaaagggcacacacagagctgtccctcagtccttgctgtaagggtaaaatgtgttctccctgtccacggggtagacaccaaccaagcagtctctgagtactcaaaccatagctgtggagagtaaggggctgaacttcatatgtgatttatttgcaaataatttaaacactagcttaaatagcctcgtgggcctggtagctaccaaatcaacatcctgggcctagtgattaatttcagttgtgaaataagggggaaatatgtgtgaaatgcctttttattccagtttttctaataatgaacacattgcttttataattcagaaagataaggaattaagtgctggccacattaaaagagtaagaaaggataatttcctcacttcctgtatccagtgactgcctctctgactccaggtcacagagctggtaagtagccaacaaggagccagctgtaatggcgtgcccctatgtaatcccagcacatgggaggctgaggcaggaggatgtaaattcaaggccattctgggctacaaaacaaaaccctatctcagataataaccaatgaagatgaaaccatggctggtggtcttagtgggatctccggctcaaatctgcctgtcgtccatgacacagctggctgtcccatagcacttgaacttgttgagtttacctaagtcattgcccctacctaagcatcattctaaattcttccaatctcttcaccccagctcctaaaaattcacttctcagattaaatgtagccttctccctctccccctccctctccctcttcctggctctctcccctgacatcacctcactacacagcactgctcatgacctgctgccttctctgttattatc

SEQ ID NO: 203 - DNA, 6775 bp, Mus musculus
ggattaaaggcgtgcgccaccacgcccggcttctctctactttttaattaagccagagtcaggatctctcactgaatttagagcttgccacgtgtacttaatctagctagccagcttgttccaaggatcctgcacatgcctcctaaatactgggattataatagcagccacacctgtttggttttccatgtggattctgggcatccaaactcttgttgtcatcttgcatggcaagtatcttatgtattgagctatctccctacacaccccttttttttggagtcaaggtctcaaaaatgtagcccaggctggccagacctgttgtcttgcattttcattcagcatacgcccccttgtatcttcccacatcataaaccgtattgctctggtgcaatctgaggtgcaggtagcaattcaagttctcctttcgccatagctgtcaagcatattttaaagttcctaatctccaccttcacttgttttataaacaacactaaaaactcaaaactgaaagaaagaggcccaggaatcatcagggaagaggtggtagagggaatataagagccagaagttctctgggcatggaacagacacttggtcctggtttcatagcaaccctggctatatgcagtaggactctatccacacccctccccctgctgaactcctaactcctgatggtttctagagggcaagccacgattgtctgctcttgtatacccactgagaagcccaccaggttcccatacgtagttccaaatctatagtcacacagatgaacctccttaaattcagtaggtctcaaaggtgagttgggggagaaaagtttatgaagggaaattgtaaggagggggtttactgccttggggtgggaggcagctggagtggggagtcacaggcatcggaatgcactttatgcatgcatgattgtcaaaggacaaagtcaatgaaagcctgaggtggtggggaggaaagagggggtgggaatcaagctacttgccagctcccatttctcacagctctggacagccatactgtgagaagtagaatgactctgttcttttcataaacacaccacgtctcactccaccacatagtacatgaaagatcacagtgttttgttttgtttgtttttcaaatctatatttggtgtactattcaaaggtagagcccctggagtgtgatgtaaatgtaccgctctcctatgcatggggcaaagacagcaacacatgatcacattcacgtgagtatttttaaatttttggaaggatcaaagaaataagcaggtatcttgacctcacactgattgtttcctgaccaagggaaacaaacagagccgtgactttcacaccagtgtaggcagggggacttagcctggctttctatggaagctcagttaactgatagctggtgttccccttgagagctcctgttaccaggagtgtgttgacctgaacacagcatttacaatcctgtttaccctgcacttatgcagtgcgggtgggattggagttccttttcatgagttttctatacaacccagcaaatatcaaaactcatacaagccagaatgattacacttccttcatccacaccatccgggattatacaagccacttgctgcttcttagtcatttactaagagactctggggcagcggtctttgtgtcctgccaagcaggttgtccagtgattcctagattcctttaacaacatagtggcaaatactgcaaatatctcctttcaatttcatatgactacagttgggaaggtgttattggttgaatggtatctgacatgcgaacaatgttagtgtcctaagtgccaattgctcagcatatgaacatatttggagatacagatgaatgagactgtatccagcatgaatgaggaaaaactggatacaagttagataagcaccgaagaaggacaacataaaaacactccgtgagattgtaaagagtgaggtgatacctctgaggtggccagaaacttgcaggcaggtgaggcgtggtcttcctgtagctctcagaaggaaccaaccatgccagcatttttatttcagacagaactacaaaagcgattgatatctgcggtttctaggcacctggtcagtgttataggagaaagcatccctaggaaactagcacagaggtcttcctgattgggttctgatcttgtttacaataacagtagcaacagtaccttccacagcctagttgatcttggagagctacagtggcaccctgcctaatctcagtgagtccaattcagctggaccagggaaatggagatgccataggatgctgctgggttaaatgtaccgagctgcaggaaagcccacatacatagtgaattcttcaggaaagccacattgcagcaggaaaggccccaggttataatgttttctaattcttccttataaaaattttcattgtagaattaactgtaagtgatgttggggaataaaaatatattctttaagtagagagcttgcactcaggcagatatagtcaaagacccttggcagatgaggataaggaagccagatcaccaggatacactaatgggccatttatgtgttgcaaaagtgagaccagaagccaagcatggtggtgatgcacacctttaaccccagtactcaagaggcagaggcagaggcagaggcagaggcaggtggatctctatgttttctggccagcctggtctttatagtgagttcctgaccacccaaaagtatcctgtctcaaaaataagtgagattgagcctgggagataccttaggcaggaaagaatttactctatgagcttaaggacttcaggtcaagtccacaaaacctacatctggtattgtagccagttctggagaggtagagacaggcaaattcctagggacctctcaccagccagccagagatatcagtgagtcacaggccaatgagagagaaagaaaaagatggctggcacctgagaaacaacacccaaagttgtattctggcctctacatgcacacacacatctcatatacacacaaaaagtgaaaccagcatccttcaaccatgaggtacctgttctataaggtttggagcactgcacttcagtaccactgatctagacccaggtctgtctgtctgtctctctctccctctctccctctctctctctggagtgtatcaacatagtttagtgcccatagacggtacaactatatttgcataatctagagggtcccagcaaaagagggagtgattgacagagcaaaaccagaagagaatgctagaaagacatgagacatagttatggcataaacatgagatgccccccagtggctcatgtgtttgaacacttggccccccagatggtgatatagtttggaggggctgtagaacctttctgatacagatcctcattggcaggtataatccataggtacagggctcatgggttaaagaacaatctatccggcctaggctctctgcatcctaactcccaacaagatgtaagcagctgctccatgctctcactgccccagccaaagtcactctcctaggcatgtcttcacagccgtgagaggagtaaacgaggcaaatatgtcccatagcaaacaacatgagaaagtgcaccgaaggctcctggggaccacaccttgcatcctcgggcccttgtgtagacccttcctcttgaacattgactgggactctgaagtgacagtgtgtgtcaccactaggcttcaactttaagaatccctaaaggtgtctaatgagatctttttttttcctctgtgggaaactaatcgctctgtggaaagtacacctactgtgagtccacccttcctaagaagccctgacacagtgaagaagtcacgtgacagaggcagagggcctggcttgcagccctagccgaacttccagccagaagctagcaccagcctttctttcattccagtcgccagcctggaaggtgctgcttaagcccagtcatgccttcccacccaacaccagatgcccctttcagccctgccaaattataggcccatttgtgaataaacaaaatgattgttggttttgtgttactgtggtcagtgagcccagaacccacatgtgtctctggaatgttccaaaactatccagtgtcttcacaatgaaatacaatgtgtgaccctaagaaataaagctcccatcatctagccacagatagcttttctggtcacaccgactacagcagcttcttctaaaaccactgcagctccattctacagaggagaaaatcaaggcaggggtcggggggagcagtctgcagttctgcctgcagtcacccagagtgtcagggtgtgcacactcagatccattctgcagttgaacttcctagcaaatctcgtcttcatgaatatgacctagttattatgggccatggcttaccacaaaccacacagcggcatggactgttttccaactgaaactaatttaaaataattcactttttttgaagaattataatgagaatccatagttacagataattgagatgaaagctgctctcatgacctagtaaaaataaagagacagcgtatgcttaggaacgaatgtggttcttgaggatgcaatccagataattactgaattattataatcattctagggcctgattttatctttgttgatttttttccccctctgtatgcactgggactgcagttgtataatagtaacacaagtttagaggactctcatctccagttgcctagcaacctacagctttgaagagaatgagagatgaagggtcaatggcaaaataatgctgcttgcaatccaacgatgatttaaaagttttagcactattaaagctgtcctaagtacaaatgtgcagagaaatgcctgactggatcagctgccacttgggtttctttcccaccttgactttgatgttggagccaatgattacataatgacatctatttaccaatctaaacaaagatgcagtatcgtagcattaccttcaaagcagagttcataacattgttgggggaaaaataaatgaaaattttgtataaattataatgatgttgacaaattgctagtaccaacccagaaagtattacccagcaatgccagcattattattgccatcaccaagatgaatagataaactgacctgtgtggaaaaacttagcaaacaacacctgttccgtgtgaggcatttcatcattcattctggtggtgagaagaataaagtcagtctatggtggtgcacacttttaatcccagcactcaagaggcagaggcaggcagacctttaggagtttgaagacacctagttctacacagtgagttccaggctagtcagaaaaaaatagtaataatcttcctcatagtcgtttactatttattttgaacagcaaatggccatagagcaactgcaagcacagagagaccatctggaaacatcatgaatttggaaactgtctttgtaaactctctaaatgggagagaaatgacaaaaaaaaaaaaaaaaaaaaaaaaaaaaacctaattataagccatagcaaaacaggaagcaaccaggaaaccaagctcagctgacccttaatgggtaggtactgaaggacagcaggcacctagccatgaaaaggggaaactaaaaaaggattaaagaataaaaatgcataaatttaattttaaaaatgtacaaaagaagaaaagaaaaggcgaaagtggaggaagatcacacatatagagcggagacacagaagagcacgtgttggtgttgggagcccctcgagtcacaacagacatggaggaagagggagactgtcaatggagatggacctgtatccttaggaattagaagctacacctgaagcacttgaatctccaataactcttgtttgcttgctttgtgatgagaatcaagttcagggcttcatacattctagccaagcactccctcacatcctcagccttgagtgtagtacctcgggatctacccatttgtttttgaggcagagctactcattggctgagcgatcactacacagactatgcggaccagggatcctcctgtctctgcctctccaggattagaatcacaagagtgcagtaccacagttggctttttatgtaggctctagggggcaaatttaggtctttatgcttatgtgacaaatatttcgccaactgggctatcttctcagccctcataggctaatacatcctaatcctcggcattctctgggccaccagtctcacctctgactgaattatcaggaaaacttgctcgggcagtcctctccccctgtgtctccaaacactatgaggtcccactccacctgcctgcagcacccacagagcaaaaagcaaactgctataatggagttgcgatcgctggtggctggatcaacattcctaacaccacagtccatgtggtgaccttctggatgtgctcagaaccttagcctaacacatgagtgactggaatttccagacatactaacacgtgaaaaaagaagagtcctgtagattttgtcactactccctttgaatctcaatacagtgtgtaaaagcacaggaaaacaaagcccaaacctttaaaggacttcagggcacatatatgtgtgctgacttcttggtctatgaaaataatgtgttcctgtcccgttttcttctatgcactttattaaaactgatgattatagtactggaccaattttgtttcctcatttaatctcatcagaacaaaactgtcttgtaaacatcttttgcaaaggttatttaaaatt

SEQ ID NO: 204 - DNA, 1975 bp, Mus musculus
gagagagagagagagagagagagagagagagagtgtgtgtctgtgtgtgtgtaggtgtgtgtgtgtgtctgtgtgtgtgtgtgtgtaggtgtgtgtgtaggtatgtgtgtgtaggtgtgtgtgtaggtgtgtgggggtatttgtgtgtgagtgtgtatgtgagagagtgtgtctgtgtgtgtgtaggagtgtgtgtgtctgtgtatgtgtatgtaggtaggtatgtatagatgtgtgtgtgtgtaggtatgtgtggggatgtttgtgtatggaggtgtgggggtgtggggggtggggggtgtgttcgtgtgcatacaaagtagatgtgcatctgtgtctatgccagagaacactgagtgtctttctctatcactctctaccttattcccctgagacaaagtgtcctgttgactctggagctaggctggcagccatcaagcccccggggaatcttctgtctccatcattcacagaagcttgcatggtgccggggctttgaattcaggtcttcatgctcgcccagcaagcctcatatcccagctatcttccctggctctgggatctactcctgtgtaagtttctgcagtgcacactgtgtctgcgcactgttttcccagcatcccctcccccagcactcagtaccagcggcccctcagcagccatggtaacacagatggcttgccgcttctgcctcacatagggttctgagcttcagggaagcacaccactggattcccacaaccagatcacagtctcctatcaccaccctgtggaggagggctctgggaagcaggtggcacaaattcatccaggtattgagtagcagcagagaaaagtggtctgggtaactaccctggaaacacaaggggtgtctcatggcctctcacctgctcatactcgggtgtgttagaactctgtgaaactgccttttgtgcctctcccggcactctatctcgcctctagagaccagctttgagctcctctgaacatctcagggagcctgccacttcatttctcccctcccttcatttcctccttctttgtctgtcccagcactaccctgagtgggcactgactagaccccagtcagacagttcagacagcttcctcgttgaggtacgtggcttgtctcaaagagctgttctcaagcccaggtgctgatttaaaaccacagacacatggaagccagcagaatggaatcaaagtatggaccccattctgaggtctcaggaacaatagggctttaggagagggaccctgttcaacccagttagccatacagagaaggaggcaggggaggctcatgaccaccctctggagcaggccctggtatcttgtcctcagtatgagaccaggaggaggcaggagcctgtgtaggaaagaccagccatttctcagtgccaccatttcctccttgaacctctggggtcttcagcggagtccctgtgcttaccatgatggctcaaccctgttgttccttcaaggacttggtgagcatctgtgtagcagatggggaccgaccttgtagttgtccttccaaatgccagctcaggtgacagactactacaacagagggctgattggttatgtctacatggctgaatcctgcatccgacctgcagtggtttggggtgagggcataagatgaactgaagaggggctggaagatatgactatttgggagcctgatcttgtaggtgacaacaggggaacaggcgactttaatgagagaatagttttaagccttggcccaggagacatcaagtagacagtgccagcactggctagtaaaaggccagaatccagcagggcgtggtggtgcatgcctttaatcccagcattcgggaggcagaggcaggcagatttctgagttcgaggccagcctggtctacaaagtgagttccgggacagccagggctatacagagaaactctgtctcgaaaaacaaacaaacaaacaaacaacaacaaaaaaa

SEQ ID NO: 205 - DNA, 3600 bp, Mus musculus
accctgccctcccctgtgtcatcaactgttggcataaagtttgtctagtgaatgagtgtgtgtgtgtgtgtgtgtgcattcatgcgtgtgctgggaatggctttatgaaatctcaaagcccactccagtgacatgtttccttcagcaactccacacctcccaggtcttcctgaatggagccaagtggggaccaagtatccagagtcccgagacatgctggggacatcttactcaaaccaccagattccccaactctagaaatctctttttctttaatatttaccttgttttgccttgcatctacatctgtacccagaagccagaagaggttgttggattccttgtggttggaattaaagacaattattagctgccatgtagctatagcctctggaagactggctagtgctctttaactactgctccagcccacagagttgtgaatttcaagtgcatacctccatacttggattttttttaaaacatgagttcagagaattgaactcagttcatcacacttgtgtggcaaacactactggctgagctgtctctccagcccatggtaatatccaataggttcagccttcccttgctccctgtgttagaagctgtaaatgtatagaccttaagggcatatgataaaataagacaggaagacgaatgatggaagtgagccctgaggaagagcagttaggaaagcctagtgagacgactgcgaggatatgggctcgcagaggtggaggtcggccagcctcgggtccgctgtgtgctcctccgtgtgtgcttacagtctgtagccttgcattcttaaacttcggtcactggacatatcttatgctaaatctctgcctgattatctgacagataagattattaacagaaagtgttattaatattaattacacaatgatactaaaaattttatatggcagaagcagatggttatttaaaacgagttaagttttagcctttttatgaagaagcatttaaacatatttagttataaatgctattttaattgacacattatttctacagtgggggctttaaaatcttactgcagttgcagaggagggtttctgtgtatatttcagtctcttaaagcgtgcacttacttgcagaaaagcagtcctaatgctgtttcaaagacagagctggagagggctttatacgagcatgcctgtgggtatcacagctgctcagagttcaggaattaggcacccgagtgtgaacagttgtccaaggcatttgccatggtaacagcactctggatcctcttctctaggtgggcatgccgtcattattttaactttctcaatccttttctggattctgcacatagctgaggtaagcacaaaaacttgagaagtatttcctacagatggagcagaattcctttagaagcatcaaaaagctaagcctgattcctcagaactggaaactctgctttaaaccagctgttggccctttctttgacatcaaattttatattaatggtaccaggtgaagttagcaacacccccaagccttaccctgaccctcccctagctaagactgcagccccaggcctttctccccgcctgttagctggctgtagtccagaggtttgtttccacaagtgatcggctgtgtctccagtatgagcagggtcgcacttgcatgcgtggtgtcactgtggtttccccaagaagcctgtgttaacgtataagtgtaagaagtgtagccttagcacagcagtcaggagtcccaggtgggacagagttcagcatgtagttattcactcaaccaggcctcacctcagctgcatcgccttgtctcccagctcttactctccacgtgagcagaggtactggactcccccatgcgtttgaagcagagcatgcccagtggggttcccataggtgcccaccttccatcgaaagcctgggagccctgcatgttttgcagtatcagcaaacttgattttgttttttgtttttgcattttcctctgcagctcatgaagaaccaaataagaccaagaccagtcagtccttccagtggcctaagtccctctggaggaaccggcagaagcccctagtctgcagcttgttcgttcagtcccttgacagtcatagcaccaggattcaggattcagggtctctgttcctgaagaatggaaagttctgctgggagagagaaaagataatgacgtcttttgcctgaaagaaggtgtcccagggtctggaactagaaagtgtgcttggtggggtgggatgaggctgcagctgagtgagagcttttgcctcatctatatgaggccctgcatccagtccccactgcctcagagggtgagggattggatcagaggatgacacctatttcctcctgctccgtagccatgatccaattgggagacactaaaattagccaggaagctgtgtttgcctgaaagtggggtgttctgtaaatcagagtctccctggctgtgtgaatccttctctcactgctgcgatcacacccataacaagagcaacttgaaggaacaaagggcctgccgaactggggtaggcatggtggcaggagtgtgaggcagctggtcacatggcatctgcagccaggaagtagggaggtaactgctgtttggttgcttctcagcccgaggccctcaacccagggaatgatactgtatacattgagggtgtatcttctcatctcaacctaatctagaatcagtattacaggcatgttccaagatgtgggtaattctaacctgtgtcaatttgacgatattaaccatcaccgtgaaggtctatgctggagtttgagaacatggaacatagagtggacagatgcatctggtctgggttgtggtgctggtgtgtctggataactctggagtaagaaactcctggtacctggcccagattactcacccgggaaaagtgttcttacctggtagtaactgaccatcctcctgctctgcaagaccactcgggctgtcaagcagcaggatgctgggagtgccaagctggagggagggtggagtgggcaggtgtgagtagttagagaaaataagcagtggtctgaagccttgtgcagtagtggggagcggaggggggtagtgcagcctaggagagggctccagttgtagagttgtgctgtgtgtgcaagcaggaggagagggggtcctcccaggctgaggaggcttcaggtagttgctgcttttaacctcaccctgggggatcaaaggcagcgggaggggagaggaatgggaaagagacgtgctttgatggatagcgagcaagatgccacctctcctgcacccactcctgaccccgctgccagccacagcaggctggggcttctgctgaaggaaaaagaaggaaatgtcagttattatgttttggaacacaatcttatctttttgtttgatttttaaagcaattttcccaaagatcaggtctgactgaagtgtattgacaaaattttagccatgatgaagaaaatgcttcaaaccccaagaagtctgaccctggttcccggaactctttgatggacctttctttctctctctctctctctctctttctctctttctttcttttctagaacaaagctc

SEQ ID NO: 206 - DNA, 2500 bp, Mus musculus
ctaaaacagaatgcaccctcacctggagatagctaccttaagcaaaataaagacaagggtgcacatgcgcactccacactacagagtctcacatacgtgtgcaatctaacactgctggtcttacagaagagcagacaggagtaatggatgtcagaggctgagtgggaatgggcaaagtagcccagtgcgtaaaagagcaaacacaaccaccaatgccctgagactgtagggcggccgtactttgtaatcattgattgtgcatctcaaaggaatttctctaggagaaaaagcatttgaatgttccgactagaaagtaacaaaagaagtttaatgtgaagggtgtgtataatggccagaactgttcatgtcacgctgctgtgtctattaaaatggcatgccatgtcctgcaagcctgtacaactaagtgtcaattaaaaactacatacataaaactaaaaaaaagaaaaaagaagccgttcccataaagacagaggtttgcagggagcatgctcttcgccccagttgagagagctctggcatcctggcctatgtgcatggatccttaatcctggaagcccttcctcagcccttccctgccccttccccacgctgacatcagcaggtgtgttttctcttagtctctctggatgttcagcttccctccagatgcaaacgtgtccatcacacgactcccagccggcaacacaatggactcctgcagaaggaggggaagcaaagttcagctctgccaggtacccacccaaaagagccatctccacaagggggctcttcaaggaagccactcctgcgagctttcagcattctcactgcctctctgggtatgagggctgcaggagaagctggccctctgactccctcattgtctgccatgagtaagctcatctctgccttcgtagggctatctcttcttggtcctggaaaagcttctccccgactcgtgccttgaccgaggaccccagcctcacactgacgcagcatctaccaaggatgctctgtcttcctctggcatgggctcaaccacagactctgggtggtgctgccaaaagtgaccctgggagggctcctgcatcctggggaatctaatgttcagtggtgcagaatcctcatttcctaccttcaatttgtctgcaaattccttagccccaagtgttacccaacctgggattctgccccaaaaacccaaatccatttgcaccacaccagccccctcctggcccacagtccctggatgcgttcctttctctgccccacctgtgtctgccgccaagaattctacggtggcctccgcctcctcctcccctaacgccctccagcccacacagctttgaacttttatggaatttgcatctgtgacaaattacttgctctttaattatattctgtcacattattcctgttgaacttggctgagaagcacgctttcctccaaagcagacacatctttgttgtgctttgcccagagttggacagctaggccgagaaccaccgtgagccctcggacttaggtcatctgagtgccgcccagcttgtgcatgagggtaactcctatgttttcccaagtcaatcttttttcttcttcttcttcttcacttaaatgaattcattgtttaaggaaatttttatcacctcctgaaatggaacactggtgctgtttgccctcagtagaatcaggctataaaaataaattccatgtaaacagagcaacgctgttgaatcccacctctatacatctgtgccctgtatctgagccgcctggacttggacgacccaagtgttacggatatattcaagattgactatgagtaatagagaactctggctctttccagaagggttggaaaagaattttaaaaagagcccacccctctgcgctggattcaaatctgttaatcaaaagtctggagatgacctaaaaccagcctttagcctgacatcaggaccctctacaggcctttatacccactgaccgttccatttcatttaaatgaatgattttcaagcaacaagttcaaagtgttgtctcatgggagttgtacaaaattccccagggcagaccttattgttactccgtgcagtggtttgaaagtgggatgtgtcccaaaggctcaggtgcttgcacacttggtccccagctggtggcgctgctttggcggtggggctgaagtgcgtgggatctaaatgctgcacctacctctacctctgactcttctttcttcgctccctctgattataagaagcctcagcccattgcctccagcaagctcggatcattccttgctacgcacatgcacgcacgcacgcacgcacgcatcatgtgtatacactcacatgtgcccttcgcaccatagtagactactctctcaggaaaaaggagtgaaaataaatccttcctcccttaagttgcttctgtcaggcattttggtcacaaagatgagaaaagaaactgttttacatcctttccagccaagcatacaaagct

SEQ ID NO: 207 - DNA, 2800 bp, Mus musculus
gtcacattgctggtggctgagaagcaggttcttggccatcagacactcctgtgtcccaacctcagcctcctgttctttgtgccttcctcccaagacttccttgattctgtgatgttctgggctctgggttcagattcccccactgtagtaatactggctgaggagccatgggcagtaggccttgggtgtgacgtcctgaatcccacattggccccttgggataatgctctgtgttggtagcaaggggacttgacacccatgtgaatatgttcccacctgctaagactgagaggggaaggtgcagcttggaaaataggccaggccagaggggtccagatttatgccccatgtaggatgggagagcctgcttttcagctgtctatcttgcccctatgtggctgacatctggaatgccccagccactggggacagcagtgcctcagtttacaaccctataaattaaatatctccagggacccccagaaccctgcctcctgccaatctcaccactcccatagtatccccaggcccaatggaatccaaacatccaccaggcctcccctctcctggtgtgaacaggctcctgggagaccctgtatcctgcctctgcccagggtgggttttatggcaaagatgtcatacttagatgactagggagagatggaccaggtgggctcacactccttcccagctgcaggcccgcctggataccactgaggcccggcttcggaagtcagagctagaacacagcatggatttggaggaggctcttagccggctggaggcctcacagcagaggtgagacccagtgggcaagcgctcggggctacaggaggtgcacatcccactatgcctcactcaacccatcagagctatcctgagttaccgttgcctgtgaaaattggcacaggggaagcaccctggagggaagggccagtagcgagcagaactggataccgtgctgctttcctttccttcccactggagaccactcccatatcctcacatgccatgtctcacccctcgggccagggtgtgagaagggagagaaagggcagtctgcagagcgggtagcagattcctttcctctccctgtgtcacaggccagggcacagtacagagctgagagttccctcatcactgctgggtgagtgggactctctagtctcctcagtaatgatttatctctacttctgagtgcagggagcaaagatatcagagaggcctgaagccataatgtcccagcattgaggtcagggtactcaggagagcccaccggcaagtgagatctggcatcagaattagactggtcctctgcccacatccttcagcatacattcccatatctcagaaacagaggcatcaatgccatgcctagagcgagtgagtgagaaatctgctcatcaccgcccccccccctccggaataggtttgggccagtgggcagtctcccaaggcacagccattgccaaatgctccccgacctcatcccctgagtgtggtgtcaggatgcccgctcagagaacttggctggccatcagtgctggtggtgggttaccacagtcaactgtgagccattggcacacacaatcctgggtgcccttctctggctctcctaaccaccctgaccacgactccagaacttctggcttcaatcctctctgatgtcaacaggcccttttgttcatacttggcaagaatgcaccacaccccagtcctgggaacagcccatgagcctcacttgagcgatctcgccatcactaacatcccgtggttggcttaccctccaggaatctggcagagggagaaaatgctgaaaagcattttgaaaacccattttgagagaagaatggccccgggggagcctggtgcctgaaaagctcaacaggacccctggcatctctcaaggagcccaactcccggagatgcccagcttctgccagcctgcccctctgaggctccctttgagcctcccggaccctgtaaatttctttctcttcttggaggcaggggagtggctaggggtgaggaggagtttgggggaatagcatttggaggcaagaaggatggtgctgagctgggtctgggaagagtcctcctggtgctggtccgtgtaggtttcattgccgggcagtcagtgatgctcgggaacagagctggggctgtgcacctaagtggagattgggggcctcaggactccatttaaaccccttggtttagggctcctggactctctgtgcctctttgggaagtcaccacacatgaagctgtgggttttgtccatttaggagcatgggcctttcccaagtaaacaccctccttcggcaacagctggagcacatgcagaaagccaacgacacgttggccagggagctgaccagagcaacacacagcttggtccacctgcagcgcaagttggagcttcaagaggtgcgtcactggtctaagagagaggtggccccataccctgtccccacttctgcctgtttaatttggtacctgcagcttgagagaagctggtatcatgcagtccctcctggtgagagcctcataatccattttacttggtcacagcagcctgtaccatgagggacacctcaggtccctcaagcaaaggagaacaagactactagagggttcttgaaccattcctggctctgatatgtgacactgttgatcatacagagaggttgatcaaaggatctgggttgtacagctgctcttaaactcctggccagaaagcaccagggacccacagtcttgctcactcaaagtgtagcatcagagaacaatgttacag

SEQ ID NO: 208 - DNA, 2075 bp, Mus musculus
ctattcatctaccctcttctcttgagctttctcttaagcactgacttgcttaaaaaacaaacaaacaaacaaacaaacaaacaaataacccgggcttttaaaagcagccaaaacatttccagaagacatttctattttttttttttcaaaaaaacaaccacatcaacaacaataaaaaccctttccatatagtaagtgctcctgaaccaccatgcacagaatgacaaagccaggccctgctgtcctcagtcacatctttataaactgtgcttccatctgtggggcaatgtgctatgcacagacagtctggtctccagtccagctgaggtctgaacctcggtggtgataattcccacctacatgggccagaaggtgttccctcatgtctcctggacccctggctcctgttgaagttactgctcccacagcccccaatagagaagcatgtggctagtagtcacatacacaatgtcccaaacttctgaccttcaggctagactcctcccagttacctagcaacagcaagataacacaacccactataagaggggctgcttggcccctcctcgatctcttaagctgttactttccttactctctctctctaagcttttacctctctctctctttctctaagccttcacctttcttactctctttctttcttccccttcccccttctctcctcttggccatggccagtctctctttatcttttctcttcccccctgcctttctacaataaagctctaaaaccatagactgtctctgctcatcaaggccccctatgcttggacgatgggataggctttctcctaatgagccatgcctaatctccctaatctcccgtcagaaggcattcctacactccagccacggaccagacaaaggactctcacctgtgtgggaacctctctccctctgccctcttcttgtatctctggggctgagtatcatcccagagcccctggtaacgggggctgccccttgtccacccccctgccgtgtgggttcagtggcttcactcagccagatgcccacctggggccgtgtggaaagcgtctggcagtcctcccgggtctgtctgcccagagcacaggaactctagccagacccgggctctctccctccctcctcttcccctacacctgacagccccacatccatcaacacctccactcaggataacacactgggtacagtacgaagttcatgcatggtggcctcactttgttaaacagtaaacatggagatttgtgaggattgttcttctttccttcaataccgctctgagatgctctgtttcattttaaagatttttttaaaaataaccttgatcttttttggggggtagggtatctattagattgttactacacaggctgttcccttggcaacacatacattcctaataagagtttcagaagtgagcagagcatccttggctctaagaaatgttgaaatgcaatcaaaaccagaggcctggctgacatttgtacaagatataaaaccccaatagagcagaagactcagtgtctcagatcttctagtgtactaaaggccattttgtttgattctgccagtagactactctaggtgggacgctatcattcatcaaaatttgttatgggggaggggggggaaaggatgcctagttgaaaaatggacaaaaaaaaatcagctttcaacaataaacaaacatcagatacaaaaacagaaacaaaaactatcctcaaaaacaattaaaaggagttttagcctcagtcctgaggagccggggttgctaagtgaagttcaaataggaaggtgcatggaaatgatgctgagcccttgatccagcaagggataagtttccaatgctgatggctaacatgaggggggaagaccagctccttgtctaaataacataggcgggataagtgtgtgcacagagcatttccattcaccatgcggtaccagaagcaagcctgcggaggaaacaccaggagccactcaaacgcagggacacaactgagaaacacatccttgggaagacttatcactgtgtggatattatagaagagacttccattaat

SEQ ID NO: 209 - DNA, 3800 bp, Mus musculus
tggaagagaggttcacttcaggagtttgagaaatagtcaggcactatggtttcctaacataggttagcattgttatatcctggagaatttttaaaaagcactaatatttgagtgccttgttgtctctatctggtatacagcctgggtatttaatggctgcgttagtcattgattcttgtccacattacagaatttaaaaccatctcagtgattactttctaccttcatctgtgagggactatctagattgggttagcttctgagaacgtctgtgaaggatactcttgattaaaattaaagtgagaagactcatcttaagtgagggagtcaccattccctatgcctgtgtcctagactgaaaggaaaaagatgtaggaaattgagcactacccctcattagatctttgaatgagtgaggctaccatgagatcagtgcctcaggctcctgttactgtgacttccttttgagactggactgaaacctggaactgtgattaaaaaaaagcaatcccttttctgtttttctttttctttttttgttgtttgttttgttttgttttgttttgttttgttttgttttgttttgtcagagtatgtcatcacaacaggaaacatagtgccaagtggtgattttgggatgtggcttagttgaagaacccttgtcccaaaacatctctcaatgttggaatgcttactgctaagacaggtggcgttaggacttagacaaactaccaggaaacacaaacacatgtggcttgacgtgatgagctgaggacgaggccaggtagcttcggcagagaactgagaggtccttgttccctgggctccatccaacacaagccatatggaacttcattacatcagcctcttttttcaaaggtaaaaaaaaaatgatctcatctttatgtgcatcctgtcaatttttaattttgggcaacaagttcattttcatgaaaagtcctgaataagtttaagaaaaaacctctttatgatctggattcatcctaggagatggacagcttgcatgcttttttatttttttccacatagaagactctttcatattactatagcacattttattttttcatttttatctttcactctatatgatgtacatatttgcatttatgtgtgttaatgcgccacacataaaattgaggcagtgtgttgaccaaggtcctttccctcattgtctaacttatttgagggaatgtctccagtttttttgtatagtttacaacaggctagctagtttaagaacttgtgtggactttcttcttttcatgtccttcccaacaaactgtaggaggtgtgtgattataattggtaaccaccaaaatctgctttatgtgtgctctgtaacaaagtttctcatgcatgtatgacatgggcaaagataccatgatccattcctctagcccagtacactagcttcctagtattctttttccagaaatattctttcctctttgctctcagggaaatgtgaccttgctgtccccccactgcctataggcagttttgggaacttccactttgtgttcacagccttaaacttggtgcagatattaaactggcaccttgccttagattcccaccttaaagaatgtgtgttagatcattaatgccaaatactaaacacccacaccaaattttgcagtgctcatggattcatgaggagataattagcaattacttcacttccaaccgagtggcatgagctgaggataagcttctctcagtagattatacattagagagaaaaatgtcaaacagcaaaaatgggatgctaagtcctcccacacaagcatcaccacagtactaatgagccagcttttctgtcacacttggagctagtgggagatgacctgagaataagtcagaggagctttctattggaagaactttattttgactctaaatataagtgaaaaagtaggtcagttgtcacgtactgaagctattttagttcagctggagaaaaatcaaccatgttttggaaataaactttggaaaagttagtctccttattttacatgaaattaagaaaaacactttaatttcaagttcatcccttcctaattctcgtgtgtgtgtgggtgggtggggcaatgggttacatgcagatgaaagaaagatgaaatttcaaaacctgtaagtcatataaagtactcagaaattgctggttatttgtgagcccagaggctgtctggggttgagaaaaaagaaaaacaaatctgggtatgccccgtagttaaaacattcctgggaacagcttgaccataagataaggaggaatgtgaggacataacagggctatctgaactgagtcaacaactcacagaactctgacactctgcacgtacatgtaatttttctgctgatgtttgaataagccaatagtgtgtcactatgctgaactccacacccctaagccccttaccccataaaaacccctagctttcaagccttgtggccgacatccattatctcctgtgtgggatgcatgtcggtccagagctccgtaattaaacgacctcatggaattacatcaagatggtcttccttcgtgattttttgggtgcatgctgaatcgggaaagtagtggaggtttccccactaggtttccccagacagcctggtttccagtggagagtagatcttgaaccccgggaccctgtagtgataattcacttacatgggaaggaaggagttctctcatgtctcctggaccctggcttctgtcagagttcccacccccacaacccccacaggagaggtgtggctatcagccacttaggaacagcaccaagccctttcacatgcaaataaggtttcccccaaactctcagcccaagccaattagaagggcttgctgttaaactctaaatcactaccagaactgtatataggagagccatgcaaggaatcaaaggactgggagaactattcctttgtctgatccttttgttccaagagctgtaacacttgggaagagatcttcttttccaaagagccctagtttcaccacattcctcactggattgtaggattttctcagacccagactcagagttaccaagtgaccggacactttgccccttcttagaattgggaacaaaacatccatggagggagttacaaagacaaagtttggagctgagacaaaaggatggaccatctagagactaccatatccggggaaccatcctataatcagctgccaaacacagacaccattgcatacactagcaagattttgctgaaaggacccagatatagctgtcgtttgtgagactataccggggcctagcaaacacagaagtggatgctcacagtcagctattggatggatcacagggcccccaatggaggagttagagaaagtatccaaggagctaaagggatctgcaatcctataggtggaacaatatgaactaaccagtacccccggagctcatgtctctagctgcatatgtatcagaagatggcctagttggccatcagtggaaagagaggcccattggtcatgcaaacattatatgcctcagtacagggaatgccagggccaaaaagtgggagtgggtgggtagggcagtggggaaagggtatgggggccttttgggatagcattggaaatgtaaatgaggaaaatacccaataaaaaaataaaaaaaaaaagaaagaaagaaagaggcttcctctgtctccctgcctgtactcacttccctcgctggggccttcccacccggcctggataaaggtctccgtggaaaacttctggtacctaggcccac

SEQ ID NO: 210 - DNA, 1800 bp, Mus musculus
tttctcgaattaccctgcgtactgcattctcttctgttcagccagcagctctgttccctggtgtctgtcctgcgtaacctgaagaaacagctgtgtctcagatgctatcaatactgtgaaagtacagtatgggacaagtgtgctagtgccttcctagaggtggcctgcatcactgatacaagcaacaactcagtggccaaagccagacatggccacacctggcctcagtgggacaggagacatagccagtcttcaaagaggaaggggatgtaaaatatattgaataatttgcccaaagccttgaaggcaagaatgagtgttttacactaattattcacagggttacaagccacagaaattttctacagaaaatcatgtggtctggagaaactgaaaacaacacaaacaataacaacaacaacaacaacaaaaaacaggccaaaaaaccaaggaatgtgtgtgtgcgcgtgtgttcgcgcacacgtaaaagagacagagatacagagacacagacagacaaacagcacacacacacacacacacacacacacacacacacacacacacactagttttaattgttggctccagcccttcagaagatcttattcacaagccccaggaatctgcagtttgaataggcagccagatggatagtgtttagactgtctcatccacagatcttagtttaagacctggaattgtgagatcagtgggactgaaaatggtggctgagatggggtagtgactgaggacccagctggtcacttagagtgcaggaactgagggccgtgggttataggggcagcagcctggggacactgcaagaggaacagaggtgggtttctggagggattctggtacaaacagccaagcagcagggcagcgaagggcgcaaatgccagcagctgagattaagaacgtcacaggatggtcttgctcaagcaaatagctttccacccatgctcacacagtcagctctaattaaatgcagtggggcacggcagcaacaaaaggaacatgaaagtcagttggaggagggctggactggaaagatggcttagcagctaagagcgcttgctctacacacacacacacacacacacacacacacacacacacacacacacacacacacccctttccaaggctggagagggaacactgagatctttagcaaaagacagccctcttcatagggcttgacagtcccactaaaacttgcttgcctttggccagcagggggcgctatggcagcacggatgctgatggttgactaaactgcagaatcctgcaggctgggattattagcccgacccacagcacagcattttgagcgcttcatttattacttttatagccatgaaccttcagaggaggaacttttaaggtttctttttaattattaaggcatctaggttttttctgaagtgccaattccgatagtcaaaaagaaattaatttcacagagtttaagggaattattgcccgtttattgacttcccttgaggcatatagtggcgattaggaaagtgaggagaaaaaccaggaagagaaaagtgcatggtggccacggcaggaaggaggactactgtgtcaccctgggacccttcctgttgcatttttcatatttttatacatctttacttattaaaaacttttaagataaaaaaaaatgcttaggtatgtgtatctgcctgcgaaagtcagaagagagtatcaaaaaacgctggagctagaggaagtggcagttgtgtggagcccaaagtgggtgctgggaattgaatccaagtcctctgc

SEQ ID NO: 211 - DNA, 3700 bp, Mus musculus
tgtgcagccatttggaagagattgatttgatagagaattgcaaaaggcaacagacaacacctccccaaggcaccgaggcgccattaatacggaaaacaccaggcacatctcaagtagtgctggcactcagctctgatgactctcttcccagcctgtcacagggacctgacccacggcttagacccatgtaagatgccatggcctaattggataaatgatggtgcgtgggtgggtgtgcagccatgcatgtacatacacataaaacagtttctgtacagctcagccaagtggcaccgcccccatgctcatagagagggagggtggagattgctctgtacactgacaacccaacctatactccacatccaaacctcctctactgtagagatgcaaaagtccacggctggcgcacccagtgtttttttatttgcttgtttttgagacagggtctcttgtagcccagacaggtcttgaactcactacgtggcagagaacaacttgaactcctgatccttctacctccatctactaggttctggtattacaggcctgaccttgttgaagatactaactcaaaagccaaaggaatgtatataaaatctctgttgtctttgaaatcattggtttacagcctgagtttttctcgatcgacaacacagcccttgcactaatggagtgttttcctcttttatacagccagaaagagcccatttgatgctaagctgagagatctaggcaaaaaaaaaaaaaaaaaaaaaaaaaaaaaagcaagaaacaaatgagaattatttcaccaaagaccaatgatcaaagcagggcactgggccagatctgatatgtaaatggatctcagcccaaggcctcagtcagtaatgtacccatctcgtaggggagaggatttgagtttgcatcccagaacccactttaaagcagtgaacgtggtgggcatcatgatcccagggctgggaaggtagaggcaggaggatccctggtgcctgctggccagccaccctagcctacttagagagttccaggccagtgaccctaaactgacaaagcagaagtaatttatacctgtgcggtaacacggcaagaggagttctcttacactgagaggatgtgttttgggggcacttcaaatgcatgctgtctctcacctcagtgactttggtagcaagggaaacaaaggtgaagagagtttgaattcattagaggttgaagattaattaggtcatctcagccccacgagtcacagccatcaatttaagagacacaacaccatacactgggttttaatgagtagggttacaaaactgtttaagagcaaaaactcaactgccaagccctgttaagcaggttgatagaagatcgtcccaggggcactacggagagtctcttagccagagaagcataaaataaaatccttgacaggtgtttgccaccagaatatgccattgtatatgtgtgatagaatccattcatttgtgtattgtgcaatgtgtgttggtaagacaacaaaaagttaatgtggtagaggctaaggatgtagttctgtcagtagagtgcttaggtaaaacacagaaagccctagttcccatccacagcacctcctaaaccagatgtggtggtataaacctgatgtggaggctggaaagtcaaggtcatcctctgatgggtaccaaggccaacctcccctatctgaggtcttgtctcatagcggggtggggaaggagaaagagggaggcagaggagaggtgggaggaggaataaataattaatcagtgcttaattagaccaaagaccaacatatgtgtcggtcaaaatgggggcaaggtgaggatggtatttccagattgaaccagccttgactagagcaacattccccaggaggtattaagaaacctctgagatgccgccaagttatccaattgtgagatcctgaagtgaagccggaaacattgccaataataagcagtggtacagtgagagcggagccaggcaggaaggtcgagagtagctggagtctatcccacctcaggctgaccctgaccttacctggcttcttcccttcccttcccttcccttcccttcccttcccttcccttcccttcccttcccttcccttcccttcccttcccttcccttcccttcccttcccttcccttcccttcccttcccttcccttcccttcccttccctccccccccttcttttcttttcttaactattaaaactgagccattgcctgcaaaagcagctatttggagcaagaacagagacccaagagctcaagtagctctcttcttgaaaaccaattacaatttttctaattactgaggagtcaagcctgcagagttttcacaccttctccttaagtgcctccttgcaaagccttcccatgcctgactcttcccagactatctgaaattccccacctcactgtggtgagagaaactgaatgtcagcactcatagtcacccagaacagagcctgccacttgctaaatatctccacctactccacctgcctgctgcgctcttcccagcaaacccttcttgcagcagttagggtactggtcatactcttcgaagacatgcagggtagggtggggtcattggtctttgtgtgtgtgtttgtgttgtgtgtgtgtttgtgttgtatgtatgtggtgtgagtgccactgagcatatgtagaggtcagaggacaaccccaggtgccagtccttgccttccaccttgttagagacaagatcttttgttgacactcaccctggctggctggcctctaagcatctggggattctcctgtctctgcctcccatctcagtgtaggagtcctgggattgtagatctgcactactactccctggacttcatgtggcctttggggatccaaacaggtcctcaggcttgcatggcaaacattgcccactgagcagtctccctaccccgaggaggagggtttttatgaggcccatgaggtcctagctttgggagccaagagagtgcagtctgggaggaggatctacctgagttttcccatctgcatttgagctcacatatacacaatgtgtacgctactccatattagccgatgaacactaaagaacagaacctcacatgaacagtagaactcaaaaggcaactgctctgtttcctgtttctctcctgactttgggtcactcatcctttcacatggtcaaccagtcaaagtgcagctgcctaaaatagaaggcagttgtacctgctggtaccatgatgctgaggggagtgcgtggtggtataagcatggggtagacattctaagagctatagcagtcagaccattcaagggatgtgaagagaaggaggagaagttggatgaggaggaaagaaaagatgtgggagtgggggtggagagcgagagaggacaggagacatcaaggaagagtctcatgacagacagaggagcctcgtttcctagaaagtacaattctttcagaaagggggaaagaagctggtgctatgaggaacccgaaaggaagcaggcacatcgcacctgcagtctgcagccagctcaacaaaacagcataatctcacctaaaacgcaagacagcttcacaattttcatttgctttgtttttgtaacttctaccaaagcatgaagtcaggcttagggagggcaaagactggggaaaagcaggaagtttcacaaaaagca

SEQ ID NO: 212 - DNA, 2125 bp, Mus musculus
ctgcataatgaagccttacctcaaaaaagaagtttattcaagttacttagaatctctatcactaattttgaattttaagaaaaaaatatatttctagaacaatgagcctaggatgatgttggaaaaattctattggaaatttcactttaccagaagatattgattatgtcataagcttctttgcttcctgcctatgtgaagctctggatgatgtttggtcctatatggctattttagttggatttaggtttaaaaaaaaacagaaattaattcttgcatggcacaggctttaattttttaggaaaaaaaaatggatacatttttagcaactgcttaaacagttgaacctgaggaccggtgctctgtgtgtagccactgtgccaggtggctctcatcgggtgttttgtgaggaaccctgcttataggtttgaagccagtacattcaggatcccctgctgcccacctcagtctttccacacagagagcagatgggtgaagcagccccagaagtgacaatgtagctttacagagatgccagtgttggaatagatgctaattggagttgaagagacacagttagagttgaaagtaggacttcattatgaaatggtttagaaacttgttaaagctattcatataacaatattctgaggaatcaaaagagctttaacccttaaatataagtcaggagtttcaaattcatgttggagagaatagttcaaggacaaaatacaggtcatcagaacttcttttcagttttcatacacagcacatacacttgcataaaatactaatttattgagctatttaggttcctataatttccattaaattctgtctggcattgtgagcacaaatacatctctgtactactttactttgtctttttctccctcaacaacccgtggaatgcttgcaccctcaccctggaggacctcagcaaaggggactatgctgcagttccatgctctgtctttcagtggtaaggagaagcctatcacaacacttacccagaagcctctttactcccacggatctttaacttcagtcctaccagtcactgttccgaggccccttgggatgtggagaaatcgttgaggatggagcttagtgaagctaaatttggtgcactgctttgaatcaggattccagtgtctcctatcccctttctttcttattttttgctgccgtacagtaaggtaacctcctctgctacacactgtccagcataatgtctcccttcaacacaatggcaaagacagtggcatcacgtcatcacagacttaaaactaccaaacaaaataagccttcttatggaacagattaatcacagctggttgtcatagcaacaacaacaaaaaagcttgttggcatactgagttatcactgggaggataaactcaaatacaaaggaacatgaaagtacattataaattaacttctgaaaactaaaagaaaagggaagataagacaaaacgaaaaactaaagataaagaaagaaaccacatcacctcagtggtagagggtgtctcttttgtctcaaacacgactgactacaatagattatattgagaaggatttctgagaaaatcctcactaacaacttaagaggaggtatcccatacctggcattggtttttagttgactactaggaggaacattaattcctagtgtgcggtagctccatttaaattttctgtttttaattgattgtgaatcaatgcgtatcatgcatcctaatctcactcatctccttgtccctctgtatttcctctctgcctttgctgcacccccccatgaaaagaatataaaataagaagaataatttttaaaaatcacatcgtggaaactgtagtgtgtcacagtgtgtcacacagtatatcctttttctacacatctttacttgcaaatgttcatctagatgagttttgaggtttgaatctgcaggaccaccttttcacatgctccagcagttcatgtagggtagatattggggtggagcaacccaaagccctggatctgggccttcgtggtagctgatttggttagcatgccagcttttctgtgcctatactattagggtgagctctttagcacagtataggctagctcactcagtgacac

SEQ ID NO: 213 - DNA, 3700 bp, Mus musculus
tgagttaggatctttttgcattttccattttctttgattgttgttccgatgttctctatggaatcttctgcacctgagattctctcttccatctcttgtattctgttgctgatgctcaaatctatggttccagatttctttcctagggtttttatctccagagttgcctcactttgggttttttttattgtgtctacttccctttttaggtctagtatggttttgttcatttctatcacctgtttggatgtgttttcctgtttttctataaggacttctacctgtttggttgtgttttcctgtttttctttaaggacttgtaactctttagcagtgttctcctgtatttctttaagtgagttattaaattccttcttgatgtcctctaccatcatcatgagatatgcttttaaatccaggtctaccttttcaggtgtgttagggtgccctggactagatctctccttagtttcagtagtcagagtactctctgcaggcaagctctcctcttgcaggaaaggtgccaagatatctggtgttcgaacctgcctcctggcagaagttgtgttccactcaccagaggtcttaagatcctgtggagggtcctgtggaggaccttgtgggtgtccagagactccgtgggcaaggaacctcggtgctggcattgactggaagggcaacattgtaattctaagtgctttgctgggcaggtgttttgttccttttgttttggctgccctctctggcttttaggaggttgtggtatgttgtgtgttgcctggtaagaaatacttctcaaatcctgttaggtgtagccaaagagggttttggataaaatgtattcttaggtattgggagctgaaagaaatgggggtgggctgtgggtaacttggtctgtaggtaaagatccacaagaggtcaggaagcatgtgcttagtccactaggaatgtgggcagagagtaagaagtgtccacaacaggaaatctgttacagagctggggatgagacagggggttggatatgggagatagaagggagagagaagatctggagcctatttacctgctcagctgactgtcttgcttctctagaaggctcggctaccaagtctgctgtcacttggggttgggacagtgggatgatctaggtacaagtttgtagaggaatatctgggttctctattggagatggggcagagatcacagtaagatgcctgattaagagttgggggcaacactgttgcctaggatttggaggagagaagggagaggtgaatgcttgcagttaggctacttgccaagagttagatcttgaatcaaaaattattagaaaaccttcatatatgttttagagattcatgatacaattagtactggatactctatgagaatttttttattatctattttctttatttacatttcaaatgttatcctctttcctatttttccctccccccaaaaaatctcttatcctctctcacctcccccggctcaccaacccacccattctggcttcctggccctggcattcccctatactggtgcatagaacctttacaggaccaagggtctctccttccattgatgacctactaggccatcctctgctacatagagccatgactcctaccatgtgttttctttgattggtggtttagtcccagggagctctgggggtactggttagttcatttgtgattgggttactgaaatcttttgaactatagaattcttattatttcaaatttataagaagattgtgggatattttttattttaattatgctaagtctaaaaggataactgaacagtaatgcttgttattgtgataagtgtggatgaagccactttctggaagtttcaattagcagttatttttatcaacatagaccattcctgagaataatattatatatagttgaacatctatgaaaggttagagctaatttatggactaaattaattttgtccattagtgacataacagtcaggctctaattaaaaccatacatgtatttattgacagaattttactcgtaggaaaaagatatccatatttagttaacagactcccaggaacattgccaacagctttgcagtgttcctgtgtgttgctagcaacaagaaaccatgtgcagaacagcccagaataggagccgcctgcactttctcatcttgatggggtgcactgacgctgagatttacaagcctgaagacacaaagaagtgtttaccactggaaagtatgttctgctctgaaaccaaaaagagagtgtgaatgcagatggagtgctttgagttttctgggcatttaggaacaaattaataatgggtgttacagttccttcaagtaatacaatattcatattatttagttttggcattttatttatattttaaatccactatgcatatttttagaaaactgattactttttaaatgtatgtatttagtaagttgcattttctttcattcttaagttctgaaaaacatccataaagggtttaaatttctttaaagcacaagggaagggggaataatttgttctaaaaaattaaaataagatgataaattaagaacagtaatttatttgggtgagttctttgaaacaacaagacagttccggactgggaggattgttctttgctaagtactcaggattcctctaagttctgtgagaaagaaaatcccaaagtggagaatctttttttgttgttgttgttttgttgttttgttttgttttgtttttgagacagggtttctttgtgtagccctggctatcctggaactcactctgtagaccaggctggcctggaactcagaaatctgcctgcctctgcctcctgagtgctgggattaaaggcatgcgccaccatgcccaaccaaaatggagaatcttacatctatgattactgctctgagaaagagagtggttggacagaatgcctgtgataagatagcatccattttaaagggactgggaaagcagtcatttttgacaacaccctgtgtgtgtgtatttgcttgctagggttgctgtttcaaaggataccactcactggaagcttaaacatgggaaatgtattttgtgcaattccagagcctggatgccaggcactgaagtattgccatgacttacttctgaggcttctctctttgaactgcagatgactttcttgcccctagatatccatataatttccttctgtgagtgctgggcttctatttcctccttacatcagtagattagagcccactcattacttccatttaatcctctcacaagtttaaagaccctatctccaaatacagtccctttctaagatattgggtattaagacaaataaaatataacggaacaatctcaccatagtttttaaaaagcacatatacatgcagtaggacattcaaaactacatataatgaagtcttggtggagtctataacagaaaaatctctaggcgttacaatattgtagttgatcagtaatgtaatgcaaactttataattaaaaaaagaaagaaagaaaaaagaagaaaagaaaaaaaaaaagaaaagagagagctgtgttgccagaggtcagaagtgtgttctgaccttctgtgattagagtgtcctttggccggagggtaaatgtcacagaagagtctgtcgtcagtcatcctgttgaggcacaccaagtgcagagtctcctcca

SEQ ID NO: 214 - DNA, 2100 bp, Mus musculus
tttttcagtggttttcacataatggtcgctattagtcctagtggttgaatttctgaaaattatttcattagcctgaagcacaacgcacagtgcggtgataaattatgaatagtctaggcagagttttacacacaagtaaacacaattactgagcacatttattcagtgtatctaccactgagactaaatcatgtaactgactttaaattttgttaatcttaattcagaatttaactctacctagaaatttatactgtcaacactcagtggaaatatgagcataattccttttaagaataaattcattaatttatgatggttaggattataattcgattcctaaagagtctattcttaaattcaagtgtaaatagtttctttattatatttaagaatgtgcttttaaattaactagttaaaatttatatttttttttcatttttattgtttgttttatttatttacatttcaaatgttatccccttccccagtttaccctccacaaacccgcatcccatcctcttcccctgcttctatgaaggagctttctccctcatccacccacccactccttcctcagcatgcaacaaattttatgttttattttgtaattgaaattatattttttttgctattgagatgaaaacgtaaaaataccagttcatgtggttttttatgcatggttatgaatcatgtactaaggatgaataattacagctttaatatgagtaagtaaattgattatttggtgtgtttagttgcatctcaccattaaccctgattgtcacagtccacaaatactttttttcaaagttaaatagcccaaatcatcactgttgtcttttattatcactagtctgggcctttattcaaatgctatcccctttccagatttccactcagggaacctcctatctccaccccccctccccccctccccagacaaggccatcctctgctaagtatgcagctgcggagtcctgggtccctcagtccctccatgtgtaatcttcagttggtggtttaatccctggagttcttgcggggtggggaggtgggggtggggagttggttggttgatattgttgttctccctatggggtcgcaaaccccttaagctctttcagtcctttctctaactccattgttggggaccccttgctcagtccaatggttggctgccagcaagtgtggagcagagactgaaggtaaggccatccagagtccagagtctgggtctttcatgatactaatttggatatttcgaagtgggcagtacaccaaaacttactgaattttgtgtttgcacaaactctttttgtatgcccactttcttttccatgtttttgaaaatacttttacacacacacacacacgcacacgcacacgcacacgtacagtacacgtacacgtatatgtatattcccctttaaaatagctgcgtgaggcagtgaggtaggaagagtagcttggccaggaatttgcatgtccttgctccagcagagatttccctggctgctcacttaaatagatattaacagctcactaattaaactacctcttctgtcagcctgaaattagcaacagcttaaaaaaaatagcaaaggctccactttgctgtgtctgtgtgctgtcttatcttaaagacacacacagctattattgaaaaacacactagaaaattagagttaagtaaacacactcaattaaaatgaattaaagtatttctttacaaaatgcaatcattcaaagactgactgcaacgtgtaaagtcatgttttgatataataactaaattcaacaattgaaaggattttttttcagattcaatagacaaacaaatggataggacattttgcagttatcatttttaaaaatgagaggtacctttccgataaactcaaagaacctaatgactgaagaactagaaaacccaatagtcctcaatggaattgtcctcagtcctctacggtacttcaagcgatcacttagccagtcattaaacatcgtggactgcgtcacatcccagcgtgactgaattcaccctgataacacacattccctgtagctcctttcttcgcttattacatttgggtaatt

SEQ ID NO: 215 - DNA, 2100 bp, Mus musculus
attactaatatgggtttccctttccttgaccttctaaatatgtggagtcacatgcctgctcccaaaattcttgttctgactccaaaacttgaaaatcacatatgtcctagtgatgtcctcattttagcctataacttactcctacacaccagatatattgcattgcctgttgtataagtctcatatgcactcaaagtgtaacacatataaagtatgttttcttagtgtttctctaaaaacattaatcaccactcagtccatctcaataaatgtcaccattacctttcacattctcagccttgaatataagtcactccttacttcttattgcctgtatattccatatacaaaccattggttaggtcccactttgaaatattatctgaaattttaaaattcttgaacagcctcatatcagtcttcagtctgagtcccattaagcaccaagacaggcaacaaacacctaattcctctttccttttcattcctcttaactgaaaatatccatgactgttttcataataagttaacaaaataagtggaatttgtatgatttacttaaggacagtggaaaatgaataacttgtgttcatactttaaataatattcttcctttattaatttacatagtacatatttgatggtgtgacaagtaatctaatttcagatttcataacctcttcccactagaacccacattcaacatcttttctttcatctttaacatcattattctttaatatttatccatttcatttttaactaaatgtacattaacatatagttacatatatttagagcagctcatttatttgtccatttgtgatggctcctcacaaagtcaaagaggtgtcttctaaacatgagagattttgtttctcagatactccaacaatgctttctcatatccttgcaaaatttccaatccttcactatggtaggtagggcctagcaggtcaggtccattcctgtgtctagcaccttgcttcctggctacagacccaagtacaaactcatagcgttgtctggagatcctcactagcagtctttctctgacagggcccttcctcagaatatccacatgggttatacatccccatttcaccccagtgatcttcacatctctgattcctttcaaaccagcagatcatgttcctgagtaagtgccctgcttccttatcccccccccccccccacaactgctcgtctatcagatctgattccaatttcccccttcacaagcagcaggttgattttttaaaagccatacatatctcttatcccttggatatattccaagaacctaaaatagttagacattaacaaattatgtaacatggtgaatatttgtcaaatgaaaaaagttaatgaaaagatattactttaaacaattactggttttgcatatgagtcatttattttctaaaaataattttctatctctcaccttccataatttaatgtaggtgatgtctctgactaagtatgactcacagtaacttttttatctgttgaaagacaacaaacaggctgtaataatttatataacattaatctatcacttttattctctccctgtaggtgggcctctgatagtttgcatagatgatggcagatgctatttcatgacctcaaatgaggaactattttttactatattctagcaaccaaattaaataagaatcatttagaatataattaaaatttgtcatgaaaattattttattatgaaaactgagttttcttacaaagatagactatgacacttttatcttgactttcctctttaacaagaatttcttttattctagatacatataataactatcataatcatcacagcaacataaatttaattggaaggaaggcaaatggacactttgccccttcttagaattgggaacaaaacaccggggaagaagttacagagacaaagtttggagctgagacaaaaggatggaccatctagagactgcacatccagggatccatgtcataatcagcctccaaatgctgacaccattgcatacactagcaagattttgctgaaaggaccctgatatagctgtctcttgtgagactacaccgctggggcctagc

SEQ ID NO: 216 - DNA, 2625 bp, Mus musculus
gaagccgagaggcttaaaagtcactcatgaggaaaagagtttcaaggaagctctcctcctggagtctggcgttctcttaattctccattcccacattagtctagtgtatggatccacatgctctctttcaatatcatcctattataagtgccttttaagattgaattctgacatagctaaagcctcagtgttccaacagtcctagatcgtccttgagtaagaccttgggcttggaattcagttctgcccctggtattacactatctctttgagtaaaagttaggtcactgcccttcacaggaatctaccatcaccaaggaagaaagaagtttctgaccgtaggagaaaccagaatagatacttagaactatagctgagttacacccatatacaggaatttacaatggtttaggaagtagatcgggctgtggttttagagtattgcattattcatgagatggttagctagaacggaactccctagttagaaccatgacttgggtgtgaaagcccttgccctaggagagtaaagacctcacacctggcttctaagactatagctgaccttagatagggttgactttgtctcagttattttattgcccagttcctgccagtctttgcgttttcattcctctgttctgtgtaagagtcattaagcatccggttacctcatttgtaccttgcgggtaaggcacacaacttccttattgtcttctgcataaaaagtctgatgcttaatttgaaaaatacattcagattccacacgacctctcctgtgtgtgtctatttgtcactcatcctacgctttgtccacccgagactagagacccattccacgcagacaaaggggcccagagggtctgcggcaggttcagacattcagcagctagtttcaggaatcaaaattgaaattcttacactctgctgtcaggggggtaaacaggtagcattccgtgggagagccagagctcactctataattaaatcaggtgtaccatatctagcaattctgctgctatgtataaccaaaagtaatgtgcacatatgtgggtggaaatgttcctatcgcattgttcatcatagcctcaaattagaaactgcaaatgtcatcggtagactgcacaaacaaatgagctcaaaatgcacacaaagaaaggtgtgctcatatgattgaaaactgtccaacaatggccaatagtgaatggcactaaaaagacatcttcttattgatttggatctttgcagtttatgacctaagacaaatgagtcatgaaaaagtgatgctgaacaattctgttggacttatagtaaattcagagttacagtgtgaacatgcttccctaagacagctcttaggttatggcccgaacctgtaaggatcacattcccatctcatctttaaagcttagtccttcagatgatggctgcagtgaacaggaagaacttcagatggctgcagtggagcatccatcccacccaaagcagtgttaaaagggcatgctcgctggatggaggctacgggaggagtcccgcagcactgggagcgtggagtctgcagtcaagccacctggtccagttctgactctgcagtgtgcttgctgtgaggtgtgtggagtaatagtcaccaactgctgtgggctgaatgcatgttggaacccaatcacaaaggtgacagaattaactatggaggttggggctttcaggggctgatcaaaggactgagacctcaggaaatggagagtggctatgaaatccaagggagctaatttgtctcttcccatcatgcacagctagcaggttccatctttgacctagaaaattagccaccgtcaaatgctgaatctgatcatgccttgattttggacttcctagcttctaaattctgaaaatgaatttttgttatttacaagctaaaagaaaaccacaatgcccaagaacaaagcactactacacacaacataaatggatctcacaagtatggttgctcaaaagaaaccacacacaaaaggctacataatgcatgactcaacttacataaaaattaaaatggcaaaagctgctctcaattgtatagagcatgggagctggctttgggaagggactaaaaactggcaggagtgtcaaagaaagctcctaagcagagaataatagcttttatttagagagttaagtgctgtttgttttattccattttaaatgaagtttcagaggggtttctatttagttacacagtacattaattgttttgagaatcatgtgcttagatgatttgataacattaggaaacattcttaaattggtagtctatccataaaaataaggtgcattgaagaatggtggtttttttttattattggctattttatttatttacatttcaaatgttgtcctccttcccagtttccccaccaaaaaccccctatcccctccccctgattctatgaggctcctcccacacccacccacccaccccctcctgcctcaccaccctagcattcccctacactggggcatctgagcctccacaacaccaagggcctcccctcccattgatgcctgacaaggccatcctctgctacatatgcagctggagccatgggtggcttcatatgtactctttgg

SEQ ID NO: 217 - DNA, 3025 bp, Mus musculus
acaaatggacctaaaggaagaagggtttgtttgcgccgtatttgttggtacagttcattctgacagagaaggtgtggttgcaagggaatgaagcggctgctcatattgcaaccacagtctggaaacagaaagagatggatgctgatgttagcaagccccaccacacacacacacacacacacacacacacacacacacacacacacacacacacaccttttattccattttggtgttctgattcgtgagatggcactgcccaccttcaggactggtcttccctgttcagtgaaagctctctggagatacgctcacagaagtgtgccttctaggtggctcaaaaccccgtcatgctgacagtgaagactaactattacctgaaagccttacctttaaaaataaatagaacactagacatcaaccggtcaatgtgaaatagaataggaactttgtgctagattctcttttactactaaggctgcgttcaactctgtgttagggcccacgcggcgcggagcgtgcttactctccactggaaggaattttctctaagtgcttcccacctgctgatgggataattgatttttattttgtaatgcctcccgcacatcgctgggatttatccagaaactgtaagaaaatgacatctctcagtgttctctccctgctttatacttgagccccaattatagatttaaacgactgcttcgaaaatctggaaaaagaaacacttctcccctccccccaccccccaggaaatctccttggtaagatgttaagatgtcagtatagagttccgtgctatggaagcacgggctgcaacagcccacaaaggaccctcaatttccattctatattcttctttcttgtgtccctaattcaatccccaggtgctagtaaacttctctggtaaataaaagaaaagagaggcctacattcaaacaggcatttatcacagtctgtgagacactaaaggttctggccatgcccggctgatcatgaaatattcagtgaatggacagccctgaagctttgtaccctctcggtggctaggattctgtctgggagagaaagggtgttttgtttctaatttaacacgttgactcggtggttatagtcctaaaatttgattgcatgcatttgtggtaaggaccaattttgtaacttgttaggaaaataaaatgcaagcatagagcttatttttaaatcttattactgtcaaaagtaaattttaaaataagctcacatggtagaagaagagaaacagaaagcatgggtcaaaaaccttcatctttttactgcagcaaaaaaaacccactctttttctcatttgtgaactaggtccacatacctatacctagggtaatcacgggtctcctcttcatccaagttacgatcctaaagttcaagttccacatgtttgatcagcctgtagagtggtgaaactgcccaagaaattcctatagcccataagatcttcacctcttcttcagctcagccttctctgtgtatcttctggaaaattctccatcagtgctcactgaaaaaaaaaaacttctctcattaacaccaatacatacgcatcgtttttctttccctaaaccacgtggacaatctttaaaaagagtatgttggtcgtcttttatttttctaccaaaaaaaaaaagttatgaaaactgactttcacactgtaagttattaccaaaataacaaattgttatgcttatttttaaacttgcctttgtcttgtttttccaaagacgtcataaactccatgagaacaagatcggtaggtagtctctgcttccttggtgtttctttaaaatgccaaatgtgacagtggaataaataggtggtgaatgaataaatgcgtgaataaaggatttcagaacagcgctcttcgccggcgaagctgtccagggttcgggtgctgagaagaatcataaaatcgggcacaaccaactaggcaaataacctaaagcctgcagccccccaaccctgagagagctcactcactggctgccatgatgatcactaagtaacacccacacccgtacttagccttccctagctcacgcaccaaaatcgtagcttcagaaactatggcccatgaccccgtatgggctcacataactaaacgggggtgtcaaaagaaacttgtcagcggtaaagggtttctaaatacatgataatcaaacccaaattcaaaaccaaggacatggtgaaggcaaagagtttctggcagcagtcgcctgtgtcacttcatgccgcttccctgcagcctgggttctaaacacagggagcagacttgcaatgccaggcgctgcctggtgagatgattctgttattaaccgcagtgttttcattatacacacatatttttttgttcttatagggacataattgtctaattacacgaaaaagagaccttcaatattttcctaccatcactcaccttataaatatctttgaactggaccgttgctagtaaagagcttgattttgaaagcttctgttcgagttgttgactagaattctgtaaataattgccaaatgaattttgatttaggacttaggacagaatttcttccaaatttttctgaaatggctccaaacatacttctgccattttccatatagatttatgcaaagcagcattctaagtattaatgattataaaattaaatatcagtcaaccctaaagaatattgatgagacttaatatcctacaatatcaaatattcaaccacaatttaattctttatgtaatataaatacatccatatcattagtatgcaaatttatctttaatgagcaatcaattataggtataccgaagaattgaatattgttgggttaggttgacttgttttgttttgcttttgcttttgttttgtcaaggagcgcaccatggcatatgtgaggagatcagaggacaaactatgggaattagttccctctccactacgccagtcccaggaatcaaactgaagttgtcaggcctaacagtaaataccttcagcaa

SEQ ID NO: 218 - DNA, 2025 bp, Mus musculus
atactaatttggagcaaattactaactaatttacatttaactaatactaaatgggggaaaaaagttacttgtaccataaatcctgaaaggcaccaccactctctatttcgggggttggaggcgcactgggaactgaacctagaggcctattgttagatacatgttctacctgctatgattcccaaccccaaaagtgcttttatggctctcctagccactccaagtaacagttctaatctaggtaatggagtgactctaagttaacagagagggagcacataattccggttatatggaatgttgactccatatatctatctcctttccctctcaaagcttaatgacaatgtagggattactttaagtataagcagtaagaaaaaaggaatggggagggcgatagcagacagcaggttcagcacatctgccaaatccagagcacaggtagaggagtgtgactttaccacacaccatggaaaacttgaaataccttcagagtaggattccagcaagaagcaagccaatggaagtctataaacccagaacaggccaagaactggaagtaccatgtggttgagaaggccagttaaagaagaggctaaatataggattggttgaataaagtagttaacaggtctactcctggctaccacaatactttccaccaacatcatttagaccaagaaacagaattaaaggagagaagaaggattaggatactgactccagaccaagcagaggacaaagatgaccagcatagactagaatagataatcaagtctattcactacctggcaggattccaagttggtttcttcccactaactctctcacaacaagtgttatgaacacgccaactaagaaaatataagtgcaggggctgggaacaggttcagtaagaaaaagtgcttgctgggcaaagcatgaagacctgagttcaaattcccagggcctctgtgaatagtgagaggtagcaacacgcacaggtccccaaagctgcaggggacaggatcaaggggatccctggggtttgcatgctgccaacacagctccaggttcagagacagaccctgtgtctcacaggataaagtagagagtgacagagcaggacactgatgtcctctgacctctgagcatgtgcaggtacaagtaccagagaacacaactggaggaaaactacaacattgccctggactctttgtccagtacgcattatttaaacaatggcatgtgaatatgatgatgattatgtaacagcctcaacagagctcatttacatacacactcaagagcgacctcaagctcttactattttattttagataaagaaccctcctgtgagtttgctttaaggtagttatccatctttaattttttaatcaaagtagagaggccatcaaccttgtactagaaaatgctattctaggttagtttcactaacaagggagttattcttcctatacgcccacaggaattgtgagaaacacaataaatttttcaggaacccagtaaatgagactttagaacatttacaacattagaaactaagtcttccctaataaatatgctaactgtaaaactactcacaatgaaataacaaatgtataaaccttgttattgtaaattttcttaagtaaaaagaacagatgtaattagtgtaataataagaataatctcaaaaagttgttttttgtgtggttttgtcctgttttttaatcataagatgtggtcttaaagccagaaattctactttccatagatttaggagggtgtagatactggcacttctacagttttaaaattgcactcattatttaattttttttttgaagctcaagaacaattttactagaatttaaaagaaaaatactcgggctagagagatggctcagcaattaagagcactgattgctcttccaaaggtccttagttcgaatcccagaatggtggctcataaccatctgtaatgggatctgatggctgcttctgatatgtctgaaggtagtgacagtgtacataaaataa

SEQ ID NO: 219 - DNA, 1800 bp, Mus musculus
gccaacctgtgccgtggacccctgatgcttccctctaaggctttacatgtaactgctatacctgagtgagtagctttaactcctggtgctctatggcttcttaaagtcccatatcagggataatagagcccaagaacaaccaatgaataatttaggaatctttggaatccctaaggaattgtggccttgacctatactctaatcggtcccactgagaaaggagagttggctgtccctgggggttgtcaatcatctgcatgaaaccatgttctttcacttatgggtcaggaagcactaccacaagtggcaccaagggatttgtcacacaaagttacccaagtatcctctgctctgctcagtgcaatgattaatttagcagacagatgactcactgtcccgtttgcatgttctctgatgctggtgctgagggaaggaggaggaaaaatgactccacagctggatgtcccagaatgaacctgtggtgtgcaaatcaatggagaacacctgttctttcatttttatctgttaacagctgatctcaccttacaatcaattgcacaccacaccatagttcatgtaataaaatacttccatatgcatttgactccccataaagtcagccccacttcacagataaacaaactgagattcaaaattgtcacttcatgcccaagctcatgaagtcacgtaaggaaatgacagaagacacagacactgggtccccaaagcacagtgtcctgtccatcagacaatctctctccaaaacctccctgagatggcccctgggagggacccacctgcagtcatctagcagacaatagcccccatcacatccaagggcaaagaagacagctcactccttcatttctgagaagcaagtaaatctatgggagactgacagggttgagtaatcaaagaaacaagcctttcagtgaagatggacatctgatgggtaaagacaattacgagatgtgggcagtctggcagttgccaaggtcagtcataagccacagtgtggcgggcagcagcaatcaaaacaaaaggaagggtggaagacctataatcctggagctctcagtagaaagcctggctccaggtctgtagggcatgcctcacccagagagtgctgatggctagcaggacagtgtgtcttggtcctctcaggttactcacaccccagagcatcctcccccaaccctttgtattggggcagagaggagcatttaagaaacttgagaatcgggaaagacatattggtgaggataggtgggtaagtctgattgaaactataccatgtgcactgtgtataagagagtgggtagggggatgatatatcagacttaaggcactgtgccagatgctggtataaaaaatacctcgtttattgccctgccctctagggagtttttcttcagggggaatgaacaactcttgcagatagctgctatgagaagtgtagtaacaagttccactggagttcagaaaaggaaatgattgtcacatttaaaaaaaaaattattagaagactgcttcccagcccccaagagcatcacttgaaactcaaagattttggagtaaggtgctggaatcttggtacctatgtctgagggctttgtgattcctagaggcaaatcattttacctccctgtacctacattttttttttttgcagctgttaagctgggacaataaaatggtttatgcaactgctgtgggaattaaatgagcaagtatacaaagacctttaagacagcttgctatgtgcctagactatgcaggtgccagtcaaagccctccctc

SEQ ID NO: 220 - DNA, 3150 bp, Mus musculus
atccgtaggtttggtcttctcattgtgtcctggatttcctggatgttttgagttaggatctttttgcgttttgtattatctttgattgttgtgccgaagttctctatggaatcttctgcacctgagattctctctttcatctcttgtattctgttgctgatgctcgcgtctatggttccagatttctttcctggggtttctatctccagtgttgcctcactttgggttttctttattgtgtctacttccctttttaggtctagtatggttttgttcatttccatcacctgtttggatgtgttttcctgtttttctataaggacttctacctgtttggttgtgttttcctgtttttctttaaggacttgtaactctttagcggtgttctcctgtttttctttaagtgagttattaaagaccttcttgatgtcctctaccgtcattataagatatgcttttaaatccaggtctagcttttcggttgtgttggggtgcccaggactaggtggtgtgggagtgctgcgttctgatgatggtgagtggtcttgatttctgttagtaggattcttacgtttgccttttgccgtcttgtattctctggaggtagttgttatagttgtctctggttagagcttgttcctcaggtgattatgttagcctctatcagcagacctgggagactagctctatccttagtttcagtggtcagagtactctctgcatgcaagctctcctcttgcagggaaggtgcccagatatctggtgtttgaacctgcctcctggcagaagttgtgttccactcaccagaggtcttatgatcccgtggcagatcctgtgtgggtccttgtgggtatctggagactccccgggccagggaccccggtgctgcagtgggccggccgaagggacttgagccccgtatcaggccgggttatttgcttcctttattaatgcagtctcaggttctgtgagattggattggagcaggcgctgtgttccactcaccagaggtcttaggatcccgtggcggatcctgtgtgggtccttgcgggtgtccggagactcccccgggccagggaccacggtgctgcagtgggccggaaggggcagatttttttttttttcatttcaggtataatcccatttcattaagactggcctcaaacttgttatgtgccagaggctaacactgaatctctaatcttcaatcctgcaccttgtaagtgctggggttagaggcattcaccacctcaggtgacttttaggatagttgacatagcaattccaatgatgaagtaaccaccccagtaaaggagtggatgtggctctgacaactcattcaacttcagatttagattaatttcttttctttttggttaaaaattttccatgattgatgcaaaaacacttttccccagaaaaaaaatataatgaaatatattgagccgatgctgagttaaaatatcaggaagagacaaataactaaaaataacaggacatgattaatggttttgattcacaacctatttttattctctggactttgagtacccagatttatatttgcagaacaacagaagaaaaaaggaggttgaaaattttagttttgaaatacttttctttttgtcttttatttttttagaattcttagctttactgaaagattataatttgaaaacttgattcattaatgaatatataattttatgtttctctaggtctagacattgacatatgtaaagatttgcccttaattttacaaagtatgatgaaccttatgtgggagtgttgtttaaaaaaatatctttgtctctcagatacctctgagaaattatagaaatgtttttaggtaaaatgctagtgtcttgatttgctataaaaataacccattttgcccaaatgatggcttagctgtcaagagcagttctggcttttgtagaagactcttttggttcccaacaatgactcactaggtagcttacatcttcctgtgactccagctcaggggattcagttctcttctgttttccccagacacccacattcatgtggctataactctcccagacatccacattcatgtgaatatgcctccccagacacacacacattcatgtgaatatgcctcccacagacacacccacattcatgtaaatatgtctctccagacacacacacacacacacacacattcatgtgaatatgcctcccacagacacacacccacattcatgtgaatgtctccccagacacacacacacattcatgtgaatatgcctcccacagacacacacacacattcatgtgaatatgtctcccccatacacacacattcatgtgcatattcctcctccagacacccacattcatgtgaatatgcctctctcaacacacaaaaatgcataattaaagataaaataaatctaaaaactcaatttcactaaacaaataaaaataaaaaattaagtaaggaaacacatgaaataagatggtagaatgttgataattgttccaagtgggcttatgaatgctttcgagtttcttatattccttcatttcatgaattaaagaaaaattccataatatagtattttaaatgtttttctttgtgacttcacaacttactttttcttcaccttcttttagaagtttttcttttcataaaccttctgccttagtcagcttggcctgccatagcaaaaaaaccacagtctggataggtgtggtggtttgagtaggaatggctcacatagattcatgtgtttgaatgcttggctcacaggaagtggcactagtaggaggtgtggccttgtttgaggaagtgtgtcactgtggaggcaggatttgaggtcatatatacggaagcttcacccagtgcggcacacagtcaccttctgctatctgagcatcaacatgtagaactctcagctccttctccagcaccatatctgcctgcacgctgccatgtttcctggcatgataatgtattaaatctctgaactggaagccagcctcaataaaatattttttatataaatatttgatcatggtgtctcttcacatcaataaaactgtaacgaagacagaagcttaaacaacagaccagtatttctcatagaatcagagggtaggaagtataagagcaaaact

SEQ ID NO: 221 - DNA, 2725 bp, Mus musculus
aattttttaaaaagaaaaagtaaaaggactaaagtagttgaaggggtttgcaaccccatacaagagcaacaatatcaaacaaccagaccccccccccgtccgagctcccagggactaaaccaccaaccatggaatagacatggaggaactcatggctccagccacataggtagcaaaggatggccttgtgaggcttcaacgggaggagaggcccttggtcctgtgaaggcttgatgtcccagtgtagggggattcgaggacagggtgccaggagtaagtgggtgggggaacacccccatagaagcagatggagaaccaagagaatggacaatcaacaaggcagaaaaaagtcaaggatggttcccctaggggtaaggatgtttgagaggcaggtgactgagaaatagcaacttacaacttgagaagaaaataacaatgcctgaagcaaaaaaagaagagtctttaaaagaaggtgaccagcagggttaaatgctaaagttaagagactatcaaaaagactattgtcttattcagagttttattgatgtgaaaactctccatgatcataacaactcttacaaaggaaaacatctcattggacacggcttacagtttcagatgtttagtccattatcatcatgacagaaagcatggcagcatgcaggcagcatggttcaagagaaaaagctgagagttacacatctggagtcacagatagcataaggagactgtgtgccacagtgggcattgcttgaacatctgagaccctccacagtgacacacttcgtccatcaaggccacacatactctaataaggccacacctcctaatagtgccactcaatatggtccaagcattcaaacacatgagtgtagagggaacattccttttcaaaccaccacagcattgagtaatacacatgggtgtattaggcatctcacagttctttcaatgcagcatcgggggcagcacatatgagaacaacagtaatgtaaacaaggacagctgattatttcacatatcaaaagtttgtggggagaaaacatcatgttgattaggattcacactgtgctgctcaccatctgagagtgcatccaaccacctccaacatacttcagtgtctgctagtcgttaggaaatgggtgttaggttggcaaccaagagtattggaagtcacttcatgtatcagtcctaagtgatgtagaaattataatcttggggagaaagggtgaggaagccacaggggtgggggctgaggtagagaagatctgtccatctgtcatgatgcaatgcaaggttgattcccaagcctgtcgtctttgaatggctcctagtggcactggcttctgtcacttttcctagatgggcataagtcctttcttactatatttttaggcatgcatcatccccccattcatgtgtttatgaaggtgttctctctaaataagctactggggccttgcttgtctgtgacttcatcagtatatgactaattacttctgcatctgtcaagattattcagaagtctaattttacgctgcaggggggttagtcattccttatagcacagtaataactaaagtgagaaacgcacttggtaatgcttgtcacactctcatggccgtcacctatatgatgggacactacacctcgagcatgatttgtggaacagccttctcatgtacaatggtccctagagactccctttgtcttgcttgttaatttgccatgatctagaaacatatattttatcaatgatctgataggctatatttattacttattttatttacagcagcccatccatctgccacaaaagaatattatatcagtattatgtcagtttgcatggatgattttggaattggtttgttatttatatatggatatataggagatacatatctccaataaaataagaaacacccacacacatatagatgtgtgtgtgtatccatatagctccaataaaattatatataaccaataaaatcaatgtggtttgggaagacacaggcagtaggaggcttatggctataggtgaactaattgtgtgctcacgatatgctgggcacagtgctcagtacagttttacacaataactttcttactctttgtaacccatgaggtggctatgaaaagcaggaatctggggcctggggatcttgcacaccctggctcgccagcaagaatgacgctgcaacaggatccttatgcacacgtttattgggagagcttgattgcagaggtgaagagaccccaagcccagaactggtgctgcttatataggcctaggagaggcgtgtctcacacctggattggttatgcttaccacctcatttgcatgcctacatctgattggttaacttgtctctcatctgattggttaacttgtctctcatctgattggttaattctcaaaacctcatcttggcggaaaaactttactgcctatgtatgcatggtggccagcggtagccagcaccaccctgcaacggcacatgtggcttcccacatggggagaccagtcatttgggttaggttatacagtcacatagtgacaatttagattccaattcatgttttttcttgtttgttctttgcgcatgtttctttgttgtttgttttttctccagagatgtgaactgttaacaaggcatccatttttgtctgccaaatgcttaggtgactaacagcagcctcctcttgaggtacctgtcagaca

SEQ ID NO: 222 - DNA, 2775 bp, Mus musculus
cctcctgctttcaccccttcccaataagcccattatattaggaatctatcagggactccatccatcaatgaaggaggagctaccaggagccagtcactgccccaaagcctgtcagctggcagccatatatcaccaacacttgatcctgtgaggacatttcacactcaaactttgacaggacacttagcctctcttacttcataggacactagaggtgctgtgatggttctactgactgtcaccttgatgccatctaaaatcattcaggagacaagcctccaggcatgcctgcaagggactgcgtagattagcttcactgacttttcgaaaggccaaactgaaggaaaaggggaagggagctggtttggcttgctttattctagcttcctggatgcaagggccatgtgaccagaggcctcaggcctccggtgctgtgacttctctgtcacagtagactacatccttgaccactttacataatcagggtaccaatcttatctccagtgactgggatctaagaaggcaggaagaaaagaatgaagttcttgctgttttatctgggtgtgttcatgtgttactagggatcggacccaggttcttgtacatgttaggcaggtgctgtgccattgatctagaagggttgtgtttttttttttcctagaagatgcttaatctttatcactttttggctgtttactagaagagatatttcatgtttttaacacatactcgagtgcatgcatgcacctcagaggtgatggatggtcataagcttgaccctggtgatcctatccctatctatgggcatcagagcaccccactctacaccttacataaaaccaatgtcataaaaaagacataggtgcatgagtgtgttgcctgtgtgtatgtctgtgtgcatgtctgtgttgccctcggaggtcagaaggggctgtctgtcgtctgtaactggagttatagacaactgtgggccaccatgtaggagctgggagttaaacctgaagtagtgagtgcttttaatagcctggctatctttccagcccccaaaccaatttgaagctacaggaataaaaagggaaattctatgtgtttccaaacctcactcttcataaagcttcctcctttctgatactgatgcacagtctacccactgtttccttcctccttggcatttatttcctttgctgctcttttttttttcccccccgggggaacctggagtccttactttatttcctccctatgtagagttatctgcaaatcatttttcctgtattttgtccaattttatggttccttaaagcagaaaaactggctccagctttctctgaaagaacatgaagtctcccgcggctgagaccaaaggacatggagcaaagtggatcctagagcgccacccagtggctctgacgggaactttatattgcctgggttctctcggatctttcctagcaactcccctagcaacccatgagtcagtcccttggatgcactgaagattttaccacctggagtatttttgccctgtttttcttattctgccaccatttccggttcctataatatttgttcgttggtcagtccattataaatagctgccacttagcaaggtcacaatgccagatattttaacatctttcacagttccttacaaatgtgtatcacttcctcttaacacacaagtgaaaactcggtgaagggactaagcatcacattcaaattcatttgttaacggacagaatcgagattttcctcttttcattacatcatcgacagcagtggttctcaaccttcctaaggctgtgacctttaacacagttcctcaggtcgtggtgacccccaaccataacattatctcactgctacttcataactaactttgctgttatgaaaagtaacataagtatctggtatgcaggctatctgatacgtgacccccgaaggggtcaagaccctcagcttgacaaccgctgacctaaggagtccttagggaagcaatgctcccttccaggtcattccaacaattacttcccagaaactgatctaatcactagctaagactttgcattattgaatacagaagtctcggaacaccagctcccatgccctgtaaatctgcttttctaaactgtgcacgcctttaatcccagcacttgggaggcagaggcaggtggatttctgagttcaaggccagcctggtctaacagagtgagttccaggacagccagggctacacagagaaaccctgtctcgaaacaaacaaacaggggctggtgagatggctcagtgggtaagagcacccgactgctcttccgaaggtccagagttcaaatcccagcaaccacatggtggctcacaaccatccgtaacgagatctgacaccctcttctggagtgtctgaagacagctacagtgtactttacatatattaataaaataaatctttaaaaacaaacaaacaaacacccaaaaacaaaaaaacaaaaacaagccgggtgtggtggtgcacgctttaatcccagcactcggaaggcagaggcaggtggatttctgagttctaggccagcctggtctacacagtgagttctaggacagccagggctatacagagaaaccctgtcttgaaaaacaaacaaacaaacaaacaaaacaaacaaacaaaaaaaacctgcttttctactagctggaatctacaacttcaatccttcccatatttccttttgctgttttctgccaaccatagtaaagctaattcaggtacacactgaaaaaggc

SEQ ID NO: 223 - DNA, 1700 bp, Mus musculus
ccaggggtccaggagacatgatcgaacacctcctgtcacatgtaagtggaaatcaccagccatcggtttcccggggtttcagacctttgctcaactggagacgaggctgtctgtgcacagcccactgccccacaaggacccagcaaagccagtggtgtagttcagttttgacctgagagtctaatggtagaaatccagtctgagagctggaaaggaaaacagatgtccctcatcaagcagccaatcaggaagctacaggactcaacccctgtttgctccaccttttgtcccccagcgtactctgcaatgattgtcatatccaccacttggctacaggaggcagtctgcttggaaatggcctgcagctgatgagtcagggtgtgtccctggttcctgactgccactctttcctagaaggagtaccatgacacaggcatttccccttctttaaggactcttgccagtaacaaggaggccaggaaactctgtggtaaggagcagtaggaaacaccgtagccctcataagaacgactctaaaagtgccatgggaggagtcagtgaggtagtggctctcagccaagtgttctttgatgaacagagaggccagtcagtccaggctgtccctcctctgtccccccagaggggaggatttccacaccacattggctctggggtctgctggctgaagcatcagtgaaaatgaaagatttctagagaggaagtccacagtgtctctccatccccatacgtcagtgttctgacctgagtttgaggcacactgatgtgagaaactgtggtgaggagcatgtagtgagctatccccccagatgacataagggctgtgggatgcttgggcctggatctaagccacggctcctctcatccagggtctttatcagctctctctttatcacaatcctctcctgcgccacccctctaccccatacacacacagcccaacaaggagggtttctgactgactgatcctgtatcagatacctggccccctctacccattgacagcttcctcatcttacccagcagggcagacacaggggtattttttcccagtgttttccccaggccagttttagactctgcaattaggtctcctaggagatgttcagaatttggggaaattttgtactttcattttgcctttgtgggtttttttttctcatccagataaatgtgttcattgtgagccccacgtggctaggtgatctggcccgtccttcagtgactttttatttgccagaatagtttgtgtaatagaggacttttacttagaagtcatgttgaagatggtcattggttgggaaaccaacatggtcagaggcatcagcccctgaaactggcaggcaggcaactttgccacttgtagttatgcatcaagagaaggaaaggatagcaaatcttagaagacagcataacgtggatttcaagagccggagattgagaagatggctcagaccgtaaagtgtccgcccctcgagcttgggaacctgagcctgagtccctgatgtccacataaaagccacatacacacacaacacattcatatacacacataatacagacattactaattaaaaataaagaattggatatgggttcactgcaaagcccatttgagtttgggagaggctgctctttgtatagtcctcctcactctcagagtgaggcactgtgtacccaaa

SEQ ID NO: 224 - DNA, 2325 bp, Mus musculus
ttcagtgaatatttacacacccatatactggtctaaaaacctgagataaatcagcaaagaaaataaaaaccctgctttcccacgaagctcacattctagtgggatatgcagacagtgaaagataaacacaaaatgcaattatattacactgcatatagaatggggtaagtgctcaggaaaaatatacgcagaaaaaccaacaacaaaatacaaaacccaacagcagcatttaagagtgaagaggaagggaagaagcccaatgtggtagggcataactttaaccatagcattcaggaggcagaggcagaggcagaggcagaggcagaggcagaggcagaggcagaggcagaggcagaggcagaggcaggggcaggcagaggcagaggcagaggcagaggcagaggcagaggcaggggcaggcagaggcagaggcagaggcagaggcagaggcagaggcagaggcagaggcagaggcagaggcagaggcagaggcagaggcagaggcagaggcagaggcaggggcaggggcaggcagaggcagaggcagaggcagaggcagaggcagaggcagaggcagaggcagaggcagaggcagaggcagaggcagaggaggcaggaggatctctgtgagtttgaggccagccttgtctacatagtaagttctggctcatgtagggatatgtggagagaccttgcttcaaagaacaaaacacacaaaacagatcaaaataaaaacaatactaagggaagaagattggctttttttttccttttaaaataaactacctctttattaacagagctgttagcagacgttaacagcacagaccggggctgttatttttctgcatgcagttctgaaagctgagaagcacagcactggaagggctgcgtttgggtttggttacaactgctcagccctggcacccagatgttctttgtgtacagcggtgcttactcagaatcatagatagcaaacttaaaccgaagctttttctttagatcacttggaagggaatggatgcctgcagttgattctgtggggctcagggacctgtgtgcacactaagagcacagcagcagatttccccccaactcacccttttcctgaagagactgtagcctgggaggtcttcagactttatgtaataaaacgacttaaacataaaaaaaagaaagggtttggtggatgtgtttgtttccatggtaacgtggtagagggtgtcatgtggtgatgcaatacacaagagaggctagaaacaagggaacaaaagggacagagctctttttttttcttcttagaattatttattagttgtatgtatatgagtacactgtctctgtcttcagacacaccagaagagggcatcagattccaatacagatggttgtgagccaccaattggttgctggggattgaactcaggacctctgggagagaagtcagtgctcttaactgctgagccatctctccagtccccagagctcattcttgtgacaagactactcccgtgctaccaaaccactccctcagtagcaatattagtccactcatgaggataaaccctcaagtcctatctgattctggttctctcacctccaaacagatcttactcgatgtgcttgctgactttgatcacttaactgatggaagggttgtcagtttctccactgtgctctttggagttaggactttaaggctatacaaccatcccgccctcatgttttcactgactagtttcactctttttcagttactttgtgtctgtaagtgaatcgtcctctgaagcaggaaattaaaggttttttttgaaagttggttggatggtgttttgctgtggcaaacacgtgtaggaacatttcgttaaagtggatacaggtgtgaaaggctaaagccaacaattgaagacatgtttagctgaagcagacacagatgaaaggatgttctgctaaagcaagcatgtgaaaggacatgtgatgaaggattctttactaacaacacacatgtattgatttgccttacattttgtggttgggctgcatatgtcgggactccatagagagaaacacaccaaaaaaacttctggaggtctgctgcagtttgttgtcccttccaagaactggggctgattggatgcatataccgaggcaagacccttgtgctgaggtagggcatgtggaggacacatgatgtttggagggtataaataggactctacacagtgctagagacagagcttgccttgctggtacagctagctgtgcaacacttgggggtctcttatcttcactgatctttgcttcctcgagagaggcatagctact

SEQ ID NO: 225 - DNA, 3725 bp, Mus musculus
agtgtagctctgcacaattgtggcatctggcagtgtacaggtggatatggactcagtttctttaatgggtggtcctgggaggttgaccatgctccagttagaatctgagaaacacaaattgtatatcttttatttcttttgaggggccacaagaggcgggacagacgggagggctggggagtgattgtgactagggtgtatggtgtgaaatttccaaataatcaataaaaatatattgaaataatattttccaaaatttaagaagttcaagaaaatactagagaatggaaaagccttccattctcaagccctagcaggagctctcagcagtgaatattgttcttcctggaatctgaggtcaattcctagcatccacacagtaggaggctcacaaccacctgtagctccagcttgagaatatctcatgcccctggctggcatatgtacccaaacaggcgtgacgtacgctcacatacacacatgcacatgattgaaaattatcaaattattttttgaagattggcagaattaatattttgaaaaaaagagatttgtagaaaaaaaaaaaagatcccaaataaccaactctgagcagtgggaacagtgctggggtattgcaatgtgtgattgcaagctctactccacaaccacagtaacaaaacctgcatggctctgactcacatgaaatatgtccataagaatgaaatagtctcctcatttttgtatctgttgtgtactatgctcaggcaccattgatctgtgaaatagattatgttggtggaaaattctgtccaaattaagcatagacgtctgaagaaagttcctccaaaagctatggagaacaagtgctgctcatacggaagacctaagcctggttcccagcgctccagttgagtgcctcacacctctggtagctgcagaatcagatgccctcgcaggccccagcaggcacctaccctcacctgtgcatatccagacgcacacatgtaatctttaaaaatatgaatagctcgagaattgggaagatggaaatatgtgtttagaagttatcagagggagaggaaagtagaagggaacttgtctgaaattctgatttttcatataattagtatttcagtgtatgggttacactggaaattcagactagaatctggggcccttgtccggagcggtgctcacttcgtgaagctccccgtcatgagcaagtgctccatcctcatcactccctccgcctggcttttctatgccgactttatttttctctatcaacatgaaataaaggaaactgtgttggtttcttaactatccagaatatcaacttactaatgtaaatgagggtgttttgtagccatgagaagccaccattacatgtgtccaggactggtgagtggatacatggtccccaaactgagcagataaattcattcctttatactttgctgaacttaaaagaactgcactcagaatcttattaataaaaacatctacttcacatttggggctgctgtttaaaattagcctgaaaaaatgggttactttttttttttttttttttttttttttttttttttttggttaaagccaagtacagtaaattcataagttctacaaatggaattttacagaaacatttttataagccatagctaaagtcagtttttctaaaaactccccataaggtgagatcatgaacgccatgctcaatacagaaggggtttttatttttctccaatcagttgtgtttctataaataaactgtttgttgttaaaatttgctgtttcctcgtcacgtaagaacatctcattagttttggtgaaaaccttccaacaaaataagatgaaattgcccagttttccagggaacagaggcccccatggtcctgcgcggcagagtacagctaggaggtaagttaacataggactactgtgtggtcagggcaggcatttgaatctccagaaacattcaggcagcagcctgtgggcttgaatgcctcagtgtgcctcaagtcacagctcctcctctgctccctttggtgacaaagccattgctgagcagggacactggacaacaaaagcgactggagtggggtgaccatggagagagccagtcttacggtgctgctatatcatctagaaccaaaaagtgggtttccatttttccttgctgaagttgattagaacaaattctattttttttccctgtaaaacaaaatcatctttttgaagtaaaaggctaagaggtcttgggtgggtaaaatgctgaaagttttcattgttagaggagaattgttttattttgctcccaaatttgcatgaaatagtgaatttgataaaatgaaagtctaagaaaatctatttttatttgcagaaattatatgtattgtctgacagtaaaaattaaaggagtcagagctagaaactgcattaagtcagatgaatttagctaagagaatctacaaaagaagaagaaaaagttgttgttgaaaccaaatgtggatttagtactttaaaaagtgaattgttgcctgttgaagcttgtttcctatctatgactagttagcattgcgattgggcatcgttccacatttgtagcaaaacctggactagcaaagatggaagcctgggctcctgtccggttgaatggacttggctgactgggttccaccactgtgaagtgatgggtagggttcaggcgaggactgaagaatgccgtccttagctatctgtgctctcttcctcccatgctcccgttctgtttgcagtcctagaatttgtttctacatgcacatatatttattaaacaaacaagagaaatcttgagggatgggcagagcacactttgtaagatagatcaccagcacagatgaccttaaaaatgtgcacaggggctctcaagtaaccgaagagatttctgatgtatatatatatatgctttagaaatcagactctttaactgattattttccagacagctgtagaagtaacatcacatataagaattaatttagggtagtataaaaataataaaaatttcactgttagtagaataaatatttttgtttgcttttctgcttgcaagtaaatgaactaattctctaaaacagtaattttcaatagctgatgtcataactgaaactctgcttattattaggatggctaattgttcacatttctttggaaattgttgttttaatagttagtacttttatacctatatcaggtttgcttagtcattaaaatatacatatttttattaataactatgttataaaaaattatatttgactattaaaaatccacactgaaagacctttacactgagaaggcatctaaagtattataaattttgaacaaacttttaagtaacctatttgatttattattatgaatagtatcattcagtcattttaaaggttataataaaaaaattgaaagcattaaaaatctaataataaagatattttcaaggctgaaaaataataaatcttatgtgtttaaatttacatatcaagttttgccatagctaagtaagatataactttatggataggatatattcagctgatatatattgtattaataggtagtaaaatcatcttggtatttcctggaaatactgtcatactgtcacattgttgtctactgttgtctctgagcactgcttcagcgtggcttctctatttaccctgtctgttcatgtgggaacggagggagttgcactagtt

SEQ ID NO: 226 - DNA, 3475 bp, Mus musculus
ggtcttatggtacctttccatcaagtaggcgcatacccacatgctctccttcagtcaggtctcttagaagattggccaagtagatgattagcgtgtatttctgtgggaggcaaaggtaactggggtgaatgatggaaataacttattgacaaccttcaatgggaagatgggtaggtgctgtggatcctcttaactcaaaggtattaaatggttgagcaaaaggatactcgtgaactggaacaaaactggttgccaatagctgacatggccctggctaaccgctaatcctcagcgataataatttctacaaattgaagtttaatgtatgtggtagcactggcagaacttttgaattttattattactattagcttaggtatcttctgtgctaactgttcggggcgtttacacccttgtttgcacccttgggacaggccagtgctcctctgtggacgctaacctttgcatctgcctctgctgatagtcacagacagtcacagcttggcaattctgtttagtcaagcaaatgtttataacagcgtttaataaactcatccagcagaaactggatttgaaagagacagaaaccagtaaaaactgtgtctgagattaaccggaatattttgttgggcattcaaggctgtatgacttagttaactggaataccgcagagttactaaaaaaacccaaatacacattattagacatatttatacacactgaactgttttaaaccagttatgttggaataaagacaaaataatactgtgtatttacataacaccataacacctttcattagaaaaatctcaagccttcactaagtaacggagctgtgtggcaccctgcaaggtttgtgggatggaaggtagaacgggagagaacacgctgatggcaggacagggcaggcacacggcagagagctgcagctcctggtggctcaatggccattcaggttcaggttgccgcacagtagggagtacgtggaaagagcgtgtggaggacaggggactgtggacctgtgcgtgtttccagatatgcgcatgttgattctcaacatgaactccatgcatttaccctgagtggaacaggatgagcaagcatagtctcgcactggcctgaccatggtcatttaactcacagatcagctctgtctaggcccaggagaacctggttccttttacattcttttacccagaatggattgaagtgtgacagccagtctttgggaatactggaaaacaggcaggcatttcctagtcattgtcaaaggcagaagtggaccctcctctcttccagggcctgcccccggaggctgctatgcccagcacctcctgtgactggcccaatgctagcagcagcaagtatggagaatgaaggggactgctggaaagtgcctgcctgaggcttagcaccctgcagtgcagagagaagcagggcaaacacagggacaggagctgagcagaggcagtgacaattgaattttgcatttagaatttgaaggtattttggataccattctgttggcttcccaaaactcctgtcctgtaacttcacactgacttggttgtccctgccacagatctatcttcctgagcctctaaggaaacaaaggcacttttacttttgctcacagagaagtctcagttttggcttaacctctccaattttcagataatttaggtgtcacagatatccagagtaggatagctttcagacactataatttgaatgtctctgaaatgtaataaatagagcttcatctgggttttagaaataatgttttctttccaaacagctgtttgtttgcattaacaatttgtgccgtctctagaagacaggcagtgtttctttttatataaaatgccgctctcatctccatcctttgaggcttgttcatcactgttgtgatgttgtattacagtccttgttccatgttcagacacccagcctgacccaggggtctgcagaagagaggtcatttcctggtatggtggccgttgtcttctgctttccccagggctggctcttttactgccattccagttcaattgcgaccatttgcataagcatgtgtatgtacatcccaaatgcagcaggagtaagtattgccctgtctctcattggcagagcaaaggatcatggatcctttttgtggtccagttagcatcaaaggatagcagtaaatgagctatgatgaagctgaagataactaacatttggcacatatcagtatttaatgtgtatagtttcctgtcaaccttgtgagatagatgggggtccttgttactttgaggaaatccaggcacagagaggccactgcaggctacaagtcatttggctttgaactgactacatacagtttgctgtgtaatgcctctgagattcctaaggaagagtacataagagcacttggtctaagtgaggcatggtgatgcacacctttagtgcataccagcactcgggattcagaggcaggtggatctccgtaagttctgggcctccctggcttacatagtgagttccagccagccaggactacatagtctctctctctctctctctctctctctctctctctctctctctcacacacacacacacacacacacacaaacacaaacacacacacgtcatctctttgattcaaatggaggctctccaccctgccacttacatgctgtcacttagaacagaagcccattgtggtccatgctcctctgtgagaatgagcacagcacagaaatactcagcacagtgcctggcttgtgggaagtactcagtcaacagtactctgtgagtcaggatgcagggcattgtaggcaatcactcctcagggtcccatcccaagtgggcaggctggggaagacaagcactaacaggtctgatggggaggaatttcaccctgagcacaccgctagcaacattggaaataaactttggatctcctggaacacggcagggctgctgcagcatgaggatcagttgaagacaaatcattttcaatgtctgcctctggggacagcgtggtgccctccactggacgggtactgtgtagacatcttagagatgagggcacaccctccttcataaagatgcctgcgataacattcctgggttatctacattcttacccttaatatttgaaccccatgggataccttggacttagacagtactaagctccgctgagtgtccagggcacaggccttcctagagtagacaccagagatctgagaatgaccccagagttatttatctgggagataacagccacccatttgtttcagctcctatttgactgttaattggattaatgtctgccatataatcagaaccctggaagatgtaggttctagaggggaaatgaagagaggcttggctgataggcacaggagacacaggaagggctgagaacacacacctaaggcagcttcctgcctctttcctctagaaacaggactgcagtttggaa

SEQ ID NO: 227 - DNA, 2175 bp, Mus musculus
tttggcactgacaattcatttctcaaatcaaagggtttcttttttttttctctctctctagaagtccagtgtgggaagtagctagtatgcctatgaagtcttaatttgcttgagggaaagatgaatttttaaaaagtgggtgtggggctaagcatggtagctcttgtctgccatcttcacatttgatagaggcaggaggaccaggaattcgagcccagtagtctgggttacacagggagaccctgctttaaaacaaaacaagacaagcaaaaatgtgtgtgcatgcgcacacacccatgcttgtcctgtgagggtttccgggtatgcctcagttggtaaagtacctgctttaccaacaacaggtacaaggacccacgtttgatctccagagctcatatgaaacgccagtcgtggtggcatgtactttcgatcccagccctgagaaggaagagataaataggtccctggggttcactggccagcctgctaccgtaattgggagctgcaggccaaggagagagtctgcctcaaaggaactggttggcattcctgagcatgacatcctaggtggtccactaccctcgtcacacatatgtacgcatgcacacacacacgcatgcgcacacgtgcatacaaacaaacaaacaaaaaaataactctttactaaagaggctgtcttctgttctctgtctttcatacactgcaggcagtgcctttctcatcctgtctgtcttctccaaagaaggacacttgtttctgggtccagggtgccctgaaaaccaaccaagccacaactccgccagtcttgctgtgcagcacttagaaacggagcttgttttcctgttttcacgcctctaagatcgataatcgctgctctctgctttgctagatgaaataccaagtaactgtctcgagatgtagctgggtgaggggacggtgaaagaatagatctcggcggctgcgcactgagcccaccacacccaggctcccctgacttagctccgtgctgggactgcgcagcatttccagacaagttagtcccaagcaagggagatgggaaagagtcagtgtgctgccgctgaccatgtgggtggaactctgcgggggtggggggataagaagccccgggcaatcctgcaaagacttgccaaagcctgggagagaagggctcttcttcttgttcccttgtttcagatttttcagagaacagagtgattagtaccctggagtacactcggcacactcgagggttagtgctggatgctttagcccacacctaggaacgatggcagcacaggtcctcaccgactgctgagcagcctcgttgtctgcccaaccctcagacccccatttgcgtacctggaccgatgctttcccaactaccactgaccagtcctgccgtgagcatctcttctttcctccgcactccctaggagaaggggagacctgcctgacaaacttgctggtgtggtgaactcggtgatgtcttgctgcagatagtttaatgcctgtgtagtctttctctctcctctccttctttcccttccccctttcctgtatctcttcttccgtcccccatccttcatggcttgtcttgtgtgtgagctctggatttagttgagagacctcatgccagtgaatagctgtagagtatttgaggaagacgccaggtatcagccttgggccttcacacacacacacacacacacacacacacacacacacacacacacacacctcaaatatgcaaacatacacacacatgttcgacacatacagacatatgccaaacatagacccctagtttataccaggagctggcagaaggcatatttattttccaagcctttctacaacattgttaaaagtttataaacttttcagaacctgtctgaaactggagaaatctatttggccctagaacaattttgcttccatgatgactgcagttttagtacattttattttttaaaagcctgagaatcatatatgattgatttttgtgtacttgctactttcttctagttgctgaattttcacgcaaagcagaatttaaatgtcataaaacttgtgtgtatttgcacagcagcttagttatagctagtgtttcatagtttacacgaatatgcttcctttttctctcaaattatggggacttagctgaattttcaagac

SEQ ID NO: 228 - DNA, 2725 bp, Mus musculus
cacctccaactgagcaacaatatcatcccaagtgttatttttatataaacctaaggtagtaatgaaacttactactaatacagagataattcacctttaagtatatatgtgaacagaattaatatataggcaattacagaagatagtggaagagaaaaacacttataataaaagagttaagactattattagacagctcatacatatatgctaattatttgatagggtagttgcaaaggttgtataggaagacaagcatttctagagctgggtatggtagcacagatttgcagtctcaactattcagaaggctgagtctggtgaattgcttctgcctaggaattttccctgagtctggacaatatagctgcagcctactccccttcaaaaatgaacaaacacataaccccactctaagaagaatcattagaaaactcatagtaagagcagtgataggcctaactatatctgcagcctcaagaattagcccatgaagaagaagttcaggacagacttgcatacacatattttattctttactaaagacagtagcttcagccagtgtgggtggaaaaaaaatcagtagatgatttagaatacaggatagctatttggaaaagtccttttgtggagcaaattaaaattcataccatatgctaggatgggatacaaatagatgaaaaaatagtgtaataaataggacaaatataacccagatatctatcaatatgaaactgtctgaatacattgtggttaagcagaccacaatttgctgtgagacccatagctgaacattaggtggagctcaaggaattctgtagaagaggaggaagaattgtaggagccagaggggtcaaaggacaccacaagaaattggctcacagaatcaactaaccagggctcatatgggctcacagagactgaactgacactcagggagcctgtgtgggtctgagctaggcatatatgttatagtgtgtagcttggtcttcttgtgggactcagaacagtgggagcagaggtgggctctgactcttttgcttgcttttgggaccattttcctcctcctaggttgcttcatccagccctaatatgaagggatgtatctagacttacagtaccaagatatcctgtgtttgattgatatccctgggaggcctaccctttcttgaagggaaatggaggagtggatctgggagagaagggtgatgggggagggactgggaggagaggaaggaggggaaactgtggtaggcatgtaatatataagagaacttacgtagagagatctctgggatgcattatgaagtggataatataataggtaggaaatgttattgttatttgtatttccatcaagtagcatagggaggggttaggagagatggggcagtgtaagcaggagtgatagtgacacacatgggattggtttaatttttgatttttcttttgcttattattaagttatttatttatgttcaagtcattgctccccatcggtccccacttcccacagttcctcatcccattccccctcccccttgcctccaagagggtgctcctccccatcaggtctctcccttcccttggggccttaagtcttttgagaattaagcacatcttttcccactgtggctagaccaggcagacctctgctatataagtgccaggggccttggatgggcctgtgtaggctcctggctggtggctcagtccctgggagcaccctggggtctgggttagttgagactgctggtcttatggggttcctctccctttcagcttcttcagtccttcccctaattcaaccttaggggtccccaacttcagtccaatggttgggtgtaagtatctacctctgttttagtcagatgttgatagggcctctcagaggacagccatgcctggctcctgtctgtaagcacatgatagcatcagtaatagtgtcagaccttggtgtccttccccacaatcccccaacttcagatggaccccaacttgggctggtcattggattaccttacctttagtctcttctacatttttgtccctgcagttcttttagacaggaacaattctgggtcagaaattttgactggattagtagccctgtccctccacttgagactctgtctatctactgctggtggactcttcaagttccctctccttaatgttgggcatattggctaaggtcacccccaatgagtcctgagagtctctcacctgtcaggtctcagtatgtaatattttattcattaaaaagtcatgaaaatctcattatagatggttgtgagccaccacatggttgctgggatttgaactcaggaccttcagaagagcagtcagtgctcttaaccgctgagccattttatgccccagtacaggggaatgccagggctaaaaagtgggaatgggtgggtaggggagtgggggggagggtatggggggacttttgggatagtattggaaatgtaattgaggaaaatacgtaataaaaaaatatgaaaaaaaaagaaagaaaaaaaaagtcatgaaaagctgggcagtggtggcacacgcctttaatcccagcactcgggaggcagaggcaggcagatttctgagttcgaggccagcctggtctacagagtgagttccaggacagccagggctacacagagaaaccctgtctcgaaaaaccaaaacaaacaaacaaacaaacaaaaaaccaaaaaggtcatga

SEQ ID NO: 229 - DNA, 5500 bp, Mus musculus
atgggctcaggttacgggcttctctctctaggctcaatcttgtctgagcagcctgagtttggatgtgcaagctatctcctgcagtgtggcagattcccatgcagagggctcaggctgaaatccgtctgtgttgctttagtatattccacagatcccaccatttgtaccccactggaagcacggctgcttgcttccttcttgtggcttgaattttgagggagtcctttagaaacctagagaggaacttttcatcattggccaaccaagatggttaggtttctgtgttctcccgggtgcttcaggaacccctatctcagacacgagggcaaggcacatggctggttgaggacacaggtacagaggctctggaccacatgaggacccactgatggagcaccgagtactggcaatgcgatgtctcagtccttagaaactggggatgctgatgaacaggagatgtggatgcaggctgggggcggggcaagcgagggtgaagcctcagtacaaactcaggtcctttacattcagggagctttggggctttcttggaaggcctggcaattacatctgggactgtcgctcagagatgtgtactgtcagtccttgagaaaccagctctcactgtccaaggaccagaagcagggtccacaagagcctttcatccttcatggaatccgtggtacctgttcacaggagataacacagttccacaaggctgccaatctgacacaaggaagcagacacaattccacaagctcttcaatgcatcatgcgtttttggatgctttcttctgccccatcccttcctgtcacctcttgactgaaatccctggagcattaccccagcccccacctccatctatctccctcccaccacccggctttattttctttatggcatttaccactaccaggcacgttgtttattaatggttttcctcactaaaatgtctcatgcaagatgtcaaagattatctttgacacaaacacttagggccaggagtcacacttgttccagtgtagctactcagcgaccacttgtgacatgagtttgtacaggaagtctttagtagctttcaggtgacaacccttcctctgcagggtcccctgcctccctgttcaggacttggcttttgtcctctctccttcccttcaccctttctgctcttgtgagctgtgctcaggatatctacccagcctaaaaatgcctcgttctgacctctaacactctcctggattttgatgtcagagttgcttgcggttggaaagccatcgtcactttccagggagaccctgagctaccctgtgtttgacatgcgctgtactttaagaacccacacgcccccttgaggctctcagatctcccactggcttcacagcatcatccactttctagccagctttggagggggctttaagcagagctgtccctggctttaacagtggctggagcaaacttgctgatctgaacatcattttcttccatggtcctcttagccttcaatgtttccctatcatacctgtcttacaacattttcctgtattcttgttattccaaaaggcattatcattaaacacagtgagcaagctaggcactgtgtgatgtatttacataaacgccgaatgtatatacctaatgatgttcctgctctggtgagtcagtttcatttttataatctactaagacattctttccctctcaataaagttaaaggtctgatttgtggtggtgatggtggtatggtggtggggaggaactccctaaattgttttatgccagagagtctgatttcttcaacaatagctcaaattagatgagagttggtctacagggcttcccacgcaattccaggcattctctcttctctcactctttctttttctccccagtgatatgatagaaaacaaagcatgatggtcttgcattcacacagggcctactacccctttctgttttccttccccacttttttgtgacattaagcctggggtgctctacagctcctagaagcagagccccttcctccactccctggctcagaactgtccttgggcaaatgctgttactcattgtagctgccctccacgctgagatgcctcatacaactgtggatctgctgtcaggcctcagaagcctttcctgagtcaccatgggaaccaggagtggaggtgtgaggcgacctgtggggcagcagcagtggattatttagtgcatgttattattatatgtagtacagccggaaagaattattttgaggacataaaaattattgcttctctgagggaataggctcctgtcacccaggaaaacaccatggggactcaagactgatttttgaaagtagctgtcctctcaaggtgaccatagtattccatgtcccatagagaacatggcactgggcccttgaggatttctggacatgtacaaaatgtagaattgactcttttcttacttctagatcaatgatagccttctgtaatgaagctctgggatttacatgatactccagaaagccgtgctagatagacccttcatttgcagttgcaactgaagaggttgtttgatggcggtgggtccaggttggtgggagatgcttctaaggggtaggagacaagtgatttaccctacatactcactagtcagagtcaggaagtcatggcctttcattcatttggctgagtcataggtttctttctcatggtaggaaacacacaatgagaaagtccttgtctcttctcctccagcctgcaggcagctgggggaagattctgagcagctgcgatctaaagaagccccttcacctagaagaacatggttagggcgctaagatgaagtagaggagggcaaacaggaagtaaggagcacagagaccacacaggggccagatcatgccgagccctgatcatgtgtggagaatttgaaaattctggttattcctaaggataatggggagccacatggtctgtaagcagagatgtgtgtgggcagatgtggattgggggtgggggggggatgggaattccaggcaggacacagctgcaatatgagagaccctcactgcctgcagataaccatggttccatagcgtaaaccggaagctctcatttcatagcaaaccatttctttaaaaagatgcgattagcacactattttgataaatgatataagagattataaaacattttctcatagctcaccatactcaggaaataactgcacacaaggcaagggcacagcgctctcggtgcctcatttgtactgtcaaagcaagatcttggaagctctggcaactctgggttcttccaagatctcccttcaccccttagcactcaaactaccccatctcaggtgcctgtcctgcctgcagctgcagaagtttctcttccttagctggagctccggtctgtggccaacagcacagtcacttcaccagcctctcccagtcctgcaaatgtagcaagccattcattgccactatatcattctacctgtgctactgtaacaaaataccacaggctgggcaacccaccaatcacagaaatgcacgtggctgagcagtccagatcaaaatgctacagacttgatgatgacattgcctccagagcaaagttctgttgctgtgaacaccatgtccttacacagtaacaggcagcaaggcaaaaatgtggcgagccctgccaactcttgggattacccactgtgaggtccggcctctcaaggtttggtttcctgtgaacgagctccaagatgggggtacgtgccatgtgaatcctgaaggagacacagaccttcagaccatggcggtcactttgctacccattggccttggatttgcagatgtgcttgctggcttggttggtagttaggagaggtagtagcgttaagtggtgcttgactgtatttttgtgttatgatagcctttgcaatttcctaactacacctcggtagtgaacatctagagaaagggtcccttagcgttgcagtaagtgcagattgctggggaaatgggattccagaggcctctagggcaaaaatcaaaagctttcggccagcagttggatgtgaggaggtggagggaagagcagagctgctccaaggctggatacaactgtggtggcagtgttgattacgggggtcgggaagactgagtgggggcaggcactggcagatgggagtcagactatggttctctttctgtacaaaccggggtgactcagggagaccccagcaactaactactgtcattataagttttgtttacttacaggtagcagatactccataaatgtctgctgattcacactttgggactccccatgtttgggttaattgttggatgataatagagaataatgggggtgcttattgaggggttcgcaggtgtcaggcatcaagctctgcacatcttacctcattcttatctccctagtagccctaaggggtagtgactgtttcatgcgccggccctgtaagtagatgctattatgtgaagtaggcgctgggtgagctcagtcttaccggggacagggtgtgttctggcagcaggtggagagaggagggggaaagaggaaagaggtggaggagaagcctgtggcaggtgcaggggaggggccagccccgaagtctctggttcccttcgtgcagagattaaggcacctatttcaaatggtcatggtggtgctggttccagcctccgaccctccagtgagaggcagcaagctcctccctcagctgcacactggttggctgacctcggggatcacttggcccgtcagggcctcagctttactcatctgcaaatgggtatccaagctgcaatctacctgtctatgtgcccggagaggacaggaaagtgtcatcctgtccgtccttgtgcgcgccggcagtgagggggcgtggcctgagagtgcgggacctactggaggggggaagggctgagctagaatgagatttcctcatctttattttgtagaaattgttggggaacctttggctaccccccattcagaatgtacttcagcaggatttatggggtgcaggagactctcagatatgcaaggtgcattaatccctaaggattttgttgtttgtttgctttttgcaggctgacatacatgtagggtaagggcattttaaaggtgattcagcaggtgtgtggtgacagggtgacccacttagagcagagccccagtgaggggctcacaggagcttatctttgtctccatattgctccttcagggaaggcaaagttaccctcagacgctggcaggcattccccagtcccccatgattcaggacacattgaagatactgtttgccctggattcatagaggtcgacggagtttccattttgagcagagaagttgttgactgagacttcactaaagtacctaagtgcgtagcaagttgactccttagtaaactccttagttcctagattgggcacgaggatatgtctgacatctcaaactgctttgatctcctgtaagaaccctggc

SEQ ID NO: 230 - DNA, 2750 bp, Mus musculus
cacttcctcactgcagcagagggacggtgacaccactgagaccaaaatcccctacccagttgtcacctacaaggaaatgaaagacctgggacttagcaccagccatccaatacaaatgaaaattacaagtatggaaaaattaagattcagaagtttttggagtaggtcttctggtttttggagaatttactcacctccatgtaacctcaaaaatagcatctggccagtgtatctgacccaccagcccaagtctgaacatctgtcttatcaaagtaaaacaacaactcttttcaaaacacagggaaattatctggaaatagaactattctgtttcaagtgctattaaaagagaaatgggtctggttataaccagacataaaattggaagatacccagaactctctgaattttttttttaaagacaaaaatccactggcaaaggctcgatagctcaaaaatatttttaaaagcccgttattgaaagacttgattatgcaagacacgggaaaggagatgagttctgcgtcagatcattttggggatggaccagtgttattcagtacaattctccaagcaagacagaagccaccttcaggtcgtctgtgatgcctttcatacgtgcatggtggagcccaggactgttggcactgtttcctagaaggaggagacagaggggtttctggacctcactaaagtactcagccagcccagcccaccccatctgtatgcagttttatcctaagggagatgctagagtatatagggtagggaagggaagttcatctttgcagacttggggaagccatcacccatgttgggtgagacttgtcagtgtgtctgctgagggatcccacatgctcctgttaataccgcccccccccccacacacacacccgtgctctgtgaactcaatggtttcccagagtgaagttcagtagaattaaacactagtttatcatcggggccttatgaagcaagggaaggcattgtttatatccctcacctcacccagggaaggaattttaagcaatcctgaggtctaatgtctgaggtaaaaatctgcatctccacaatgaagaggcaggggtcaggatgtcttccagaacactagtaaagccaggcccaatgttgaagtgattcaacacagatgtgagacacatcggaagccgaaagccaactgactttttggatattgaaattatcactttaagcttggctaaaaatcatttcagtctttaaagtttcagcgtaaaaggcgtgtgtattctaatgtgtgagaagtgttaggttgtcattcatctttcccaagttctgttgtgcttgcaaatctctctctctctctctctctctctctctctctctctctctctctcacactctgcaaggctgctaattgagctctctatcttctatctaacacatttgaggcaagctctttaccactgagctacatccctggtccacaaatcagattttaacaagttaaagtctgaccactgttagacccaaaatactatttctaataaaactacggcagagttccagtcctgttctatgctccttttgtgcatccatccattcaaacatcgcagccctttgggctgtgcacttagctcctctgtgtggagaaacggatgcacggatggcttgctggctgttcctctcatcactgtaacgaaatacccgacaaaaggaacttaggaaggaagagccggctcctctggactcacagactgagaaactgttcctcaccatggcattgaaggctgttggcaggagcacaaggcctctgctgtggagagtctgagacagacgatgctgatgcttgcgtagctttctctcttcttccctttatccagtccaggacagcagcccacactgctgcccacacagcagcccacaccgctgcccacacagcagcccacactgctgcccacacagtagcccacacagcagcccacactgctgcccacacagcagcccacactgctgcccacacagtagcccacactgctgcctacagtcacctctgtgaaaatgctcacactccacctgagtgatgctaagtgtagtcaaatcagcaatggagagtaacccttaccctcacagatgggttagctcagggtcactgactgggctcagcattagagcttcactttgaccacaggcagtctggtttcagagcctgcctcctaaccacctaattgctaaaagactaagccagattgaaaaaaaaaaaaaaaggcatgcaaggttcaaaagccctgggttcaaattccatctctatcacttatactcaacaacgaacaagttctgtccgacctcacttctatgctgctgtgctttccctgtgaaagaccataatactctataaattaacctatataaataagtaataatatatgatactttatataattaaagcagataaataaatacctgggatgtacaagcccttgataaggtttggccatcagagggtaggctacattgactccattcatgtagatctgatatatacttacacgctaatgtttaatgtcacaaaatgtttaagtcacaaaaacagggttaatacattataattgacttttttccagtaaaagttacttaagcctattcaattttgcaatcaactttctagacgaccaagttgctgcttgcatttttttctgatttttttcttttgattaacaaaaaaagattccttacattgagatcgattgtatttattgatcagggctttgggc

SEQ ID NO: 231 - DNA, 4450 bp, Mus musculus
cttgttgtttctcagaaatgtagctagacatcaaaatgagaaacatggcagcaaggccaaggagggaacttctgagtttcccaaatctgcatgcattcatgcactgattgtgcatgcgtgtacatgcatgtgtatgcctgtgcacacatgtttattctgtgttgtcttacacacatagttccatttagccctcaagatggaaactgctttgtccccaaagagccctatatgaattctttacagccacctcgatgttctgcgcccttccatggccatatcgacccccaatctcttctctatctctatttctataatttcattactttgagaatgttgaatgaatgaggtcatatgatgtagtgtttcggagtctttttaactcagcataattcccttcaaatggatccaagtttttgcctgtatcaatcgtttttattcttgcataacattcctggtgtggactgtcacagcttgtttaaccgttcacctgttgaaggacatctgggttgtctccagttctgggctgctgtgactgaagcttccatgaacgttcatacacgggttttgtgtgaacataagttttcattgctctgggacaaatgcccgagactgcgggagtgaaactgtatgtagtgcatgctgaagcttttaagagtctgccaagccgtgctgcagagaggccgcaccgctctgccttccaccaggaatgtgagcgcagctgctttctttctgcgtcttcaccagcatctggtgctgccaccactctgggtcttagccactcacaggccatgaattattttaagtttcaatctcttaccatctaatggccttgggtatcattgcctgtggaccttacttaaccaccacgtggtcctctgtaaaggaatggcgagctaagactggtcagagtggatatgctaactgtgagtagatatactattttagcttccatatatgcattgcctggtcacgtgacatgttctgtgtcaagtgtatttcatctctaggtttgcctgagagaccaagcccttgggatgtgcggtgtagtaaagatctaatacagccacaggttgcattagtaatcttcttcagacactgtcttagatagttctaaatgaacgtcaggccttttcaacaagcttcaagtgcgtgcacatgccagaatttcctcttttgtggctgaatgtatttgcactgctcttcgctcctcagtgtcctgtctggatgaacactgtcgggattcctgcttggttgttgagagtgctggagtggagctacctcttccacacacttacctcattacctaggaaagcaattatccctgggtctcttgtggcattactacgtctgactttttaaaggaatcttcatgttcttttccacaatggctatactaatttataatttcttgaagtagaacagagaatagaaccagaggaggtggtgggactttccagaatgaacagatagagagaaattggttgctgtgcaaagctatcactagacaaaaggaatacgtactgttctagagcacaacaagaatgtgtacttaaggataatgtgccatcaacataaaaagggctgattagagttttaaatgcctcagcactgagacatgataaatgcgtgaagtaatggctattctaactactcagttgctattgaagtggtataagtgtgtgtactatatctttcacctttgagatttacaaggaatatcattttatcatagaacatcctaagtagttttgaacataaaactttatgtttaaatatgaggaaataaggagagggaagagaagaagaagaaagaagaggaaggagagaagaaaagggaggagaagaaataagaggaagatgagcagaagctgaaagaaaggaggggcaaggggaaagcaggggagaagaggtagaaagagaaggagggattaatggcaaaagagaagaaaaaagacaaagcaaaagaaagtctttttagtctattttttaaatctgtttaatctttagttatgttttgaaatgtataagcccacatctcaagaaagtgagtcacataggattgctcaatcccattagcaaaagacgtctatcaagcaattaaatccaacctaaagaaaactacctggatacattaccagactggggttctgagtcaaatgaaggataagagaaacaatgccaaccccctaggggtgtttgggagactcattctcttttttgtttctaatggagccaatctccaatgttgtaggatgttttgatttgttctgttctgttctgttctgttctgttttgttttgttttgtctctgaccagtacccttgaacttggagggagatgaagttcctgaatactactgtacacatgacaaatatagccacctatagacagatgtttctacacctctagaatgtacaacacccaaaagtgtcagccagcaagacagacacttgtgaggtctttctctctctttctcttagtctctcagagcacatgaacctgactctgcatcctcttctcacaataggacgttgctatggaaacagggagttgctatggaaacagggagcttctttctgggagactagatgcaaaggacagaatggagtcctggtggcacaggactttcagggcagctgaagaagcttctggtttgtcgggaatcccttcctgtggacttcaggacacaacatctcaacagtcaattgtttgtcttaagcaccatccatttgacctaatcagaaaatattgattttatgaatatatatttatattagaaataattcacttaaaagttaccattttttagtagaattagtgaccaattggagaaaagtaaacaacttctgtttagcttaataagtagtgtggtttttctcatcaatattcaaattattagaatcaaaagaaccaatataactcacaactttatttttttaactttttcttggttctttgtgagtttcaaatcatgcacaccaaccccactcatctctctatcccttcatatcttcgccatctgcccttgcaacctcccctccaaaaaataaaacagaacattaaaaaaaaaaagtgtcatggaagttgtcatgtgtcccacagtacatccctcagtctacacatcttaacttgcgaatggtcattgcagtgagtcattggtttggcttctgctacaccatcaatactggaccctcacgggaaccctctcagatatcctgctgtcaccctgtttcctgcagatcttgaagctctggatttccaggactggttatctcatgtgcttcagcagttcaccgattggggagaggtgaggttggccaactgaaagccctagacctgagcctgggaagttgctgagttggttgcactgctagatctcctccaccacagcacacaaccagggtgagctttccagcatggccttggcagcagggtgagctctcctgtactcctgcacttgggccagctcacggttgccttggccatcaaggccagctctactgtgctacccaggcaaggtgcagggtctgctctccttaatgtttcagccagtgagaggtggggccagctccccatagtgctacaaccagtgaggggcaggggcaactcagcacagaccttggacaccaatatggtcccaggcagcaacccaaccagggacatccacatggtctttagtggtaatatgagccatgaacatcaacacagtcctgttactggatatttgatcacacttgaaccctgagactgtgttatttactgaagaaaataaggaaatcctttaatcccaaacaatgaaggttaagttagtttgtagaagaaagcacccatgttggaaagtgatgtctaactgagtggcagacaatctgaaaaaggtttggtcagaataggatctgccccactctcattaaaagagagaggaaagggaggctacttcaggggtagtacatagagggagggaggagacagttttcctgggagagttttacagagacaggttgcagagagacaacaaactagacacaggtgaagacagaacaagccggaaaatgagaaagagccagaagatgagaacagattaccagagttaatttgaggccagcaaagcaaacagtcaaagactgagaaagagaggccaggttgaatcagtcagcttggagaggagtttgaggcagaacagctaagttgaaatagccagccagagttcagaaagaacaagaaagggtgagcttattcagcagcaagtctcagaggctgaaaacgttctaggcctaagttagattgtacagaagctggaagcttccatagggctaaggctaggcctaggtgagtagatagaagcagtaagacttggagatggcaactacctcaggtgaatcaacattacaccactgctgctgcatcgccatgatcccagacatggccctcagtggctgcatgggctgggatt

SEQ ID NO: 232 - DNA, 1800 bp, Mus musculus
ttacaggagagacttaccaatgtcaaaagccatgtctgtatcgaggtaacattatttttttagaacccagtttgaaacatattttatcacttgtttttttttttcctgtgccttggaaccttctttgtacagaaaagaaatttgaaagggctggactgtcacccaacccgttatttcagttgcttaaactagcaactgcatctatttgagagaacaaaagtctaggattgtgtaagatttttaaaaatgaaaagcgtgtggtcactctttttcctcagaggaaggaatacattttacgtttggagtcttcgtagaagcaggatttcccccctatggctttgagggctagagaccaccgcgtgggcggcgaggggagtcggcgggcctgcgagctctttccacttattcttgttacctgtgaaacgctgctcacctctgctaaccatcactccggagcttaaataggttggccctcagccctggaaaccctataacctcaatttttaaacggtgtgcttcttggacctgcttgggctgtgacattattccttctgccttccaagttaagaaaattacttttagcaggtcatagtaaaggcgggattattacataattggaagaagcgcgtcccatttttcaggaggcagacagcatcacggaggtgcacaggatgtgtttttctttcttctcccggcatttacaccagggccctgtgttccttttggataaagacaagacttctcggcacctatttcgcctccaatttaatgaagttgttaaagtagcaagactgacaggttaattatcctttataaaagggggacaaattgaactgtgtctttccatcattttttgatctatccggaagctccggaggtgcccagacgcggctctggtgaatagcacggctaatccactctgcagttcttccctgaccctgctctccccaccggggccttgctatattgcggttggtttttgtttcacattcaacagatcccactttattataaattcaggaggatttttttttccctccctctctccatatgttggctgacagctctgctgaaataactgatggctaaatttaaactctgatgaaaattaacccaagtgttaaatgcaaacaggagctgcctggaagagaaaagagttatcatggtagacgccaaacagtggaaaatgtgtgtaaattaatggagcctcgctggtgacaagccgtcaggcagtttgatggctcttgctagcattttagtcccactgaagttggccagagggcagaatggacaagtcctgcttttcaaaaagaccgcgggaagcttgacagtagcgctaactagatcatcaaaagttcatggtcaaataagagggttttcttttttttttttctttttttttctttttgcaaagctttgcactaaacagagtttgcagacaggagagcaatggatgagacatcaaaccacaaaatgatcaagagaagacatggaaatgatttcctaagccaaactggctgattctaaagttcatctcgagaattggctttgttactcatcgtaggcatctggctgagaacatttctcctcaggaacgggcttcccatgctgcaggcatcttccacagaaacaacacttgtacttctcaactttttcagattaaagtctgtaaaatatgcacttttaccatagctcatcgaaaagaaacaggagtctaatcaagtgtggctttgtttcctgccatgacataactatgacagtgagaataagttaaggaggaagagttcttcgctattcctt

SEQ ID NO: 233 - DNA, 1625 bp, Mus musculus
ccaattaattacaacagaggctaataaaaatgtagtggaaaggttcaaatttgaaccttgctggaaatctagttgagtctgggcatctggctggacagaagcaaagctggactaggcgcacagcaacaaagtgctaggaccagaaaggggcagtgggtgtccgtctagcatagcagctacccttccaacctcacgggagcccaatatagactcatatctgtatctgaggcaaaggaccacaagcaaaagttaatgtcctggtatggggacatagagcaaaactgtcaccatttacagccaatttatcaccaatggtgatatgtaaagaaatacagataccaaagatggcttcccacctaagatcagggactgcaacaggaaattggagaaggcactaactggtctggtcattcccaccaggaacctcattgattggcactcagggacatgtctgcaaccacttataggcacctgagtgaagaccatctgccagaactgaggaagatcctatgaacgaacattgtgttcttgctaatgatgtgactcccccggtcccaggtgcctactcgttactgggaaagcccgggcataattaacacattttttttccattttcatttctgctgctggcttaagacatcccgacaaaaagcaacacatgggaaaagagaatttatttggctgacaattcccaggtacagcccatcattgcaggggtcctcaaggtaggaacgtgagcgagtcaatcacatcacatccaagagcagagaaagaataaatgtatgctgtgttgcctgcctgggggatggtgctaagtcttcccatattgattaacagaaagataactgcccgtatgctcccaggctagcacggctgtctctcactgagacccttctcaggtgaggcaaggttggggtgagctggcattaaaactaagccttgcacacactgggaacattttgtacttgcaagtttctcttgttcctttgagatagtcgcacgggaacgtggaggctgtaactgtaaggtgatatttatgagtcttttgaaaatgcattttacttctgaagagactttgcgagtcagctcctctaggaaaaggttggctgtgccaatggatagctgtgccatgactagtcttctaggctgtgctaatctgaacagtcattctcggagacaaggtgatgatcagcacctcgtctcgctccctttgagcgaccagagaaaggagcacggcttctaagtgtatgcaattggacacagtgcagtcatacaagctcatttaagatgattgcgtctaatctcatttaagagatattagggaggtgtgtgcatttcaaaagcaatgaaagatcgcctggtttgtctggcttaccttcgtcaccaccactgtcagaaacctccttatctctgggttctttctgttgtatttatgtttgcttgtcttttatttcctttatttggtcatttagtctcttgggtatacactcatctcaaaacatgagtaacaaggagaattggtttatgtgaagaaatggttcttagcagcctaaggaaaaccctacaaggaattgcagacaccacacaagtgggcataaagagcggttaggttgggagagatggct

SEQ ID NO: 234 - DNA, 2325 bp, Mus musculus
ccccacagacttacctacaggggatgggatcgagggattttctctgtcgaggttcatcttaccagaggacgctagcttgtgtcgagttgacaaaacaacacaacaaaagctaagcaggacaacacaccataatctacccctgataagtaactatgtgatcaccatgaggaaagtcatattggctctaggatcctaaagacctcaatgaatatatcatattatttggtttatgtggtgtccctttcttggttttcttttctcttcctgaaaacaccgctaaagctaaagccacaccaaaggttctctgggaaaagatcaggaagcttttctgcacctctaggttgtaagtgcatggacttgagaattcctatgcaacagaatccaaacttagagagagaaaaaaaaatggaaaccacaaacatataagagaatctatctcagagcttccacaaattagaactattcataaaaacccatttcattttttaaaatgatctttacagaaaaaaataaatactcactggaaatggttagctgagtgtgtgggaggagcaaacaaagacctgcttgtgtaacttctattcgccccatttaaacccgctgtgaacaaacactatgttgggatgactcagcattttaagtgctatatcatttttgctttccaaagatggctcagatcaaataataactttgcatgttcttattaataacttttgtatttctatgaataaatgccttgaacgacttgaagaggaagcctaggtgtgggccgtagtttcaaagcgttctgtctgtggttgcttggctccctgattctgggcccattggaggcagaatatgatggtggctggagaggatagtaggaagtttccttactctctgtgggtcagaaagcaggtagaataggggacacagaaaggagcaagatgtagccccaaagacactccggaaatatctactttatccaaacagaccccatctctccctttcaacacctcccagtaaggcctttatagtgtgactccacgagaggttagtctcctgattaggtcagagttcttctatctaagggttgctgggaacctcatcagatatacccaagggtgcatcaccaatccttgggatgtctcttatcccatcaaaattagccatcgtgtcattggagaaaagacagctactatacaaaaacttcaccacaacacttaacatctcacaaaacccagaaataaagagggtgctgcaggggtattggcaggaaaaggaaatgctttacagctgaaggtgcagaggaatttaagtacagatgatatcattacacaagatggggcttgactgttaaacaactctgctctccataaagggtttaaccttgagggtgaaacagagtggacaccccatgcccagcctctggagtctgtcctcctgagtagtgctgacctcatcttccccaccagggtccagctgggccacatcaagccaggcactactgggctttctgcttcccactctagaacaggtctgtgcttgagtgctgactcctgttggaatcctaagcaagtccaaacctgctgcagtcattccgggaagcacactgtgctctagccatggattctgcagtctcagcaccaacgtgatacagccatgctccctgcccaagacttcaacggcttcacgttcctgaatcataggcctagtcacagattgtcatgacttgaatggccacaactatttttctttaagtgtacagtgttggatcaatctggccattcaagttaagactgactttgtttcctgcacagaactcatctcctctctttaaattaaagcccagacgcttatctgtgtctctggtctccagcatggtgtttttattctctaagagtaatttggccttttgaacagactaaggcaattaactgtgtcagagacctgtataggatttaatgaaagctatgcactgggcagggcatggagggagcacattaatattattatcacactgcatggaaggctgttggcatggaccattaggctgcacagttcttcaaaaaattgttataatctatatgaagtcagtgtttaattaaaatgtcgacagccccaagatgtgttccttttaaaaataaaacaaatgaaattcactaataattcttttatttcctactttgtgtgggaatgtgtgtgtgtgtgtgggggggtgtgtgcatgcattagtgagcacttatgtgcacagaccagaagtcaaagccaggtgtccctcagtcattctttatcttactgagactgagtctttcgtaaagtctagaactctctggttccactatg

SEQ ID NO: 235 - DNA, 1900 bp, Mus musculus
tttgttggttggttttcatggttggttttttggcttgggtttttgttttgttttttgtttgtttggttttggtttttgttttgtttggttttgcccatatcatgggaaactgtgtggggcagtggtctgtgcacagacagcctggtctccagtcaagcataggtctggaaccccagggacccaatgggtggtgatttctacctacatgggacggaaggtattggatcatgtttcctagacccctggctcctgtggaagttaccgccccatagtcccccgcaggagaggtgtgtgactatcactcacataaagtccaagcttctggcattctggctagacttcacacccacagttacctgactatagctgggtatgctcctccccacagctaccctgcaacaacaggatagcctagcccactataaaaggggctgcttggcccctcctttctctctttaagctctgacctttcttactctcatctctagccctccttctctctctcccatcccccctctctccacatggccatggccagcctctctccctctttttaccttctctctttgtctctgcctttctacaataaagttctaaaaccatagactgtctctgctcatcaaggcctgtcatacttgaatgatggaataaataggctttccccgaaagagcctcatctaacctcccaccagaaagccttcctgtgctccagccatggaccagaccaaagactctcgcctgtatgagaaccacccagcgtcccctctcttgatggcccctcctcccttcagccctggggatgaccaagcctcccgcagggcccctattttgttctcagctcttccaaggtgtccagcggtgtctgggatgcccaaggctgagaacctggtacctaggactgccccttgtccacccccatgggctgggtccatagcctcccacagccagacacccaccctgggccacatggaaagcatgcagcagtcttccacatccgcccgcccagagcaccagaactctggtgggatgcaggctttctcccactccctttattcccctatgcctacctcccggcaagctgaactgaaatgtttcttcaaagagtctggaccagctggctgcagtacaagtatcatactcctctctgggaggaaagatccacaggtctctctctgccacacttactcttcgttcagggcacagcatgttatggctctgtgatctgacaggccactgtgttggaagagcttcattacctgctgtaacgtgacaagaatatctgtgtctccttctccataaagctttagctcatcccaatggagaggaccacaccttacttgcaaccattttccacaacacacatatcacatcctctatgagagaatagcactccttgaacagatggtgaagcccaagccgtggataggtgggttcacagcttccgtgtaactatagtcagcaaaatcataactctaggtgagatgaaacatcttgagcaaattgacgaacgttgaaatccaaatccctggtgtgatggtttatatatgcttgtcccagggagtggcaatgtttggaggtgtggccttgttagagaagttatgtgtcactgggggaattggctttaagaccctcatcctagctgcctggaaaccagtcttccactagaagccttcagaggaaaatagagatctctcagctctgcctgcaccatgcctgcctggatgctgccatgatcctaccttgatgataatggactgaacctctgaacctgtaagccagccccaattaaatgttgaccttaaaagatttgccttggtcatggtgtctgttcacagcgcagtaagaccctaactcagacatctagacaagatctccatggggtcttgattgaacttctcac

SEQ ID NO: 236 - DNA, 2075 bp, Mus musculus
aggttatccacaaaatacgtttagcgatattctggcaacgtcctctgatgtaagagcctgcattagggatgttcatgttcatggccacacagtctgaggcatttttcctcttagccccaaatgtacttgtatagccctcacagatagcccctctatcttcaaatgtacccgagactctgacgactgtcacagctcttgtcagcttgacacaaacctactaacgtctgggaagaaggactctcagatgacaaactgattccatcagaatggtttctataccattttcttgatggctgataaacacaggaaggccagcccctgtggacagtgccatcactaggcaggtggtctgaccaagccagggaacaagccagaaagcttagttctccatgatcagcttcagttcctgcctcaagttcctgccttgacttccctcagggatggactgtgacctatagacaataaaactctctcctcccacaactttcttctggtcctgtggggcggtgagctagtcgagcacaggcctggaatcctggtgaccctaagggaccgaaggtgttcagccatgcctcctggacccctcctggacccctgactcctgtcgcagctacagcctcccaccaccatcacctccaccccaccccccagagaggtgtgtggccatcagtcatgttcatgtaggcaatgctccaagctcctggtattctgtctggattccacccccacagttacctggcaacagccaggtatgagccgccccacggttacctagcaacagttaggtgggcccagcccactataaaaggagctgtttgccccctcctctctctcttacctcttattctcttgctcttactcttgctcccttgctccccctctctccaccttctctcccccctcccctccctgtgtggccatggccgccctctgcttctctactcttctccctctctctgcctttctacaataaacgccttaaaaaccatggattgtctcttctcattgggaccgctgtgttggagcaatggagcaggtcttccccgaacaagccacgcgtctaacctcccaccaggaggactccttgcacaatagccacggcttccgccaacccaagacgttgcagaccaagccaaaggctctcatccctgcagtaaccagctggagctctctccccctgcccttttcccctcagtccccggggccagagtccgcccgccatccccactctgtttctcgcctcttctgagacatccaggggcacctgaaatgtccaagactgaaaacctgacgtccttggcctccttgcggcccagggacccccagaaccggcacggcacttcctcagtgctcagcggtgtctgtggtgcctgagaatctgatcccgattccggcagttccgaggggaccccagaccgctccttcgccacccccggagcgggggtcctgcgtcttctcacagcccaacgcctgtccagtggttccataggggtgtgcacaatccaaacttccgggagtctcgcctcgcccagcggccctagcgtacatgggaccccatttttaccccacatggtccgtgttttaccacaacaataaaacactctgggaaaagagcttttggaatagcttagttctgtactttacaccttgttattaacaccataaatttttttaattaaaagccatattctatgataatgagcaacacagcaatttagtagcaaacacacaatagcagtataaaaacataaaggtatgtgtagtaggtaatgttaaggagaagaatatacatatttttctataaagttgaaggctttatagaatttctgaggctagcagaaattatgtgtatgtaatatagatgaagatgccgtgatcatcagcgatatccaattctatgccccatagactctgtgaccaccaccacccaccctccccctctagagtagctgagctcttgggctgctgtgaagtcctgcagaccactgcactaaacaacagcagtgttttgtgtcttgggtgtggaggctagaaggaaaacacaaggtgttggcagggctggttcctcctcagga

SEQ ID NO: 237 - DNA, 2425 bp, Mus musculus
aggctgcttccaagcatgtttcttatgatgctcatttaaatcctagactcttccagagagcttcctttttgctttgtgtgaagacagcctctatagcctcacatttgctccttagctgagggtggctttgaactccacatcctctcaccttcacttcacaggtgctgggcttacaggcgtgtgctggtatgccctcctgtggatatcaatatttctatcacatttttgttaaaaaggaaatagacacacaaaaagttatttaccaaggctggtgtaataataataataataataataataataataataatatataggggatatacccaaacagcacatcaggccaaggtggtttcacatgagagagatttattgttggggagagaagaaaaagtggaaggggaaagaagagagagtgagagggggtgatctcctgatttatatggaaagtgacgtaacacaagtaagggtgggaggtgagccaagtgggttctgggatatgagggtcattggcttggcaacggaggtcatgggttacattgttagtgcctgggtttggaatgtcctagtactaacatacctcccttgttattataaagagaaggggaaaaaagggaagggggaaaaaagagctgatggtgaaaagagaacgcgggcatcatgtctcttaaactgcttcctactatctaggagcatcgtcaatttcggggcatatctggctttcaccatcagaatccatttggcaatcgtctgaatcaggttcttctatggacagtgactcttctgtggacagcggctctcctgtgggcagcggctcttctgtgggcagtggctggtaatcttgtaacaggagccgattaatagtttggttagaaattttttgtctctgtcattgaaagaatgtagacaagattaataagaaaaggggcaaataataacgccaggaagatgactaagagaggtgttacgaaaaggagtatccacttacatataggatttttcaaaaatccccaaaccggaggtctcatggtctctgaagtttttgatgtctgcctgtagctcctggatttggtttttcactatcccggactggttgacatagaaacaacattcttcttggaggatcaggcaaagaccaccttctttagccgtcaggagatctggcccccgccggttctgaagtaccacggctgccaaagagtctgtttctggatagtaagcacagtttcagtcatttcccgaagatcacgtttaaactgggaagtgaatgtattatattgggtcatagacgtcattatccctgctattccagtaccagcacccacagctattcccatggcaaccaaaagtggcacaacttgaacttcttatattgggcagctatcatgtttacaactgggattggtaggggctcgtttccctcgaataccccagttcggggggcggggggaagtagcaacatgcaaccccctgaccagctggccggtagacggtagacgatgatacacttgagtgccacaaaggattggcgtgttctgaactgtgggacattgtggcagagatgatgtgtcaagagttatggttttattgcagtctagagaactcagtgttcctacagagtgagtcccagaggttttgaagcaatttgccacaccaaagagagggatagaagtgaggtatggagtcatggtaacattggatttagggcagctagcaaggggtgaggtaaggttacttggtagtatcaccggagatgctgtaactgtcagttgtgaattagttccagcaggtgcacatagccaacaacccttaaaatgcccaggcctgatgacactaaggagctggtaggccgaggtcaagttctgaagcaaaagacggaatgacaagttagtactattcatgaggggggacgtcaaagagttaagaaccttggaggaatatttgattttctctcctacttttcctatgtttaggggtggggaaattgagacgtattttctctggatgtgaatggtacttactggggagctgggctgagttttgcggtagagcttaccatcaactcctgtttcccacctgggatcccatgggtctcatatgtagaagaagagtgtcttgtggaatcgatagaaggaatgattaatccgtgttcctaacatatgtatctcacaagaccaatatgggcagcccccatatttgtccggccatcttctgcaatagtcctttgtccgatcaaagagaaagcaagtatagaggtcataatacacggatgggctaacagatgctgggacgatggtgatttggatcagttcttggcacccagctatggaacagtttcctgaccctattgaaaagtctgtttgttatctgtgggtttttcttggactttgaatctccagacataagggctacccttggcggaaat

SEQ ID NO: 238 - DNA, 2125 bp, Mus musculus
ttacttgccctgttaggcaagaacctcctgatggttcctgttcatgtggaatgttgtgtatcactttcctgactggaagttcctgctgcatgctctgtcataaactatatgttctctgcagccgagcaaggcctgacctttaccactgatggccactgtccaggactccagtacaatccagacctggcctgagtgagtaggggccctgaaaagccagacccatcaaatctcctggaatacatttgtgacagttcacccaacttgctacacaccttgcacattatgttgctgtgttctagaacctgttggcatttgaaatagggtgtaatgaaacttatgttcttttcattatttatattgtctatgtacatgccatgtgtaaccatgtgtagccatgggggccagtggacagaattggatccccctggagccagagttacaagaggttgtgttgggtgttgggaaacaaacaaacaaaaaacccaaacaaacaaacaaacaaacaaaaacaacaacaacaaaccccatagatctggaaaagaggtaagagctcttaagcactgagccacctctccatccctgacctgaagtcagacactggactttaacagattgaaatagttacgcgtgatcactctcttttaggctgtgagcaatctgatgtttaggatttagtcaattgttgattaaattgatttacagttctccagtagcaagaacagcacctggcatatgttaggctctcaacaaatgctgtcaaaattcaatgaatcattggagggaaatgatatctaaaataatacctaaactgctggtgttactatattcagactctcacattcaaacgaattgaaagtgtgctatcgaaggagcttactgtcagctgaagggactgaagtttaaaggacatttggaggccaccaaggcctgggatgggcaagccggttggcatgactaacacaagctgtgtctgaagatgaagctgttagcacaaggtcatgcacagctcacaatgcctttgaaaagcagccatgaaatagagtcagagtgagtgaatggcctgtgttatggtttaggttatgtgaaatgtatcccacaggctcacaggtttggacttggtccctagttggtagcactcttttgggggactgtggaacctttaggaggctgggtctagctggaggaaacaggttgttgaggccaggacacagggttgtaggttggctccatatcccatttcagctctctggttctggctgccccatgctcccactaccacagagctgatcctgctgccatgtctttcccatcgtgatggaccatgacttctgaacaacaagctagaatacatattttctatttgtttctgccgggtgttctatcacagtgatgagcaaagtagctatataaccctacacaaccttgagattccgccttctactgagaaggctggccaccctggatctagaacactctcctggagcatggaaaggaactgaggctgttaatgggatgtgacattctgggatccataccacacacaggactgtaccctagccctctgctggcctctcttttagacaggactgcaccctagccctctgctggcctctcgttttgaatatcactctatgccttcccaagtcagaggaacacaatttaaagcactgatggagaagttggaagctttccctgagcctgtgctatgctaaggatctatccatctatctatatgctaaagagctgatagatgctgtcccatttttgcacttacataatggagccttattccaaacctcaggttggttttcttgcactcagatattactgagcatgctgggagaattgcagcttgagtgcttcaaagtctcctcacagcctccaggagaaagctcgccttgaggagcaagggtggagttgcatgactgcatctctaagagatgcagagcagagaccatacttaggcactcgcctgtgtcctacagagggagccattggaggctagagctgaattgctccacaggacttagatagtcatggtgtccaccacaccacaggaatttgtggccttggggcaggggcttccacaccactgcctagagatgtctatgggttttacccataa

SEQ ID NO: 239 - DNA, 1975 bp, Mus musculus
ccccactcccctacccacccactccaacttcttggccctgacattcccctgtactggggcatataaagtttgcaagaccaaggggcctctcttcccaatgatggccgactaggacatcttctgatacatatacagttagagacacgagctctgggggtactggttagttcatattgttgttccacctatagggttgcagacccctttaactccttgggtgctttctcttgctcctccattgggggccctatgttccatccaatagctgactgtgagcatccacttctgtgtttgccagaccagcatagcctcacaagagacagctatatcagggtcctttcagcaaaatcttgctggagcccccttattttaatcagtgggttcatactgtcctggatagtactgtggattgtacgagtcttggcagaggttggaacaccagttgtcatctgttccattttaccacctgtcaatctgaattctgtccattacattttgttaaaccagaccctgacagacgctacagttgcaaagcagaagttactgaaatctgcttatcttaatgttttgttatttaaaaatgattgtgcaatgactgttacacagtgccgactctgaggcagcaggcacaaactgggagtgttccaagcaactaggacacatgattaccacaataaaaggtgttgattctatttgtatttctctcataattgttccatggtggtgattaaataacgggttagaagcttaaacacacattttatctacacagatgaaaaactaacagaaaactgcaaaaattagattagttctagggaattccatagttcccaagcaggtgtgtgtgtgtgtgtgtgtgtgtgtgtgtgtgtgtgtgtgtgtgcaggggaaggggagagtgagggtggagtgtggtatgtttgggagagatattgattgaatcctgagccagtcatcattgtcaggaaaggttgatctatttgactcagcctccaggtgtccaccatcattcacagttccaggtctgttcccatgggtctctccttgtggattcttcctggctgtgcccatgcagtgtttgctgttgtctgtttgacgatgtgctgtggctgttattggttactgtcttgtggctaactatttcacctcacttgtaccaaaaggtgacatgcattgtctttaagaaaaattgtgtttgttttttgttttaaatttaatttatatgttgagtatgtttttccatatctatgttcatcacttcatgtctggtgctgccaaaggccagaagaaggtatcataccttttgtaactggagttacagatggttatgcgctgccatgtgggtgctggaaactgaacctggctctcttgaagagcagccagtgccctcagcccctgagccatctttctacccctatttatttttgagaactttatacgggatctctacatctacatcactcttccccttcctcttaactcctcccatgtcccccttcaaaatttatggtctcttttttattattgttatagatgtatatatgtacatgtgtatgtgtacatgtatgtgtacgtgtatatgtaacttactgagtacatttagtttactcatatgtactcctgtccaggattggacactccatatgcaaactcattcctggaggaaattgatttctctactctcagcagctattgaccaactcttcatctagggagggaaccatgtgtaatttcatctctccatattggcacagcatgcatcctcttaccaccacacatacttgtggcatccaaactgatttatccatctgtgaaccttgctgacagggaaaaagagtgtgtacttgtgtctgaattggctggaacaatcccagttctcagtttcctgtctccttggtaccataaaaagaaagttcatttcactgttaggggctgtacatcctttccaaggaatttacacttttttagtcactgt

SEQ ID NO: 240 - DNA, 3650 bp, Mus musculus
atgaatatttgaacatctgtcaacatgttcaagtcccaccctacttatatttcacacagtttaactctgagggggcagtgaggtccttggtgttttaccaaacatcctgtccatggccaggtgcccttcttggtgctcaagtcatcctatctttacagaggtggctctttaaggagggttgcccacagtggtcctgagacttacccttctcctgagtttcctctccacactttgaggagggcagtaccattccctgtcatgtctggtttcaaaatacaactaagggcagctgaagctccctcattgattttctacccattagcttcctctttctataggctgatgtagtttagtttgtaagctttaatttttgcctttaatggtttagtttccagaagcacaggtatcaacattgttagggatggttccaatctctgagttaatgtgctgatcaagtgtcctgaagatttggtggtccaccttttccagtcaggaaatcgggatatgtggtctgacaaggtgagggaagatctgaaattgggactgacctagaaaatccaggacacgcagctgtcatacataatgctcctgtgtcctagatagcactgctgtgcctgcatcatgtctgcctctggacagctttatttgatgtccgcgatagcttgtttctttctgttttgggtcatccatttgttaaatctccatttcctctcagagggatgaagtcagtgttcatttgacttgaagcatgggatgactgacaagctgcttcttactcagctctgcctacttctagaggtcaaactggctgcacaggaaggtggcttctctagagacactggtcctcaagggcagccaagccacacaaaagctaggaatgtggaagactgatacctgtgcataagatcaccctcgaaacagccatcaagagatacaggaaggaaaggaacctgtacacagtcctctggagaaaggcatggaaagaggagagttaagatggggtgtatttactttcccaggaagcactgagatcaggaagggttggtcctagattagagaaagctacagggcttgtgttcttgcttggctttgggaaaaatctgtgcatgaatacttcgcttaggacccaagtagccagggaagacagactccagaagaggaaccctttttctagtctagagctcaggttccctagttttggtggcttaagaggcatcagaaaagaacatcttcaagggacagagctaggttcatatattaagtgtccaggtatcaggagagcacctgccagggatgattgtagttaagtgaatcataaggtatgcccctactgactctgacagaactgcttaccttgcaaaacaggaatagactgtggcgggggcatggtggaaggtggttgtctttgatccaggaagagacctcaccaggaggtggttctgctcacaagtttgctcttggacttccaagcctcccaaactctgagaaactcaattcctgtgttttaaggcaccagctggtggtattgtgttataacagatactacagactaagatggagcctgccacagatattattgcttttagagaagatgctgagaacttccaagatgagtgaacaacaaaggggcagcactctgtagctagagagggtgtttttattctgccctgccactcacctgttctgtaagattgggcaagttacctctttctgtgctttgccttgcctgaaaaaaaaatggatgcaatagcttcaggattaaaatacaaagagtacagagcagtggctaacatgtagaaagctccagtaagtgtttgctgttagtggttaattttagtgctactataaggtaaatgagaatacaatagttttaatggaattatttttcagctaattgcagatcttgctgaagctcctgcaaacaacctgcctaagtctttatagagggtgtcaagaacccgtagtcaatcagtcaattcatgcatctttgcaaatttagacataaatattaatgtgacctcattcatacccacaggcggacaaggctgtgaataacagtgtagcctataattacagtttcataacacaccgtggaacagaaactgccagcctcccaccaaatccccagccttcccattttgtgtaggcgactgtggcgccaggagaaagtacaagatgtgcccccttgcagcctgggcctctgatgagagcctatggggctctctcatgtgcatcttttctaggcaccaaaggcatctgtgaagaccagcacagtgtcttcaacacagcagagtttgcctaagctgaggatagttagtactgctcatttgtcaggcaagaagcacatttttgtgtatcttaggcaggctgtagggccatttgttacagcagttagctagtgtgtttcaaacattgtgagagtcttttaagcatacagtatctcttacacatttcctcaaaagggttatttactcacagctacattatggagctgttgctataaataagcaagactcatgttggtttgatctgaaaattgtggaggtgggttgagtgggagtgggtttttgtgttcgggtatacatgtgctttacgatatcagaggacaaccttgggtgttcttcctcagattctgcccatcatattttaagataacaaccctcattgtattagagattgtcgagtagggtaggttgtctggtcagctagccctgacaccctagtgctggagttaccatcacctagctttttatgtagggtctgaggattaaacgtgggtcctcctgattatgcaagtactttactgacaggatagtcttagccccagaaagcatgttatgtttatctctgccatctcacatctgctcaacaggagtaatcttttgatttccacaatgcagactcaacgtggctactgcaaatatgtgtagaaagcaccccctcttcccaacatcactagcagcctagagttgacttttaactcctctattgaggtcatgtgccagtaagtcttcctgccttggggaaagatggcactgtgactgctttgtattttacctgacctttgtaggttaaggttgtgtgtactaggagtaaaggtaggagttggagactaggaaggacattctgccttacaggcactattggcctgagaggtattcatgtacttaggttttctacaggtactgttggccttggtgacattctttcacatccgagcctttctttcttgcactcttacacactcttttgagagttgccattattgataattctcaacttgaactctcatttgcatatacatgcctctatccctattcctaaaattctacctcctgccccagttctctctgttaaggtcttaccagtatctttccaggggaactatctttaaaagtgtcttgaccttttctttctagagccctttgccctgtcaagctttgtgccaacaaaacagacgcacttctttcttttaccacaaagcagctaatcagttcacctgttattctctagagttcctgaatgagggtaagctatagacccactgagtcctgcagctccatctaaccacagggccacgtatcagaccactgaatctttcctagttcatctcttgaagttagattgatagtcaaactggaagcctcacc

SEQ ID NO: 241 - DNA, 2200 bp, Mus musculus
aaacccctctggctcactgtgccttaagaagcctctcaccaaagttttcacattcccctccttcaattatgtggcaaaataaacattcctcaccctagttaagatgtaagcttgacataacttctaaggaaacccaactgattgccattatcttgtcatacactaaaaaacaaaacaatgcggcagaatgggaaaggcccagacaagtgtttcatgtgcaagaagtcacgatcctggtgatgtggtgggatgttgtctttctgggaaatgtctctcctcctcatctttaccttgaggctcacaatggagcacacatctgagaatctgggcagggctttcttgagagatgaggcccaccaatgacttgaagcctttctgaagctttgtagcagtgtaattggtgagaagaattgggtatgtgccctctttaaatcctggtggaagggccatctttctctggtttctaagagatccaacctctaggttggttgtcttcagctgatggctgtactggttggttttgtgtgtcatcttgacccaagctagagtcatcagagaggaaggggcctcagttgaggaaatgcttccatgagacccagctgtggggcattttctcaattactgatcaatgaggaagggcccagcccatagtgggtggtgtcatccctgctctggtagtcctaggttctattagaaagcaggttgaacaagccacgggaagcaagccagtgagcagcaccccaccatggcctctgcatcagctcctgcctccagcttcctgccctgtgtgagtgcctgtcctgatttccttcaaagatgaacagctatttaaaagggtaaacccttttctcccaaacttgcttgtttggtcatagcaatagaaacagtggccctttctaaatctaggtttatgctgtatgtaattaaaacaacccatgcttggtcgctaggctctggaaccagcagctgcccactcttctagctggccctgccgagctgctcagcgctgtcttgtgaatgcccgagccactgctcatgctccacagaccagccacccctgtggctggccctgcctactgccagtgacctctctggcctcacccagttccctgtagctccatgaaaggaaaacactggagacttttatattttaacaccgaccagataactcaaaggctgggtgaagagtatccttccccaccgtccttggcctctgcagttgcctgtggaggccacaaactatgggtgccctgagaaacctacgtgtctgtagctccattctctcccttcttgtctgaatcccaaccctcgttcctattctgtctggaaatcctgcctattcttttacccagcgattagcttctgctgtctttatttagccaatcaacaattagggaaactctccctagaggcttaatactgacttacgccacaccaagtgccaatttgctgttcttaatcaggaggtgcatagtgttaattataaaataggtttatcatcagctggcttaggataacacatgctaaagtagttattgcactggcgtgcttcattagagttgtggaaactgatcttcaagcctcaagaaatacaagtagcttgtatctccaatagccctgtctacagatgtcacgtgtgtgctgtgttgctgcgtgcagcatctgtcagaaaagcacaggcattgcaggcagcacttaaaattgtgttgattgtgaaacctttataatcaagtaaaatggaaatctcatcatttgcatgataatattctaagataataactgtcctggttagttttacatcaacttgatgcaagttagagccatttgggaagagaggacctcaattgagaaaatgtctccaccagatcagcttatgggcaagccagtggtacattttctttggttgatgtactgtttgcagtactatgtctgggctggtggtcttgggtattagaaaaaaagcaagctggaaaccggcattcctctgcactgcattagtccctgccttggcttccttaggagacagactgcaagccgtaagctgaagcacacactttccttccctagttggtcgtgatgttttattacagaaattgataccctaattaagaaaataactaaatcattaaagttaacattattctaggaatgttatgtagtttacaagagacattaataacatgctcatataatgacaaca

SEQ ID NO: 242 - DNA, 3325 bp, Mus musculus
acagtaaggccggtttgagctgagaagatgtctcagccattaaagtgcttgctgtacaatcatgggaatctgatttttggatctgaatcacccaataacaaaaaaaggtgtggttttatatgtctgtaattccacggctggagaggaaggaacaggaaaatccctgcatctttctcaccagctgacttaatcaatcagggagctctgggtttaaagagtgaccctgtctctataaaaatgcccccccccaattggagctggcttacaggtacagaggttcagtccattatcatcaaagcgggaacatggccccatttaggcaggtatggcgcaggaggagctgagagttctacatcttcatccaaaggctgctagcagaatactggctttcaggcagctaggataagggtcttaaagcccatacccacaatgacactcctactccaacaaggtcactccttttaacagtgccactccctgggccaaacatatacaaaccatgacaatgctcaatatcaacctccaacattaatatgcagacatgcagacacacatgtacaacagcacacaaacatgcataaacaaacatgttcatatacatagtctacaatatacacaaaagaccacttgctgttaacagccctttttgcctaatatacatacacacaaatcctacagttgacaataaacaattcctaatatcttctcacagttcttatttctagaagctgactctggagaagccccaaggcctctctcttgaacccatctggagtacttatgggagaccctgggaccccaattccaagagctcatacaacatcagcatctcatctatggtacaggactgctcttcccatcatccttcctcttgccactcacactcaaagtcacaagagagagggcacactgaagggtggaggaggaagaggacgaattggaggaggaggaaaaaggctgactttctacttcctttacatatgcctgtcaacatggtttgtcctctgagatgtcacgtaactgagtctatgatgcctagtgaatataaaatctcccaggacccagagagccagatgtctctgctaacccaacaccttcatgtcacctcctcccagctccgttgaactagatgaacatttctcgggagtagcatctcgcacctcacagaatatctaaagcgcccatcaaccctcagagacaagtgggggtgaagaactccatctgttcccagcagtccttgggtccagttttagacctcaagccaacagtgagtggtccaagtaacccaagagaccacaccatcattactgctcactaaataatgatgatgaatagtcattaaaccaacgggatccatacaaccacagaaatatctctactctttgtgaatttatggaaagatgatatagcctttctcccttgttgttgttcctatgaacactgggctattcttttgaattatctaacagctattgtggatgtttctttctttttttttttttttttttttgccaactcccaagtatgctttccctcccaccccacatggagagattacatcatatcacacatattaagatattttggtctctgaagacctaataaaaatagatttgctataccaagggagtctgaaaagaacagatcgcttatctcttataagctccacattaaaagatgaactggaggttgttcacttttactacatgggtcacggtggtctccaggctgcagaaacctagttaacaatctagaggtaaaggaagtggcaagatacccagtacacccatatgtgatcctttttcctctgttcaggcctgccttcacaacccaggcaatattacaaagatcatttgcaccaggaatggtgatatacaccattaatcccagcatgtggaggcagagacagacatttttgagtttgaggcaagcctgttttacatagcaggttccaggatagccagggctacaatacaaagagaagctctgtctcaagcaacaacaacaatcatttttctttttgtacatctaagccacaggttttgtgtagatccaacgccaaaataaatagctcccaggaatttaatctctcaatcgggcattctaaatcttcaggaagtaggatcactagaaccgtgtatgtgtgtgtgtgtgtgtgtgtgtgtgtgtgtctttgtgtgtgtttgtctgtgtatgttgtttatgtcatacaacatatgtatgatacaccatagcacatacatggagttagagggcaactcagtgtgttggtccttaccttctgccttgttttaaggcagagtctctttggttcactgctatataagccaggctagctggacctcaagctttctggcaacattcctatcgccatctcccacgttatggtaggggatgctaaacatctgtgctagtgtttggcttttacgtgaactcaggttatcagggttgagcagcaagcattttacccactgagctacctctagagctcgccaccttgctttgaaattagattgtttcctgggatatgtaaaaaggtgcctaggcccagttataacataaactgatgtgtctcgagagccttttacaggcagagaatctgcatcattctgattttatcaagctggagaacagctgtagggaaagaaacaaacccagaatgcagaagagccccacccgtaatcacaagccttgagcagatgcacttctatgatgttctgccaccaatggccatgaataatggaaaagtcacagaatagcctcaagtattttcattttctcagcagggacccaggttctgcaactgctttcatgtggcgattctgaaaaatcaaggcccgaatgaggtctttcagaagctaatccacaattatcctccgccaaggagatgtagccagagatggcttgcatcgaaagatgtcagtagcttgtgaacccacgggattcatagagttgtccatcttaatgtggagatggttctgtggatacagtgcttgccgtaccagcacggggacctcagttcatatccccagcacatcagattcattaagaggtcttgtcttaaatatatcaataaacaaacaaataatgaatgaataaacaaataaatgaataaggtttatataactgatacatatgtctggcctatacagagacacaaataattttaaaaggttaaactgtgtgtatttatcccccataatacatagctcagtaaaacgtagacctggtaccaacaaacacgatgccaatatcaatacgttcaatccaggtactgtccaggtatcctgatagtggaatatatgcctcccacccctgacccaga

SEQ ID NO: 243 - DNA, 2625 bp, Mus musculus
gacctctggtcctctcaactttattatgctatgacttctactgtgtttgttgtatataataaactctgtaacatgctttatattagactatcttcgaattctcagtaacaactatgacggtagtaacaatggtttttctggtgtttttcagtttatatggacagctaaaactaagttttgtaattaaaaaagtgggcatttgacttgcgctctgcagggaatacatccaaaatacaaatctacattgtaactcacaaacagcttttcattcatctgttcagaaatggtctctagcgcctttacaggaggactggctgtgccattaaagcactgggcaggccttgctctccagcgtgcagtgtgcccttgagtgctgagctgtttgaggaatgcggggacactctggtgactgggatgagaatggccccatgggtcggtaaaaggtaagtgcaaaaagtcagccctaccaaaggaagccctactggggacaagacattccactactttattgaaaaaaacacacactacctaaatacttagaaagatgaaacttgatcactcatataagcaagaagtacttttataaagctacacaaaaagtggcatgctgcctattttttaatactttaactatccgggatgtggctcatagtggactgttctgtatttgattttcagtatgtgctaacttagtgtggtgcattcaccatgatgaaggttcaagaaacaggtattttgggaactccagagcatttacaaagcatctttaaattagctatctgctctatggcagcttttaggggcactcttagataacctcagttttcagatgagcacagagcacatgtagatgctaatatcctgacctgtagctggcatggcagaggcacgcacattccaatgaaaaccgggaaggcattctgtccacctgggaagacacgctaggcaacagctgcaggaagaggcagccttgtctgcacaatgcagctctgggagtaggggagcccaaggctaccactgaggaaaacccctaattttgaatctgcgtgggtctgtgctactagaagaggaacaattctcccacgtggtcaaaaggtgaccaacgttagcatgtattttagcagcttatgactgagaggtttttcttttcctttcaaagcataggaattcccctgaatgttttactaatacctctctagtttccttcacagattataaatacactagccattagccagtcaatgtgattgttagttctaagaccagcatcctaacacgacttcttaaatataattgcaatcatttaactatttatcaatttgaaatacatattttgagtaatgtggaagctgtattacagtgatagcagtagatatgaataagttatacaatctgacgaattgcccttaccttgtggaccacaatggaaaactgggctgttactcagagaacacaagtggagagaaacctttcagaataaacaccaccaccaccaaaactaactaaaggcatatatttggaaaaaaattaagtggaaaagatgagtctctatactgacagataactaaaactggtttttattttatacatgcgaatttcatttaactaatttgcagtatccttagtgaaagaaaactgattcactctaacccacctccctcagtctcttccatgcctttcccacacctacccttttggactcaaacaaggagaaagccttctcctgatcctcctgcattctgggttcctgcacacactgcctctctggccctgagcgagggtgggtgtcagcaagaaaggtggcacaggagggctgacctttcactaatcactgtgttgctgcagctactggcacagctcattataaaaaggaatccttcaataagctgcttttcaaatcagtaacactttgatttttctgagaacaaagattatactttcagataaaagcctgcgatgcacagttctgttaattgggtttcaagtttagaaaaggcgctgggttagttgtcattatcaagggcctacaaactgtatcaaatgtatgctggtgatcttggcttttgttatggaggtaagaacatttttattgatcacctattattaaaattttttagagatgttaattatttcaactatccgtaaatataggaatattgccagaaatctcccagtcatcattccattaacaaaaatcccacaaataactaaaagaatatattctgcagcctccctcctaagtgttctgcagggtgagctctgactgaggataaatgcaaaagcaggaaaacagctctgagcagctgactgcagctttaatgcccaagacacagatgctagttatctgctaactgctctttactgtttcccttcggctccttcctttatgggtggaaacaaccaacaattcagaaactagtatggtcaaagggaatggcatgtttcatgacttaccagccatttgctgaatgccactgaatgcacccaggttgctggaggaggtggcctgctgcagaagctgcaaaagaacacaagaactcagtcagaacaatgcggagcattatatggggtacaaaattagtttcctttatgtttatatagttggctgccattccttgttgacag

SEQ ID NO: 244 - DNA, 2775 bp, Mus musculus
gggtttgatccccaaaacacatcataaacctgacatgacagtgcacgcctgcaatctcagtactgagatgctaggagaaggggcatctgagttttaaggttaatttttggctacctagcaagtttgagagtgagagtggtatgaagtacaggagactgtgcctcaaaacaaaacaaaacaaaacaaaacaaaacaaacaaaaagaaaaacaaaaacaaatccatacattttcacttcaaattaccacaaacctcttcaaaacagaggtggccattctgactggtgtgaggtggaatctcagggttgttttgatttgcatttccctgatgattaaggatgttgaacatttttttttcaggtgcttctcagccattcagtattcctcagttgagaattctttgttagctctgtacctcatttttaatagggttatttgattatttggagtccagcttctaaagttctttgtatatattggatattagttccctatcagataaacaaccaccaaacccagacactattgcatatgccagcaagattttgctgacaggactctgatatagctgtcttgtgtgaggctatgcaagtgcctggcaagtacagaagtggatgctcacagtcatctattggttggaacacagggctcccaatgaaagagctagagaaagtacccaaggagctaaaggggtctacaaccctataggaggaacaataatatgaactgaccagtacccctgcccccctccaggcttgtgtctctagctgcatatgtagcagaggatggccttgtcagctatcaatgggaggagaggcccttggtcttgtaaagattatatgccccagtataggggaatgccagggccaggaagcaggagtgggtgggttggggagcagggcagggggtaggtataggggacttttggagaggaaactaggaaagggggtagcatttgaaatgtaaatgaagaaaatatctaataaacaacaacaacaataaaaccagaggtggctgttcccactctatagattagcaagccttggctttaagagttaggtgatgctgaagttcatagcaatgctaaatgataatgagcgattgttgttgatttgcatgcaaagcatctcagcccaacaactattctcttttgcatttctctgctttggctctctctgccttcttaaccacccagagctacagtgcagaagaatcataagatggggcattcccactccatagtaagcctatgcccatatccattggaaatcaagatagtcttctattttctcatctgtgatcaggggtggttggtctcccctgctctccagcacctgcaagatgctaatgtcacgccatatattcacaattctgattttcttccctctgagcaatctctgactgtgctattcacactttcagtatgagtattctattcttttccagggccacctcattaacatatttaacactttagaataaggagatgcaaagcctgatttaaatctttaagatgtgctaataataatttttcaggcaaagctcattatttcttcaagctttcagaacagccccactataaagtaattataatatatgccagtggctgtccaccactctaggttctcagacaaagattgggacctgttcagagaaaccagcagcttgaaggaggacaaaagacccaggagaaggcgtgtcgatagcacctggcacacattgtgttttttacccgtttcactctgagtcacttaccttcactctgtccttaaaaaaaaaaatactaaaagtaaagtagaacttttatagcaaacagaatcagaaggtaaaagttcacatgaacagtgatgcaagatgaagtagaaagtcaagagcgttgataaggtttgcctttcaacatggtctgaaaaaacagtttaaagggtatggctctttgaccctcacctggttgcctggatacagacctaaggaaaatcagcttcttgaagagattccactgaatgcatgtgcaaactataaacttacagcctttaggcccaaatttactttgtggtccaacagccaagggtttccattaatttcatgcaaaacaatttccaaaacgaaaggaaggatttttgcatgcttttgttttaaacttcgctcatgcatttatggtgtgcatacttgtgtgctgtaggggatatgcatgtctgggccttaaaggacaagttctagtgctgtttcttaggtggtgtccacccccacctccttccccttatttaagacagggtctctcagcagtatgtaactagacaattaggctaggctggctggccaggaagccccagggatcaacttgtctccattgctacagcactgggatgaaaaagtcatgcatggatttttttatttctttttttttaacatgactgcaaatccacagataggttattgtgtttacaaggcaggcacttaacaactgagctttctcttttctggatcttgcctgcctccaaattctaaaaaggtaaagctgtttttttaagagaatggcaaatgaggtgtgtgtctttgcaaggtttctagtgtttttggcgttaataaacaatgcagtgtcagtgagaaaggtggggttcatgtctgacaactctactaaactgccagttacttaaagggcacaactattccttgctaggatgtgcagcctcctccaaaagatcatttaccaatgtatcagtggagtccatgaaattctttccaagctaattctatggattcatgtactatagtaataa

SEQ ID NO: 245 - DNA, 2475 bp, Mus musculus
gaattaagtggttcttggtacactctgaaataagtgactcaattttgtactaatctaatatttgcaaaacaaaagacagcactaaagtactctctgtacaaattatgtatccatcaagatgggttcagttatgctgtgaaaagaaatcacctcagatgttctctgacaagaggcctttctcactcaaatagaaatatacctagaagagtttatgttcaccaatatatggggaaaagttcgtactttgggacttgatttcctatgtcagtactatgggttcttgcgtcaccaaggcaagtctcatggacactgtcggagtagctatgcaggaaggtgtactttctctgtagagaacaacactgaaatatatgcgaaatcatgatgtagtctactacaattcctataaaaggcagggtacagttatgggtcatccacaaagaataatagtagtactctcttccatcacgaattgtgcctcagactcttaccccagtatttcatcaccaatggatgtgagtgagataaagcatgccaggcctttgtcaatgagccaatggacctaatcactgaggctcgtttagggaaaaggaaggctccatgcaagaagcgatctctgagctcaagatgtatgtgaatgatgcagcacatgaagcacttgtgacgcgatcattgcaggctatcctcattggggaagatgatgcctgagccagtgtagtgctggacgtgggggaagaagtgagacatcggagatgctgaggggtcactctgagcaagctcagttatgtggagctgaagaaagaaacaagaaaagatggcattgggcattctgtttcagcagcctctgatggtgccaaccatcaggaggcagaaggacggggtctacaggtgactttgaggtcaggcccaggcatctgagtctgagttgcccatggaaagcatcgctggagagcagacctggagctcaaagagagcactgaactcatcgccagcttagagtggaagcctcatactcctacagctgtggaagtgcagcccatcaggggactggaatcagggaagggctagatggtgttataactgtgagcagaggcagcaacaaggcaatttcagatggatatggggaaccaccgtaaggaagactgaagagccaaaaaaagactgagtcctgcttaccgacaaaaggagaatttgagtttaaataaaagatcccggatggagccaagcagatcagcactgctttggtgaatggaagtttgcacagaagtgaggcaaagtcagctgctccctccgatgctccactgctcagagggaggagcacttcctcctcctcctctaccccctcctcctcccccaccagatacacatcaaatgctccccaggataaaaaaagttcccactcagagctgaaccagaatgggcatgaatgagtttttctaaaacctaattttatggctctgagagttaaaattaacctgttgttgctttgtgccttctttcgagtttaaaaaatgattgcacgtcatcttttatagcacggccgatatgaaaagcatgcacactgtcttacaacactgagacctctcaaattcctgtttccagccagttccacggtccacgttccagatgccccaaccacagtacaaattgaacctggctagagctatcctctgcagattccctgcatacactgggaaatggaatttctttttcagccaagccatactgtacttaagctgctcaggagttacaggcttcacagtgatttgcttacaaaatagtgcttatcaccccaagcatctacccaaacgtgggtctttactgcaaataaaagtgcatttctatttttgaaaagcataaattcatgaccttttctttctttgtatctttctctaagctatcagaatgggattttatagtgaaacaaattagtcactcttaccatttcttctcattttagtgcttacctccctccctggcttgttttagacaaagctacaggggccaaaggccagcttgtaggacttagaaggctgagtgatcttcctgttatttaataatggccacaagctaaaagagtaatgtcgctggggcagacatatagcatgttgttgtactcactaaggatcacttaatttctatttgtgattgaacctcagttttaccacactcttaaataaacaagagtcccgtcttatctgtgggggatacattccatgaccccagtgtgtgtctgaaacttcagatcgtgaaaatcctatattcactatttttcctatagctaacacaactatgatggtgtttaatttacatactgaggacagtaaaagtttacacaacaattgtaacagtatatcataataaaattctccgtgtcacactgtggtttaggacattactagggataacaaaggtcacttgaacacaagcgctagcacatgacggcagctggcctgatagatgacaagccactaaatg

SEQ ID NO: 246 - DNA, 1850 bp, Mus musculus
atttggaggtacatatgagaggtatgatggttaatgggtgagataatgccatatggataagtggtttgagaaatctggtatccatgcagatgtaataccctgttgttgatatagcaatattggcccagagtgtgactcggcactggagccccttggtagacattcttggtaatcctactttggaacatggaaggatacctgacttacagacatttactcaccaggaagcttaaggaccctggtgggtcctcttggtggtcagctcagaaaactatcaacaatgactagtgattcggctacttctcgctggagttcatctctcctcactaaatcagagtttttccctttttttcaattttttattagatattgtcttcatttacatttcaaatgctgtccctaaagacccctacaccctccccgaccctgctcccctacccacccactcctacttcttggccttggcgttgccctgtactggggcatataaagaattcttccttttgagatgaagcaattctcataaatcaggacactatcttgagcttgccagtaccatgcaggttcttgactgatttgcaagaaagatattcctgctttctgtctaaggaggtcaatacaacatccttgatagcatttttagttttgcaaggcattggaaactgcaaaacatatatatattcacaaagtaaaagaagccatgtgaataaattactttttcattgttatgagcaaatgcccaacagaaagcaacttagtggaggaagagtttgtttggtgtgcagtttaagggtacacagtctgttgggaaagaaagacatagagatagaggtagctctctgcatgagcttgaacatggagctgcttgctcacaacccaacagataggaaactgagaaaggacaatagtgacaatcagctggctttctccttttcccctcttcagtcagtctgggatcccatcccatggaaggctgcccaccgacactcggggcaaacttattcctcagtttatcttccctggatatgttctcacagatgcagccaaagttgtgcctcactaatcccaagtcagttcttaatcaaaattaatcaccacaccatgcaattttgcaagcaaacattaaatccaactatgtgacattacatagaaaattaagtggtttattggctgatttgtgtgtgtgtgtgtgtgtgtgtgtgtgtgtgtgtgtgtgttttggctgtggatatgggagcttttttagatatgttactttccataaaggatttagggccatcctaaatctaactctaaaagatgctatataaaatttggttctatttccaaggctgccatagagcgaaaataaatcctcggcagtctgtatattcatttatgcatacatactgtaccttccatagctgaaaagagttcacagcacagattgaattaaatatgctttccccacagatgttattttgaatagcataagtgctattacccaaaattaaaacagataagaatattaattgtacaatgatttcattgctaccatgttatccccactgatgattttctatccttgccaattataaagccatccaagttaagtatgttagtgtaattagaaaatatgtagtcaaatccttatatggaaaggttgtgtcatcatgtcagaatctgacagctattgactagggagagtgtctttaggaaccattatttatatcctagagattactgtagatggagaaaacaaagtattcaatacaaaactaaattcccgttatttctttccatgaatccagccctaaaaaaggatgaaaaagggaaaactccaacacaaagaaggaaatgatactctagaa

SEQ ID NO: 247 - DNA, 2425 bp, Mus musculus
cctgtagcctgactgaggttgctatcgctactggatgtaatgactagagcaagaaattgcatttcaccatgcgggttccctccttagacaccagatagtatagctctaatgcagttgtcatgggaatggtcagtgccaaatagaataggtaagtctatccagttgtctcccaggcagagcccatccctttatcttccttacatgtctacgtagatgacgtgtgtgtgtttgtgtgtgtgtgtgtgtgtgtgtgtgtgtgtgttgttttgctttgaaataggaggtcccactagttacccaaggctgccaggaaacttgctaaggattgattgatcggccagtccctttcccaaggctatgtgactcacctggggcaagcttgatctccagtgctgtccggatgagggccatcagtgtggacgtaaagtgcaccgtcatgtcctcattggatatgggcatgttcatgcgaaccaggcgctggggatgagtaggagcagatcagggccaagcatgttacggtcactcccaccctagaattagtgtttgggctctggagcttggcttggcgtcctgagagtggtcccggcaggtgcctggtccagaaggctgggtgggtggaagttttgccagcattctctcctcccggaccccactctcatctgagctgagattctcctggctagagaagagcagaaatccaagtaaaggctgtagcagaagccaggcccaggagtctgagtcctgcccactgactataatgccataaggggatatgatcctggctgaggaagaaggcagagtgtcactccctgggacagcctagaacatagtgggtgagcctattctatggttttgcttacctgtcctctatctgcaactggatcattgggtaaggagtggcagccaagaggcctctctgaggtccagtcccagtgaggcactcctcaagagagatgttcttgcttaactcaggtcttaaccacaaacagggggccagggagacacacttgaagacaggtgagcagagcaagctgctcccatctctctgagtggccagctccctttcttttcttgtttttcagagacaaaacatcttgaaacagggatgtgtctgagtcattcctctgggtagactcagcagctgcaagagactccggctctcagaacatctgagggaggatatgggtctcaggtatctgagaacactcggttggccatgaagcaccccaggaatactaatgtcctctatataggaagaaaactagacagggcttcctccctaaagcaagcacccttctttgggggagggacacacagccctagtatcttgcccccaagttctgtatcttcattgtgatggaggggggcataggggtgcagaaaataggaggtaggctcttgtcctatgaatgctggcaaagccccaccgggcacgtccaattacaggaccaggacctcacatgtcacatgggttacacaccaggaaaagcctgcttcccagagcatggcatccctgcagaccagcaccgatggcagtgtgagaggctaaggaattcctcttccagggaagggggttgggatgggaatgaaagaagagcaagcagactgttctaagagggggagatctgtccaggacaccaagggtcaccctcacaagggcttccccagatttgcccccagtcatggaggacagacaaagatataacctcagagaagcagagtggcagaccagggcaaataagctccagacacggcactggggcatctcgtgggcccttccccatcttgccccaaaccatctgcaacctaccctgaagcctcccctggtctggtcgtaccctgaacctcaggattcttaggcatggctagaaagggcagtgcaacccttcccgcctgcctttctgtctgactgggtgtcataggaacagagctctccctcctatggatagagacatgcacgcatgcagggcctctgcagtttcaacacacatgctagttgagggcagaagataaaggcagaaaaatccagaggcatttgtgagtgttgggagagctgattggttcccatagactacacggaatgaagtggcagacaaaaacctagaatgggatacggagacagaagatggacagagtacagtggaccaaagagggaggagccagcagggagctctcaaacagatgcaaacacagttggcactgtttaatggggagcagtcagggctgtgagtgctgaaggcactgcaggtggaacgagctgtgactgaaccaggaaggaggcctggaggtgtccgtgttcacttcctccctcgcgactcagtgatctgagattcctgaacacctaaagcggggaccctcagccaagggcatccaaacagactttcctgttcaacagcaaggcccctctttctttctaccgggaagc

SEQ ID NO: 248 - DNA, 1900 bp, Mus musculus
tttgcacatatatctgcatgacagaagagaacatcaggcagaagagaactcaggactcctggatgagcatccagtgctttttatttttatttttatttttatttttatttttatttttatttttatttttattttttggtttttggtttttcgagacagggtttctctgtatagccctggctgtcctggaactcactttgtagaccagaactcagaaatcctcctgcctctgcctccccgagtgctgggattaaaggcgtgcgccatcacagcccggctgcaatcagtgctcttaaccactgagccatctctccagcccagggtaacatatgtttttaattatatttcttgagcaagagaaacaaatggcccagagtctgcttgggaatcagaggacaacttgctgacgtcagttctctacttccactgtgtggattccagggattgaatttaggtcatcaggcatggcagcaaacacctttacctactcaccagccctcctgagatcatctctgctcctgagacaaccccaggatagaaccacatacacactcgggccactccccatagaaaccttaccctgctcctgcccagacagctgccacggtccctgaggaggcagcctgctttgtttgaattccgtcttcctcctccccataaatcagttaaggatctgcgaagactggcaccagcttcatggccaggaatgcttgagtccaagtatgggagcaggggtctggcttagtgtccctgcaggctctggattctctcaactcccaagtcgtccaggcactgagctcctcccattcagcaaagagcctgctgcacctccttctgagcctggtctctttggttctctctgagctctaggaccccaaccgaggtggtaaatgtccaaggtcaatgtggtagtttcatccttctgtaggggcagagacctccctgctttcagtactagatccttgaatccacctcctcccctcagcccttctgcagaagcccgtggggatccaggtgaccttctggggttgggagctggagccttaggacagtgcacaaagcaggcctgcctctcctactgctgcatggctctgccctagttctgaagctcctctgccctaactgatgaaaaggaagggagccctctgctttccaactgctgcccagtcctcacagctccctctccttatgtaagtacactgtatgcaagtacgctgtagctgtcttcagacacacccaaagagggtgtcagattcattacagatgcttgtgagccaccatgtggttgctaggatttgaactcaggacgttcagaagagcagtcagtactcttaaccgctgagctatcactctagcccccctccttttctttccttttcttttcttccttccttcctttcttttcttttttgttggtttctctgagtcctagccatcttggaacagtctctggagaccaggctggcctcatactcacagagacctgcctgcctttgctgggattaaagccattcataccctcccatctcctcactttcctctcgtttgtgaaggtccctcgataagtggcccatgacctttcacaggcagagttgtaatggcagcgagaatcctttcgccttggtagggatggctctgtccaaagccacattaaggtccctcttagactggtagggaagggctggccctcctgtgagcaatgcaggagtatgggacttaaggacttaactgggtctatcatgtcccccaagcccaccttctgcttggaccaaaaggccgggcaaagccaagaacctgctaaaacaccagcttcctccttaaaagggtaaggacaagggatggaaggggctgtgcacacacgcaagacactgatacacatttcctgagcatagcagatttt

SEQ ID NO: 249 - DNA, 2625 bp, Mus musculus
cagaggagactctctgtcttctattctcggtggagcttgagcttatatatgagcccttcaagcccacccgcacagtgacacacttcctccagcaaggccacacctactacaataccgccacacctcctagtagtgcagctccatatggccaagtgtggaaacacaaggatctttgcaggccaaagctattcaaaccaccacatactgtcaaaagagaaaaagctgactatctccataggcattttttaaattatctattttgttggggtggggtacacagactcatgctatagtattcacacagtaccctctgaggcagatggatgctagggaccaaacctaggttctctataagaccagtaagggctcaactgctgagccatctctttagcctttctatagctatttttaaaatgcctctcctgtttaaaaacaaacaaacagccccaacaagaacacctctggcccagctggtttcactggtaaattcaagtgtcccagggaaaattaacacaaatttacccaaactctttcagaaaatagagaagggaggagacctcactactcatttgtggagctggcaaacatcgaaaccagatagaaaaattcaccagaaaagcatcaaactctccctaaccattctctatcatgaacacactgaaaaaaacgttctcaacaaaatgtccatgagtcatgagacaacaacagacaaaatgatcatttgtttcagccaggtgcgtttgtaccagaatgcaggtggcttcgatacttgaaaattggccaattaattctccatattaacaggagcaaggaagcaaaccatacagtcatctcaataggtacaaaaagtcatttggcatgattaaacacaatagagtaacccaactaaaacactcagagtccagaggcggcagggagggtggaggagcagtgtggagggaggctagcgaatactctgttcctctcctgagatctagggcccctgcgctggccgcttctgcttcgtatttataggatgatttagtcactgcagaaagacaccaagaaataagcacacacagatctgcagaggtgtcagccctctttattaataagcaaggagttgcttgtgtaaaacttgctaacaagcccatatagaaaagaaatcaagggaatccaatgatgaccatacagggctccaaaaaccagccccactgtgtcagtcagcaaacaattaggaaaggaggttttaaaacttcctaggagaataccaccaagaccacagaaggataaatttaacaaaacaggtgattcctgctgcaggcagcccatgggcattgctgagagaagctaactgtaactccagaaagtaacccaaagatcctgtctataccatgagactccagcaccctgggcaggctggttctccataggggagattcagtgtgtgcggtgaagacccagccatcattctaggagaactggcaggcagggggtcagatggaaacaacctttatccaaagccgtgttttacaaaacaaaactgaagtccactgggcatcaagattcaccatgagtatatatattattaaagacaggagagtgggtcacgtggtgcagataaggatgagtcagaatccaactgctctggccacaatacctgcagcagcgatctcctttcacacccccacaggctctctacagagacagcctctgagagtccctagctcgcagagacctcagggtgtctcacctgggaagtgagtttacatcaaaggggttattggtggccacccatcccgcttctcagcctcttgcctgggaatctgggagcctggctgcaggcctggaaacccccccccccgccccccatcctcagagaggtggaagaagactctacttctgcccgtgcttcagattctgctcctcggagtgtccccaccccacccctgccattctttctgtacctagtgctaaggcctgactctccttggagcccccaccatgttgttacccctgtgcctgtttgtctatggcattgagaactcttctaataaacacctttctccatagtgatctgtctcggtgtcctggaacctccgcatccaagcctttcagtgtcccccataattccaacaattgggaggctgaggcaagaggatcgctgggagttcaaagacagtctgaactacttagaaagttccagcctggaatcactatgtatagtgataacctgtctcaataaaaacaatactaaagaggcttgggagttaacttagtgaataaagctcttgtcacataagctctaggacttgaattcaaatccttaggtcccatataaacctggatgcaatagcacaggcctgtgattcccatgttcctactgtgtgatgggaggtaaagacaggagactccttggaaatttgggaggcagcagtaaacaagagaccctgcctcaataatgtggaagacaagggccaacacaaggctgtcctctgacctagatacctgcagtacatcatgtatgaacccacactcattcatgtgcacaggaatgtgcacacacagaaagaatttatttgaaaaagacagaccttcacaaaaggctccccatataaactaacaatgcctaacacagaccagtgg

SEQ ID NO: 250 - DNA, 1725 bp, Mus musculus
tggttgtctgtcagaaagggtttggtattgtcatttagtcgatgaagatggccaaagtatcaacagctgttaggagatgtgacatttcaggatatttttctctggaaaaaggaatatttcaaaatgttgaagttggaatctcgagcaatacatgattggcagagtacatgacactaggaagcactgaatgaaggctctgcaggagcaggaagcgtgtcctgaaggttccacagaggcatgggccactgctttggggatggaccagcacgcccaagcggtgtgcagtgcctttcccctgaaagtgccactctcctggctggtatcggagaaagagcttcctgagctggatgtagtgtctgtcacagggtcatgctctaccgtctggcttcatggcagagaccggattcctcctcataccattcttacactaatcaagtcatgtcaaaacaaaaccaaaaacaagtagagatcaatattttaactgcttttgttaatgattttctaccttgaaaatggacttcttttctagttcctcaggtagcccagcaaggagagcaagttcaacacgtgaccctggctaggctgtgtggctctgactctcagtttccacatctttaactaggggcatcatggttcttactgtatcagggcttggtgacaattccaggagctaacactggtaaagaatgggcatgttagctcttaccagtgcagtgatgagatgtgttcctgggatgtctgtgctaagagtgttgacctgtgttacccacagtaggagcaagggggtagggtgtgggaaatcaagtgtcccaggaacaccgtacaacagataggatgcctgagctgtgttggccaaggcatattaatggctgttttctggaggatttatttccatcgtcatgtgcaaatgactgtgggagtgcaggctgtaatggaccttgtgtttaaagtttctattgtcttggcttcgcagagccccgcctaggcccgcccctcagattgcctctcaggctccagaggtagtgtgtctcttcctcccattagctgtcagctctgatttggtgactgtgaggcctggcctcagagcagttggcagattggccttaggagatgctaggcactggagtttgccagcacaatttgtactttgattaatttatttaatctaactatcttgtatcaacctgcaaggataattatgcacaaattactgtttaaactggaagcttgtctcccctcctgagccccatgctggtccatagctcttcaccgaagtctttttgagagtgtttcttattctcttgtcttccccgagataccggacgctccgaagtgaatactctagtctgagttaaaagctgttgagaaaagcaaagcactgctttggattctgatcccgttcgtctgtctctcgggcagagaactggctcttttatctttgcctgtgagttcaattccattttctcccagctgtaaggttttgtagctgcctgctgctgcttcagtctttgagtcaagtgggattttcagaatgggactagagcaggttcctatgttctttgcaagcatggggaggggctgcgagtagcatgtgggggcaccctcaaagttggttctgttttatttactgcatttgctgattataaggcatgccgttctttttttttttttttttttttttttgagacagggtttctctgtatagccctgctggctgtcctcgaa

SEQ ID NO: 251 - DNA, 5850 bp, Mus musculus
cagatgtaaagtacaactgggccctggcatcaggggagtcatacatactcctttcaccataaatcctggtgagagcaggtcttcttcagagtgagggtgtggtcagagaaggccaacctttaaataggatcctttaaataggatcaaagggatgcagaaaggttatctagatcagcgagggtgtgggagtcctgcaaggaaaccggccccacagaaggaatcacaggtctcaagagatagagccagagtcaggaaggaaggacttgctgcaagctccttctcagcagggacagggcacaagggaagagcagggcccaaagaagctgctggtgatggtggacttcacaccaagacttcacgccatttcaagtatggggaaaaggacaatcactaatgagaggtagtttgggcaacttgataaacttctgggtagatccttcctatatagcatgatgtcaatgtagaaatgtggaggtataactacagaagtaaaacttttataccttaaaaatgcttacaaaaaggacagaaaacaaattatgaaaagaattacagaatacctagaagagaagtatgaaattcacaaacaataaataccaaataccacaattgaaaactccataaatatgagcagatgctttttaaaaacaaagaataaaaatagccttttagacagagaaaaacaatcatttcatcagtaaacaaacaaagcgaagaagagatgcaattctttctccatttggcaagcattacaaaaatatacccgtcacccagaaaaggtcaggtgtcaccgtctcatggcatttccagcagaaggggtttaaccagcaaatcagaggctgaggggagggcaaggagcagcagagcattctgagatgaagtgtgaggctggaaggcttctgcaaggcctcctctagtaggatggctggcatcagtaaggcgacaggaagcagcacgccatggctaacacctagaggacttcatctttctggaaaagtgagaggtgctcccctctgcctcgcagcaaagcctccctgagcaacgagaggtcagtctcctccccagagctgctaacaagcagcaagcaaaagctttgggaactaggcaaggtgagttcacggctaacttcagttctaggtacattaccaggctacagagaacaaaaggtgtaattaatttcaggttctatataccccatggccagattgatcctaatagtcccaggacagaatgcagaggctttgtcgggacatcagctcacccacggccctcagctcatcagggccagccgcttcctagttcttccccgcactggaatttcaacaggcctactttatattaagtaaagtttctaaataagtttgtctttaaagtaaaaacatgtgcgtgttatagcactttagagcataggatagaaatatagaaaaacaacaaaactctccccaatccagagctctctttgaaaggagtcctcagagaattcttaacatgtacttgcatgtgctgggtactaagaaatggaactaggtctagagaggcggctcagctgttaacagcactcactagctgctctagcagagagggtccaagtctggttgggttctcagcacccacacagcagctcacagttatctgtaactccagttcccaggggatctgatgcccctttctgtctccttgggtacctgtatgcagatgatgcaaagacatactttttttcccaaaaaaaaaaaaaaaaaaaaatctaatataaaatcttcatttacttatcaacctcatgttttccaacttcacagatctatagacacctgtgtagcaatgaatttaaccagtgtcaactgatgccaaaccaggaagccaactaatcagcgattccccagcatggtgacatgatgcgcatgtctgggctggctcttttctaactccttgcagaagaactgagaggctttgcgcctggcctgcaatgctgaagcatcttctaagaggtgccaaggacccattggtttgccccgactacagggaagagctgttccccacaactaccagcatcgtgcattaaactatttcacctctgctgaactggaggggggaaacagtacctccttcctctgacatgcatgtgcttttctaccaaagaggccgccatgtttctcgcatgtaaaggcatctgtcaatgtccggctgaacatgcattgaactgcctcttctcatcctctgcctgcagttgccgttttactggattgtcagaactctttgtaaattaaggaaattaggctgtcatttgtgctgcactaagatttaattgcaatcagtaaatggcacactaactggggacttaaatgatttctctacactgacaggaaatactcactcgacatcaactcctacacacagcaaaccacagggaatgcaaggactcacaaaagtctctggcttgcagtttgacaggggcttaatgcagctttctcctagcccagggagagatgggaatcaaattcatttttgataatgcagagatgtgatttatattcgtttttcatttcgattaagtttgcagctgcttcagaaaacaataatgaatttgattattccactcactaaaaacattaggatcagtgttctttaatttagcagattaatcatgtcttcctagcacattataataggcaaaaaaaaaaacctagtcatattttaactctacaaacgagcacataaaaactggatccacctccccatggtgccattaatagctattttgtttttgtttgtgaaagctatgctgtggataagaacatggaactctgctcccatcacacaaggaattagctgaaactggctactgctcgctgtcttcatggttctcttctgcttattcagccagtggttttttttttttttttttttttggtttttcgagacagggtttctctgtgtagccctggctgtcctggagctcactttgtagaccaggctggcctcgaactcagaaatccgcttgtctctgcctcccaagtgctgggattaaaggcgtgagccaccacgcccggcttgaggataatcttcctgttctttaaaagtcacctgcagtcacaaaccttagccttcccgggcatgaggctatctatcctatggaggtccaatgctgggttcttgctaggaaggaggcagtgcacgcctcccttcagggagcccatgttctccccagtgagacaggtgttctcagcacgcttccaagtttgctgtctggacctcctataggcctaacctccctgtttcactgggcccaggagcaggagtgaagcagcagtggcagaagaggaaggaaggtgccagggacaagcgacaagcactttcctatccacaactaagatagtgaaggcattttagtaagagacctcaaacgtacaaatgctcaaagcatcctctttccaatccaaatcccctcccatgcctcttctcccagcacagcagcaggaagacaggaggccagcctatgctaacagtagattctttctgaaagcaacaaaaacagacctgtgcaggtaagagctgtgtactggctagttttgtgtcaacttgacacagctggggttatcacagagaaaggagcttcagttgaggaaatgcctccatgagatccaactgtaaggcattttctcaattagtgatcaagggggaaaggccccttgtgggtgggaccatctctgggctggtagtcttgggttctataagagagcaggctgagcaagccaggagaagcaagccagtaaagaacatctctccatggcctctgcatcagctcctgctttctgacctgcttgagttccagtcctgcatcctttggtgatcaacagcagtatggaaatgtaagccgaataaaccctttcctccccaacttgcttcttggtcatgatgtttgtgcaggaatagaaaccctgactaagacaagctgtgatcaagaaaacatttggggggagggggacactcctaataaagtgcatgacctcttccaagatcagttttgatgcccttgtattcttcagatacctttttctctggctcattatacctgcattaggcaaaaagccctctccatacaaaagccttaattagttaagaaccacaaagctagggctcaagtgacagcccttcagtgattcaaagtggacatcttagagacaagacaccacaggttcagcccaagttcaacagaacacaaggcagcactgagactgcaggtcagagagcaagagttaactgagagagccaagaggatgctaagggggtagggggcggcatccaagcagcagggaagtctaaatgacaaggtaagttcagagtaacagcttgaggtgggagaagtttgggcacaccatggagggaagccactcacaagccctagcactgtggcatggccactgggaaagggactagtccgtccagtaccattcctcccacagaccaaaggagaagggaacaaaaggccctacagaagaccagatggcaaggaagtcagtaagtaaaactacctgaaagctctgcatggtctcaccaggaaaagctcactgcactgtggatgctgcacggtgcagtgctctaaaacgcacgatgactgatgctaagctcagctccgaggcctccctcacagtcatgttttttacctgagggagctctggaagaaaagggcactgtacagaaatggggagacgggaacagagtcaagcagaaacagacatgctgagctaaaaagagacaccagtgactggccttgatccttcacatgtgtgtgaacaaaggaagcagagaagcaagaacactcttacagtgagtgtccctgtaggtcacttgtagggtgacatgaaagcctggccaatcagaacacagcttctgaagccttcaaagcagttgtctgcttgctagtgtcctaaaatccagtaagcaatgttcagctgcctttagctttctcctgaatatcatcaatattcttttttttggggggggggaagggggagctccgagacagggtttctctgtgtagccctggctgtcctggaactcactctgtagaccaggctgactccaactcagaaattcgcctgcctctgcctctcaagtgctgggatttaaggcatgcgccaccacgcccagcatcatcaatatttttataatagtattttgaaaacacttgtgtatcaccaaaaaaataactaaaagatctcagtatagtcataaacactggcctaatggctctcccaggcatgacatcagttccagaagccacaaaggcacagacagacaaatgtacataagtacataaaaatatatgatgaaaaatgcacctctctctctctctctctgaaaagccacagggaaatggcagactgaagagaaatgcctattttgtttgtttgtttcaatagtgggctagctccaaattacttaatttgttaatcaaattggactaacacaaaaacattttccaaaaaaatggacaaaggctacatacaactaaaaagacaaaaacccaaaacatgttttaactttattcatgatttaaaatgtttggattacaaaaagaaaaaaaggtcctttttttttttttttttttttgtaggaggcagtactggggattaaacccaggatctttcgtgtggttggaaaacattaccactgaggcacgccatgctccaaagtaccactgttaagccattatatgatatgcaagcaagcttttacgtgctggcaaatgtaatcctgagggataatttggtgatatttataaaaagcctttggtcgctgggcgtggtggcgcatgcctttaatcccagcactcgggaggcagaggcaggc

SEQ ID NO: 252 - DNA, 2725 bp, Mus musculus
ttttctgtatcaggctaaccactcctcatcctacaggtaaagtttagcatcatgacctccacaaaactttcctttttcatacacttttgggtcttcctctgaactcccgagggccctaagcttacttctatcacaccacactatcaggtacctgtctattcctgttttctctcaaggacacgagctctttacaggggtaaactgtcttcctgggtccagcgctctcttactcagcacaagacgtggtgtacaaagtaagactaaacacagggtgtgttgaatgaactgtccattctcttttatgggaatgagtctcatgaaatgaagtggctttcagtaaagcgaaagaacaccaacagtgctaacaagagacccacatggtccctgaattcttcctatagcagacggtgccccagcaaggctgcaattatagacatgaacgcacacacatgcacacatcattttaaaaaaaattcacagaatgcacttaacttggattttttttcttattggaaacctgtttacaatcttgtccactgtcagtcttaaatgccactctccagaaagatggctgctgccaggaggaatttattttcaaattgaatcacagcatgttcatgcagggaagcacctcttttgaatctccaaattggagggaattcagggaggaagaaaaagtgaggtgattagaatctgcagtggctgattcaggaggaaaaattatgaggctaaaatatgtgagggtgagctaaacagcagctattagtggtggagatggagggggtggggtggcagccacctaccacctagaaacctaccagagtgatgagcaggcacagcaagagtggggacaagagacagggcccagagagcaaagtggcagggaaagctgaggacacaggaagcacatggacactttcttgctctcctcccagggcaagggagctggctatggccctgtccagcctctgcccaacagctaccattatctctgctctaaagggattcaactgtgcttctgtgagactattcccaaacagggaatagtgggtagattccttctatcagttaccccaccattagctggtcagtcactcaggagaggtttgtaacaagcattcctgttcctactaattagaggtgaaatggtcagtgaaggagccttgcacatggagcccttatgctgagtggattgtgtgactcactctctctctctctctctctctctctctctctctctctgtgtgtgtgtgtgtgtgtgtgtgtgtatgttggcagaggcagcttaggaatagatcatcagcttttaatagatcaccaacacctggaacacagtatagacatcgacagtgtctcaacttgtagttcaggccagcctgtaacttactatgtagctgcagtctggccttgaactcctggcaattctcctgcctcagacttccaagtgataggattatgggtgtgagctacaatgcctgattcatttttaaacacaatattttagacagtgtccagtttaggctcctcatctctcctccccttagcctagcaagcatgtactcatgttccacagctcagcctttgggaagcctactgcatgtctgcaaagtaggggagattccgtagtcccccctcccaattatgttagtaggcagatgcacagagcctatctgaaatagcatgggtctagagaaggccaatttatcttacagacagacacagagttactgcctgtgacttgctgggagagcttgcatgcagcagggtgccaagggcaggtctggggcttgcaaaaacctcctggggaaaatgacatgtgtctaaaagtggagagtaagctgagtgggatggagggatagaaaggacatgagatggccaagtggctaagacacagagagcagggtatggacataggtcacagggcaagagggaactgccattatcctaaggcaccagggactctaaagcttgagtggccagggaggaggtaggggtatagatggccacagtttggaaggatcccctggcctctgctcttctgaggagacagggtagaagcagggctcctgttccatagactgcctagggaatatggcaagaggagaagaagctagggtaggaaagcaatgggatcgagagtgattttaggtgtgagttgatagtcaccacagcctggatctagcagactgaccatctcaatgttaggcaagagtcctggagaggcaagtaggagcatgcaatttcactgctgctgcctccttcctgagcccagccaaggcctggaataggattgtgtttgggacatggaggaatccccaagagtagggcctggcactcagaagtgctctataggagcaggagggtcatgttaagctgtcctctgagctcctctgtctactgcctggagacccccaggttgtcagaacaacacagaaatgttcactcagaacagcctggacattacagactacctaaaaagcatagggtcccagatgggccttggggctcagatattggctagcctagtgcttacacacatagctctaccaggtgatctatctgttgggactgctgttcccatgaggtatgcatggtatggggcaatgcaggttctggtatggtctaggctgaggcccctgactctgtcacttactatctgtgtgactgggagagtcaggagttctccaagcctcagtttgccttgtgtgaaaagggctgattcaaa

SEQ ID NO: 253 - DNA, 3100 bp, Mus musculus
tctcagttaccccatctggaaagtgggagtgaggaccctctagcccatctgctgataggctgtacctatgccaccttctctccaggcttggagggtctggtgaaccctgtgcctaatgcaaaccttgagaattcaaacaagaaaatgacaataaatgtaataactcctccacacagtaccgatgctgcttgtgagctatgttgtaactacttcacatacttagctcatccagtattcctgtgaaataggtactattttctcactggggcagggtacacagactagaatagttttgtcacatatccaaacatacacagagctaaaggtcagaacaagtggtatggccccaggtgagcttttcctgcatttctcaatgtggatgctgtcattcccacctcccaggtgagtagatggagccttagagcagacatggattccaggtgcctgatgacagtgtaaagccaggtggcttcagtcagggccctaccctgcttcactcaactccaggtcctttctggcctatgggaaagctgaagagtaggatcttggtgcaccattgccccaggacagggggagagatgggtggtgcctgtgtggacagcctctggggtgttgaagagcagggcctgggatcaccagggcctttagaagtcgaagggtgagcaaggtcggtgctgaggttcctgcctccccttgtcccaacacccactcttctctgaagtgctgtctcatctcaggtttgtttgtgttaacgactaatgactagatgacaaacctttcacgtgcctatcataggggtctcacagccatgttcagcctcttcctcagagtacagatctctgtggtaatgctcagggattatttagatctatctgcaaagagctgtggagatggagccctgccagagagaccagggaggcatctgaacacgacctcacacacattttccccgcccagactcactatcatgtactcaacacacagcttgccatcattcacattcatcatagtaacccagcagagccagcccatcagctgcctgacaggttccgggcacttgcctagggaatcaagagtagtaaggaagggctcagggaaaggagccaggcattggcagtgcaggcctttaatcccagcactggcagaggcaggcagatctctgtgaattcagggccagcctagtctttaaatacaaatgaagaaacaaacaacaacaaaaaggaccagacttacaggcgcccagaatgcttattctaacgttcagccagtgcgtaggccaaagccatcactgtaggctaaagggttttggctagggtctggctctgtctgtgtgtgtagactgctccacacagtgtggcaatccttcctcctgtgagctgcatacaagaatatgttgcaacaattggaatttggaatcctgaaaagttatccttccctcccaccccaaatctctcccgaacccaagcgaacagatttatttttagcaatccgtccttattgcaaattttccaaagcactcgatttagttcttctcaacacattccttttgttatacagggttcatttctttgtgttttatctagctaaatgatgtaattacaacaattcagacaacacagccagcgctggttggctacagacttcactgattctggtagcacagctcagtcggtgggaagaaaggttcggtggggaaggttccagaagctctaaccataggtatttctgggcagggtcagagtgtttgggcttgtgactagagaatagccgtgagtccagtgggacagtgtcaatatcttctgctggatttaggtcacaaggctgctgagaccatcagaaaccacttagggctctgcccaatacacaaggatcctccatgctgccttgcaccccaagtcctttgtacccaccatctacttgctgtttggttggttgttttcaaaatgttggggattgaacttagagctttagccatcccaactaagaggtctaccaacctacacccaagtcctctaaatatactgtcatagctctggcctacaagggctgattccctgtgctatagggggttcttgcaggtaggaacagatcttcctcttgcccttgggtcccagtgacttattggtgtgatgtctagctaagccagagctcttgattactacattgcatgtggcacatatatgtagggatgggatcattctaaccagggtcaggtggccttctggagactatggaatgagcccctggttcctacagaggcctgagaggtgggtctcacagccttgactgagctcagacagtgctgtgttaagccagcctcacacccatggctatatatggctaactgcccctaattggatccctccatctaggcacctcaatgttcatccctgagatgttttcccttcctgtagccttcatgatagcacgctattggctctttcctcatctctaaagtaagagactcttgataggcacgtgaaaggtttgtcatctagtcattagtcgttaacacaaacaaacctgagatgagacagcacttcagagaagagtgggtgttgggacaaggggaggcaggaccctcagacacttcggaagactgcaaactagtgcaagccactctggaaagcagtttctccaaaagttcaacacagggctgagagttatgactcagaaagtaaatgtacctgctttacaagcctgatgtcctgagttcaaatcctggaacctgaaatagaaggagagcaccaactccctagaattgtcttttgacctccacaagtatgtggcacgtattcaaccatgctctctcaggcatacattattctctctctctctctcatatatacattactattactacttctagcaacaacaacaataataatagacaaaataattttttagaaaagtttaacaaaaaaagctaccatatgattcagccactccttggtgtcgtcacccaagatgaaagaaagcattttttatacaaaggttcctgtgatgattataaacagcattgtttataattcctaaacctggaaatagccatcactatgaatggatagacaaaatataatgatatagccacacaatggaa

SEQ ID NO: 254 - DNA, 5375 bp, Mus musculus
gaggacagagcgtctgtgttcttcccgtgtgttcacggaggagtgtattcatcaggaagaagaaggtctgttttacagcatggctgctgtgtgtctgcagcaagccaggcattaggcattctctttgtatctcaaagctcattactgaagtaaggcaaacatgtggtgacatgcacaaattggaagtggacacttcaatggctctgtacaaactgaataggcacacgtggctacacatgcacaggcacatgcaagtgcacatgtatatgcacacaggtatacacatttgtatatattcacatgcatatgcatgcatgtacatatatatctacatgcatatgcacatggacgcataaaatatacacacatgcatgcataggtacttatgtaatactcatgcacataaagacacatgtatctgcacacaggtaaaagagtatacattcatacacataaatatatatatgtaaacatacatgcataaagatgacatattcgaatataccatacatctatttgcatgcatacacacagcatacatgtctactttatagtcgtgagggtgaatgcacatgtacatatgagcacacatctatacacatgcctatatatacacacataggcacaggcatacatccatctatgaaggtacacataggcacatatttacaaatctatctcgctagtgaaaccagggaaattcttcctgttggttttatgaagtggctctgcagaggagggtagctgtgtaagaggctgtgatggttctcagcctgcagtactggggccactagtccccaaaacttcaaagctctgcactctgccaatgaccagaggaagcttggcatggattttccccagtagagcctctggatggacatgaagtgggcaccctgactcagcttcccaagacctcatacaggggcttgggacccatgaaaactgtggggtcaaagtgggaattgtcttaggccactgagcttgtggtcaaatggtaaccactatggtcagggccaacgtgagcaaggtgtgtgtcagccaggctgggtgagcagtcatttgagatgagcgtttggatgtattttcaagtgagtgcctggggtgggtgttttgggtttgtagatacccacaaaagcatgtgttgatgtggccaaggttgttgcatgtgtgcctatgagcgatcaagcgtgtaccacacatgcgtgtgcagtgctgccccctccccttttattacttcctccccgggtttgatgttgtgggtgaataaaatttaaagagctctaaattttttaaaaagagccctaaagggagtggagcgccagtgcgtgagtcattacatgaacacctgtgaactgttgattttaattgggccacagctgtcaggttgcagagtgggagggattggtcccttggctggtctgacttcaacatccccctctcttgtcagtcctttgtgtatgtggaggcacagcagaagggcagggtggttcctggaaccccagactccagactcccagtgggcatggggaaggggctatgtgccattggctgggaagctggcttgggttcagctttgggttgcagtttgcctttttcccttggggtagcgagggatcacccacttgggacctgtggccttccacttatgcagaaacagaactgtgactgctcctagatgcaaatttacctgagtaggaaaaccagcagaagacaacagtacccagcaagggacttgtcctcttctaagtgctgggcatgcacaacgccattgactcctcacaacaacctaccgagataacacaaattatctccactccattggggaggaaactgaggcagagaagggttaaggacttgccaacgtgttacagtgctgaacaggcagagttccagtctgtacactcacatatgtcaacttctacaaacactcacccttggaaggattcacacactcttgaaaagttattctccgtagctctcaccatcctgctcacagccactactagacactcaaaatgtttgtctacacacagaggcatagacacacacacacatatatacacacactcacacaacacttgccaatgtatgttctccacccacatacaagcacacatggggcccattctgcttcagacatgcagcacctctacgtactcagcacttcccctaaccacaaatgtgctgatgtgtgcctgcctacaagctgtctcagtcgcaaaacacctccaagacctaccagctttcttttcttcaaataggagacacctccttgtagatctgtttcccctccacactaggcagtacccctcagatcagctcccccagtcttgtggcagggctgtgtgtgtttcttgcacgcccacagtggaccgcctgcacaaatccctggtcggtaggataggatttagtcatcctcacacatactcatctacagggactggagggaaacgctgagtcccctcttctgtccttaccagttcaatctgccatgtccacacccaagagacatgtaaactttagggcatgccctaacacgcctaacctttctctctcattcaacaaatcacatagagagagaaccatgtgatccaatcataaactaatcccgcttttctgaactgttcagccctgtgcgggctccagtgccttctccattctgaggtcacctggcccttcctgtcaagggaccataaacacctccatcctgacagcagcaagatctgtcctcctttttgcctctgccctctgccttctgcccctcaaagtatctctgtcattttactctatctggtgaagcctacattgatcatttccttgtcaccttgcctgctccctctcccctgcccatggctgctgggcacagcacagatctctggcactatcatctccttataccacccgccaaccatcaacgcattcagggctgtggcgtgaaccaggcttcagtcatctgaacttagtgtggtctcccctcttggctgcagcaagaacccctgtggactctgcatctggagccccttctcattgacaccatagatcactgtgtctcctttgggggcagaacttctgaagcccctcccctccccacccctgcctcctctgggtcccaagcaagcccacaaagatgtcttcctttgtgcaggatctctgacctcttacaggggctctacccctactgggagtaagcttcccctggctcttgccaccctttacccaagcagtgactcctgtctcattgcaccagcacatagcacttgctatagacacaattacaatatggtcaatacagactgatctctaagccactggaggctgccccgtgggtaagaagataaactggggtgtcattctagccctacctgtaggaggagcaagcaagtctactcaatatctacacattcatcccataaagaaaattcatgctgataaccagagcttctctactgacgacccatcatccagttgatttggtcagcatatacttagaaagactgctggagaaggagacataaaatcagacacagagagctcgtgcagcagtataggacagccaactgtaaggacacatgatgctgaggaatgagccgagagggtttcctaatggaggaattaaaatagcaaggactcaagtcataccataggacacaggtcagtgaactgaaatccacaccacagatgtctcaactgctttgaacactccatctctggaaacctggctccccacttccttaacatgggggtgaggcctgaagctgccttttctaaggaatgactcctgtcaccctccctcccttcactcatagaaccttcagttagtgactttcctggttgacaaatttaggaagaatgaatgggtgaggccctgggcttcctataactcctaagcaagcaccccacagcctcaggtaacaggaactctggctctcttcccttgtctgtgcactcatcaggtgacagggactcaaagggaacctgtccctcctcacacaccaactatttgaaaatacagtattttatttcatactttttatttatggggggagctctctgcatggctcctgtgttttctcacattctttctggacaacgagtctatttttattttatttcatggaatttgtcttttgaaataattaaccaccttcttgcagtaatttttctttacccaggaatgcaaaaaaaatcacacaacacattggactgtttttaatagtcacctcaaattatgcagttgctgtatcgtgataaatatgtagatgagggaagttggggtaatgggtccctggagtggctcatcctggtttacagaggagtgtggctgtaccatactggggcaggagggccttagccaagctctccaagagttaaaagcaaaagctggttgaggcgctttctttttctgccaacccaagacccagagcacagctccttcttttaggttgctgtcctcacctccagagaaagccatggtatatttcatgttcctttaacctcccaaagttggacccaaatgtgcaaacaggcacaaggtggttcaggacttataacttgtctaggacattgactctcaactgccagacaacttggaatgttttcagggcaagaggaccatttcctgaccttccaagacaccactgtcttccccccccccctctctccccctctctctctctcacacacacactcagccaatgacctcaccttcttaattcactgagcacagcagcagcggtcggctccctagacagcagcccttgtgcagaacagtcgcgacgacctctgtggtgaaatgtcctcatagcagcaggctttaagctgctaatggtttggaagtatctaacacaagtccagaaagttcacacagctgctgttttcagtcagcccctttccctcaaccctgctctggaacctttctgcctgagctggctcctggactgccctgcacagagcacgtgctcggctcctctttgagctggttttaaccccggggtgcccccagaacctcccatcaccgttaccatgcatcctttcttggcttcccttttccctctgctccacatatcggcattcagacacaatgggtggggggaaataccttcggataacccctcatctatgcatctcattctcagcaggcctaggtggtagagacccctctctcctgttcatccttcagcttatcccttttgtaccttcatccccaccactccgagggcatcctggtcaaattcatcaactgtggcttctggatccttaaactctgctctctggaagggattgaaaagctgtgaagagcctgttcagccaacaccgtcatggtccctgcctcatcagctgaccctgccttcattctgctgactgactagcatgaa

SEQ ID NO: 255 - DNA, 1925 bp, Mus musculus
gtaacattaaaggcatagctgataaagtgccaacagctgtcacaaactgatatttcatgatggtggcaatttttgcagtaagagttgtggtattaagctacttgattagagtgtagacttctgcaccaattacatacagacatcacataattgcacagagacaggttgatttatattccaaaagttcacctagttgatactatctttaaagtataagccataaatttgtaaactgtatgtcacatatttagtatcatttttcactctgaatgcataacagaaatggaacatttctataaaactacaacatataaagaactaaagtgtatacatggatacaaagagactttaagatagatatgctttttaatatggtgtctgacattgaggttaaaagaaagttttatatacaccaagaaaatggagaagaatgctaagtctaaaatattagcaatatattaacagtgaatgtattctgatataaagtatcccagtggctgtctttatacaagcacataactcccaagtgtatagtgtatacatacatggaaattcagaacagttagttcattgtatttcattatcactttctattagggtgctatttgtgaaagctaaattaggttcagaacataccaccagctgcaatagaacaccagctgcagctttacctcccctgtgtgcatgcctattgtgaatctcacagaccttcctgctctcctgccctcctgggacaaatcccagtccccaactccagtaaatagcccctacttcaccacagactatagctgccaaaagaccagataagctgaacctagacctcacctactctctataaccccagagcctattctcagggtcacacttagtgctatagcagaacaccagctgctgcttctcctccccaatttgcaggcctattatggatcccaaagaccctagtctttctttcctgtctgatccctgtgtcacagcctcctgaccccagcatatttgccctgttccaccataagctacacctgccagaagactggataggctacaaccagacttctctcacaatctctattaccccagacccaattctcgggtcagaacaggacatcagctgcagcatcccctgcccatattccaacccacctgtgaattcccctgtcttttcccacctaccttgtcactgtgtcccagaccccagcaccagcaaatatctcttgctcaaccagaagccaggcctaccagaagaccagccttaaaacccctgcaagtattacccataaatacactagctggacaatcaagtaaaacaggaccactcagtcaacacacactctgaagatccagggaggcagcataaaccaagaaacaaaattcccaccaaaccaagacaaatgcaaaatctgaaacctagacctaaaaccacctcaaatacagatgcccagatttcaggaaaaaaaaaagccatcaataatagccagggaagtatgactccaccagagtccagctatcctaccacagcagatattgaataataaaacatagctgaagcataagaaaaaaacttgaagaggaaatgaataaaatccttaaagaaattaaggaaaacaaacaattggaggaaattagtaaatcccttaaagaataacaataataataaattgaaagaaacagttaacctgataaagacatgaaaatggaaatagaagcagttcatagattggcaggaataacatagtaaaaatggccatcttaccaaaagtaatctacagattcaatgcaatctccaccaaaattcaaattccaactcaattctttacagaggtagaacatttttgtttttttagttttattaggtattttctttatttacatttcaaatgttatcctgaaagttctctctaccctccccccaccctgctcccctatcc

SEQ ID NO: 256 - DNA, 4600 bp, Mus musculus
tgatcagccatgagtctctgtatcgacaactccactgtgtatttgcattggtcagaacagcagacgtgtgtaacttcttagcacaagcttgagtgttaaagttaatgcatttgttgtgagtgagaaagcaaggaacacaacaaatgttggagagctcgctttgcctaagaatagccccaacgaccaattctgccctatgaccaacctccaggacccctcttaccagagaacctgtactctgaactcccctccctccctcggagaaaccctcactgaaatagagccttatctgtctgactttcggttctgagccagtgccatccacagagacattggctctgggcttgatatttggcctttgtagatgtggactaggagtttgttggtgataataaaatcaatgtagagtcaaaatgtttaaggccaacaaacttgaatttaaactgctagtattgaagaaattactattctctagaaagtaggtcttctgttcataatattaagtaattcaacctagttattaaatacaaagtctttcccctttgttctccttgtttccatttggcagtttttactgtacaagtgaagaaattttaactattctgaaaaagatggtttgcatttgctttaaatgtaataactgcccagggccttgtattttttggccacatttgcactttcatggaaaaaaaggaaaactttttgccaagattattcccccaagacagtatggttgtctttgctaattaaaatggttctctgacacatagcatgattcttgtgtttctttcgttgtgttgaacatttttccacagtgaaatattctgtgcttttcatgtacctagtgctgtgtgcatgggtgctttagttcatctccggcccccaacgggcagtgtgctgttcctgtgcttaaacacaaaacagcacagagtccctcggccccgtccctctacggtctgtgcattcggtgtcttctgggccacagctgtgatcccaaggaagcatcttgtcactaaatataataggatcaaatcatttgttcgagattattaaattgtatttctgagctaggaaatatgaatttaaacttactggacattctgagaacaccctatgttaaactaggaactggagacctaccttgtaatgaactagggctcccaaagctctcccactgtcatctctccccaggacacagtgttaaataccagagaatagcttttgttcttcagtgataatacgctgagctctttccaagttagcacatgattattcatccaaatagctaatagagcatttccacactgacggttctgaaatttgacattcaaaccctccattgtcgccagctccatatttcttattaagttatggttaatttttttaaagataccaactaaggaaaaccaggtgacccaggcaaaggtttagcaaacagtaagtccgcacaagagttggtcattcatatataaagagccatatgattgcaggatgaaaacttctgttcttgtttctttgacctcaataatataccttctatacagccatttgttacctgatctagacaggaggcatccgttacattcctgcttttctggaccacttgagctattagaagctgtgcatgttattttcagaaattcagcaacagcccttcccacctcccagccataattagtgagaatccttaccacctgctctacttatagcaataataataaaatcattcatcaccagtctccagccaccctccctctttctctgtctcatttcaagccataaaaatttgtaatgagaaaatgacaaaaaaaaataataagtataattggtactatcccaaaatagttcattatagatgggcagctcttgatgcataaagaacttagaacttgaaaactccctgaagaaatagctgttctccagcaacacacctgcctgagcaccctgcatcccaggtgagaaactcaggagcagggaagtcctgacacaggctgaagtctcccctcacccagcacaagctactgagatgctaaacagaagcaactcaggcatgcgaatgcctgttttcagatacttccccttctatggaggcagcaacagaagggaatctcaggatcctaattacttggattttaccccgtattataaggagctctccagaactctagtacacgcatgtcaagctagtgacctggcacaatcctaaagtttcagctccctgcagtgtgactttagtcttctgagtctgtcaggagtcagtctgagcctaatgcacccttgtgcatggaatactaggctcttatgcctgaacgaggcagccaagtgggaaactaaagtcaacttagaaaacgtggtcagctagcattgggcagaggagaatttgcactccctcggtagccttgacagcctacatatatgaggaaggtggtcacacacggggagaccccaaatccaccgtgttcccatctcggcccctgctgatgccctacagcttccagcgttgctcgcttgtctcgaagcttccgctgatgatctagtgaaggtaccgatgagaaagtgtccttggacacacaagtcaggggagagtagactgcaggccacaacccctttggagatcaaatgaccctttcacaggggtcacatatcagatatgctgcaaaccagatatttatattaccatttataacagtagcaaaattacagttatgaagtaccaatgtaaatagattgtagttgggtgtcaccacaatataaggaactgtattaaagggtcactgcattaggaaagttgaggaccacttccttaagtggctctttgggtaactaactctctttgctcttttgacactctttgtcagaatctatgtcaccagcaaaataagggttggaggtgtgagccactgcactctctgctaactccccccattttcctcatgtacctcacctgttccattgtacctgcttccaacagaaggagccagctttatgtccctcatgggcagctgtcagcatccccaaattgtaagcttatttcctgaagaaataccattccagggaacactgaactacacaaccatgtggtgtcgttaatctcctcacagcacccaccaagtggcaaaattacctcagtagagaagacactgaggtacaaatgcgatcctataaagagacccctaggtgtagttagatcagggtgtatgactgacctttgtgattagaaaatctcagaaacacaggtcagtgctcatgtttacctgacactaaagtcctagccctcttatgaccttcatgtgggaggaactctgagtagcagaagcaagcctctttagattgagtgtttgtgcctggccctcccagggcagctgctgctgctgctgctaacctccattctccacagctccctctaggaacctttgttccctcacacccagcactcttgctccacacctgagggagctctcccacacctgaccaactctgcatctaaatgtacagggaattccagggagctctgaggtgagccaggcagagacagctgagccaagagaaggactcccactcaggaggcctgtcaggaagacgccatgacccatgccttcaggccaagagcagctctgtgtggcctgctctagaggccactgggccctccccatggatgttaccccttcagaagcctgagaattattgtatgccaccatgatattttttcctcagaatttatccacagaaaggcattttttttctgtaattgaagacagtgctcttgtcccactcataataattgccttcccattattccaattccatttcatttttataatttgctgatggcaccgtagctctgataggaagctgcaaatggcaggcatttggatggcggtgtcctctcctcgttacccctccaactatctcattctgtcaacagcaccctagtttcacacatgcacaaaccattggctcatctttaacaccaccagcagctgcttcaagccccaagttctcacagatggttttttatctctctcaccaccgcacccagaaaccactgtcccctgacagtctatgtggcacccggctcaccatcactgaaggaagctctgtgtcaacatttcagccaacctctcttgctcttccccatttcctaagggtgccccacccccttttcttctgacctctacctttcatactacaactcagtgcagtaaccttcagccctactacacagaagtggccataatttaaaactgtccaggaaagacaacgcagtatcatgtgatattaggatttggcctcaaatggacagctttccttccttacagtcccaaagctctgggcatttcacctctatagaatacttgcttccctggtgacaaatggtacctaccgtgctttgtggatttgtgggggcggggtgtggtgttccagcaaatgccgtgttcacgctgtgttcatgtttgtcataaggcctcctgagagcatacagctcaccctggagcctaccagcactcaacacgaaaatgtcatgggaactgcatacatctaagtcttccaatgctcgtcttaagaaaggacgaaaccaaagacagtggaattaacttta

SEQ ID NO: 257 - DNA, 2000 bp, Mus musculus
ctattggatggatcacacggcccccaatggaggagctagagaaattacccaaggagctaaagggaactgcaaccctataggtggaacaacaatatgaactaaccagtacctgggagctcttgtctctagctgcatatgtatcaaaagatggcctagtcggccatcactgcaaagagaggcccattggacttgtaaactttatatgccccagtacaggggaatgccagggccaaaaagggggagtgggtgggtaggggagtggggggggggggtgggtatgggggacctttgggatagcattgaaaatgtaaacgaggaaaattcctaataaaacaaaacaaacaaacaaacaaacaaacaaaaaaaaaaaaagaaaatgcatccagcaatcccagattatacctctgctcctgtggcatgcagaaatgtcagagacccatgaaaaattgtctctcagcagtgttaatcctactgtaacatttacaaaggcttaaaaaaaaaggcatgacctcagcccttcaagaatcccacaaaagagctcaaattagctgatgcgagactgcaagcaaagaacttcacttttcagtgctcctctctgtgtgattatacaacaggaatgatatctgcccactcgttgcttattttgagaaataaagggaaaagaacagtttgacaaatactttgggtttcgtgacggacactaaaataggagaagagtatatacaaacatattgagttctaatcacacgtttatcctccaaggctttgggaggaagtatgataagtttacagatattttattctgataaggtgggaagcacatcttttcattaatgttgaacatgtttaagcctttagatccatcaaactatagaagtcaatcagatatctattaaatactctgttattattgaagccaccaagtgattccctgagctcatatgattctccttacagcttgttccctgcccccctcattagcatatgcacgtggtggccacagtggccatagtggccagggtcccctcccttccagctcagaactagatgttatcttcatgatttttactgtcttaaacattctccctgctatctgctgagtgtgtgaataaagccaaagtagactttgaagttctagcagctgcctttttctttttatctgaatgcagatctcaggctactaacaattggatagcctgcatttcccttgaaagtgtttgactacatgcagtctgtaatcctcaatatgagaatgcctctcccacaccccagatcagctaaattagaatatctgaggatggagccaagaaataagcaacctagctgatactgaaagtctctagggtttgagtactgttcattaaaataatcactaatataattccaataattatgttaaccttatacattttagaatataagaggcaagcataggctactcgttaaaaggaaaatgagacgtaaagaaactgtattttaaatgaaacaaaaaagaccaagtgtatcttgatgatgcacttttaaacattctccctgtccattttaaaaggacaatgagctaaaaataattcaacaatgggaatgcagtctaagcatctattcaatgactattttgcagttattataaataatcattatggaacatgaataaaaatatgcataactgatactaaatagttcatgtgtttggaaaaaactgatagagaaaaggtcagagttataaaattatatgtggattctctttctattattattttcaaaaatacatttgcttatataatttaagctgaagcaatagaaagtaaccaaacttagaaatttttgccgcagcctcatcataacacgtcttgatcctatgaaacaatagatgatggtggctggttctgagcatatatttcatattaatatcttaaattagtcacatttattatacccagtcacttatgatcaagacctaaagacacgtgtcagtctaggaatcacatattcttgtctcttct

SEQ ID NO: 258 - DNA, 2125 bp, Mus musculus
ccaatgttataaatccatggatacttttattcaaaatttaccattttgatataaaatttatcttatctgcacatgaaactttcctggtacttgatacatattttgtctcaaataactttgcaaaacctacatatttgttgataattgcctgatatatttttgctctcatcttatttttaactttggcatcttgttcttcttttaaataaacagcatctgttcatctcttgctttatgatctaatttggtgctttttgttagttaatgtgaatcaaacaattgacaatttaatattactggttggtatatttggtttcttgtctggtaatattttttaattgcttctacttttagtcttgactctttttgtttcattttttgattagtcttatagtttttaataaccaatctttttcttctcttgatttttcctaattattgataatacatttacagatactattttgtgcttgttatttcatcttaaagagaaattatgagtgccatgaatgaaataataattactagcaaagactatgcaagataatataaaaattatttacttactcaacaattttctcacatatacataagttgggatgaagttcaatgcttacttgttgtgcttgaattcctaggtatgaccctcagcacttcaatctgcaatcagtcagtcagtcagtcagtcagtcaatgttctttgtcattttattcaaggttctgagaaacaattttttctactgtgacttacttacattgacaaagatttgcatttaccctgtggttttacttttttttcttttcttttcttcgatattttctttatttacatttcaaactttatccccctttccagtttcccctctggaaagcccctataccatcccccctcctccctgcatttatgagggtgctcccctacccacccacccaatcctgcctcctcccccaggtatccccctgtactggagcatggagccttcacagaaccaagggcctctcctcccgttgatgcactacaaggccatcctctgtgatatatgcagctggaaccatggatccctccatgtgtactcctttgttggtggtttagtccctgggagctctagttggtgggttgcaaaccccttcagctctttcagtcctttttctaactcctccattggggaccccatgctcagtccaatagttgactgtgagcatctgcctttgtatttgtaaggctctggcagagcctaccctgtgtttaactgaactgtacacatccctgacattcttttccttataattttcccctttgctctgtcttcagtagagctaagtgtgctcagactgctttcctgtgacacacaggttggtgaagcctttcctcagctgtggcttgtgtcactctttctctgacacccttagccaagaaggaccacttctgttggtgcacagataatttaccctaaaatactctgatgttttgttttcagacgtctaatatgggacaaaataagacagtaaatattttcctgtgtttttctttccattagaagctatattatccctaccagagataattttcccattactgtttatcttctctagcagtccagagatatgactatatttgggtgcttttcaatatacctttttatttaaggagtcctttggctttataattccattctagggatgactggggatggaggaggcagaggggagtgtctcagtgggttagatagagcacttgctatacaataatgggaatttgagttttgattatcagtacctatatgaaaaccaagcatggccacttataattataaccctagtgctggaccagaggtcatagggacaaaaagaaagatcactggtgtttgctgtccagccagccaagcatcaaaaatcagtgaactggaattcactgagagaccttgtgtccagagactgaagtagagagtgatggagaagggtacataacattcttctctgccccccacactggtgcatacagctgtgcacacacaaagagcacacacatacactcatacacatacacagcatgacacatgcacatacatacacacataaacatgcatacaaacacacatacacacacatgtacacacacaaatac

SEQ ID NO: 259 - DNA, 3375 bp, Mus musculus
tattttacagcaataatatatatgatttaaaaaaaaaaaacatgctggagaatcttgagcagcatctctcatgtgcgcaactatgtgatgagtccaagagtcaatatctatgggaaatgtactcttacatatggaccactaatgaagatctatctgcccaatagtttctttcacaatgtgactatgagtatacaggctgttagtcactagtactttcttttttaattagtttagatttcttgaccttctaactcaagaaaaaagaggccagccggaaatgtataagagttctcactccacggagctggatacactatttgcccagttacagtaaattcctatccgtgtgctttcaagaaggcactaacactggtgcccgtgggcttggcaggaaggggtttccacagcacagccacgaggaccccttcccacgtggttaatgcagtggccgagcttctctctatcggtttctgacaaaatgagataatcattgattcactgtcaactttaatttaaagcaagagaagtatttgattagagaaggcaaatggctgaatgtccatgaggaagatggaaggataataaggccatcaggaatcagtgatgagtcttttcaataaatactcatgatctaaaagcaggggcagtgacctggtcttccagtgtgagcagcaggacctgggacccaggtaaatgatgagtaaagatttttagaattaaattggttgaatgggtgtgacattaccctgttcctgctgcacagtattatgtgaaatacaaatacatttgacaaggtttctaggtgtatatatggccaaatggaaacaaacaatcaaattaacatcaacaacaaaaactttctgtgatgaaggcacttaaattgctgcacaactcagatttctggcaagagcagaacccacagccaacagtagggaatgcaaactcaatctaggcaaatatctaggatatactagctatggcccggccagcacttgggtatgcatagtaactcagaaatgccacatttgtgcttttaaaactctgttgctaagccactcgtgcaaagagctacaggatggccagtcatatgaggagtcctgtgatcggtgggtaggaaatagggcatgcctctctgcagcagcgtctcttctgcctttctcctagcctctcttcaaaatccttgatgtggttattagggaagtggaaagagaacaaaaggcatgttcctgaaattctaatgatctcgacttcacagaatttggctcggttttccaagttcatcattttcatttctacagtgaattcagcacagtaaatgctcacagcataatgataatgggagggtctgattacagatggtttggatgagcaagtacacacacccacgctgcaacacctacatattggtgttgaacaacacattcagccacagagttctacatgtctgcttctagttctggtcccataatcttcctcatctatcatggttagtcttcaatgtcaatgtcactagatttagaatgacttaggaaacacacctctgaataagtctgtgacaatatttctcgggagtccaaggggagaagactcaccctgaatatgagctggataccaccatgccactcttccttactatggacatagtaatttcaaccatctcatgccccagctgccatgtctttcctgccattaagaactgcagtccctcaaaccctgagccaaaacaactcattcaaactcacagcagtttgaataaaaataggctcatctacttgaatgcttaatcgaaattagtggaactgtttaggaaggattagaaggtgtggctttgttgaaggaggtgtgtcactgggtgtgagctcttagccaatgcgctggcaccatgcctgcctgccagctgccatgctccccaccacgatagtcatggattcatcctctaaaagtgtaaggaagcccctgactaaatgcttttttctgtaagttgctttggcacagtggtttaaaagtaaaacaccaccataaggggttttcatcgaatatcttgtcacagaaatgagaaacataactaagatatccttcactgaacctgagaaagtgtacatatcaaataccagcttctcaccataaactcagcataaatgtggcacttcatgggtgggcaggtctacatcttctcaagggtcaccaaagcattttttggtttggtttgggtgttttgagttttgttttgttgtgttcacctgtaaacatcgattatctgcaaatagaaatgacgctggtctctagcacaggttttgaaagcagctgagactgttactgggctgacttgagaactttgaccatgatcacagtgcaaaatgaacccacgacaagcagctcattcattctcctgataatctacctcacacttctttctgttactgctaatgtaaatacttgacttcatttgctagttccatgatcaaagttagaaatatttatttctaaaacatggctcaggtgttggctcctgtctgccagcttagggaattcccagtccacggaggtgcccagcacccaggatcacggtatgagaagcccttttgactttcttcatgggcaccacaagagatgcacacatgtcagggacgctgtgttgtccaccctgctgagcctctcaggacgcagacctgcctgaagggagagtgttcccagcccacagtgagctttaactgagatccatccctgccattatgagtctgtcactgtaatcattcctggctatcagtgatagcatggggtgtagaaagatggcatttacatgttttgtaccctccacatcagcaatctgtttggatcaccaaatgagcatcgggcgccttgctcattatgtaactttttagcacagtaataggagctcctgctgagccaagtgggagagaaaaaaaatacaattctcatttttatgtgcactttagcatactgacctcctttatcctgttgatgtgcccattaataaaacattttttaatgacctgaaaggctttttatgaactagagtgtgggcctggctgccaagcagctgtgcatttgaaaggacgggattgagtatcaaagcgggctgtgatgaagtctggccttgaaactccctatgtccagaatgggtgctcatggtttttgactgggctataaatgaaaaaagatttctacagtggaggagtctcaaaagatggaagtaaggatgcttgtaacacaaaggatgattcatgggttgcagaactggctaggtagcagagcacttatcaaacacgcaagaggccctgaattcatcccgaaaaccacggaaaatgaaatgtgcaatttagtttcatttaaccatctgaattaagatttttc

SEQ ID NO: 260 - DNA, 2000 bp, Mus musculus
agagcactcactggtactgctactcaggttatccagcacacacaagcctctgaaaggtaactcaagagggtctcaacccacggataactggaagctaacataccaaaagataatacgccttagacttccaccctcaaatccttccaaaaatactttcttgaaacacattagtatcacatatagaacaacaacaacaaaaaaaagtttttaaagaataccaagcatgtgaaccattaaaaaaaaaaagactgcatttttcacttttacttaagctataaacttaattatcatacaaagtcatgagccaaatttcaaaattggtatggaaatgcgcccaagtggctgactgcatgtggactgtgcagaggcagagaaatatgagcacctgatgaactgagtcagagtatgggcagtctaaaaccttatgtccacagagcaaatccgctcccacggctaccttgctccttttcagagcctgacattaagcttgcatccccaggattctgtacaacctacttgagcaaaacgagacagcattagactagccctaacacacgtctaagcacatttgccacttgtgagatgacaaacacagcatcttcaccctcaacttggacatcaggcttcctgcgttattgcatttggggacacagggtgtcagtgtgtcatatcaaccacagggcatgctttcaagtgtgctgtggccggtaaggaaaagcttttacgaggagagggcaatggagaataggctgctgtctacagtaatgtgagacgtgatttggcaaagccgcgcaacagctgagcaccatgtgaacagacagcaggcgggtcactgattcccaggagcttcaagtggaagggcgccgtagtagagaccttgtgctcaaccccttcatttcacaaaggaggagatgaagacccagaaagcgacccaaggaaaagcagctgtgggggtggggggatcaaaggaacaaacaaagcctcagactctcatcccactcaccacgaccccctgctccccccaactcccctcgcacgtcactgaaatcagaaagaagctgtctagagaatgtgctgtgaagactttgaaagtctatggtatgggaagtccatgggttcggggggagatctgggatgggaagcgttcctgtcttgcagtcacaaagacctaggttcaatccccagaagccatgtgaacagagctctgcatgacggtgtgcacaacttcagttctgaggagaggaaggcaggtagatccctgagattaggtggggagccagcctaacctaatcttggtagttccaggccagtagaggagcctgtgtttaaaaaggaaaggtgggcattatgtaagaaatgtcacccattaattgtcttctaacctacacacacacacacacacacgcacatgcacacgcacgcgcacgcgcacgcacacacacatgcacggatgtctgtgatgtgatgaagactatttttctgcaatagaaaccactgagccataccacaggcatgtcattaaacaaaagagaaacactgacagcttacgagtcaagtagtgtctatgtcctattaacaggagggcacgaacagctcatgctcagcgcatgctcagaggtgggctgcattatcatgcatcatctttgaaagtaactctgactgcctgttcataaatatttgagctccaacagaaaaaaaaattcaaaagaacgaaaaagttcctcataatttaacttttgaaggatgcagtcatttttagcactccaaaaaccaaaacgtcacctttgagatactcagtgcgtccctctgtgcttagcatagttgttttctcccacttggattttgaattgcagcaaaaaccctattataatgttagccattttaatggttcttatagatgctggcaaagtactacagaaatagatgctgaaatgcacttaaggatttttagaacagattgctcatttccaaactatcaagaaacgggtaagggaagaaga

SEQ ID NO: 261 - DNA, 2475 bp, Mus musculus
tagcctcaacataggtcaagggaattccatcttgctactttttctgataaagtcgtataagatttaagtgttattattgcctttcaatgtttggctgaactcactatgaagccttttgtcctagagttttccttatgggaaggattttgagaacatattcagtttataaatagagatggaactgtgtaaggttttcaattgcttcatatgtcagtttcaggaaattgtactctttcaagtaatttgcttattttatagtaagtcttagattttattgacgtaaaattgcttgtttacttattacttcaatgtagtaggatttctaaagagatccctcattttttatactggcaatttatgcttctttcattttagatttttcttgatgagtgtggttagaaatttattgatttctttcaaaggaccaatttggggtttcattaatttttttctattgtttttccgtttcattgatttctgctcttaagaaaaaattccttccttcaacttacactggatttataaacagttgccctgtttttgttcataaagatgggaaatggagttctggcctgtagacctttcttctcttataccggaaggacttcaagctactcacttccctgagctgggctttacttgtgtccccacactgcacctctgtgtgttctccttgtcattcagagcatcccatatttcctctgtggtccctttcattggctataagttcttcttttctttatgagttccttagatatgtgttatttccaaatattttgagttttctgagtatcttgttgctattgatttaaataaattattacccaaacatattttgtaatatttcagcctttaaatgttcacagagactttctgtagcatgtcttgcggctgtcctggttgttgtaccatgcacacttgagaagaaagtgccctgcaggtatcaggtgcagttttctgaggatgttagtcaggtcagtgcccttgatagtggtgtttaggtagtggttttatgcgcttactgatttttttttcttgtggttctgggtatgaaccctagcacgagtcccagtgatgttctttgccatgttctgtcagttattgagaaaagaatattaaaatcaccaaccagtgttgtgaatctgcctatttaataataaattctgtagcagtttgctttgtagcattctattttaggcacatatggactttatttttagttcttgcagatgaatagcttctattgtttctatcaaatactctctttatgtctgattatgttctgccttgcagtgcaatgcatatgatgtcaatatagccatagcaaccttcttgtgaggataggagcacacacacgtgtttgtatgtgtgtgtatgtgtgtgcgcgcatgtcttcatgtgggtgtgtatgtgccacaacacacatatggaggtcagaggacagcttccattttgtggagagagggtctccatgttgcttttccaatgcaaatgccaggctaggtggcctgccagcttctagggagtgtcctgtctcccactttctttcaggaacactgaggttacagacatttgctcagtgcctctggctttcatgtgggttctggggatttgaactcagggcctcacattcatatgatgagtcccattatccaccagcccatcttcccagcccacagcagcttgcttgctttctctttttctctctctctctttctttttctctttctttctctttcttctttctttctttcttttttaaaaatttatttatttattatatgtaagtacactgtagctgtcttcagacagcaccagaagagggcatcagatttcattacagatggttgtgagccatcatgtggttgctgggatttgaactcaggaccttctgaagaccagtcagtgctcttaaccactgagccatctctcagcatctttcttatgatttctctttcatggtatgtagttttcaagccttaattactaaacttgaagttttgtatttagcaagtatggagatcatagattctgtctccttcccatttttgaaaagttctgtttttttatttatttggtgtttgtgtgtgttacattatatgtgtgcggagctacccaccctgtttgtttgtttgtttgtttgtttgtttgttttttgttttttctttcgagacatgatttctctgtgtagcccttgctgtcttggaactcattttgtatactaggctggccttgaactcagaaatccgcctgcctctgcctcccaaatgccgggattaaaggcgtgtaccaccaccgcacggcttttttttttgttttgtttttttgttttttaaataaggtctctcactgttcttgggtttgattgggtttgactagcttggttggccagcaggtcctagggatctgcccacctctgccttccgatcactggagttaaaagtaccactctccatttaaaaattatttttattt

SEQ ID NO: 262 - DNA, 1900 bp, Mus musculus
ctcctcctcctcctcctcctcttccttctcttcctcctcctcttcctcctccgttgtatattttaagtttataaatgccacccctctctaattttgagggatgtattgaaagctgaccttgaatgttctgtgtagatcaggttagcttccacttggagatccccctgcctcagcctcctgaatattagaattatagctatgaatcaccatgactgcttggaaataacactctagtaagaagacgacggaggctgaggctgagaggctgagactgaggctgagaggctgagaggctgagaggctgaggctgaggctgaggctgaggctgaggctgaggctgaggctgagaggctgaggctgaggctgagaggctgaggctgaggctgagaggctgaggctgaggctgaggctgaggctgagaggctgaggctgaggctgagactgaggctgagaggctgaggctgaggctgaggctgagtctgaggctgagactgaggctgagaggctgaggctgaggctgagactgaggctgagaggctgaggctgaggctgagaggctgaggctgaggctgaggctgaggctgagaggctgaggctgaggctgaggctgaggctgaggctgagaggctgaggctgaggctgaggctgagactgaggctgagaggctgaggctgaggctgagaggctgaggctgagaggctgaggctgagaggctgaggctgaggctgaggctgagactgaggctgagaggctgaggctgaggctgagactgaggctgagaggctgaggctgagactgaggctgagaggctgaggctgaggctgaggctgaggctgaggctgagactgaggctgagaggctgaggctgaggctgaggctgagactgaggctgagaggctgaggctgaggctgagaggctgaggctgagaggctgaggctgaggctgagaggctgaggctgaggctgaggctgagactgaggctgagaggctgagactgaggctgagaggctgaggctgaggcactgcagaaggaagaactaggcaacttgaggttctgaactaaaaacaattcaggtgaactaagaagcgggcggggtggctatccccagaagtgtggactccaactgacggccacacacttctttagatactcttgctttgctgcatttataatattgatcctcactatcagattcttagcttttcattgcagatgattacaaagacattctaaatataaagaataaaacccaccaggaatctcattatgtagatataagaaaaaaaatccatgagctgtgaacacatcccatttttagaaaattgtctcataccttataaagaatgttagtccttgcttttagcatttgattgtgttccgtgagctctgttctgcatacaaataatctttgcatataaattctaatgactgaacagtgttttataaatgaagtgaaatttttaaatattggcgaatattgtaattgcctcatttttttctatcaggaattatactgtaatgaacacatctatgtataatactctgtggttttgactatttcctgaataaatactcttagaggtcaattacaatgtcaaatttaagaatggttacaaagtctccttatgtatacaactactttataaatatttcgttccaactaaaagtcccattagcacttacaactgtacttttaaaaaatatcttttttaaagtgaataggcaaagatctcttcctcctactttgcattttctgaattagaaattaatgcatttattgacatttttatttgtattttattttcttaatgtcttttcagtgctttgagagttttctattagaatgttgcttttcccttgatgaatattagctccaacataccaagaatgttgatttg

SEQ ID NO: 263 - DNA, 3675 bp, Mus musculus
ctccatttcttctttagattttgcattgaatttcaaatgtttttttcaatttcaagccaaagatggctttcatgcttaagataattttgatcatgatgctaattttccccttaataattatactttaaatatctatatgccctttccttcccaattataatgctaatatctgtgagatagcctaaatatccaagagaaaatatttagctcatcattattccatcagtgatgattagccttttttttgccctttcaagtacttaaccacatcatcattcctttgacctcaaattactttggctaggggataaagaggatgatggaaatcactttctcccacacaatcctgtaattaaatatgaatgttacagatgtactcactgtaaattcaaatagagagacttgtttttcaatacaagtttacagcaaattttactcttaagctgttgaatgcatcaaagggcttttatttctctcctgcctatattttcatataatttaaactctacttcaaattatctggatagacttgatactctggcattaagtatggatcagcggcaagcacttagtcctgtaaagtggagtgttggcttctttattgtctcctcgtagagtgttaggcacagaatggaagcagaacccctatgtgcagtgtcttcaggtggtgagccagacacacaggttagcacagtgaaaagaagcagcagcctacagcaattaaagcctatagcaatttcactacaatatggtccctagaacctaatccctctggcattcctcctccttgctagatacatttgctatgtgtgttggttggttttaagtgaatttgatataaagtagaataattggaaaggactctcaataccttcataacattggcccgtgggcaaacctgtgggccattttcttgataaatgattggtgtgggagggcccttccctttgtaggccgtgccttctctgggatgatggtgtgagttgcatcctgagcaagccagtaagcagcaaacctccagggcctctgctttagttcttgcctccatgttcctgccttaagctcctagactgacctctgtcagtgaaagagtaacctgagctttgcaagctaaaataaaccctttctttcccaagttgtttttggtcatagtgttttatcacagccatatgaaactctgactaagtgactgtggtaggaaattgtgtcgcacaaagtagaccgcctctgactttttgatggataaaattctagttacaacctagcactcacctactgctgaatgtttcctggtgagcaggtgagtaaaaacaaagaaggaaccaatgttgtccctgaagcaatataaaaatatggaaagctgtactaattcgcttcactctagtaaccatttgctatctgtgctataaaaccatattgcctgccttatatagacataagattttaaaaagaagacatcaaagaaatctgacatctatctcctgcaagcagtatattcaagaacattatctaatagtctaccagataaagcaagcctttcgttttgttaacacagcataagcaaattggcctatcattcgctcgaataatctctcgctattatgcatcctgcactgtcataaaaatgaaactgtgtgcaggtctaagtaacctcacatatcttctaacaatctcacaacccaacaactggcttagctaaaatttatagctcaacacaaaggaaggtcatatgcaattcatatttgaggaataatcaaatcaatattaactgaataacatgtatttctagaagtttgccaaggccaaggtcataggaaaaactatgatttttccaacagtctcatttgtatcatgtaaacgcagacctatctatagtgggattttcagggttattacactctgcagcaatgaggatcactccctttctaaaaaacaagcaaagctgtgtttttgaatcagatttagcatagcaaaatatgtacggctttgtcttataaatccaacacgcttgatgagaatacagcatgctctcaatgtttgatggtcttttactgctaagaaaagaacaagactctaagcaacatgtagtatccatggtaacgtgtagcttgtcatttgctgttcacaaagggaaaattaattccatttatttacactttcaaggatttcatgcattataatatcttgagggaattcaaatgcagccttgcttattttgtttatatggtaaattcatctctattttacaaaagccctataaaaccataaaatagaattaatgtcatggcgatgttgaccttatttcctttggcaacgtgaaggtagcaccatgaatttaaagtgttttgttgttgtatgtttttgttattgaaatagtttcctttaatagaattttcaagctcctgtagagtgaatccattaaagaagatggatcttgggagacaatttatatgaaattcagtaaaatataagaccacagtcatttttattatttcttactagaaatgaggacaataccaatttttcttgccaccttcactctttatttctctcttctccatgtggcatctttctttcccttacctaattcctatgccttttcttacttccccgaagactaacacttaaggaagtgaggtctgttcaccctactgtaggtgattggtgaaagagcaggcaccttgtgatttcctgatacagcactggagaaaaccactttggtctacactgttcagaaagggcaagaattgctcactggttatgggtcacttacttccgtctctaaaccctgggactattggcctgtacaaagcccagctcagtaatgacccatctgtcatataaacccctgttatagattctgtgggtgcaaaaaggttttaataaacaatcttgatataaacagtgtttccttagagtcataacacagtaaaaggaaaggagttctttttactctacaaaataagctaagaacactcccgctttataaccagatcgcaaagttcttctttccctgtatttctctatcactctggaggagtgggttagacagagcaacttcacattttcactgagtgtgagctttttctgttgatcaactgaccatcccgtttgcagctttagcagtttggacccaccctttgtgtgtctcttgtgggagcagggatctgtagtcactggactgagtctgaccctcttcttaactccacagtctcagcactgcagtacactgactgtgtactttcataggccacttcatcctagttattttaggtttttaaatatatatatatattgtggtatgtaaacaggatgacctagaagttgaatttcagtcatcttaggtcaccattaagttttaaaatacctaatagtgtaataaatattgtaatagactgtggctttcctcccaacaccaatgcaaaaactaatatctgaaatactagttgttgaaatatttctattaaaaacctaaggaatcaaccacgtaaaactagcacatttatttaatagcagctccactcataagtgacaaatttagctgactaatggtcttctgattggtgactgtaacaattgtggtgggaccatactatgtaatattatttagatatcaagaataaaaatgaggtaccaagacatgagaaaacatagaggaacctttcacatatgttg

SEQ ID NO: 264 - DNA, 1875 bp, Mus musculus
ttgtagacccataggaggaacaataagtatgaacaacaagatgaaccaaccagtacctccagagctcccagggactaaatcaccaataaaagagtacacatggagggacccacggctccagctgcatatgtagcagagtattgcctttttggacatcaatggaaggagaggtccttggtcttgtgaaggctctgtgccccagtgtaggggaatgcctgggccaagaagagggagtgggttcgttgttgaggaagggatgtggggaggggatagggggtttttggaggagaaaccaggaaaggggataaaatttcaaatgtaagttaagaaaatatctaatgattaaaaaaaaaaaagaaatgtggaaaaaaaagaagaagaagaattctggggctggggagatggctcagcagttaagaggtcctgagttcaattcccagcaaccatatggtggctcacaaccatctgtattggagtctgataccttcttctggtgtgtccaaagacagagacagtgttctcatataaataaaataaatattaaaaaaaaaagatgcagagacaaggcaatcttcaaatcgccacagcttccagacgtaaagatggtaccctgactcaatgtttgggtatcagctccatgtttcagtgtgaggtctccagtcttggcccttccctgatgagctgacaaagattaggccatagctgcactttcctgagatgtgacagagaatgagttttcctgtagcaggaggtagacctattactttcttgataggaggtcgagcatcccgcttctagtctccctccccatcctcttggcctgaaaagcaccccatttagcccacagttctgctttcccagataggcagagagaagctgaggcaggagatgtaccaactgcctgcatcatctccgagctggaagccaggctggctggtgctcaaggtttaattagctgaaataactgcacataatcatctttaaaatgatagtggttaaagcccaggctcagcgtggatgattattcaatcgccctgcacgagcatccctttgccagctcagccgtgccaatgaggctgccagcctgagcgcatggctccagtgtgccctactgaagcacctctcctgttgttctcactccatgtgatggaggaggcaaggcagagtgtgtggggtttagccctgcatttcttcacggacacctctcaaaaggagtgtttgggtatgggggtggggtctgccaaaggttctgtaaaaccatcaaatattcccggagaagcaatcagagagtccccatggagatcacagacaaggaggcactggctctagccgatgaatgactatagcctggctttttctatctgcaggtctgtttctttgtttggaaaatggagggcactcactttaatttcaaaaatctattttatgtgtctgggtgttttgttgtaatgtatgtttgtgcaccatgcctggtgccagaggaggccagaagagggcactgaagaccttagattaactgttacagatacttgttacctgtcatgtaggtctgggaacttaatccaggtctctgaaagagcagctagtgctcataactgcttagctatccctccatggaaaatggaacattctcacttttaaaggtgtcctggagaatattttaataataacaaattattattattattattatttacaattgtacatatgtatgctttacttactggcaaccctcacgcccacctccctaccaccccaatccacactccccaacaaatctctcttacattcatacctattcattttgttctgtgcctcagtaagattaatcggggccatctatatgactataggtttggaattatgcatttaagc

SEQ ID NO: 265 - DNA, 3150 bp, Mus musculus
actctaaaagaagctgagagtagagtggttaccacaggctggggacagcagtgtgtcaggaacagtgggcactgacagttctgtaggagcagtaaggtctgctgagctattacatggtaacataactattgactagtgtactgcacagttcaacagatcataacagaggactcagagagttttcatcattaaaaacatgcttgacactcgaggcagaggcaggcggatttctcagttcgaggccagcctggtctacagactgagttccaggacagccagggctatacaaagaaaccttgtctcaaaaaacctaaataaataaataaataaataaataaataagcttgaagaactcaacatgtttaatatgattcagacattatatagcacatgtatgtgtaaaacatgtgacacatggaactgaatcctgtaggtgcggagcgcagagctactacattggtgagccttcatgagttgggacacttcatttaataagttttgtgaattatttgaagagtaaatgagagggactaactccaagattaggtagtattacataaagctattagggatacttgggtagaagctagaaatagacactttaaagtcatcgtaagtagaaacaaccataattatgagggtatgcaggaagaagtgtgtgtggggtatacagcagggtttcaaactggggactcagtgacctaatgttttttaaaggacctttctaagtcttaaggtagttaagaaatcatcagacttcgtggacctctggctcttacagtctttcctcccctgagctttaggtgcaggagttgtgttgtaaatgtatccattgggcatcaaatgactagttgatttctgcattttaaccagttttttttttttttctatagtggactctgctgcaaagaagagatttttttgatccaaggtgtgagctatacttccctgtgatataaggacaagttattaggagtatgttgggtctagtgaagtggccacagtacattctctaaactctagaacctcaaggtcctgggtagctcacctagttagacaattagacagttgttggttcccactactatcgagcctctggggcatcttgttatgttggtcattgttgtggttcatagatgtcacagctgtgtaggaccattgattggccctttcttggcagatttgtctccaagaaatggcaggaagttatatctgtgatagttcaacaacaaggcttcctgagtaagccctaaagagtgacaaccccagcagacatgtttaatgaggaagggggttctcttgggggcctcttcatggtctgagatttatgcacaaacatcttttagtatttctaatggcagcctgcaacaaaatctctctctgacacaaacatccgatctttcttctcagcctaagtagtacagttgccataacaacctgatgagggtggcgcgtttgctgctgtggtgaggttgtgtccgtcgcaattttcagggttttaaaattcagcatgacattcacagatgtgacaaagaattccatctgtccactgatttgattttcactcagttaactgtccaaaatcaccacccacccccatgttgaaaagggtccatgagtttcatgtctagcattgggcttttgtgtgtgtgtgtgtgtgtgtgtgtgtgtgtgtgtatacatatatatatagtgaatacatgcttgttttcattagtaaatgatataattcacagcaaatataaagtagaaaatataaagtagaaagaataaaggctgaagctgattttcagtggtttcttatttggtaaaagcaatttacattttctgttgttcccaaacaaaataatgggtctcattgtgacattttcgtacagatgtttcatttaacttggcgtcttatccatctccctcctctaaggccacctgactccctctgcccacctcctggtggcctcctacctctcccttctgctttcttgtctgatgtgctccactattctctcttgtctttttcccttccccgaagatatagtcctctaattcaggattctctccctctccctaccccgccccacacactgacacatgtgcgcatgcgcacacacagatacacgcacatgcgcgcgcgcacacacacacacacacacacacactgtcttatgtctacagtacatctaaaagaaaacgtagtatttgcctgttttgagtttggattattttgcttaccaataatctctagctccactatttttcctgtaaatatattgaattcaattttctttatggactgaataaaattctattctgtacttataccacaccacacttcggccagtcacgtgctgggcttcatctcaattggtccatttcctggttattgtgaacagtgcagcaaaaaccatgattgagagaatatctgtgtggaatgctggtgtagagtccttagggtgccaggagagtaagagatgagctctacttttagtaatttccacactgacttctgtggtgactgcgcctatacctgttgccagcccctgtatacgagggtgtttggttattttttatcaaccggacatacatgagagtcacctgggaagagggaacctcagctggggaattgcttccattagattggcctgtgggcagggctgtggggtcattttcttaatgtttggtgtggtagcatccagcccactatggcttgtgccacctatgggcaggtggtcctaggttgtataagaaaaggctgagcaagccatggagagtaagtcagtagacagtggtcctccatggtctctgcttgagttcctgccctgacttccctcagtgatggatcatgccagggaagtgtaagggaaataaatcctttccctccaagatagtttggtcagtgtttatttatttatttatttatttatttatttatttatttatttatttatttattatcacagcagcaggaaaagcaaagtataggattacctctctcccatttgttgtcatttgttttctttttgtgcatgtgtgtgcaaagtaagctatacgaatctactttcatttatttacagatccacccaattatcctagcaccatttgttagcgcctgtcatatcttcttcagtgtttgttattaccagctagctggta

SEQ ID NO: 266 - DNA, 2200 bp, Mus musculus
aacagtgatcagatacaagtgaggcaagaacactgctttcaggctgctgctatagtgtattgttttcccagtgaagcatagactcatcctcctgagtctgcctcctcctcagtgaggatctcagtacatgcttgagggaggccacttacagggagcctgccaggattagctcagaactgcagttagttgcaggaggaagcaccagcactggctaggcagttctgctgtcttagttccttaggcatctgtgttaagggattaaatatcagcataagaacacaggagtgcctttcatgagaaaagtccctgtcctcaaactcatctctcaccctgatgtgtttattcttttggctgatgctgatttctaattttcagcatgtttgaaggtgaaatctaagactttctcttaataatttgtgatacgaatcttcattgcaaaaggaaatcacttatcagtagacttggtgatatttttaaaaaaggaacagttggaataaagactttgctacagctcatgaataacttttagagttttctatcattgtaaagggatgggcaacttatataaagacatcaaactatgccgactaggccggtgtaagggatttgcacagtaattgttacgtgtggtctgttctcagatgagaggactcatctcttgtgtcttagcaggagttgcattttaggagttattttgaaggcagagtcatttaatcctgtggaataaagatttcttcatgggaaatctcacagactcatgggagtctcatccataagaggtagagtttacttttatgtgatgttgttaactgctttttttgagttttccctttttacttttatttttaaaaaggcagatagtttctcactgagaccctgatcataatcagggttaatatgtgatgtagcaagctaaagagtaaatgagtcaccagtaacacctcattagcactgtaaagataactggggagtggggagactactgcgggaaaaataggcggtgtaaacagcttgaactctgcagttggaaaaacatcattttctattctgcatatcagaattaccaggtttataaccatttgttggatctagacaggatgttctttgtgtccttgccacaaaaaactggcttcctctgctgcagctctctgcctttcaaatattatcaatacacagagggttttgtattgtccattatatagctgtggtctaggctgaggctacttctctaacctgccttttacaggcctgagaggagtccactgaaggacgaggaagaaggggtcaggctctagggaaaggttcgccaattggaggccaggcccagtttacctctctgagccttattcagttaagagtactcctctggggtgaaagatgccatggagcccaggcttcattgtcaccttcattttcctgcatctctgcactccactcatggctagccatatctgttctcagcgtcacagttgtgttcatggttccagaggctatctgtgcgatgactcccactccgctgggactctgggactctagagcagtagcagtgtgaacagctggttcttttggccttccatccccttgggtacgtacttgccagtcttgccatgttttgtaaagagagtgcttgagccaacaaaaggttgctgaaagtaatcaatattatattattgcatgctgtagttgtggtagttgttttagtatgtcttttcaaatggtgatatctactgtattgagtgggcaatccaccaatgtatcaacacctataatttaaaaatagcagtcttaagtgacgttaatgtgtattattaactctggctgtaaggtctagtagagtttcagtctcttagaaaacgagcaattttcagaatcccgcattgttacatagtatcttattttcattttgtttaaattggacttataattagtattcagtaggtaagtctcctgaagaatcactgaagtagttttcatcatattgtatattgcataaaataatggatttcattgtgacattttcatatgtatgtgacatactttaatcatattaccccctctttcccagttgatcctcattgtcacagatggactgagaacaacactttttctcttggacatctagatttcaaggcactgtatgaaccaggttattgttcctccaataaagtcttttcagtctaggggcaaaccagagaaggat

SEQ ID NO: 267 - DNA, 1900 bp, Mus musculus
cagatttcctacttgaccaatgaggcataaaatcaatactcaggatcttattagtttaaatgatctgaacttacctgctttttattttagtgggtacctgagatcccagcagtaatctatatccacaccaccatcaattcaaaaagggaagtctacccttgtctactttgccatattaaatgccattttgctcatatctgaaactgttcatacacagcttctcttgtatatgattcagtgttcactgaattttatctctaggaatgcacattagtttttgttgttgttgttgttgtttttttgttgttgctgttgttgttttttttttttaacttaatttttaactgttcctttctggtctttccacttccttttctccccttccctttgtttcctcaccacctcccaccttctgtcttctctttctatgccctttgttcctatcattctctgtttcttgttctctttctccttcctcatatccaaatctctcccgaaaggtgtgtcctagtacttttatttaagttcccaaatttccactcttctcttcctgtttatctttcttactcaaatgtacttgttttcaattgaccttttcatgccattgactgtaagagattatgtcatgttggaccacacttgggtgtatttgtgactccagaggcagatggagggaggtaacacccaacttcaaattctcagcatgtcagagaaggttctcagtttactgccaccagctttgataggaagaaatggagaacacatagggccatggagagaaaactccaggtagcctctggagcaaagaaatgagttgtcaccagcagttactacaagggaggtgcaaggagaagtcatttgctgcgtgtttcagggaagccaccttggtcccactatcaactccatggaagcaccagtacttagcacctgcccagggagctgctcccaaggtgaatggagttattgggacatccctagaaatttcacagccagccagcctttagggaagctggagggctaagaaagatttgaaacacatgaattgttccaaaaggcagggacagccctttaaaactaccatttttataaactggtgaaatagaaccatattctacctccatggtctgtttcccagcaacaaattgggcttgtcacctaaattcttggacttgaagttctttacaggcaagatcaaagcccccagttctgctgcctgcctcctgcatcctcccacagacgcgatcttagaaaggaagggaaaatattatcatttgaaattaatttagcactgtgaaggtgctaagtgctcttcagaataatatattcaaaacaacacatggaaataataaaagtctgctctgcttattcctccctgaggcaaaagttagattttttttttttttttttttgttttcttttctggtatccatgtgacctgttgttaccaggatatgcaacggtctccaatcacctaacattttaagcactggcatgaaaacacttgcttttaagttttctactttttgtttctagtatcagagatgggaggccattttttggttgttttggttgtttgtcttttaacccatgcacatatgcaataacaattaaggtttaaaggccatgcatttgaaagaccagggagggtttcttgggaggacttgaggaaggaacggaaagggggaaattatataattacaatttcaaaaaaaattataaatattatgactatcattagggcaattatttattttattatacatctggagacaacctgaaacagcatgccaagaagagaggaaaaaggctgcgagagccctgccaagtaagtgtttgcttctcagtgcaaggatctgcatttcattcatagaatccagttttaaatcgctggttaatggcg

SEQ ID NO: 268 - DNA, 2650 bp, Mus musculus
agagataatatataatgatgtatacacacatacaatccgcacacatggtaaccatctatctatgcctagacattcagactggtaactcgactaatgtgtgcaaactccttctgtgggcagaaggactgctactgtgtgcccagatggggacatggaaaaattatgtttacccaacttcagagaatccatgccaaaatattcctcccaaacaaatgatttcacttgttcttgttttcctccaacacaccagcctgacaaactgttttatacatgaatttgacttttcaaaaactggtacacaataatggcaaactcggtacatccttgtgctccaagggctaaaggaaggccttcaactgacgtgtgaactgcatcctaatgtagaataatatcatcttctaaaagcacaggaaaggggacctgtacagcagcagacatggcctgaccctgtggggtgggcatcagccggagccagattcttaaaatagaaaagaaatgacatacttcccaaagttcatagtgacaaaaaaaaaaaagaagaagaagaagaagaagaagaagaagaagaagaagaagaagaagaagaagaagaagaagaagaagaagaagaagaagaagaagaagaagaagaagaagaagaagaggaggaggaggaagaggaggaggaggaggtaggaaaagaaaaacgaaaacgaaaaagaaaaagaaaaagaaaaagaagaagaaaaagaaacagtgcttccaaagcccaaactctttattaaacagaaacccttttccatacaaaaggagatataagcagaaaagcaattaggagatatccttgattatcattatccttccgagttggacaacttcctcaccagtagtcattcaacacttcagatacctcccagggaccctgtcccagctaagtctcaaagactctacactctacggtctgttttttaccctcattcacttcttttaagtatcatggaatagaatagttagatccatcactgggcagggtggggcgggtatgcctgttgtctctgctacgtttgaaactgaggatcacttgagcccaggagtgaccagcctgagaagcaaaacaaaattctacctaaaaaaatatagctgtgcatattaggcataattagagccacctttttctagcacctacagacgttttctaggctcaatatttcctatttacagtaaagatgcttgccttgcaaatgtgaacagtgaagtattattcatcaagacagcagcagagcaagactaagcccacactgtcctccagctcccagactaaggaaaacaccaccaggaaccatttatcctgatgttgatggttgctacacccccacatgccaactcctcttcacaccagcatgtcataatgctggcaaagtctggcaaatgcacagccattttaatgatgtcgagagggttgcaatgcaactcagagactgcattgtatgagcaaggctctgggtttgcaccgaaaataaacaaacaaacagaaacacagggaaattaatgtacttacgaccagaaaatgcatagccatgatgcctaagccaggcacgctcaaaatttaacatgcgtaagaacaccttggggtctcattaaaatgcagacgtggattcagtagttcttggagaggcctcggcctgaggtcctaacaagctcccagatgacactgatgactgtggactccatttccagtagtgagaccacccaccaggacctctcgtgggggtccaaagtaatctctttgtcacatagaactcctatcccatcacaaggagaaagcagacactgttaaaagggaacatacaaaaatacacaaagattgctgttgtccctttctggagaatgggagaatgcaaatttgggattcttggtcccgattttaccttgcaccaatattctattctcctttcctcaaagctagcttggcatcctgactccctcaagggagacagagactgcttgttgccaagatgcagcagtatccaaggtacaaaagcattatcttttattgtctaatgccaactaccttccagaagccagcctaggacagttttaggcctcctacagacgtggctgtaagactgtctctgagattgaagatctatctcaatgatactggattcactgggtttcacaatgtcttaaaaataatctcgggctggtgagatggctcaatgggtaagagcacccgactgctcttccgaaggtcagaagttcaaatcccagcaaccacatggtggctcacaaccacccgtaataagatctgatgccctcttctggtgtgtttgaggacagctacagtgtacttacatataataaataaataaataaataaataaataaataaataaatcttaaaaaaaaataatctcattgctgggtggtggcggatgcctttaatcccagtgcttgggaggcagaagcaggcagatctctgagtttgaggccagcctggtctacagggtgagttcaaggacagtgaaggccacacagagaaaccctgtcttgaaaaggcaaaccgagccaaaacaaaacaaaaaaacttgtctgagtttaagaagactatttgtccctctcccctttctccctgacttagaccatttagcgaacattctgaaaaaatact

SEQ ID NO: 269 - DNA, 1825 bp, Mus musculus
tttccctgctggcacctcatacagcttcatttctgcttgacctcagcatgagctggcaggaccagctgaatccctatctgcttagtgtcagagcctttttctgttgaacagccacattgatctccagttcactgtatccttcaaacttcagcagtttctattccattactcattgatacgtgtgggatgtggtaagtttgtttgtttgtgtcccttataaaactgtcagcctattaagccctcattgaatgaatatctggattaggtttgccaaataaaacatcactttcccagttacatttttaaattttaaatactcattgaaaaattgttagtgtcttagtgacagtcccaaatatacacaaaactgtcttatattaaaaatgaagcattgtttatcataagaaactaaatttaactgtacattatgtttttatttggtaagaaattctagaaactctcagatacattttgatttcaggcctttcttaaagctattcttccttaagaattgttttgagcagggctgggaatttagctctgtgatatatatagtgcttgctaggcaagggtgggtccctggttcagtcctcagctctggagagaaaagaattgtattgagcaatcaactgacgttttatctggtaacccttggatcacagagctccaggatgctttctgttcacttatcttgcttatgtatttttcattttgtctattaataagattaatacacatagtttttactaaccctgtattgccatggctacatttaggaaccattagtctggaaattcaaatggcattgctaattggtataaaagcatacagatgtccacttggagtctgctgtgtgcgtgcaatagcttgcctgtttcaccctcttccactctgtgcccagcacctaacagcagtggcacatgctctgaaccctctacttccttccatccttccacaggcattaagatcaaggggatttcttccttgaaaccctgccttgttaagtcattggttctcaaggtgcccttggtccctaactgagcaactgtcagccatccctgggaacttgtcgttcaagcacattcttagacccatccagttctgccactgagaaaccccgggtggggccagcaatctaggttttaatcagcactccagctggcactgatgctgactcaataaccatcaggaaagacaatagctccctgagcttctctatataaaatacagatgattgatgcatgagtaattagcataatgcttaaatgtagttgcaaataaatctacaccggcagtcagattttagcaggcgttctggtctctctgtttgtctttgagtttctcctctcccgtagtcttcttcctgtgaagctacaaacttagttcttcacattaacccagtatgtatgtgcaaaggaggaggtttaattattcactactcacccctcactccctcactctcatcctttattttcctcatctgtatccactggaggttttgatatcttctgagatggtaattcccccatcctcatctgtcatgtctcagaatgatcttgactaatatctcctgattaatactgaaacccctcaaaacccttagctagccactgttgacctgattttcaaattcacttcccagctccccaactttaaacagggcctcactttatcagaacacagagtcttccctgcctctgtgtgtttccaaggctctggcctcagtgccaacgcaggccttccgtgtacacatcaccatcagcagcccatcacattgactcctactcctgccagcagggatacttttaaatacacatagattctt

SEQ ID NO: 270 - DNA, 2475 bp, Mus musculus
acttcaaatgatttaattaaaaaacattcttaccactgtacccatctgcttcagttttagctaatttcagatatagttgaggtgacaatcaagaatagcaccacggcactgctcttagaaaagacagtggtgtgtccatgggattgaggtgacaatggtgatcaatcagagcaatgtgttctgcttttgagactcttacatcgtgaaaacatggtctacagaatggagaatgtaagagagctttactctcttcatgtgacaacccaaaagatttctatttacttcttcctgcagtttttaaaaaaattttaaagcatttatggaaacaatattatgtaagtagcaattaaaaatatatatatgaataaaatgcatggttaaaatcaagtataaagtcacagaaaatcatactaattgggaatgttagtagcagcacagtggctacttgaaatgctttctttctatgtctaagtatagtccatttgactatctatctatctatctatctatctatctacctatttatctattatctatgtatcatttatctttgtctcggtagctgtcatctgtctatctatcatctatttgtcatctattatctatgtatcattaatttatctatctctatttatctatcaattacctttctatttatctatcatatatctatctatctatctatctatctatctatctattgcctaggtacctatgtatccacccatctatctaacataactcaaactagacttggaagaacttttattgtctattatctaacagtagatttgtaaagaaaagtgactaaaataccctatggcaggattgaaatgaggacccaatgtggaaacttaaggcaaattagccttcctgccagcctgtcaggtctaagactgacctgagacactatcactgtattatctcccagtgccccagctcagtgttagacatttggtcgatgcccagggtgctggtggagaccagcccccttgcctgtgcttggctgctgggtctgtgtctccactgctgctcccactttgtgccctacagtgtacctcactatttgttatatcagtgttctggctccttttttctttagagtctgggcagctccacagcttgttccaccattctgaatttctctgtgaagctgggattggaaaacaaactgcaccatgtaattatccttgcaacactctcctctaagacttccaatttaatagagttgccaagatttaaaaacattaaaacaaaaatgagcttgttagagtagattagacttcataaatgtgttcctactttattatgaaacattgatttctgtggtcacctcctctaaattattgaaagctggggggactgctttaatcaccaagaagaaatgtcatcagtcaacagctatagaagttggtgtgggagggtgcatggagaggaagggagggtccaccccagctgagtagtcagtggggaacatcaggggagactcgtgtccctgccctggtgcagctctgatgatagccagcccagtctgggataggaggggaagtctccagtgctacatggtatgaataaacactggaacccaagattacatagctgacatagtcgttcttatttctaggccttcaccctctagtctcttaggatccccaccatatagtgaggcatgaatgctggcctctctcccagactcttacatggattaaccatcccaaaggaatctgcacttgtctctgggctccttagaaatcacagtagtcagtgttgagaaagaagagctcttgaagcttcttaaccatgactttgaagagttgatctgtggctgcagccagccagtgttacctacagctgtttgtcagagggagaccaaatagcaggcagccgcacatctcagcggtatgtttgccactccttggtcatgttcttgttcctagagcactagttgactctgaggctaagttccttgaggtaggcccagtgagacaatgagcttctaaaggcaacagcttcatacttttcatttgcttgaagaaaatggtgattgcccaacctcaaaccaaatcccaacctcttctgaagcagcctggctccttggacacacttcctgaatttctggtttctttagcatattttctcattgctatggctcacttctgcccagattgtgtttattaaaaaaagatctcccagtgataacaaaaacaatagcagcagccagccaccaaaaaatagctctaggaatgaaattaacaatagagatgaaaatgtatataataaaacttgtaaaacataaattaagtacattgaagaggatataaaatatgggaagtcacccagcattcacagataataagcgtcagtgctgtcaaaatggccactttctcctccagattcagcacaattgtctcaaaatgccagtgacattcttcacaaaactacaaaatgcaaacatagaatttttatggcaccata

SEQ ID NO: 271 - DNA, 2875 bp, Mus musculus
actttagattttaaaaaaaattatatatctatttcatgtatgtgaatacactgtcactgtcttcagacacaccagaagagggcatcggatcccattacagatggttgtgagccaccatgtggttgctgggaattgaactcaggacctctggtagagcagtcagtgctcttacccactgagccatctctccagaaccctaaaagtattttctaatgtatgaatgttttgctggcatgcatgtatgtgcaccatctatacacttggtgtcctcaaaagccagaacaggtgttgctgggactggagttacaggtggctgtgagccactgtgtgggtgggaactaactaaccctggatcccttgcaagagcaaccggtgctctcttttaaacacacgcagtttgtgtgccagtattttacctgggtatgcacctgtgtgcatgctgcctgtagagcctagaggaggggagaggacctcctgggtctggatttacagatgggtgggtgtgagccaccatgtgggtgctggctatcaaaactgatcctctggaacagcagccagggctcttcaccactgaaccactgctccagcgcaattggcacttcttacaagggtacttttatggttgcttaaattgtcttttctattctctcctttcttcctgtgttgggtagaacctagggcctcctgcatgccagtcaaaagtttactcaatccttttcctaatcttactcttaaaggttaaccataaatgccttcaaatgttaagagatggtgagttcttggagatggcttaattagtgaagtacttctcagacaatcagatctggtgtggtgccaagtgcatgtaatctttgatctctgggataggcaatctaagtctacttggtgagctcacagagagaccctgtcttaaaaaacaaggtggatagctcccgtgggaatgcctcagtctgacctatgacttccacatacacacgtatatccacatatataaatattaagactaattcagggttggagagagtacacaggttctgttctcggcactgctgcttacaaatgtctaacaactctggtttcaggggatccaaagccctcttctagccaggcatgctgtggggcctcgtagcaggccccgagccaagagaggggccaagttgtgtgcaaatcccggaaatctcgtcccagatctgcagtagaatggcttcccctgctctgggcctttgtgtttctgtgcacagccctgtgccccgacccttgcctcaccagagggggttgggtagcacagtagccaggttaacttcctctctccttataaggtcatgcccagcagcatctagaatttcccctcatgaacccccagcactgtggccaatgatatacactcacaccctactcaccctacaaaaggtttacatagcttttgctctcccccttagacaagctgtttcactgatgctgcctcccccgaatctgttcttactgcctgtgcccgaggttcttccactcccagccctcccacgatccagcagttgcgattgttgttgatcacaccacagcagatgggacagcagaccctgaacagcagcatacaagggtgcaggcatgcatgtgtgcaggcaaaacacccctacacaaagaaaaattaaaatgtgtaaagttgaacatggagggctggggaaatgacccggttaaaagcaatggcttttctctctcagggggtattggagttcagtttccagcactcgagttgagcaggtcacaagtacctgttggattctagagaatcccaacactcttctggtctccaccagcacccagagcacacacagtacacattcatacgtgcaggaactcacacacacttaaaaagggggaatggggggctgatgagatggctcagcgggtgggtaagagcactcattgactgttctgtcaaaggtcctgagttcaaatcccagcaaccacatggtggctcacaaccatctgtacagctacagtgtactcatatacataaaataaaaataaatacatctttaaaaaaaaagggtggggagggactgaacatggagtcagtgtaaacactttgatatacattacacaggtctacatgtctcctaggtgtgcatgcttatacttttactaatggaagcagctataccatgatacattcatgggggaaagaaatctgtctcaaaatataaatatgcttcatgaattttgagttcaagtgcaatacagagtgagttcagcctgactctgcctccctagtgttgggattaaaggtgtgtgccaccatggccggttgatacatttgctcttgtgttatctatgctgctttaatactgtgtatgtaatatgtgacatgcaaatccctagaaagaagagctagctgttgggtagaaaaagacacaaaagccccgttggtcctggtgagtgctgcacactaatagacaatctctggcctcacaccacaacaaaagcttacccaaaactgcttcagacaatcagaacattcctgagcttggaattctaaggaaaagctcacaacaatgtagggtcttccaacacaagatgtgaaaattagttaagttgcagtacatagaaagggaaaaaaaaaatctccacactgcaaatagcttttcttttcttttctttttttttttaagatttatttatttattatatgtaagtacattgtagctgtcttcagacactccagaagagggagtcagatctcgttacggatggttgtgagccaccatgtggttgctgggatttgaactctggaccttcggaagagcagtcgggtgctctaacccactgagccatctcaccagcccgcaaatagcttttctattatacttttttttgg

SEQ ID NO: 272 - DNA, 2825 bp, Mus musculus
tgagggggagtcccagatttacattcatccccaagaaggccagccctaagctttatggtcagtgcttgccactcgtacccactttacagataggaaagccaaaggtcagaggaggaaatcgtggtcatgtgactcactgtattatgatgccaatacaagtgacaggtggcaaactggccttgagggtgaggtgacttataccctagtcatcacaactaatgtgattatttacagaccaaataagcacatcgagggaacatgtcactgtgcccaggatatgctctgtgtcactcttctaacatccacaggcatcccaggtaccagcaatggccccatcctttggagatgtaaacccacactcagagttcaaagtctcatctggtacatgtgtggcaagcataacccaaacccaggcagcctggcttagaggcttgggggggggggggcttgggggttagggttccaggcccagaacactgccaaggcccagcacctcagcactcagctgtttgtctgcaggcagcaccgtggatggctcatcccacgctagtgatgttctcttgatgggacatttgcctaagagccacacttgacatttcactgcaaaatgccatcatggccctgggacgtttgaagatttttaataattttaattttaactggcctcattgattttttttcttttcttttgtttttatttttatacctttgggttttttgtgtgtttgttttttgttttgtttttgttttggttttggtttttgtttgttgttgttaattggacagggatgttcttcgtgagccttgaacacctcattcttgtgtggtttggatcccacttgcttactcttccatccttttcctaattgcctccctcctcgtggcatctgtctctacctgactcttcacacatatggtccctctctgtctccctagctatacagcactgctctctccatctctggatgcctcccatttctgtctctgtccccacatcttcccttaatatgtgcattgtgtgtgtctatgagtatcatgtgtcagcccctgtctcttctctcgcatgctgtctgaattctaaggaaacagctatacacagttaattactgtcaccccctggagcagctcctggcccacaaaccttgtgggcttagacgggcataaaaagccatgaagggtgccacacagctttagctctgtcatttctgttcacaaaatctaaatcgcaaaataacactttgtaatagaataaattagcatctcctggcttttagcatttttcatgttcaaaataatacatattcattaaagaacttaaaaagcaaaagagaaaaatagcctcttatctcacccctacctccggactgctggcaggttctccttctaaatgtgcactgcctgtttgccttttgaaaagcatagccctaattaaatattgccatgctgtgcacccttcatattaaattatagctcattttataagctcttcatagatatcactttacttggtttaaatttttatatagattcaaggtgtttccccctgaccaaagaaccaccactaggtttggttgatattcaatactgacattttttttttttagctttaatgttcattggtttctactctgattagtattattccctttatctttcttttgtactgttctctttttgtatgatttctttgctctttcttttgttggctggttggctggctagctggctggttggctggttgcttggctggttggctggtaggttggttggttggttggttggttggttggttggttggttgtttagttgattggctggttggttggtcagttggttaattggctggctggctggctagctagctggttgcttggcttgttggctggtagattggttggttggttggttggttggttggttggttggttggttggttgattggctggttggttggtcggttgattaattggctggctggctggctggctggctggttgcttggcttgttggctggtaggtaggttggttggttggttggttggttggtggctggctggctggctggctggctggctggctggctggctggctggctggctggctggctggttgcttggctggttggctggtaggtaggttgattggttggttggttggttggctggctggctggctagttagttagttagttagttagttagttagttagttgattggctagttggttggtcggttggttaattggctggctggctggctggttgcttgactggttggctggtaggtaggtaggtaggttggttggttggttggttagttgattggctggttggttggtcggttgattaattggctggctggcaggctggctggctggctggctggctggctggctggctggctggctggctggttgcttggctggctggctggtaggtaggttgattggttggttggttggctgactggctggctggttggttggttggttagttagttagttgattggctagttggttggtcggttggttaattggctggctggctggctggctggttgcttggctggttggctggttggctggtaggtaggttgattggttggttggttggttggctggctggctggctggctggctggttggttggttggttgattggctggttggttggtcagttggttaattggctggctggctgactggctggttgcttggctagttggtggtaggtaggttgattggttggttggttggctggctggtaggttggtttgatggttggctggctggctgctcggttgcttggttgttgtaatgctacag

SEQ ID NO: 273 - DNA, 1900 bp, Mus musculus
acccacatggcagttcacagccgccatctgtacctccagttccagggaatccaacaccctcatacaggcaaaattccagtgcacatgaagtaaaaaacaaataagtcattaaagaagaaatattgccaggcagtagtggtgcatgcctttaatcccagcacttgggaggcagaggcaggctgatctctgagttccaggctagcctgatctacagagttccagaatagtcattgctacaaagagaaaacctgtatcaaacaaaaaaacaaaacaaaagaggtaattagttatccaaaattgagtggtcatcccctagaaacatatatgcaggcacaactttgaacagacttagcaggttgtagttcagtgtttatatgtgtatgcaacaaattttctttccaaggactgttccttttatttgcatatataggtcatgtaaaattcctcattgagtgagtggctacacctctctccctcttcctagcctcctttcactccacttaggccttcttacccatgctccaagaacccactggtgactgtcatctggtcagagcagtttccttcctgtttgcgtcttaattaacctgccagcaggatttgagttaatttctctttccttggaagactgctcttggctttctgctgagatggcttcctgctattagccagtttagcagaacttttaaacaaaggcagattctgttgtgccgtttctgtgtcagtttcccgggaatactgtttctcatcatattcagaattaaagtacactcacatccatggcctataaataagttttctggctcctgcctatctctccagtttcagcttgaatggtgctggctttgtgatgtttcttgaacctgccaaccccccccccccccgagccattcgacttgtcattccttatgtctagagagttagctcttcgtccagatctcttaatggttctctttgccctgttacttagcgcactgctgatgagcaggctgtgaggggcagggacagatctcagacactctgctgcctccctgctgctgctctgctttgtttcctccaaatcccttgtcccagcttaaatgacatgtctgggaaccacgcacactttctgccctttgtctacctgggtacttttctcagtgtcccaaataacccagcaacacttgctactccgtgaacatattttaaatgaattctggtaagggggtaaatccgatgaaaatgggactgtttccgttagatttggtaattgccagtttttggtgtccttgctgagtgatttcagaggactgataagtcagtgtgaatggatcaggagatcttgtgatgtctttgacccgtctacctcactcaattctatcccccaaccttcccaaagactccccaagctccacctgatgtttggctgtgggtctctgcttctgtttgcatccactgctgaatggatcctcttagagacagctatgttaggctcctgtctgcaagtatagcagagtatcattaatactgtcaggagttggctctcttacatgggaagtaaaggtggtactgggggctgggagcatgatgggaatgtaaagtgaataagtaaataaactttaaaatggatcaggagaacctggagaaagggaaattgagaaaagtcaagcaacagttgtaagagtttgctgagacaggataagtggagtcaaaaagataaaaggtttgatttcaatgacatcattgaacattgtccagagacaacatggcagggccggccttcacataaaaggggcatatctgtcacaatacagagaaactcaggtcgtttatgcagtttctaatgtagaggagacgtggtgttctgacctgacctggtctggtctactacatgagaattgtagctaggtactgagctaga

SEQ ID NO: 274 - DNA, 3950 bp, Mus musculus
aaaacctgtgacactcctcccatcaggaggtagcatggactcttgccagcaaaactaagagcaagcgaagctagaagtccctgtgtctagtctacaaggatctgtgacttctaccaccatctcccctaaggaagctggtctatcagcagtctgtgtctgagatacaagcaccaagttctaagtggaagcatgaaaagacataaaagaggccatcttggatatcaaaatcttcctgactcctctgttgaactgatagtctaagacaaaaccagcaatcaacaccaacaaataaaaaaattacaggaaatgatagattacttctgctttagactgtcaagagtaaaggcaccttgttattatagaaatagttaactggtataccttctccacctgatgagaactatcaaagcatttccagacagtctacggtggaatttaccgaggcccagaggcccataagccagaaagccacatctgttcaacgtgtttctttctctccctccctcgtcctttcttcctctctggcttttctgccctctcaccctccttcttttgctcttttctgcctgtgaaataagtagttaacaggcacccagtggtccttttattccacaggcatctgcgctcagcgagaaggccaagttgattccatagatacttttgtggcttaaaggaatagtatcctaacacacaagccagaggtccttttacaaaccagggcttctggggaacccaagggaagttgggaatcatgtggtccctgcagatggtgctctggatggtgactgtggagtcctaaagtcaccttgaccaagctactctcaagagaaacagcgtttcactccatcagtaggtgagcagcctgaatctctctcgtgactccagtgtcctagaatgccatcagactgttcttctatgtgtcagggggcatgtactgtctgaacagcatgactaccacaataagtcctgatctgcctttccctgggattaagtctgactcctaaatcagtttgcagagaaaaagcctgctgagattcaagggacagctctgtcactctgctctgtggtctggtaaaattccactcactcactctccaagatccagtcctagtgtcattcgctgtggtagcatggcttactttaattcctcctccccatgtggtagaaaagcagctttggatgacctgtatccttcccatatccttcccatatccttcccgctgctctctacactccacccgtccagtgatgcacagactggggtcacataaggtaagcgtcttatcaccatccgttagtgtgcacctgaccctcggagactgtggaagaaaaactccctaagacatttcttcagcaaatatttatcaagtgccttctctgtgccaggtacttgttctgatgtcacagcagggaacaaagcacatggatgtctgcctttggagactttaatttccactgagaggaaacaaacaataaatagaaagtattaagtaaaacacagcgcttctgggagaggaacgaggctgtgcagaagaaaactgaagaacgggaaataatgtgagacacagcctttttgaacagcagtttcagtttgagcaaagattggaggatatggaaggatttagctaaatatatctgtcagaagagtcctctaggcacgggaaatagcagtgcaaaggtcctgaggttggggtagggtcagattccttgggagtcagcaagaaagccaaggtggctgtagctgtgtgaacacaagggtgtgctttagaagacatgacaggatttcaagcttttagtctcaggagtgggggtcagtggagtggtgcatcccatcttgtttgtttgtttgtttgtttttgtttttgtttttgtttttgtttttcgagaaagggcttctctgtatagtcctggctgtcctggaacttacactgtacaccaggctggcctcaaactcagaaatccacctgcctctgccccccaagtgctgggattaaaggtgtgcgccaccacacacggctcttattcttttaaaaggctagctgacaatttctgtgaagacaagactttcgggagaaactcaacgaagctcccgaaaagcagtcatcacaaaccaccggacagatgatggtgaccaggaccacaggtgacagggaagaggatggaaagtagtcagacttcagatgagtttggcacagcatcatcagacagatcagatgtgatggttggcaaaagctgaggtggactggccagcagttagagggaaagaggggctgcgactggctgagccgaggagcattgtgggcaagagtccagaacaatacaggttcagtttgatatccctgttagatgccgaggagactgtgggatgctgggttacagaatcctttgaggaggtgtaggctggagacataaatctgaaggagctaataaaccccagcatgttatttctctctcttgatttttatctctccaacggtaagccatggtggaggtgaagattagctgagctattagaacaacggatcctctacaagtcattgcaaacatagtcatttatctaaacggcagctcagcatcccgcacttcacagtctttggctgtctgcctttgctggcctcttcacttctgataccatttttcaggcttgtactagaccgtgctcactcagaacaagagctcagctgcgccggggagcagctggtggcagaggatgagccagcaaactctcaggtaaccctgcttcgactaaagaaaggctcagtagacagaagtggggaacaattgtccaatcgtcataaagccaacaacagaacagcacaagcttaaagggcagacaggaggatgaccactctgtgaatgctgctgcttctatccatggggcagagagatacacaggcctttgttctttatagcatagagtgggggctctttgcaggactgccttaaaggagggtgaattatcatcctgctgaacacagggcagtctgaattggcatctcttattccagcgtagatattcacagcatttgatgttattctcacaactacccaggttccagagtgagccgtcgcctattctataagcctctctttcagcatcttattttctccctaatggggccagcctggctttctctgatgatccagaagattctgacattttaacatttataaattaatctactttgcatgggctaatcctggaaacacagcagaaggaaacatagatctccttgctgtctctaattcctaaatccctggcgagctagactcaggactcaggtaaccatctgcaactgtgactcttaaaagtcactggggtattaggagatgactctgtggttaagagggcctgctgcttttgtagaggacctgagtttagtcacccaggtcacctctaaagtatcaaacccccctcttcaggcccctgctgttacctgtacatacttgacatatacacaccccaaactcactctctctctctctctatctccctcccttcctccctccctccctccctccctccctccctacctccttccctccctccctcctcccacctctgtctcaaataaaaatacaattaattttttttttttttgagaatcaatgactcttggcacttggacccctaaagcctatggctgagagtgtaatggctcggggcactcctttagtgggttttgaaccatactgcccagttttaatgagtctgtaccagtttgttaatgacatctctttccacacaggcaggaaactctcattagatatttcttccgtgcatagcagaacaggaggtggcaaagattcacacatttcccctgagtcctgggcctagcacaagcatgcacatttgaatatatcaccaggacttaacatagaaagtaaaataattaaaccaggcctagcagagcagagagccatctgaaggcataaatcctcacgtgctt

SEQ ID NO: 275 - DNA, 4625 bp, Mus musculus
ttcaatatatagctgactgcttctagagatatttacatattcaaaagtaagactggttaaaatgctttgagaccaggaaatttccctaaaagagtctgctttaatctcagtttcattttctgtgcagtacagtaatccatccttactaaccctcactgcttgggtactgcatgtgcagagaagcagtctgctctgagagctgccgtcaggggttgggaggaaaccctatcttctaaaatgtgtttccaatacctgcttctgtgctccacccaggcattcagacccttcctgttgttcccctaaatgcaacaagttgatacatttatcacctaagaccacaaagcaggaaactgaggcttagtgtactaagcagcactggaatccaattttggttccaaaatatattactagtcacaattttccctaagaagttgtgtgctgacaaggagatcacgatgaatgatgttacctgactctaccttgtatgtgaatgcagtgttacgcaatgcgatacacaagaacacatggctgaccctaagcattatagcctcttctttgttgtgcaaaagggtgctataggaggagtaaacgtcacagaatttgggagtagctagcatcaaggcaaacttcctgattctagatctacctgtgcttttctttctcgatataatatagaacttaaggatagctcattgaaaccagacgttcagtttgcataggtgacatggcaggccatgtgttccaggaggctaccagaaaacagattcttaagaacagtctaagtttactaaagactttgaactggatgaacccacctgcctggtgttctgaaggccagctaggaaggagacaagctaagcctggagacaaatgcttaagggagctgggggtgctgctctcagcttggctgattctatcttatgccaagagcgaggagaccaagaagcataaggttcaggcacatacgttgtgagaagacaaagggccagtgggcaaaggaactgtacatggtggcacaagcacgccatccttgaaatggagaggttgagacaagaggataatgggtttagaaggcagtttggggttgacagctgttgacaatcaagcatctgcccttctcaattctactcaaacattctaaactgatgtatccagtggcagaccacggatttcatggcacacaccctcacatcctccccccagctcctcccattgcacgtctggtttcaatgagctatcctttgtatccactcaacttgcaggacttgcccattccctgtctctgaaccaaaaacaaaagcaaaaccaaaatcgaacaaacagtaagaaagaactgatgaagaaaatgaggggaaaaggtagctgggaatcactcaaactttgagattgttgatttcagaggcctgcccgacctttaggctgagtgagtgtgtgtgtgtgtgtgtgtgtgtgtgtgtgtgtgtgtgtgcgcactcccacgtgcatttaaaagtgtacatacacttcttttatctatctatctatctatctatctatctatctgtctgtctgtctgtctgtctgtctgtctgtctatctatctatctatctatctatctatctatctatctatctatctatctatctgcagcattaaacacagatgtctgagtcagtgcaggaaacagagagcaagaacacagaaagaggtgaagacaaaaaaatcaagtagtggtctaaggactgaattagatacagaaggaaagaaataaagttagaacagagcctacaagataaagcagaaaataacagacgtctatatgttgaccaagtgagtaccacgaataggtttgcaagagaagttgttcaccctggatcactcaagccaacagcaggctaagacagatgctgagacttcagaagagacgtgtgaaaggaggcatagcaatattaaagagagatggtgagcagggaccagccatgagctgagtggattcaaagcacctcactaggcagagaatttgggatctggagcagctggtaggacggtgtaagggtcttggcctcatgatatcagtggcacttccatgggatacatcatcactttagaatgtttgagtaggattgagaaggggagacacttgatcattaacagctgtcaacctcagatgtttgaggctacagcttttagccctgtaggagggcagcatctattgatagggaggtacccattttaattcttaagaggagaaatgactccctatgacttgtttcaaggtcttagacatacgctatccaaaggaaaggtatgcttgaaagaacatccccatttctgggaaagaataaaatttaaaactcaactgcaacaataaagaaagttacttggtattcactcttcatttatagcaaggacactaacatatgagaagagcatcctgattcagagatccaattctaaacatgagacagaagttgttgctgacagcatataacatctgttaagtattatatatttactgatcatacttaaaatgcatttatttccacaatacataattattttacatagcaagtcataaaagactgtgtgagcctgtcagtgtatctagacagtgtatcaagtataattgtatgtaaatgtggttgcattttaaaacaagtacaattcactctcttatatgactgggattatcatggccccaaatgctaattttccaaatgttataattaaaagggaaactatgaaaggatgtaatttttgcagctgtttttaacattttaaaatgacatttggagctacacatactgtgttaggtccaacaaaaaagcacagcataccatctatttttatcaagaataaacttttcttttcattaaaagacagctagcatttttttaggtataactgcacatcttgcaatttacattcctgttatcatcagcaatagaaaatgagagggttggagtttctcagttcacaccattactttgaaagtgagactgtgattatttttaaaagagagaagaaaatgaaaaaaatttaaattagcaaaaaacataaatatttgcatccttatgctgctgtaatactgattagtttattatctctaaagtctggtctaaaggcaggagcagacagctagccatgtcctggcagcattttagctgacagctatagtggtataggcaaggggtgtgaggttccattagctctagactgcagcatatgtagaagggagttcccagctggtaacagagatgaggggagacagacatactggtaaagtcttgacgtccaactctatcgtccttgggtatcaggtatatggttaggaagcaaaaaataaaatagaattactggccattggatagacttggattctctgttagtaactctgggttgtagtcaatgtaggtctaccaaaaggatgcatacctcacacagctacacaaggctggtctggaattattacattatataattgtatataattccattttcattgcatactggactttacaaaagtactgtgtctctgatcacagataccatctgaataagccctagccagtgcctggatgcttaatggcattctttagtgcaaatcctcctaacaacagcctagcatgtaggagagaatgactgttctttatctggtccattgcagggcattatttttccccctgggtatcaatgctcatgtaaatgttcactgttaaactaagaaaacgtactttgtagggatgattgacaggcttttctaacctccccatgtcacaccttaggttacccaacagtgaccactatataattgcagttcaatggtgtgaggcaagaagggtgtgacacaatttaatctgaaagttatcctctagttaagccagtttgtaatagaaatatccaaagcatccaggggaggatttgctaaatgaactttcacagactttctttcttgcttgctttctttcttgcttccttcctttctttctttcttttttatcgaggcatttttaaattaaagtttttttcttcatttacactacaaatgctatccccaaagcctgctataccctcctcccaccctgctccccaacccacccactcccgctggccctgccattcccctgtactggggcatatgatcttcgcaataccaagagcctctcctcccattgatggcctactaggccatcctctgctacatatgcaagtagagacaaagctctgaggggtactggttagttcatattgttgttcctcctatagggttgcagacccctttagctccttgggtactttctctagctccaccattggaggccctgtgtcctatccaatagatgactgagaatccacttctgtatttgccaggtattggcatagcctcacaagagagagttatgtcagggtcctgtaagcaaaatctttctggcatatgcaatagtgtctgggtttggtggttgtatatgggatggatccccgggtggggcagtctctggatagtctttccttccatctcagctcagaactttgtctctgtaactccttccatgggtattttgttccccattctaagaagaagtaaagtatccacactttggtcttccttcttctaattgagtttcatatgttttgcaaactgtat

SEQ ID NO: 276 - DNA, 3325 bp, Mus musculus
gtatatgcaaaatctctacaagaactatttcaaataattcaaataactaaaggtgacatctaaaacacaaacacacacacacacacacacacacacacacacttttaggccattcaacaaacatctaacacccgcctttacatatattctcaacactcatttaatcatgccatgtattaagttctgcacagccaaagctgaagacggttctccctgttcttacttaaaaaataaaataaaaataaaacttaatgttatttttaatgaatagacaaaccatttctttttacttctcttttttcccttttttgttaaacttaagggacttaaaaaaagaaaaaagacattcactagggtcaagctttcacctgcatcatttgcctttgtctgtgctttagggccttctggcacacagtaggcaggggcaatcgcctactaaccagagtggacagtgaaaaccaaacacaggaaagactatggcatttgccagaagaacagagtgtgggtgacagagctcacttacaatgaaatacagcactaccatggacacaagcttactcatcaaaggcaaggatttccatgagacttccccacctccttctagactggatatatttcaaagaacaaaagggctgggcaacaaattccagtttccatcccagcactaaattattaacacatacaaagacaaacaaactgaaatatcaacacctccttcaaggtcaaccaccaaatttgagttatagaccatggacacagagcaggaaattcccagtgtagacagctactttggagaccccagtagaacagaacggtggaggatgttctactgtgcaacctcaatgtggacaagtttgggagagagagctgcagggggtgggtcctgaagccttgcaggttaataaaggctttagtgattattagcccaggggttctcacagaaaacagtatggattttcttacactggcaacaggagcaggggaaatagaacaagtggaataccacagagaatgctggacttgcttaacaagacctgtacccagagaactcattttactggagagtgactggccacagttatctcagtgcctaacctgtctagagaaaaggaataacaactccagctctctctaattatcctgcctacctaaggcagaacctggaaaaatcatggtcccatgcaaggcactgagacctaactagacactgtagaatgttcgcactttaccatggtttgccactgtatcaccacaggcacattaccatagccctcttatcttgagcaggatgtccatcttttatcacacttcactcctgggttcccaacacacagaatgtaacaacacaaagcatataaagaaagaaaataaagagtttgaaaatacggaaaaagcatcattggcatcaatgtctatagcgtcagtgtctatgtcaacaacgttgagtcagggttccatacatatgtcaagaaggctgagattatcagactaaggtatttaaaagaatatatgcaaatgaaaaaaatacaccatatgtgtacatatgtaacatgaaagcagaaacactatgatcctaagaaataataggaaatgatgtcacaaataaaacaataacaactacaacaacacccaaagggtaacagcaacgaaaactgccttactgccttgggtagcttattagtaaattggacacagctgaagaaataatctgtaaacttgatcatacttcaacaggaatttcgaaacgtgaaaatcaaagatgtcaaagccagagatacacaaacatatacaaaacaaagcatattagagtcgtgagaaagccacagtgagtgtgacacatgagtagatcaggaggaaagaaagcgaaagttcataagaaatgttgacttgaaaatgattgacggtttctcccattctaatgtcagacagcaaaccatagaaacagaaagctcaagatgggagaaaaagtaaaaaacaaaacaacattaaaaaaaaaaaaaagtatgggcaactatgtgcaatccttaggaaaaataaaatccaagacagagaaacacttctggaagaagtccaaggtaagtaacctgtagaggaggaaagtcagagctacatctgacaaccacacatatgccactcacactaagagaatgtggatacatagttaacatacctgctagctagctatctgtcaacatgacccaacaatgatcatctgagaaatgagaaaaggtctccatcatactgaaccaaaggaagtttgcaaggggatcttcttgattaatgactaatgctatgactgatgttggagggccaagacatcatgagcagactgctgagtaaatgatcctgtctaagaaagcaggctcagcaaggcatggaaagcaagccagtgagcagtgtctgtccatggcctctgctttcattcctgcctcacttccatggccctgtcttcagttctggcccagatttctccaccacgatgggctataatttctaggataaaatcaaccatttcatcctgatgttggttttgggcagcattttaccatagcaatagaaaaatgaactgggacattgtgctaaggaaagatatgagcaacctagaatgcagctttctgtgaaaatgttctccaaagacagaaaaactaaaaacttgtaaaatttgttcagataaaaaaaaaaaaaaacccaaaagtcaaaaacaaagacaaaaaactgggggaatgtgttgtctgtagactatttgtgcttcagaaagttctgaaattatgactcagaaatgacctacaaaatagacaagcagtgaagaaggaatatgtaaagagaaatctcacttagctaattcctaactgataaaacaagaaacagttttttcaaaacaacagcagcaatacatctacttgcacatatcatacataccatgcatgcacctgtgcatggtagacacatgacaccaaggatgggatgaattaagaaggcttatttatatcctcaggaaaggacattcactcacacatataggagtgtcatgttactgcaaaacaaacttggattagctgcaaattccagagcactttgcaaaagaaatatgactgacatgataagaaccaagaggaacaagtgatcatgtaaaacctttcattaaaaacacagagcaggaaaattgtggaaagcaaaaatatgcataaaaacacagcaacaaacagaaagtgacagtaagtatgagagatactgcactgactacatcaacaaccaccttcaacatcaatgatcatacactggtgagaagagatgggaaacatttaagaagtgggatttatgacaa

SEQ ID NO: 277 - DNA, 1950 bp, Mus musculus
ttcagggatgtaacttaggacttgagtgcaaacacctctcccagttgaaccaactcccagccaactgttggatgggattcagaaaagagttgtgaagacgctcacatgtgcccagggactacctgagcttatggggtttagagcaaggaggtgctcgggaacatgaatcgaccgacattcttaaagaaatagtttgctagcgtgtctgagacttctttaagcaagaatggtataccatccatgtgtggggctcttaacaagcagacagtagctggatcccatcctacttaatgaactgaagaataattagaagattcataaattaacttcctttgaacttaactgttaatttaaagtatattaatgtatgaaaatagttgttgagtttgacttcagagtatgaaatacgaatactccaagaattaaagaagcttttgaaatccaaataattttacttcttagtggcttataattaatgtaggaagagtataagctgcaaacaaatggcatactttaaaaatgagcttcttactcataaaatgctaattagctttctctctctggataatggctctggtgttcctccccacatttcctttctgtttttaagtcaaatgttagggagctgttttggagaaatttataactttaagctttttttttttttttttttaaatgaagtgactgtgcccaaaggaggagggcattgttaaagagcagatcatggctattaataagtcggatgggagaactaacagcttaaaggattcatagctttgtagccatacaccagacctgcacaggcatcctggtcaatgcctaggcccaggtcgcatggcatagctattaggtaagagagatgggctctaacggaagctacattggctcagatttcttcagcttgttctgttcacagtgaagctggtctgtttaaacactagcatcttgtcattgctcaggccagcaagtggcacttgaagctccaggagtcagctactccatgatatttctatgctcctgccatttggtcatgtgaatagttgacttccctgcaaggcacaggaggtggccaggtctctgtgtggcctttttctgcaaaggctgagtgaggccgagagagtccctcaacatctgcctgcagaaccttcgtcagcactcagcctctttgctgtgtccctctgggccagagtcctgagagtcacactggccagctcccaggacccatgcattcacactgctgacaatactgcctgtatttgacaggttggaaaaatgcttgagggaaaggttaaataaattaaagccttcagctttatacatgtataaacaaaagcttttcctggtattaaaagaacctccctttttgagcattaatcagtattaatggtattcttttggtcgggttacattattatttaaaaaagtaaccatgacttaagaaatgagtgttgatggccgacatttctgcctttcattttaatgtgtaatctaaaatggcagcttattttaaagggtgcttttggttataagaatgtttactatgttgtgataatcctctttcagcataatttctgtaacgacaaaacaagaatccagaattttagggtcgataatagtctagagaataaacatctaatgtgaatgtttccaatttggtgtgcctgtttttcaaacaaggtcatgaactctggtaaattaatctagatacaaatagcttcgataaccacagagtttatgtgagcggtgatagtagactaatgagctaatccattagcagcctactccaacctctgatgccttagcccaattgctttctctgtctgaattagttttcttgcttcttgtagtgagtgcaataatttctgtttatcacaagggttagtctgttttaattatagcaatttttctgagtacttatctttctaactttgtactatagaaacctcgaag

SEQ ID NO: 278 - DNA, 1950 bp, Mus musculus
gtgttgtgctaagacccacttcctacaccctccctccaactccatcctcaacacatctctctctgcttctatcaatttatgcataattattaagatagtgatgttaagtatcagtacttattcacctcaactgtacggtcataaatacgacttgcttcaggaattcgattctcataactctctgtccctgaagaaacgtaatcccatctacttaccattaggctgcactgctcataatgggatgttcaaggagattggtggcacaagcctgtgacaccagcactcaggagactgaggcaggaagacacaaggctgggcctaatctgagctacatagtgagaccctgtcttgaaaacaaaggaagatttgaatagcccttttaagcagtttaagcctttgctacattaaaaacaaaacaaaacaaaatacttactttttaaaaataacttatagtataaaagggacatggtagggctggagagatggctcagtggttgagcactgactgtacttccgaaggtcccgagttcaaatcctagaaaccatgtggtagctcacaaccatccataatgagatctgatgccctcttctggggtgtctgaagacagctacagtgtactatatttgataaagaaataaatctttaaaaaaaaaaaaaaaaaaaaaaaaggacagggtactagagtgcatgtggcccagggcctgacctctagatttgcctgattctggacaggttctgaggggacagcagattctgactgaccatgtatctgtgggcggcagaccagctcagagagctgcttgctgtgtgcctctgcatcctccagcagcctggctgggttgcatggtactcgcctgtgtctagctttggccttccctgttagagggaaggcatagagagaggccaggctttgagggggctctgcagagtcatgtctcaccaggcagctgagaggatggaatgactctcacactgctgagagatgcccacctcggtgtgtttctctcccatgtcaaggagtctgccaaaccagctgaagccagtagacagcattgtttttacaaggctggagagcagcagtggactccagcttcccagataaatatgcatgagtcatatctacataagccaattatgagatattaagagataaacttccatgaagaaacattctacatatgcatgtgaggccacctagaccagatggaaactgtccacccccaaaatatgggctacgcctaggacagaagaggacagaaacagagtggcatagtgacagaagaggacagaaacagagtggcatagtgatgggcaacctgccagaggactgatgtcttttcaaaagcacatgtgaagacagcaagaggggagggtgaggcaggctctgctgcctttcttcaaacacggagtccaaacaaaaagaagatatctgaaaattcacaaaatacctgtcagagcccagaggagccaaaggagagacatgacagctagattttagaaagctgtcctggatggaccttcagcccggggccttgggggtcgactgaggtcgaacctatcagccaatgatgctgtgacaatattggttaattgtgatgcacgcagtacagtgttactgatgcatgcagcatacaagcctgggacctggcagccctaacccccattctccataggccagttacagaggcatgtcacggtgtaaagcagagaacggagataaatccaattcacgttgggaagaggaacaaagacatccagtgaccactcagggaccacttgtcctctcctgacaagcccttccagggtcctgacatgaggcttatgttgaaatggaaggtcagaggtatgcatagcttgagcagtgaaatccctctcctggagacagttcttcctctgcctaataccagccttcaactttgtccttttcccagcataagacttgtggagac

SEQ ID NO: 279 - DNA, 2400 bp, Mus musculus
gggcaggctggagcctccttacgggccagcgtgcttcattttgttttgattatgttgtcttttcgtttgttgtatcccccaatccacagatgctaattgacctcacattgaatcatctttgtcttccatacttgcttgtgtctaattatttcaagcatactcatctgaatgtattatgattatctccggtccttcccttggattgcttagtttttcaggagtgtgtgttctccgtagctttaaagtattagtgtcataatagtgccatttgaactcacaggtgtgtgtgtgtgtgtgtgtgtgtgtgtgtgtgtgtgtgagagagagagagagagagtgtctgtgtgagtgtgtgtgtgtgtgtgtgtgtgtgtgagagagagagagagcgtgtgtatctgtctctgtgtgtgtgtgtgtgtgtgtgtgcgtgtgtgtgtgtgtgtgtgtgtgtgtgtgtgtgtgtgtgtgtgtacatgtgtgctggtgcttgcagactctagaagtcaaggtctggtttcttcctctatcgctgtctacctttttaaaattttttttgtcttttgttggttttttgtttgtttgtctgtttgtttgtttgttttttcaagacaggctttctctgtgtagctctggctgtcctggaactcactctgtagaccaggctggcctagaactcagaaatctgcctgcctctgccttccaagtactgggactgaaggcatgtgccaccattgccagccttaatttttttttaagacatggtttcgcactgaactcagagctcacagattggactggactagatggcaggcaaaccccaagggatccaactctcttcatctcccagctctgggatcacagtcacaggccccacagctggctttttacagggtgcagggatcaggtcctccctctgcacaggagggactttactactgaaccccaacccgtaggccccaagacggaaagtctcctgtagctctcaccctgctgtgcagcctaggctgggcagcacaccctctgtcgtggttacaggctatcgccactcctggttaacatggtgctttttgttgtatggttattaagttgcctctaaagatgtgtctgaaatccaaagatattttaagcaacttgcaacatttgagcaaatttatgatttctcaagctttacagctttggggaaaagcacttagcttgactgtcacaattttggtttcatcagctacacattaaagctatttctataattaaaaactccatgctttaggccacacctcattcttagcaaaaacactgctattttttaccagaatagtctgcaaatcattatctatttccagaaatcaggcttattctcagaggggaaacccttgcctttaagaggaaggcaccatgactgagtcacctctgagaagccgaagtgttgttagtcggtttcagcctgctcccctgtggtacagcagtgggcacatcactgtctaatactaacatacgtgagggcttgtacagaaccatggatctttccatccagttgcagaaccctagactaaagcctgcacctcctctctcacctttggtaactcatttgccatcaaaatctgactttacctgaattcatttgacaacaaagtctgctctgaatcagagattaaattcaaagtctttatcctgcttgttgtaaatattccattttttttcctactgtggaaacatcaatttttttttgagacagaatctggcctagaactcactacgcagaccaagctggctatgaacgcttgggtaatcctcttgcctctgccttccaaattctatctgttcaaatcttaatattgtttaagtgggtacacctagaccccttatatgtggttcaacataatatataggtgataaactgtttttcaaaaatccacaaaattctaaaaagtgtatgacctaggataacagaaaaagcttcaaaacattgtactaactagttatgatgcagacattgtactaactagtcatgatgcagacattgtactaactagtcatgatgcagacattgtactaactagtcatgatgcagacattgtactaactagtcatgatgcagacattgtactaactagtcatgatgcagacattgtactaactagtcatgatgcagacattgtactaactagtcatgatgcagacattgtactaactagtcatgatgcagacattgtactaactagtcatgatgcagacattgtactaactagtcatgatgcagactgttgtttttttttcttctaacaatcaaaacttaccagtcctgggtgctggagagatggctcagtagttgagagcactgactggtagttcaattcccagcaaccacatggtggctcacaactatctggaatgggatta

SEQ ID NO: 280 - DNA, 2075 bp, Mus musculus
actcaaaaaataaagcttttccttaaaaaaaaaaaaaaaaactgcagtcatctctgcacatttaagaaggaaaaatggcatgctgagactaggtagcttgcaggcaagctgagtagcactatcaatggggcagtcctctatggctcttggtaccaaaagaaattagaaatctgggagagaagtggggccagtctgggatgtgctgagtttctgtgcctgtgggacaactcagggaaatattagcagtagtcgctgtcacacagaaatgcagagacagaggcatggctgctgtcctgagggagatggtgctgtcacagtaggagaggaagagctggggataatattagagaatccctgtcattacagggcacagatataaagaagatatagaaataatatcaaaggtgtaggaccggggcaggagaagccaagagagaagagccatagaaagggtgtgggtgacagaaaaagctgaaaagacacaaaagaggaaagtgaggagaagcagcatcaggagtgggaggagaaggaagagaacatgaagaggaggaggaagaccaaatctataaaaacacaaagggggtagagaaggaagggaaataaatagaggagagaagcaggaggaggaaggggaggaagaagaggaggaagagaaggaagaggaagaagaggaggaagaagaggagcaggagcaggagaaggatgaagagggggaggatgaagaggaaaaggaaaaggagaaagaggaggaggaagaggaagaagagatacagtaagggtggaactaggaagcagttcgtagcaataaaagctacaaaggtatagagggagaggaggaggtaggagaggagaaaagggaatagataagaaagaagaagaaagggaagaggggaggggggaggagagaggaagacatagtagaaaaatcagtggaggttggtgaaaagtggcagaaagaggaggagggagagggacgaaagtccctgggtgtgcaggatggcaggggagcttgacctctgctgcctgggtttcctccttttgttctgaagatctgaggcttctggataagtgagtccatactttatgaagccacatccatgatgccaatcagcacacacagaaataagactccaaaggtgtgagccctcctttcccctgacactaagccccaggtatagaaagtcagaacaggtgaccccctccacaggcttagaccaaaccatagcccctgatgcctcactgccccccccttgaacatgcctgatggacatttctgaccctggcacatccatgtataccaggcctccagtgaccatcaacccagtcagtgcatttcattgccaaggcatgacaccatattacccagaaccttctggcatccttggctacctactggacagagcaataaccatgcctatttgtagcaacaagtcccccacattaatttgagaacgatgacatttggaggataatagcaaattgattccttggaaacagaatgaattttacctgtcattattaccttaagtgggaattcaaagggggctgtaataaataatataaccacattatatttattcacccttgatctatcctttataatattaactaaagaggtaagcagcatggaggagggagaattatttctggtatgacaggaaaagagctctgccggggaggagggcagcgcttcacgagagacggcagaatgtcttttagcaaaggcaagtttgtaatgagtatcaggctgactttttaaaataagagttattcaggtgtgaaatgggctcccccagaaatgaggtgggagtcccttagcttctcgggggccataataatgggttagtcatgtatgacagcttgcataatggttactccagtttaggaggctttgggcagccctcttgtgatttatacaatatcaatcggaaaagtatcctatttttgccaggagggaaaagtgttttggagaaccaggctcattgcagtctcctacaaggcaagctcttcatgctaacttgcaatccaccagccccagaatatgctctcatagaagagcctgtgaccccccaaag

SEQ ID NO: 281 - DNA, 2925 bp, Mus musculus
agacttatagttatctacgccaggtctttagcctgcacttaagaacctgtgtactcaaagccttagacacgaagcacagtaaagaggctaaaagcacaggatacagagcaagctgtcccacagcgctggctgtggctaaacgccgttggctgtgttacctcaccctctgcctcagtttccctacatatacaagaaggcaactacacctacagggtcactttgagtataccaagtgttttttgtttgtttgtttttgttttgttttgtttttagcagtttgcagaataacaagcatacggtaaatagctctccctcggtcatcagcccactctttaaaaagatgacttggttattttgagctctcatttccccaaatgagacagagaagaaccttcaaagaagtcacaaaaggggtgacatatctcacacaccagatggtgctttccctcacagggacaaaggacagactggataacactagaatttgactctaagttgtaagacaaaccaaaccaaactatccatgtaagcataaacacataatcctagaatgtcctcagagcccagagactgtctccggagcccatgttttaagtctgcaccctgcctgctggttaaacagtacattagacctccaggaactgcatctgtgactcacagaacccacaagagtctcatgctgggggagccttgcctaacccagtgacctgtctgacatgtaaactgatcatgtccactcaagctgccactcagggatactcagccctacagtgtagctcactcacagtgctcaacacagggagacacagacaggatttacaaagccaggcaaaaggtcccagcattgccacaagccatgtgtgccatgtctgtcctgcaagaaggcagtgtggcagttgcttgcctttccttggtcactcacacatctagacatttctccatcataatagtgacaaggttttgtttcgtgagtagagggacagggtccggagaaaaagaacaatgactccctgccttgtgtggaatcttgttgttcatgaaatcatttcaggaccagcatctttgaatgacacaacaccccgaaatgatagcaagtcagtaatgatgagctgtgtgtttcagtggaaggagtgtgggttggagttttataaagcacacatatcaagcagggagataggttgagcgccccaatacacactagcccactcgtctgatgctctcaaggaccccttccttgctccaggctcaggtcctgtaagaaggtgggtaggtatattgcttcacacagacagtcctgtctgcccaggacatccacaggtaactcagaaaatatcctaacgataccgcccaatcttcacattgatattagcatgtcccaaatcccaactgtctccagcacacacgggcctctacttctttctaaaaatctccctgattactcacacccattgaagccatccccgcaggcacatcgcacacagctctccacccacctgcacatccccctcggcaaccgttggcatggaagatgctatcctcagtagttcattcgtcctcctagggccctactcctgtatgaggcttcttttctgcttgccctcaggtacctaaaggtcatgcgctatgatgtatttgccttggatgctctcacagacatcgcaggtagccggcgacagtcgggacgcaatgtgtattggttgctttgacctcagaaggaagatctacaagtatctacgtgcaaggacactgccttcagttttcccaatgcagttagaatggaaactcactgcactgggtcaatgtaaaagctacaataaacacaggaaactcccaggtttatctgcaaattaaaagagcaattactatggggtgagcttaagttccttcaaaactatgaaccgtgaaatagaatctgaagtctcccccatgcctggaaatgcacccatatactcttccagtctcatccttgtatcccagccttagaatatctctttcatagcagactctgtgctaaaatccaggaccagcagggatcttatccccagacctggccttgccagagctaatgaagtgatggacacctcaccagacaaggacagatgacataaaaacactaatagggcctgtccagacagccacaaagaaacagagtggggagctaaacaggaaagtggcacatgcatatgactgtgatagtgtgtgtattcacgtgcattcatatgtattgggatgagatttgcattagttaaggtgctttgccctgaaattcccaggcaaagcaaataattcagtcagctatccatcacctctgaacgacacgcaagataagagcgctccgattctctaaaccccagtttctcaccaacagtggggtgaaaagtgggctgcctggggttttctgggaatcagttccaggggaaatgtgcagagatcacttcccgatggaagccagtgggcacctcctaatggcggtcagcttcagtgcagggtacatggcagtgcattagagctgagcccttggccctggaggctctgggggagcttcagactgaagctccacgcttcactgtactccaggaggcaaagctgcactgactttctaaccccagtctccctgaactgtaaaatggaaattctaatgtatagctctaatgtcaaaaataggataatgtggtaaattattcagcccaggcaggtgataaaccccaccctcccaccccaaaaaagaaacccacaaaattaggttattgtcaaatactttgtcagaaaagttccaagacaggctaaaccttgagttcctgacctatgtggtccatacaaaaatagactttaggaggggcagaggacatagggaaagatttgcaattctttgcctgattactcaatttggatgccaacgtgctatgagacttctgacaagatgta

SEQ ID NO: 282 - DNA, 3600 bp, Mus musculus
accagcagatctctacagttcaaatcacctttttccatattgaccattttccatattcccactaggacggtccattaagccccacttaaagcactccattgctttctatatgcaaagtccccaaatccatatgctttcaaacaaaaccatgatcaggtatatcaccctgaccataccctagtccctggtaccaacttctgtcttggttagagttcccattgctgtgaagggacaccataaccaagacaactcatataaggacaacatctaactggggctgccttacaggttctgaggttcagctcatcagtttatcatcaaggcaagagcatagcagcatccagccaggcatggtgcaggaggagctgagagttctacatcttgatctgaaggcaaacaggagaaacctggcttccaggctcctaggactaagttctctgaaagcccaacccctcagtgacacacttcctacaacaaggccactaacagtgccaccacgccggggccaagcatatcgaaaccatcacagtgggcctgctcataaagactcccaggtcccttgaccctctctacagttttgtagaagatgcaaaaactaggagtggagcctgcaccccctcctgctgtcagaggcacaccagaggcagggtcacctctggctgtcccgaggctcagcctttctctttccccagcttgggattcctggggttcaaaaaccccagtgacaatagtctgatagccaggcaaggggcatgcccggcttcctttagactattccttctcctcccgtgacagctactgctggcctctcctctgccagggtggccgctatgggcctgtccctggagctgcttcttctacactcctgaccacctctgccctccatcctgcagtagctgagcatctgctgtgcacacaggttgctttggaagctggtgatactgcagtaaagtagacatcacacagttcgccttcacggcattgacacctgacacgtggggtcatgacaatgatcggggtcatagcgctgagttctatggagaaaggcaagggatatgaagggtattgcaaattctccttagcttccattccctgatgccccggttgttctgagctttgtgtatttcccccctcacagcagcgagtacttcactgggtcagctctggctttggctacttctcagctctgtggctttggaaaaatccccaatgtctagagtggtaatgcacacttgccactccagcccatgagagatggaggccagagcaccgggagtgtgaggccagccagtcacgtgggaccatacctcaaggaatcaaaatatagaaatctataaacctaaagtccccagaggaacgcatctatcttccttcttggtgacatagaaataagaggtttctgaaagatataagtgagttcctggcacacacaggtaagtctccataaatatcagccacccagtgtaaacacacacacttcctgccctgtcagaaacaaggagtgaaggtctggatactgacatgcaatccattgctcttccctcggctgggccaaccaagtcttctcttcctattggtgctaacggagagggcagttaggatcagtggtcagcgttgcacattgacctagccctcaaaagccacctgggaatacggctaggggaatggctcccctagcacttgctgctcttacaaaggatccaggttccagtctcagtacccacatggctcacaaccacctgtaactccagttcttagaggatctgatgcccacttcaggcctccaagggtaccgggagcacacagtgcacatatgggtataacatccatccacataagtaaaattaaacataatttttaaaaagccacgcaggaagaggtcaggtggaatcagagctgggaacggcgctcacagaagggctccagcttatgtgaatgagaaggaagtcctgtcactgctgcaggatcctgtcactgggcctacactgtgactctggggtcccatcaatgttggagacagttccagaaacgtcagttcttgctgctgttcggtgccaccttccctgcttgtccaatgtgtccctgccaggagctgtcctttctctcccacccctccttgagtaagcactgcccagcttgggcttgttttcaactccctgctgtacccttggtgagtcccaaattgtcaggtgcgctcagggaggaaggagcccacgatctgccagtctggctggcttggatctggcatccacccgtgccccacacttgagagggctgtttctattttgctttgtaattcttggggaggatctggcttgcaggaagcaatctgttaattgatgctgtcagaggagccagatggctcgtgggtggcgggtattgcagatgcagagacaggcccacctgagagagtagggtgtttacaaagtgccacctgtgagcaccaactcagctgcctctcaacttccatagcaccactgtgagccaggtgttctgtttccaagaaaacaaggggcttgttctctaagagtaggctgttgaaaccccttccttgttgtgacatttattaagtataaaacctccaggctgtgacaaacagacccaaggaaagcagcttcggacaagcagaggtcatttctcctgtaggaaagagtccaaagggaggcagtgcagggctggttgtgtaatcctgctttgcgatgtgccctagggatccagggctttcccaacctatcattgtattctacatggcttccattttccaaggtcgctgtcttagttaggcttcttttgctgtgatgaagactgtgaccaaagcaacatggagaagcaaaggcttatttcagcctacacttccaggtcactctccatcactgagaaaagtcagggcaggagctcaaggcaggaatctggaggcaggagctgatgcagaggccgtggaggggtgctgcttactggcttgctcctcgtggcttgcttagtttgctttcttttatatcccagggccacctgcccagggctggccccacccacagagagctgggccctcccacatccatcattaattaaaacaacaacaacaacaaaaatgcctacacagacctcctacagtccaatctaatgtggcaattcctcaattgaggtgtttttctttccaggtgactcgagcttatgtcacgctgacaagcaaccaggacagtcactgctttacccaaaaggactgttgcagctcctgccgtcatagctgcatttcagttctggcatccacctgtgccccacaagttactcacacgtttactgacatcctagttggtcagcacgtagtcatatggtcactgctagctgcaagggaagctgatacacgcagcctttatttctaacagtcaggatgtaaaatctacacactctcttattaagaaagagtcagtggtggggagccagcaggttggttgggaaagcagggcagaatggaatcgactatgttcgtattccagcctttccctggtctccacttctcccctctgaagtgagggccatgacaggtcctcacagtgtgtagagatcctctgatttgttgtatcggtagacatctaaacatct

SEQ ID NO: 283 - DNA, 1975 bp, Mus musculus
ttacttgggcttcatggtagaaaacgttgatttaatatgctgctgcgacaggagaagcttggatttcttttttcataaaatagttgggtgaatgaagagcagggactttgagatttatatgtagcctcttctacttctagaaacctctccctcacccgcactccagtaagctgttgtatgtgtggtctctgtgtatgctctgttaggtaaagcctccaaggtcagtgggacagtgggtgagggaccatgggtgacaaaaaagcctttggggaaaatgaatttggccagctattgagagagcatttgtaaagacattaacctgagagcacctgttcaccactgcagtgtggggaatggagttaaactgtccctctcttgaaagacggtaaaatcacacgcccgaggagggtgcaccaaaaatatttccacccaaagcagattcatctttctgagggattattttttttttcagttgtgttttttttctaagcagacaaaacaaagtaattgctatttatttaaaatattcttttaagaatctattactattaattattattatttgtgtgtgtgtgtgtgagcatgtgcgtgtgtgcacgtgtacaggagtatcacaacattcacaatgtgtgtggttaagacagaagacgtcttggaggagctagctctctcctccttcacgtacgactggggtcccagggatggaactcaggtcttcagagttggccccaagtgattcccccgctaatccatctcataagccacatacattcatgttaggagctaagggatggccaggacatccttagactgctcactgattgctcacagtgggtcctcagaacctgaatgcccctgaccagagtctctgcccccttccttctctccagagacagcacagcaccttgtctggtttccaggcacacccacacccagaatggagcaaactgggtttgtctgggggaccttcactgaagtgggttgccccctgtcagatgggtgtgaatgcaaatcggccacctccagtgcagtcccatttgcaggtattgatctatgcttgaaggagggttctgaagaaactgtctttgaagctcccccacccctgctctgcttccccagtccctgtggctccctgattccaggcattcatcttgatctttgtgttcccaacaccaaggtaggtcatttcaggtgacttagaagtgagataccatcaggaagaatttggaaataaagtctttgtcgtgtcacattaaggcagccctatcaagtggcagtttatcaagagccacctcacaaggttttaatgagcacgctgcctgttcttgtacaatactaattaatcccattttttcacactgctgtgactgctcaagaaacccacattgttttatactcggtagcaaagcggctcttactgattaaatctccttgcctgcgatggagcttgacaactgaattataccttgctcaaaataataatgggtatcagctaataaatacggtttaacacacacaaaactatgcagccaaaatcacaccacaaaatagtggtttgacttataggctcagcagtgtttcattaaacatctgtattataattcaccagtttcccaactgatgtaataacctaattgatgagaacaaagacaagccttatttatccacccaattgcttgagtcttgactcacgctttttcccccgtgggtgttattgtgaaaataaatatgcaatattctttttatagaagtctaatttaggtccccttctccctctgttgagaagtcagcaccactgccaccatgtgtatctgacaagttctttacctttgtcatggagggatttggatagggtgggtgtggctgtggctagcagagaggagcacaggcttctgggacttttgatggaactgggggaaggttcactgatctcttccccaaggacgaaattgttttctaatccgaccccacctgt

SEQ ID NO: 284 - DNA, 2325 bp, Mus musculus
tgccccttgtggtcgctgcaagcacctgcactcatgtgagcatacccacacacagacacatttcacttcacgtatatgcatagttaaaaacaaaataaaccacaaaccattaatttaagacaatggcttttccagtctccaaaaggttaccaaaaaagtatttgatcattagttgtcttagtcataataatttctgtatgtttcaaggttaactacccagagtcctttctcaggtgttgactctacttccatataaacactgtatctgtttaaaaatggaaaattacaactctcacaatgatatttatgagggatggtgtctatgtatttagtataaaagaatatgagaaaagttatcaaaagtgttgtagctaagctcttcagctctccaaatgcttcaagtcttgttttctttgtccctcgtggcaccctgaatgtgtgcctcggagatggaatgagttggcttttctcacatctgttagtcagccctcaactttcagtcagatctgtcggcttcccactcgactccagccgtccgccagtcttccctggtgagttgcatagcaactaccgctcagcctcacctgcaaaaggttagcccaacagttttcatgctttcctgaaatattttttttcagctctcgaaataagcaagccagctggtagcattctaaatagatctcctctgatctcctccttaagtgcaatacaattgcctacccagtctttgcaaacaagctgtcagggaagctctctccaccggagctgggatgtgagagggatgttcacctctgccagtcatcggccggtgatcgcaaggatcactctccatctttcttgacctctgcgtcatcgtcagagcacgaggcagttaaatgaatggctcattttggtagcagtcgtcctggctatcacgcaaaggacaacccctgtgagcattcgttcttaggactcttcctgcacttctgcaaggctgctcactgtacaccatagagcgccagtgctccttgtgctgtagtctgtataatgctgccttccagaggacattccagaagccctagatacgatctcagacttgtgctgaagagttcacactgtgtgttctctctgtgcaggaggtcaaacgccagcacggtgacgcttcctgttcaatgtcacaggaataagtggtgggatgctgaggttgaagtctgaaatgtctcccacagactcgtgtttgaatacttgggccccagctgatgtgacctttgctaattaggagctaacaggcagacgtggctcacttgaagtgggtcttgagagttgtagcctaggcttgctttgaatcctgttctgtctgcttccttgtcaaccaaactgtgcagaacctcttgactccactgctgtagatgtggccttcccaggctttccaggccttccctgccatgccagactgaaactgaaccaagaggagcctccctgccgtaacttgcctctctcaagtatttggcccgctctcaacacagtggagttgggagctcaaatctagatggctacgggtgctccttgcagcttaccctcctcatttcccaggagttactattgaagtcacgcagtgaaggaccagacactttcccagatttttttttattggatgttttctttagttacatttcaaatgttatcccctttcctggtttcccccctcccagaaactccttatctcatcctccctccccctgcttctatgagggttttccttcacccacccacacactcgcacctccctgccctcgactgattcccctacactggggcatctatacagccctcataggagtaatgacctctcctcccattgatgcatgacaaggtcaccctctgctacttatgcagctggagccatgtgtactcctttgttgatggcttagtcgttgggagctctggggctctggttgattgatgttggggtctgcctgtggtattgttgtttttcctatggggttgcataactggtgggaaatagtcctggagtgcctgctgcatcctgaaagctcaagaggatctgactaacggtcagcctcagtgaaccacacggacggaggcagtgtccattgtgcgcttggagaagaacagcattgtggcaggacctgggaagggacaggcacaggcgaatgcaatctagcctttctctggtaccaaggttttcacgtcccaaaattcagatgcagcgcctgtctgtcaggctcagaaatgaacacaatgagaagagaggcagctattctctctgcagtatttttcagtgaagctggctgacacgacgacattcaggcaattttccattgc

SEQ ID NO: 285 - DNA, 1950 bp, Mus musculus
aggtgtcacttctgtattaaaacacactctaacctaaagcttgctgcttaggtagatgccaaggctaggccttccagttcccacccaaggtcctcagtgccagcagcctgggctgaggaagaatgaagctaggggtctcttggggcacagcagatgaaggttgagtttgctagagaaactcctgctaggttaagcctgacacagagattctggtagatgtgcaacagtgaagacatcagggtgtgaggttgtcctcttcactgagaagactgaagcttagaacatccttgagggctgatgaaagaggtgtggttgtgggatgacagtcagcctcgtcagggcttgcttccaatctttctcccttctgttagggcaggttctagaaactagccttgtgtgagaggagctggaagactgttttgtatttcttcatggtttttgagttgggttctcaccccatgtagcccaagctggtctccagctcttgacagtcctgcttcctcagcagcccaggtattagggtcacagatctatactaccatgtttggcccctgtttgcatctcttgtgcctagcctgtgtgagcagcacccggcggaagtgcggtgcagtggctgagcatctctgacgtgtgctcttggctctgcaggcttcacttcctgcccttgtccagcaccattatgttgttcatgaagtgtagcttccagaattatatgcgacatactttatttacctcatccattcattccacccatttactgttgactcattcagctaattataactgtgtgttcattactgtgaagtgccaggtgctgaatggggaactagggatgttgttgggaaaggtgtccagaggctcggttcacaagggggtgttggggaggaattagggcttcaaggcagagtcttctgggaggagtaaacatgtgccacttgggcatcctggcatgaagccatgggtctgagagccccctactcccttcagatagccctgcaggcagatagacagatgtgttagctcttttcctgctcaagctgagccctggagactctgctttctctcttgctcaggaagtgtgtgctgtagagtttgggctgaggaggaggccattctccatccacagtgttgtcagggcagcatctattctctcctgtggtctgtgcctggcctttacattttctgtcttggagaggtaattttccagaagatgggagctattaacaaattagaaggtatgaatgtgaggatcccagctcacctagatctgtgatccagcccttgtggccttgagcagatgcccatgccaagggtttgaacacccactgaaggtaggagcaagcccttgggaggattgtgtcttcggctgagagtccaggtctgcgagtgtgctcagtgccatgctggcaggcaggagctgctgcgccccctttgtttttcagcttgtgtacattgaggaaagaaagttggtgagttagcaagattgtcaagatagtgtgtgagattcccaagatttgtgttctctattctgtgtgctgtttaggaagtgttttcagtcatttcatcaggagaagatagcattatttttagtctcagattaagataatttggctgtgacatctccattcctatatccactgcttgtttactggtccctgagcctagagacttcttatgccattctgactatcctcaggctttggcttcaagatacataggcccattgcaagagttgccagactgtggtttatagcatcccttctggacactgaagtgttgagtggtcatgtggtccagttgcttgtctgagctgctctggttccattgtcaaatttggcgtagatctccgtgctcatccttaaatctcactgagttgtctgtatgtgaggtgaatgttgtatgagtggaaggctgtgtgtttgcaacagcaggatttatatggcagggtgt

SEQ ID NO: 286 - DNA, 1750 bp, Mus musculus
tgaggagaacctcatgaaggtagagccatcccttcctctttgtgtttgtcttagtaagctttaactggcaactcaacacaacacatggtcacctgagaaggaaatctgaaagaagggattgcccagattgtatcagcctgtgggtgagctgatgggagttgtctcagttgttaattggtgtaggtggactcagttctctgtgggtgctgtatagaaagctagctaagcataaaattgtgagtaattctgcaaggagacttcctccatggtctctgcttcaagctcttatctgagttcctgccctgatttccctcagtgatgaactctgacccagaagtataagatgtaataaccctttcctcacctaagttgttttaagcagaacaacaggaaaaatcagaataacaatgtcttcccagaacttcccagcaccgggagaacctattcatccagcaagctcacatgatcctggcatctacccaactcagaaaactgttcttccaacaggctgctggtttaaatagctttattacttgtggtgaaaaatcaagcctaaagggagacaagaatctcttcagatattgtgcagttcttaataaagcttcccacccttgcttcttgacgatgaacaatcaataaagggttggctttgagcagtgcaataagcacaattcatttggcaagcatgtattgagcacctactgtgtacttgctgttctctagagcaagcgcctgtggcagctaggaagtgatcctggagaaggctggacagaccctccgagggggagcctgcgacagtgatgtcccacagactgaatggggtgtttgctaataaaatctgtgtgaccaatgctcccccgtatggccacctggtgcctttgagaccgcttcagtctggcctccctctatgaagctcattagaagaacatgtgagctggaagccccttgacaggaaaattcaacatctctaagattgctttcattctgtcagactgggacttgacccccttttctaaacagtactaaggagcctgggctggtttcccatgaggaagctgagtgagtggaggctccttagggtccacctggagactagttagcataaaccagtcagatcccaaaccctcagtctgtgcggtggtcaatgcgcatgcattgcaggctcctctctcctcgggatttagaaggattcgagacctgattaccatcgctgctgctgtgtgaggtttattctgattgtatgctcagtaactcatgggggatagggttgaacatcactttggaggattctgttttccttcatcttccaggtggtgggaattgagctttgtcctttagaggcttcaccggaaggaccagccttctatctgtaaccaatgtcatcccaaatcagcccacctttcaaaagagcccaggccgcaccacaaaagggttcagtgcatggagtccaagtctacccctggggaatgacttatgatcgatctcctgtctctctaacctgggttgtaaatgatctgattttcagagtcttggtttccttactcactaagcagggataatataggtctgtgttccgactcaggccccaaccccagactccatttgccactgtttctgattctgaggaggaagacatgacaagaaaggctgaggtagcctccttctaccccaattatgtctccctggtcttttccattagctctcagctttccagccagtatttgtgagacagctctatgtactaacatca

SEQ ID NO: 287 - DNA, 2850 bp, Mus musculus
aaggaaagagccctggtggaggggtatgaagggaagagccctgggggaggggtgtgaagggaagagccatctttcttgctaatatgtggtcctccagttcatgtctttctcagcgtgggttcctcacccctagagcttccatgatggaaagtttatgtggtagtctccatctgggacctgtgggcacaggaatgcctgcccatctctccactgtcatggaactgcagagcctgtgtgactttctaagcagtagacaaatcatcagaacacaggctctggagtaggcatagaccagggcagagaccctgtgccagccattccacctagcagaaggacttgcaaatccagccagccaggtaagtcctttcttccctgcctctgtcctctgattttaaaaacttagacacagcaaaaacacctttgtggtgtaaaagttgacatccttcgcatgtgtacaatttactctgcctcacagtgtacagaccagctccgcaccctgtctgccatccctcacagtcgccaccccattccttcttttccttcagagtaaagcctctccaagaacctcatgtaaaccggactccatagtggatgccttttgtgcccggctactttcatttactctaatgcatctgtgattcattcatggtggctgatagcaacacaatccttgtccttgctgcataatattcctctgggtagacataccacagtctgtgtatccaggcatccactaagggcatgtaggctgtctctagttgagaataactaagaataacactcttacatgtattcatggccatgttttatatattttatttatctgtttatttctctgaggtactggcaatagagtcctgagcagcacggcaattgtctgcatagggttgcacagttttgacacactgaccagagtgaccattctgttgtgtggcatggcacagaacagtaggttttggttgtcagtagggtagcactttgccttgtgcttgtgacctccttgtcaccgtttccagagatttccacctccatagctgtagcataaacctccaaagctagaatcgcctctccctggagcagactcatccccgctacaccctgtggctcccacagctttcctgttcatccagctttggctggcgctggagtctaatagtgtaccatgaagacctctctctatcttggtagaaagaattcctaagaatttctgcagtgaccttctaaattggatggcataagagagcacgggcaaaggtaggcttacttaagatagccagaagcaaacatgcccactagtgaaatatgggtttgaggttgccatagtgatgagagaagtgaccccccgtggccgctctggacagctgctgtggacagagtccaaggtttctgtttgcttggcttttgttttgttttgttttttttctttgcataagcttctgccaagtcactttggtgtcgggagagctggctgcctgcgttgtggagaataaaacaattttaaaaaataataaagctgattgtatctgcttagtcactttaagaaagtgttgaattaatctcagctgtggacttttaaggggagggaaaatggcaaatggcccttttgtctgtgaagggggaaggccagtgagtcctgtgggagaggcacaggcaggctggggctcagctgcttcctaagagattgtttggtcaggtgatgcaggtagcctgggattcaggaaaggtaatggcataatggaggagtgatcttgataatggcaggagagcccacctccccgctaccccaggtcaagggatgcaagagcatccccaggggttccagttaactgacaggagctctgtcagagccacatactggggctgcagactcccagacctcttggggaatctctcctgctagactccagacatggattccagcattagaaggggttgggcccatctgatggacagaggcaatgaccaaagtgagcaagaagagagggctctggtagagcagagcccattgcaaaacagtgctggccacccttgcggtaggttcttgccaaaagctagcctccctgccagctgtgccacaggcagcagagatgagataggtaatcaaggtcaggttgccatagacagcagccaggcacaggcttatctgcagacacaatcatcagccagagatccctgactcctctcagcatgtccagacctccaggaccctctgggagaagtatacctcatcccccccaccccccaggacctatacaaactaggccatcccaggcagagcctcactcttgggccagagtggtcaatcataaatgtctctcaaagctccttggttgatgctcttgcatccccctgggaaccaccgtagcttgacctgcttattgccctcaaagaagagtgggacaggcaaacttttgttggacccacagacataagccatggccatgccagggtgctgtgtcaggtgtcccagctaatgttctgatcatcagggacttcagagaagaagtcagaggctgattgttctgaggccctggatgcatcaggctctgtcttttgtacatgtcatctctactgaccatgtgtgtgtgcttgtactggcatgtgcacacatatgcacatatatcatacacacatatatacacacaaacagacaatgcacacacaatcagatacatacagacacacagacatacacatagacatagacatgcacgcagacacacatatacacatgcataaacatacagacacacacaatgcacacacacaatgcatgcacacagacacatacacacaaacacatgcacaagcacacacacacttgcatgcggtgccacatgtcagctccct

SEQ ID NO: 288 - DNA, 4575 bp, Mus musculus
aactaagacaaccaggctttaagtaatttgtgttttttaaatgctgacccccaaatgcaaagaaaattattgtaacctatctcatctccctgagcaaagcaaatcgccttcaatcatgtggcatcttgtgtgtgtgtgtctgtttttaggtatatatgtgtgtggctgtatgtgtgtatgtgtgtgtgcacatgcatggatgtgcatgtacagtcaggcacgcgtgggaagccattatttgtgtgcatacattatatattcacgtgtatgtgtttacttctgtgtacaagtgtgtgttatgttcatgcattgtgctgtatcatatgcacacatgaaagcatgcctaggagagtaccaggtgtgggtgtgtgtgtattagtgagtgtgcatatgtatgtgtgcgctcacgcatacacgctatgtatggtagggagacaggcacttgcagccctttgcttcaggatgcaatctgtgaggaaagccatctgtaagcatcacctgctgcatctccttcacctccatgtgctgagtcattagattcacagtgcagtttctggttcagagaaggctctgcctctgattggccctgcatccagactctgcatccaggcatgtaaatgtcccataggggtggagccagtctgtttgctaaggggagggcaggggtgcccgctggcctggaattctgccaggggtcattcttctgcaccatttcctctcaggcgtgcatgaaatggtgtttctcagcctggtgtttgttaacctgtggagcaatatttcctctggctccttctctccttctcccactttgtgaattacctgcctgtgactggcagcttctctcctgggggccagaaccaggaaggctttatacagtgaagacgggttcaagatcaggtggtcatctggcttcactcacaacacagctttggtacttcagtcatgcctaaggtttttatacagtcctggtgcattctcaaagatttgttcctcattgcttagcatgtaggcagcatgagagtgctatctatgtatgtggttggtgggatgtgtttttatttgacatggaatggagctgtctgaggccacaaaataaggattcctcagacagttccatctctacagaaaggatttgtgtgagttttcataaaaagccagagagtgaaaaacttaggccaggtaggatgtggttggtcactcactctgcatttggctcaagatgccacagagaacagacattgcatggctgaaagaagcgggtgtatgtgctaataaaactttcttagtggcagcaactggcactagattccccccttgagctgccgttcctccctctctgtgactgagaacaccaagcctctcatggctgcccactcatgttatcaaactgcttatctccccctctttcctgttttctgcatgtctggaggaagaggactctgggtgtcaatgctgcctgcacacctgctcctgagtcctccatacaagtttgtgagagacggggggagctgaggctggaatgctgccacccaataatgacactgcccatgtaaattcaaaagtggagccgaaggtcgtcgtggctgcctgtgagccacagctcaaccagtgccacccggcttcaggaagcagaggaggcaaggacccagaagcagcagggagggatacccagtgctgccctgctgatccctgccatggagtgctttctgtagggcagatgataacggtgataccatgccgatggccgtaataacgagagataaaggaaatgaaacattgcaaagcgctgatggatagcgccttcagtctgcagtttaatgatctgtgagtgcaaatctgtagttaagaatgagccaatccctcacttccactctgctctgttcatcccagataaggaaatgaagaagtgcacagaaccctaatgtctcagatgtcacgttctgccttattagaggaagcagtaccagtgccccgaggaacccatgaggttctggtgatatcactccacctcactccatgacagtgaggtaacactctcagttgcccccttggacacttagtgctcagctggtggcgttattataggaggtccaggagccgttgcaagttgaaacctaactagaagaaatgtgttccctggggggtgatggccaccctgtttcctgtcctctctgcttcttggctgacccagatgtgagcaagcagcctcaccttcccacttccatggccaagacccacccctcctcattgccctgcactatggaaggcaccctcaaagtctgagttcaaacaagtcattcctctttaatgtgtcacatatttggtcagagcactgaaaaaatgacaccctccttaggctctgggcacattgagagctgaaaccagctttgggcctaggtgggcacaggggagttgggcggtgcgacttgggagcagactccagctgggagcaggtgccctgtaggtgaagtgtgtaaccgtttctctctccagtgctacattgtctttctggctcagcctagggtcacctgcaccttgcaggcagtgtacacagctgtgtacatgtgaggaagggattccaggtggtaaatgctatcttgactctgtgccagctgaccccagggagatgcaggtgaacagaggggggactttcccaattgctggtgagctgactaacccaaattagctcatccctccccagtagccttaccaaactgacaggaaatgtcataccatgggttactctgttcagagccaggcctgactccagtaacggtgccaagtgcacaagtctaaggtgcagatgacacagcaggctgacctgtgctccccacagatgtggctaggtatatgtagcccacgtgtgcagcatctatacgtgtgactcttccagatcaagtgactctaagttctgcctaaatgtcttggggcaaggttgggagggtgccggggggaatgctaattgtggcttgggagccaagaggggtcgttcaggcctccttgctcaagaagggaaattacgagcaaacgtgtctgctcggcaactttagggaaacaaacacacagcagtggaagagctttttaacagccctgcacatcggtctggttcacaaggcatctaaacccaaaataaaacaatggggaaggatgtgcggcagcttgcgggaagatccccaaatagctgacggcttcatttctgtttgtttatgggtagatttcagagtcacatctgttacttctttgtgagcttaaagacatcctctggggttgtttgctttcccagcctgctttccttctttctttctttttctcccttccttccttccttccttccttccttcctttctttctttctttctttctttctttctttctttctttctttctttctttcattttttggatgctttgagactgacgctgccctaacgttgggtgacaaggagggcagttggaagagcagctaggtcaaccccaggaaaacaatggctgccatgggacctggctcctgggaaatttcttcttggtacttctcaaaatatttgctctgtggaacagccacttgacatggggctgctgatccccagacatgcaggactgacacacccacaggctccccatgccctctccattttgcttcttgagcccaaagccatgtatcttctgtgaggtctagtattacacagtggtcactcttccaagatgcctggttcgtagccactactttcctccttccttccttccttccttccttccttccttccttcctcccttcctcccttctttccttctttccttctttccttctttccttctttctttccttccttccttccttcctcccttccttccttctttccttctttccttctttccttccttccttccttccttccttccttccttccttttttcttcctcctcttcctcctcctcttctccttctctttctcctactcctctttctcctcctcctcctctttcttcttcttctcctcctcctcctcattattattattgttattattattattattattattattattattattactgccaggcaccttctaaaagaagggcagtctcaaaggcactagtaggttgtgggcctccccaagttctgtttatttctcctgatgggatgacactcttgggtgtgctctatctcagtgtgatctatctcgggtgtgctctatctcaagtgtgcgctatctcaggtgtgctctatctcaggtatgctctatctcaggtgtgctctatcttgggtgtgctctatttcaggtgtgagctatctcaggtgtgctctatcttgggtatgctctatctcaggtgtgagctatctcaggtgtgctctatcttgtgtgtgatctatgtcaggtgtgttctatctcaggtgtgatcagaaggtgatctccactctctcctgtgagtgcaggtgtggtcgtagctgggcattagtggttccctgaagctgaagaactcatgttacttatggggtgttaggcttacctgacataccctgggtagtcattgggacagacagacaagacatctcaccctaagaggtgaagc

SEQ ID NO: 289 - DNA, 2425 bp, Mus musculus
tggggacctggaattaatgtatcagacagcgtggagtgaatgacaatcaggagtggtgcattggctgatgttaaagtgtatcattcttttcttggacttgtgatcgtggttcaggggcttgttgttctatgtcagaaatggctctaggtatcccaggaggcttctgtcattgtgtattggcttcactttttcagattttttttatatgtatatatgtgtctgtgcgggtatctgttatgtttgtacatgtgcccacagaggccaaaagagggtgccagagtccctggagctggagttactggtagttgttggctgtcagatgggctggggactggatttggatcccccctagaagaacaggaactgcacttaactactgagccatctgtcacacccctgtgcaattgcttctgctggtgactcccaactcagattcattggtgtctggaataatagaagcacagatattagcccatgctgatctctgtctgtataggagcaacctaggtatgttcactcagtgactcagcccttgtcaactgcaggtttgctggccaccaattcttcatgtgtatggattaaattacactgagtgtgtaaagtgtcaggattaggttagagtcatatgtcttggatcttaggtgtctgggttctcagccttccagagatccgcaaactatggctcggcagtagaactggctccttcccacttccgtctggatctggtttccagaaggttttcacaggccacagcctgtccatgcccccaggaaaattaaggccagacatctttgtgccaggagctccttcagcccaactcagttaggccccgtggcccctcatttcctttgaaaaataaaacacggcatctgtcagacgtactgagacttctggcgctcagcactctccgattttactctgatcattaccctttcctcctgccaaaatatattaaaaataatcttaacagaacacaaagcaaagagactatttctcaagtcaagctgcagagtggcccggaacggatcgcgggtgagagcctgcttttttcacagtgccgggaaaagcaaatgttgtgtgtgtctgtgtgtgataaacacggtggcttgatggagttctggagctgagagagcgagttagcttctgaaagaggcaagccgcagccgcggtggcccagtttccctgtgaacattttttttagtgtaatggctgaacattttgtagccaaacccagaacctgtggatgtgaccttgtttgggaaaacatgatctatgcaatgggtcaagttcaagatgaggctggcatggtaaatgctggaggtagaggctggtgctatcagacagagcaggaaccccaagattgccctccaccaccaggtgctggaagaggaagggggagccttctttgggagcagggccatgcccacacctggggtttggcttctagatcttgtattctgttgtttaagttgccggtttgtagctgtgccttagtgaacgtaggaagatgagtctcactcctagcagtgatgtgaaggagctctgtccactacaagcagacgtgttctgttcctggattgcttgctgatagtctttccatcccatgctagggttgataccagtactcaggggctgttacaaggacatctgtgatcctcagaaagagaagccagctgtacacactcacagcctggatctgcctctcgctcaagacagcgagcgcagagctgagcaaggcaggctctctatgactaaggttctgttagatgacctgcacaagttggctggcaccgtctcctaagactatttaaaatgcagcctctaggacctggaaagagttctcacagggagagattactatttagggaatgtgtttgttcattcactcagcaaacaactgtagactaggttttatctaccaatggtctgttggtgcacaatggagatgttaacctggttgcaatttactgttgccagtggacggcaacactgaagacacacacttgcacttttgtgagtgtccaaagtgagactatagacaggcactcaggatccacagctagaggttgagcacctaacagcagctccgacttggagtaggtgaagagaagagctacctgcaggtggacagggtcagtggtcaggacacagcaggtgcaaagaccctgaaggccccacagaatgtctaggagtcttggctgcatgggctcaggctctgcctgcctggtatctgcaatgatcccacctctgcgttagaaggagacctcccactttctctgacacaagcctcctgtaacccaagtcactggtcactcacccccctctccttcccagctgctctgccttgctgtgacccttccattgtaacatgccatgcccgcctctgtctgctgccttgccctgcattgcccttccctgaagcata

SEQ ID NO: 290 - DNA, 3725 bp, Mus musculus
gcacggaaaattctatggaggggctcagaaggagttccagaggctcagaagtctgcctggttgattagaagtctagagacaagctcaaaacgtggagttcaaattacagagatgcaattaaagtatcataaagtgatctgctgttcagacttcagaatcatctgtcccccgtatgaccggctaatgcagatatcagcaaatagcaaccggatttgtgtttactgcataggatgctgcgctgtggagtggggagcagcagaagtggagccatttctcttaagaggtctgagttaggaaacttccacagttggagagggtggtgcagcacaggcctcttgccctcacattggtccaggcagcaagcagagccccagacaattctctggccttattaaaatccaattacagtaatagctcagcctcaaacgcgaggcattgtgaatgcaagataaatgtttccacagagcaatctcccaaggtcctccatccacgtgtctctgctagagatccagttctagctgcagctggctttctgagtttgcctagtaaaggaatttgagaggaggagcctttgagcatggtaggttgagtctatattattatttttctttgacccttacaaagaaatgaagcttccatttgactaactcaagcatgtccaagagctccatcagaggccatgtgtgtgacccttgccaggccctgacagctttactctcttgatgcagatggagatgcccccttgcaagggctgaggagtgacacagaggaccagatgcttacgtaagagccacctgggtgctgtgagctcagtgactttggtcctgtatgagggctctttgtccatgtcatctgccttgggtggggtttcaggaagactgaagcttcttagagattagtggtgtgcaggtgtcagggattagaaatcccaaaccattgaggtccatttgcccccaacaggaggccccactggagggcctccagatgttcctctcaggctccatgcagtacccagggagtagagacacagtgagaattcagtgtattctttcctgagttacatattgtgcaacatattgtgcctgttttcttgggggggggggttgtatttcttgagttaaatgcaacaactaaacacagagagacacttacaaagagatacattttctccaactgcatttttttccaaggccaggattgctgtatgtgccgccagtaattaagaggccatcagagacagcctgatgatgccggtgtctttggagagctaggggatccctcccctacctcagcctctatcttgccataggatggagctatttttagttcttcccaggacccaaatgagatttggatttgcatggagagggggccagggcagcctgggctctttccaggtgctggtttcctgcagcctaaggagctttagggaaagccagctgctcaggcagactctctgcgctcggagaccagctttgtgttcaaaccccaaatggtggcatgctaaaaaaaaacaagtgatgtgttctacaaaactcatgaccactttcagcaaatcccgaaggtcaccaaaaataagaagaagctgagaaacgttaacagatgagaggaaccccaggaggtataaggggatcccagagagataagggactcgagtaacggctgccacaggtgccacacgtggactgttgtaaaccatgacataatgatacctgattgtttgtcatgtcggctgcggaccgtagaaccactagggagacatatgggcagctgaggacttggatcagtccacagtccttccagagtcccagcagtctccacagcttctctgcaaacctaaagtgcttctaaaatagaatccctaccataaacagtctaaacatgatcgtatagacactctgccattccatgactgggggaagctgccatgccctatcgctgcagcagccctgacctgcatctgtgcgcagatagaggcccatgggctccagaggtacatgcagcatctccctgccattgagggacatagagaacctcttagtgacaatagaccatgcctcatcaccgagccagacatatggatatcagccattggtgtctaagcagacgccatgtccaagaaacacacacacacacatgcctcaattacatcctttctatagctgaatactattccattgtgtatatagaccactttttccccactcatttgcctgtttatggacatccaagtggtttttatttcttctatgtcatgactagtgcaagaataatcatgagcatgaggtacctctgtgggagtattcagagtcctttcagaatatggccaggagcagtaaaccctaggcaaccctagctggtcaccagctgtctgccaagggacgaatctcatccacacctgcaagcttggtgacatgcccaaatcacacagcggtaaccagggtaacgcatgtgtgctcacaccgtcccatatgcccatgggaccccccaagagttccttcagagaagacatgcaggggcacttaccctacccctcctctaagctgaccaccagcctgcactcagcttcatcttatctgagacctggaaggatggaatgctaactagcaagtctattaaacattttttttgccaaagccccacacacatcacgacccaattctccaactgccactgcacaaaagaccaaaagtgggtcgccacggagacgaaggggtgagcgggatgatccatgagcaaccacttaaaaaatgccttagcagcagcttcagaggattaactaagcagatgagagcagattcacagacatagcccagcgacagccatttagtactaacctgtggccggtgagggcgagcctgtggcaggggacgagagctgacacccacagaagcagcccggcaaggctctcctctgcaggaagcgcactgctgtgactatatagaatgtcgattcctacaagatgtttctgtttgcccagggactggggatatgggtggactgaggtcggttttattttgttgttgttgtttgcttgtttgtttgttgttttatttttgtaaactggaaattccatcatcagaatctatgggggttatgttgtaggatcaggaaacttttgcttgtccatcttttaaagaatgaatacgtacctgtcggttaggagagcttctgcataagctatgttgtcggttagcaaagcaatttcagtgcttcttgctcacaatctagtgtccgctgcccactgtccaccctactgccactgcccactgttcaccacacactatccaccatactgtccactgcccactgttcaccacacactatccaccatactgtccactgcccactgttcgctgcccattctccattacacagagtcacaattcactgcccattccattatccaccatctcatcttccacccattgaccagtttctgctgccagctgcctagtatcaaaggtctacacccctgcctgtcctccactgcacaccactcattatccaccacccatctgatgtcacccctgtaggactgtcatttctcaagggacagctgtaatgaccagcattctgttcggactggcatggctctcctgagacagaacctagctctaagtctcaccaccccagggtatgattgcctaagaggtgtggggcatagatccataaggtatgggtgtagggtacgggaccatagggtgtacagggcattaaggtgg

SEQ ID NO: 291 - DNA, 3450 bp, Mus musculus
ctctttggttggtggtttcatccctggagttctggttggttgatattattgttcttcctatgaggttgcaaacctcttcaagccccttcagtctttcccctaactcctccattggggtccccaggatcagtctggtagttggctgcaagcatccgtatctgtattgatcaggctctggcacagcttctcaggggacagctataccaggttcctgtcagcaagtgatggctttcaagtggcctttagtgctagctttcctgttgtagtttccctctacctacccccacccccgccgccttgtctctccatagcactgtatttatgctcttttctcttccttgagagattctctcccaaccgcccttccccctcccctcactctagttccttactaggtacctaccctctgtgggtttttttggattgtagtctgtatattgaatgtgtagaagctaatatgcacatataagagaaaacacactgtatttgtctttgggggttcaggttgcctcactcaggatgatttttgatacctccatccatttatctgaattttccataatttcatcctccttaatgtgagccattaaataatattctattgtgcaattgcatcacgtttccattatctattcattgcaacagccaggacctggaagcacagcctagaatcaacattcttgatgatggtggaacaaagggaagaaaagtgtatcaattataaaggaatagggtcctttgagaaacttcccatggacagcaggggttcctgtggggaggagatgagacattcagaggcagccactgcagaggtagccatggcagaggcagccactgcagaggcagcaatggcagaggcagcccagcagaggcagcaatggggagctgagaacacagttgtgagggagaaatgagtctgtgaggatgctaggtcagctgggagagtgactcagtgaggttgatcccagaaggaagtctcaggagctccatagtcagcagctctctcacaggcaagtcaggttactccagccgtgcctcctacagagagaacctgcagctcatgtcaccgcctcagcttgctggccacagacacggtaatcataagtgcctttacgatggccacaggtaggcagtaagactctgacccgagtagttgcttctgcttctatgtcgtgggactggggacttccagttttagttggttagtggcttatttgttttaaggcaaggttttgtgtagacccgactgacctagaactcacttcgtagctgaggttagctctgatctgatattccttcttctgtgccccaaatgctgggatgacaggtgtataccaccagaccaaactgttctggggtctttccagtcaccctttgacacagaccatatagaaaacactagaacactggggaaggtctgaaggaagggtctgtcctgggtgctaccaatagggccaagccccatgaacctcccagccctgctgattctgccggctgatagtggagaggggtagcatgggcaggcttgtgttgccctgtgtgtctaattagcacactcgtccaccattcaaatatttaatgagattgtttttttcctcttgacatcaggagttctgacgtttgctgaaccaactcggcatcttaattaaggattcgtctcaaagattctttgttcccaaaagattgtgtgggagtcggaagcccaagaagcaggctgtgttgggggtcagaaataatgatcatcaacttatcatgagaaccaggcatctgcagatccacgcaaacaaacccggaagcgagagcagcagcctcgttgctgagggaagactgggcattgttaggtgctggcgttcagggttctgtgtgctggcttccgcacattctgatggacttgagagagcatccctatacacagacctccaagccagaaccagctacagagacattgatcctcttatcagtgagggggccaaggcttagggagattgtagcctgataaggtcctatagctaagctgtaaaatgtaccctcaggtcttcttaacaccctcatagcctcagcttctcttcctacctgtgggttaccatggggatgagacaggacagtgtatgccaaagctcttggtcactcagactgccatatgaaccatccacattctgcagcaaggcaggctggtaaggttcagccactggggcggtgcagtaagacaccatctgctccacagtgacgcctcctgtgtgtcacaagaactcttgggatcagggaaacctggacagccaagaactgtgttgctggccaagagatcactgctaccagagcaggaggtgggctggagaagcgttttcagagcagaggagactcgagttaagtagcctctgctccctttcagagcatctgcagcgcaaagcacagttccctgggtctgtgaagcgttctgagcctttgcgcctgaccttagaatgacctaaggtcctcatgaccaaaagtgtgtgcatgtgtgcacctacagacgctcacctctgacgttcctccggggtgcgagcccaaacgggagggagcctggaaaagttaaaaagagctgggctttgctaatcagtgcctctctgagctatagggacagcaaggctgaacttctgagacctctggcctcactggcccaggttgtcccccttgctaggtctcccctcagtcagttctgcctccatgcccaccatgaagtttctaggacctggaggatatgtgccggctgctgagcagaagggaacactgatcccatcccgctagcctgtgatcagatttctaggcaaaggactataactcagaatcttaacaatcatagctgaagcatcggagaagccaagctcaggccagaaaatgagcaatgtagagaaacatctctggttttcaaagctattttcctagcaggttggtaacctctgccagtcaaggctccttcgtggctttacagggatatctgtccccttctctgtgcggaatacagagaacatacaataccaaatgttacttctggggacctccagccattctctggtgtagggatttagccaaggagtggccagtttgcttctgacattccaggcagattccccctgtcaaccacaccctcatgtgccgaaacctttgtgtatttgtgtccccagcccacagccatagaccactgtctcacactgaagagacccccatgttctgtgcacagagaaggtgtctttcgctgctgtgtcaggacttgattttccatccccaaccttcatgaatccccggctcccgcctggacatgcacatcctcccccagcccccatgacagcagttcctccagaatggctgctctgcctcaggtgtcctcactgctcacagcccatttggcagttcctgcactagggtgtgtaatgagccctatgaattcatattctatcgctgtttgttgaagga

SEQ ID NO: 292 - DNA, 1975 bp, Mus musculus
gtcacacatacacagtcacacatacacagtcacacatacacagtcacacatacacagtcacacatacacagtcacacatacacacaccattcaaactaagtcttttaaaagggaaacgaaatatctcgagttttgctctagcatttaaagtaagtcaatcagatgacctatcttaaacagcccgtgaggatgtattttatctgactccttgacaagacctggccctaggtgagcactgagctgtgtgagtttaggctggaaattatcttactttgtgttgacagtggtttccttttgattttggtttggctttggtcttatgggaggaaaagctttgatgagccttgcctgaagagaaaattaccttgcaagtccaaatgtggctcttgtgtgcaaattaggcctccaggcatggttagggaaaatctattagttaatggcttcatgactcatcccctcaacctattactggaaattggcgacaaatggaatgatttgctactgagaagggctggccctttacccgtttattcctatgctctggtctaagacactggcaaaactcgggaagaatcaagcagatgatcttgccttgtcttccctataaagaaaggctctgccaaaaagaaggtcattcctctcctggtctagttgattctttttttaaatttattttgtgctcttttgcattgatgcttagtgctgattgtcagctcgacaaaacctgggatcccttgggagacgggcctctaggcatgcttgtgggggtttcattgatgtggtagacccatctttattggtggaaaccatttagtccctgatagaggaatcctggactgcccacagtggagagggtgaaccagcaggcattactacctctctgcatcttgactacagagtcaacgtgagcagttccctcaggctccaaactctatgtcctacccgccatggtgggctgtaaactgaaccctgaaccaccagagcaggttctcctttaagctgcttttgttcaagtattttatcatggaaacaggaaatgagactcactcactcaatggcagcaaatgtaacctcacagttctcataaatgaaacaaaatggcctttcaaattccacattctcatttttcttcagcgccctgtctgcctccaatctcccaccagctctcgttgttctctgtgctgtggtcttgcctcgactgtaagaaacgagtccctggcatataggaatatatcttgagaatattgaattgagtctaaagacactgtgtattagatagcttagagaaaaatctattttccacaaatcctactggtgagaatcttgagctccaagtctttgcttttgctaagttctgacttgtttccttggcagttacacaagaagaattcgaaacaactccctaattaagacacgatccccaaagcactaattgtggatgtcctcctctgcagatcccagagggctgggatttcatgttattttttatttcagcaaaaatgtcatggcttatggctctccttttatcaacagtttgttctcaccggtagttccatttttaaagcatatttgttggatgaataaacaaataaatgaacaaaaagaccatttccctccctgatgaagtgacttgagtcttagaaaccaggcaacttatctaaagttccaaaccaaatctttggaaacctgggtccagctctctgctgctaaggtagtggtaagcttgttagctattcttactgcaggtatccacagggagtgatctgcttcagagagatttcaaaaccgaggatgggaggggtagaggtggggttgtggcaggtgatagcatggcaagcgtgcatttggctctaactcactgcctgggaggctctagtcatttaaattctcaaaaatattaactaatattagggaaacaacaatacctaattcagagatgaagcaagtacatgtaaatggaattgttaagatgatc

SEQ ID NO: 293 - DNA, 2675 bp, Mus musculus
tgtggtttttctacaaatgtactctggccaatgcaactctttctcctccaggcaggaaaagtagtaataaactattgatgtctagaaacttcataacagtatgcataaatactgtttagctagttcttggttattatcacaaagtccttccaatgtcttccccagccatttcttcatggtagagctaatggacgaacataatcccaatactgtttattctacttataaactagtatcgggagaaatagctcgccagtgagatggggtggggcatttccaatttctgataagattaggagttatttgtagaaacagcagtcactaaacacaccaggctacattccttgtttaatatcccctacagtctgagagacctaggagatattcctggatatttttccctaatcctttttatttctagtctctgcttttatgcctttgccaccttccatgatctatgtttaattaaatatctaaatccttgttcatgttgactgaaaagtcttggatacacacagaatggaggagtacaactgaggtgtacacttgcatgatgacagaataagcagaaacaaaaatttgtcttgttttgctcattttacctacatgtctactaagtatgtctagggtgggggctatgtttgcatgtgtgtatgtgcacgtgtctgcacatatgcatgtgtttgtttgtgtatgcatgtgcatgtatgtgtgtagtgcacgtatgtatctgtgattatatgattgcaagtgtgtgggtacagtatgggtatctaaacatgtatatgtataaatgtgtttaatccaaaagttgatgctgttgtgttagaaggcagctcatatccagacagatcggaccaggccagtaccaatgaaaagaggtcttttgcaggaaagtgaggaagaggaataaggaggcaaggaagaaggggtgaagggttgaggtctctgccttttattcaagctgtaatgtaatcatgctcacccctatgcatagatgaggtgtgcaggtgaagtgcatgttgggaatgtttggtgattgccatggcaacagtcacaagagagtctttgttgccaagaggtgatgtcatcgctggattcagagactgtaaatagcttctgatgccaacatacttccatttttaacataaagagaaggggggaaagggggagatgagaatagtggcatcagcattggggtccacttggtaatcactcacttcaggcttctctgtggacagcagctggcaatcctgtaaaagtaaatgattaattgtttggttagagatgtttttgaatttgtccttgaaggaatgtggaaacaatattaatgaggcaggggaaaatagtaatgccaggaaaatgaagagaaaagacataacaaaggggagtatccacttccatatagggtttttgaaaatccaggaattggaggcctcacattctctatgattctggatgtctgactgtacctgttggattttatttcttcttttcccagattagttaatgtagaaacagcattcttcttggaaaaacaggcaacaaagaccaccttctttagcagtcagggcatctggtctccatgagttctaaagtaccaatgctgccaaagaatcaatttgtttttagatggtgagcatgtgtgggaactaaaaaggggtccgggggaagagggggaaggaaggacccacgccccaccagagtactacctatgctctggacaggcaggcatgggagggctgacacacgctttccactcagccccaggtgggcacccaagtctctgacccactcttccaggggtggacaaggggatcccagcctgggagccctggggctactccctaaagccccggagttatgggagagtgggaagagggaagagaggttcccacaccagtgagagtgagcacagcagatcttgatgaacagagactgtctatggttttagagctttattgtagaaaggcagggagtatgattttagagctttattgtagaaaggcagggagaaagagagaaaggagagaggagggaaaaggctagaaaggcagagagtaagagggagagaggagaggagaggagaggagaggagaggagaggagaggagaggagaggagaggagaggagaggagaggagaggagaggagaggagaggagagaaagaggagacagaagtgagagaagtgagaggtaagagagcaaaggaaagagagaagagtgagagaggagagaagacaaagagagaggagtgagagggtgaaaagggtaaaagagaggtgaggaggggcctaacagccctcttttattgtctttactgttgctaggtaagtggggaggagtttagcctgaaggtcaaaaacttgggactttgcctacatgacttctagccatgcttctcttgtgggggctgtgggggcggtaacttaggcaggagccagagttccaggagcatgagggaatgcataccatgtaattgaggtgaattatcacccttctggggttcagacctcagctcaaccggagcctgtctgtgcatagcccaatgccccacaagcatgatttcagacatttcttgaaaactggttttaagttgggaagagaacttactgtatagggttagggaagtagttgtcagccctggcattcctgtaccagcacctatagctact

SEQ ID NO: 294 - DNA, 1850 bp, Mus musculus
gtttgcccacaaaatgagaatgaaactgagaacctcaagacccacctcagagtctcaagaaacagcaagctaagcccagagctagtagatggaaacaatatatactcctgttttttaagagaaacaaaaaggtaacgctctgccttagttcagacccagtcccagactttccctgctctgccctagttcaatctcagtcccacactttccttcctcattttagccaaactgagcagctctctctcttactccacctcccactcaccacctttacctgccaccatctgcctctgttctcacctcccccaatgaaactgttctcaaacatgctaatgagcacagttgttttcaacagggccgaggttctgaatcttacccaagggtaatcaggcttaccccagactccaccttccctatagggcccttctcaactcatgcctgctctctgtccccaaaaccatcctgtgcaaaaaagtagtcttgaagtcagttgtctccagcttccaaggttagttcctagctgtaccagtcttgtcctctcttcacaagatctctccatttataaatgataacaggacagcaaatctctatatcccttccagttagtgtcctcaattttttaattattccatggacccatgagcttacaacacctcccattgttagagggaagggtgtttctccgtcttaatgatgtcatactctgaccagtagtataagagtagatctgaagaactcagcacaccttccccaccagaggagagtcagcctccagggagggcttggaccctgggactcaggcaggaatgccatcttgtataccgtgtctctcagagaccagtcctctcaggagagcatgcaggccacagaagcagcagagcttcttggacaaggtctcttcaggccttcatcttcagccaggaggcagagctgagctccagacctctgccttccctgccagaggagaacttgcctgcagagagtgctctgaccactgggactcaggagaaagttggtctcccaggagtgctgacagaggctaaagtatcacaggaagaacaagctccagccagagacagcaagaacatctaacaccagagattaccagatggcaaaaggcaaacataagaatcttactaacagaaaccaagaccactaggcatcaccagaactcagtagtcccgccacagtgagtcctggatatgcaaacacactggaaaagcaagattccggtttttaaaatcatatctcatgatgctggtagaggattttaagaagggcattaataactcacttaaagaaatacaggagaacattgctaaacaggtagaagtccttaaaaaacaaagcacaaaaatccctcaaagaattacagaaaaatactgctaaacaggtagatgtccttaaagaagaaacacaaaaatccctttaaaaactacaggaaaacacaaccaaaaaggtgatggaattgaacaaaaccatccaagacctaaaaatggaagtagaaacaataaagaaaccccaaagggagagaattctggagatagaaatcctaggaaagaaatcaggaatcatagatgcgagcatcagcaacagaatacaagagatggaagagagactctcaggtgcagaagattccttagaaaacatggacacaacaatcaaagaaaatgaaaaatccaaaaaagatcctaactcaaaacatccaagaaatccaggactcaatgagaaaaccaaacctaaggataataggtatagatgagaatgaaaagtttcaacttaaagggccagtaaacatcttcaacaaaattatagaagaaaacttccctaaactaaagaaagatatgccc

SEQ ID NO: 295 - DNA, 3350 bp, Mus musculus
tcaggattcattggtggtaactttagccaaaatgcccaacattagggagagggaacctgtagagtccaccttcagtagatagacagggccttaagtggagggacagggttactaacccacagttaaaatttctgactgagaattgtttctgtctaaaagaactgcaggaacaataatggagaagagactgaagtcttggtccaatgacaggtccaatttgggatccatctcattggagggcaccaaggcctgacactattactgatgctatgatgtgcttacagaaaggagcctggcatgatcgtccatggtagagaggccctaccagcagctgactgagatagaagcagatactcacacccaaccattggactgaagttagggacccctatggttgaattagggaaaagattgaacacattgaaagggagagtgaccctacaggaagaccagcagtctcaattaacccagactccgaggagctcccagagactgagccaccaaccacaagcatacacaagctggtctgaggtccctggcacacatgtagcagagatctgcctggtctggcctcagtgggagacaatgtatgtaatctttgagagacttgaggctccagtgaaggagaagatctggtggcaacgggagaaggcaagggatgaggaactgtgggaaggggactgaagggggcaactgctggaatgtaaataaataaaataatttaaattaaacataataaaaaatactggaaaaaagttttagggacattaacatagatgaactaaaggtgatgcctagcacaaaaatgtcacaaatattagtcaagaaaggatgttacagttttgagataggaaggtgacttattgtactttaagataaagaatgatggagatgatttcatttattcagagaccgacaccgtccgttggaactgctggccattttgagatgccagctgaatcaaatcaaacgtttgcatgggaggtgctggtacatttctgtaatcctagcacttgggaggcaaaggcaggaggatcagggattcaaggtttctctttgctgctacaaagtaaatttatctcggcccatgctacatgaatgctgtttcaaaacacaggaaaatatactctcaaatatctctgtggtaatcctagaactgtgcacatcagctgtcaggagaatctgagcccatactcatctgtgacacagacaatgcctcactaaaatggtccagtgaccaaagctccttaaatgagtgattttacagtacaaagtcatgttcgcgttgctggaactgtaatggatatcaagtagttattattgcagatgaggaagtaaagaaagacttttaaaaaaatttctcctcatatttatcatctagtagatgttatttattttctattcttttgcataatttttatatattaccactgtccttaagtaagggttacagagcttacctcgcgagggtatatgctgctttggatctttgttgccctgctcttcagcatttgaacatccttcctttttttttctttttgtttctttgctattcaacattcaaacatccttcctgtcttctggtaatcccttagcaactgggcattgctcccatcatggatctgagggagccaaagagtgcttctttctgcctcattgcagctagaacaatacttagcaaaaccaaatcaagcaccagagtcacaaaggatgtttttttaaaaatttgacttctgagtcctatttccagaattagaaaattttcattcctaatgagttcttagttaggtgctgatagttgggaacaatactgtaagagccacatggctagagtttagacacatgtctgatggtagtcagagatggaatggtccaaaaattgagacaagtcaagaaaaaggcagtagagagttatttgtgcataatgcatatataccagatttgaactatgatgcacaaaatgttcaaggaaaggccagacaggccatcgctgtgaatgaccttgcctctcttattcctgtttttctgtctgtttgtttgtttgttttcttatttctcttttattttcctgtcaattctgtatgatcttcaagtctggctctcttcttctgcttgccttgtgggagagagcaactgctagatccttggacttctattcatatctgctgctgaccattgttggtgagttggactacagtctatttttcattggttgaaatatttttcatgaacagatgaagcgcagagagacttctgcattgttcagttctactggtggatgtcacagaactatccaagaggtccttggaatgattcaacaggtttatgtccggagctgatcctgtgccacagcactccatacccaaatacctccaggagaaagctggtctcctaggagtgttgacaagcctgtgagcacaggtaacactaccacttcagttcaaattcctggctcaagagggaactacccagagccatcaagacacaggaaccaaggaacacctggggactggatactactggtttctgcctgcaccatggaactgaccctgtgccacagctcttaataaccaaattcttcctggagagtacagaaagcaggagggacaagccatagtcagagagagcaagatcagccaacaccagagataacgagatggcgagaggcaagggcaagaacataagcaacagaaaccaaggctatttggcatcatcacaacccagttctcccatgaaaacgaccctggataccgccaaacaacagaaaaacaagactctgatttaaaataacatctcatggtaatgatagaggactttaaggaggacgtaaataactatcttttaaaaaatacaggagaacacaggtaaacaggtaaaagcccttaaagaggtaacacaaaaatctcttaaagaattgcaggaaaacacaaccaaacaggttcaacaaaaccatccaggatctaaaatggaaaaagaaacaaataaagaaataataaagggagacaactctggagatagaaaactgaggaaaggaccaggagtcatagatgtattcaccaacagaatacaagagatagaagagagaatctcaggtgcaaaagatatcatagaaaacattgacacaaacatcaaagaaaatgcaaaaagctcctaacccaaaacatccaggaaatccaggacacaatgagaagaccaaacctaaggataataggtatagaagagagtgaagattcccaacttaaagggacagtaaatctcttcaacaaaattagagaagaaaacttctctaacctaaagaaagtgatgcccatgaatatgcaacaagacacagaactacaaataaattggac

SEQ ID NO: 296 - DNA, 4875 bp, Mus musculus
ctgttgttctggaagaaagtgtaaacaggggctctttatctctttcctttacagtttcaatagtaacgaaatcaaagaagctcatttccatgttgcctcatctattaggttgcttgtactctgcaaccaaataacacacattgacagcaagaacagtcagtgtccacagagtgatgcatgttttcatgcaggatcaagaggtctgcacactgcctttcttctaaagcctcactccctggcttatggctgccatgtgtgttcctccttgttttttgtaggagccgtcctcagagtttgtctgtgtcttagccattttattttaaatgaatttttatttctttgttttagaagcatggtctcatatgtatatctatgaaatgactttattgaaatcactatattgctgacttcgggctgggacctttggttctcctgtgtgcaccttgagagtgctaatcgtcacttattgggagaaaattggtgatggataggatcatgcactaagtcttccctgtaatttactcatttctgtcttcgaagataggtaaatataatctcaaataactaaaaaaagaaaaaaaacccagcactctgttatactagaggtgcacacttcaatatgcaaattttagaaaaatacattactaactgggacatgtatcccctcaatgtcacctagcctatgttccatagacaaacatagtgaaaaatctttgcttgaatctaaacagagttattgtggtaccccgtaaatgaataatgtatcagttaattattcatacaaaagacttttactctaaataacattcctggtttatgtgtatttatttagttactctatgtctaatgaaattacttgtttggctctagtatcctgtagtctgccaaaaccctccctgaaatgccattatgcctctgagcaagagattggagtgtgaatctgggctttgtttatgcaggtaagctctgctatggattccaaagcctgcttggagtattgacatgactgagaatttcagaggaataccatggcaacaacttaagtgtgtttatgtaacacatgaaaactttaggagatctattctggaaataattgtgcaaagtattttttctttccaggcttaaaattatcatttcaacattctttttccagaatctaattgggctttctattccgtcactgaaatggaggatggtacacctaaggggatggttagagaaggctaacagtttggttttaatttgtattgggggaaaaacaacccacagatctttgcacatggttggcagtgggttggaacagatcatgctgagtgaaggattagctgaaatacagagattttccagatattagactacaccaaaaattcaattaaatatctaattacagctttaattgttaaacaatctacccgtttactttcttgtgtgaagtgttttgcttcctgctgactcatgaacaggtgcagtgtgcaggtgagagctctcccatcaccacatgagcgtccccagctcacccttttcctacatacattctgcgttactttttaaagcacggcctagaaccacaaaatatgaaaagcctgcagggcaaactgtgcacttaaagaaggtcttgtagcaaggagaatggcctgcgcttgcaggccagcaatccagggtaaaactgatcaaataatagcccagaaaatctttctattttgattctgaagattaggaaaggcatcataatgcaacaaggccaaaaacaggtttttttggaggggttgttggtgtaggtttggttggatttcagtttcttaaagaaagtgtaatacatgttgttgtcaatgttagcaagttgcaagccacaattaatgctaagagtcagaggggaaaaaaggaagagaggtttgaaggatcccttacccaatagactccaaggtgtgtggtatcatcagatgggctgcgtagacatgtgtaaaccagaaaagttgtaaatatgcagtggcatcaattcccttgcaaagctaatttcacatgagaacaactaccaaaatctagcttttgatttactgcaaataattaaaggtccaagttcaagcttccaaaccatctaacactgaaatattttttttctttcaaaaataaagcatgtaaaattccaaagatgatttaatctttcaactctctgtgaaaaatttaaactgagagatggttggtaggcaaaacaaaagtggaagccacttttcacgcagccgaaactgtcagaaggaattgaatggggctgaaacttacaaagctagcagtttgaggcaaatgcaataacactttaaaataacattacaagatttattttaacatacttaaaatgcaaaaactcttctgagaattctggaaatggaaaatgtttactttagaagcactcggctatgttttggttccacactaagccataaaaggattcatgaagcctgcctaacatgtggttcataatgtctgctttgtaaatttagcattcaaatagtgccagtggtaaaaaataaaattaaattaaaaagataaacaaccctgggttatcataactgtggagagacaaactcctgggtaattcgaagaagacaactatcaacttccatataaagtagtaatatagacatacattgtatagcacccatgtaaagttcttcctattggcatgagtactttgccacagcataatggttccccaactgtttgaaatgtggctaggatgactgcatcttaaatttcattttgttttaattgatttaaatgtaaaagctaagaagacagccacagcttgtagctaccaaactggacaatagaggtcttcccttcctattgccaaggatgaagtcactcgtgtctctgtggtacacacagtgatgttcagattgtcaggattttcctgaggtggataaaagcctgctgctagtatcagtccttcttagacagacttacctccaatggccaccacatggataataatgtgtcacagaacttgctcttatggctacattggccaactaactgaaaactaaaagcaacaaagtgaggtgaaagaacaaaaatcacctattgaaaatatttaatgcacgataccaagggaactttctaaatgaattgagcaaagctcatacgaactcacagtgtctgaagcagcaagcacagggcttcactaggtcctctgagtttaacttgtagctttcagtttagcaattttatcggatgtctcatataggtctgcctctctgactgggtgccagggtcccgccatcatgcctcaaggagaagaagtcaggaacagtgtcctggtctacattacccttcaggtagcaccaggtaggagcagggaaggcagagccctgggccaacaggatccagcctggctaggagctagtgctgagaatactggaagggctggtggagagacagccttctttgagagccttaggcaccactctttcctgggacgatcattaatgaaacagtttgctgagatgatccttgcttgctcatattgctttgtttggtgactgatgacaatgcacacactttattcatgttgaatcggatactatatactcttcgaggaagaaatacccaggaagggaatttccttggctgaaggctcaaggccatatatgattgagtacctaatgtcatcattatgtgttccaggacaggtacagagataggtagacagaagctctgctcttgtgttgaggctgggacctaaatcttggtcctctgcaagagcaagaagagctcttaactactgtgctatctattaagcttctaaattcacattttttggcttgcatttttttttcctcttacactctttggttgattaataattcaattatcatttctgcagtgaaaacattaatagaaatatctatgtgtcagaggtgggggctctgtctgaatttgggtgtcatattgacatatctgaatgtctagtatgatgtaaatgtgaaatccccttctaggtttgtgaggctgaggagggacgctggcaaaagtagttctctacacatggctgtcgaaggtatggcacagactcacaggaggatcctcaccacatgcacttgccacctctgattgagcagctctctgatgggtccctagccatgacagactgaaagctctgcagcccaggtggcaaatgagtcattgctttccattctatggcaggtggttcgccctgccctgcaaactctctgacatacagtatgagcctcagctcagctttccaaagtcccagtgtgctttgcatttcacctttaaattaacctcaaatgggttcagtgttaaactaaatctcccaatttttctgcattaaatttatgttttttgtttgtttgtttgtttgttaacagctcaaactcttacttataagctacataatggatacaaaatattattaggaaagccgccctagcttagaaattagacaatttgtaaccccatgttattattgtgctaattaggttactttttgatctaggtcagtttacttatttggaatgtggagctaataaaagctatcctgtttatgagactattaaagggagtgaagaaattctcagctgttaaaaatgtcttgcttctcttgcagaagtcttgattctggcttccaaagcttgcctcagaatttcaaagctgattatagcttcaagttcaggagataaagcacctctgatctctaagggtgtctgtgctgagtgtacaccccaccacatttaccaataatttaaaataaattcatatgtgtacatttgaaaaacaacaatgtaaaaataaaaattcaataaattttaagaattattacttaaatattttataatatgatttgtgtaaaatgtattt

SEQ ID NO: 297 - DNA, 1950 bp, Mus musculus
gcacttgccctcaggatgattccacagtggctaatgctggctcctaggtctttggtttgtttttgatttatgtattttgttgttgtcactgtcataaaatacacggaaaaacagcacattggaggggctgggggctggttctttcagcttacaatgtcaggttaaagccctcctctttgaggtaagcaggaacctgaaacccctcaccacatcacagccacaatcaagagcagagagtaatagctcacccgtgctcacttgtttgtgcttagcttgattgctcggctcttataccggccagggctgcctagggcttggcgctgcctacagtgggcgtggtcacatcaataatcataactaagacaatcccacagaggcatacctacaggccgatccaatgttgaccattaagactcttttcccaggtgactctggtgtgtgccaagttggcaaaactaagcagcttggagctgttctttgtatcactgtagtatctctgcaggctcagaagtatatgaattctcaggcatccccctcacagtgtgggacacaggcacggaaaggcctgggtgaaatgacgtctccaagccttgtaactaaggtgtgggacactctgtgctatgctacggtggtaacctcaaagctgaatcttgaaaaaccaataaacatttctttcacagcgatggtaaagtgtgctatggagagggaacaccgtgtttaaaagcacggattggaatggcgagtaacatgtcaagagcacagtgaagacattcttctgggtgcccttggtgaggacgcccaacctctgctgtaccaggtgctgaccgtgaccccccagtcctacgcccgggtcctcagtctctgcttggttcatccacttacctcacatgtcaaagctcgcacaacattggctcatatatgtggtgtgaggataagaacagctgttaggaagttggacagagctcagttgtgaagggctatgtgggacagaccagaggcccctggattgctctggcagctacttagggaccgttgtttcttgtgtgccgggatagcgatgggagaaggagggtgcttgttcttacgttggtgatgagcacagtaaggtgctgtcctcttctgaaggcctaatgattccacactgtgtattctccccgtccccagccccacccccagaataacaagtgtacgctattagcgctgtgtactcttccacttcacacttcttccaggaaaatactgtaatattggaattaggcagcagaagctcgcggtttcgatgtctgcttcaggttggcaaaaggtgacagtctaaggagggatgatttgaaaagtgctaatagtaaaacattacttattttggcatgtctaaaagcactcgctatttgctgtgactggtgtgaaaagaaccagcaaatgggaaaattgtgctctggataacgcaaatgaaaactccacatatcacactgcggctgcattttctttctctaacatttcctggtcatttatatcagttacatatgaagcaatattaaattaaaattaaattagttaattaaactaaaatattgaattacagtgctggcgttactattggaaagcagattgacctatttgttttgttttatgtgcttgttttgctaacagctgtaaatctaggcagaactattaatatgtagaaaagaagcaaactttgttaattgtagaaatcttttcatcagtatatgttatatgctaatgtctggaaattagacacactttttatctaaaattgtcttctttaaaatataaatacatcacatatatatttctgttttaaatataagtgttttttttttttgaaataggtcatttttcaggaggtattttattcttctgccttttgttaatctcttgagcttcatttggggtcagcacctgtacttcccaggggctattagtatatttcca

SEQ ID NO: 298 - DNA, 3600 bp, Mus musculus
atttttctgatggctagggatgttgaacactttaaaaaaatatttattagctatttttacttcttttgagaatggagcctatttcattgtttttttttttttttgttgttgtttttgttgttgttttttttgttgttgtttgtttttgagacagggtttctctgtgtagccctggctgtcctggaactcactttgtaggccaggctggcctcaaactcagaaatccacctgcttctgcctctcaagtgctgggattaaaggcgtgtgtcaccaccaccctgcccattgtatttttgattgcttcttttttcaacagagtgtcttagtttagtgtgacttctatttctgtaaaagaaatgttttacttcaacatataactcttaggtcacatgccataattgaggggagtcagagcagtgaccaagccaactcagtcagtcaacagggtttcaagggagagagcgatgattaacgtaagaaaagacaattaggcaatattataacatgacttcagccaatgctgaagcaggtttatttttttttttccagtttgcttttataccattctacaggtacgtgaagagaatagggttagttcttaggtcaaagagaaagtagtcaaggaacaaacaaggcaacaaatgaagtcctgtggtcactgcgtctaagggtttatcagggtgaccaagataaaaggaatacatacattccttgtctgtcttcatcttgagcctagtcctagcccaatgtaaatattctagctgagcctactcctttgtcctagtccagtgtaagtattcttgctaatatccttgaagcagcattaagggcagaaactcaaggaaggaactcagaagtaggaactgaagtgaaggcatggggggtgcttactggcttgctcagccaccttcctttatagctcaggcagcagacggggagtggcaccaccacagtatggggctctcccacatccattattagtccagacaacccccccccccccaggctttccctcaggccagtctggtgggaacctttcacctatcgaggttccctcttcccaataactttggcttctgtcaagaagacaacaaagtaaccaggacactagggagggtctcatgtatcccaggttagcactgctgttcttctgcccccatctcccaactgctaggattacagttgtgtttcagtactcctgtttaatgcaatgctggacattgggcccaggtcctcaaggggtgtcaagggtgacacctctttgtcagtgcctccaagacattctgccaaagttaaattgctctggtgggtagcattcattcagccccatcttgttctaaatcctcacactgcggtgtgggatgggggagaagctgagttaaggtttccctagagttggatattagcattaaaaatgctagaatcagaaatacagactgtaacaggagaggagaccatgttgggcatgcttagattttgtaagcacttagctaaagcttgtgaggacttagtctgtgctgggagaaggtggagagagcaaagacagataaacaggatggaaagcactgagatccacgcaaacattctcagttatcctccctacaagctccttcctctctcccgtgggttgttagtgtttggagctggatgtcatctactaacactggtgggggtggctgacttggctgaactctgggaagcagccagagaggaactgtgagaagttcttaggggaaggacagaaacgtgggtgaggagaggattgaagcaccccccccccccagcctttcacctgctcttctgccatttagagtgcccacagctttgcagagtgattgtggagagagagagaggggggggcgggggagggagggagggagaaagggaaggaggaggatgggaggggagggaaggagaaggaggggaaggaggaggaggggaggggcggggatgagaggggaggggaggggatggaggagaggagaggaggagtaagcacatggaagccagggccccacctcagcctggcctcatcttccactcttccacagtgtgtaatacattttctggttggtttttatcccagcctggtcaccggattctggtggccttgctgcaagtctgttgccatggctaccactttacttatactggcagtctcatctatgctacaatctcctcttcttggttaggggtctcaaaacttgagactggcaggagtagagctaactccttctctgtttccgtgtctgcctcgacctccaatcaggttgtcacaggcagtcttcaatgctcagcacctggaaagcctctgcatgctaatgaggcatctcagtagccttaagctttagcctttcctcaaacactatataatccttggttcaccctgaataaatatgaacaaaccaagatcatctcagagagcggattcattaaagatcgtgggagaaggccttcgctgaaagagctgtaacactaagatctcagagaagaccctaccctcctctctgatcctactcaccactgactcccaacagggtcaggatcctgttttttccagactctgccaaccccctcctcctggcctggcaggcagcagtgtctgacaccccacagagaagaagtagattgcggaccccacccgttctggtctttgccttgtcctttcccggctggtgctccccgccagagaagtggaacgtggcgctacaccttggtttacctttgatcctctttctcctatggccatatccataggtaactcctcaccatctcttctcaccatgcagcaatcccatgagcagaatgcagttgctgtcagaacaaaatgcccccaatggcagtggctcgacctaacacacgcttatttatcgacacagctaatggggtaattaacattgattatccgtttcgtgggatctagaatcacctgggagattaacctcctgaagacaaacctttgcccacatctacaagggatttttagattaggttaattgaaatgggagacccatcctaagcatgggtggcttcattccgtgggtcaggaccctgaaaggaataaagaagaggatgaagttacttttgacaatcatctatctctctctgtttcctgaagacacaggtgcaatgtgactagctgccacaaactccagctgccatgacttctagaccacgatggactgctgcttaaatcatgagttgtttaaatctaagttgtttcaattttagccatttagtcacagcagtgagaaaagtagttactgagttgggaaggcagctctcccagacagagctttggctctgactgttggagactttcctgggccaggcagacaagtagcacaggtctcaggctgtcattccttcagtgtaaacacagaagcctgaccaggaggttaggaaatacaaatggagcatgtgcccgaggaagaggaaggtgcattacacaggtcactggtccccacatggagccgtccctgcctcagtcctgaccctcaagtcctttgcagcagccattgctccagcagtgaacttgcagagacttggagctggtgagctgtggaggcacctccactctggctttgtcagactctggta

SEQ ID NO: 299 - DNA, 4150 bp, Mus musculus
aaacaatataacaaattcctgcggtagttagcaaatgctagtgaggactacaaaaaagggaccattatatgctgttggcaagaatgcaaattagatgcaaatcagtgaagcaactctggaaatgagtgtggaggatccacaaaagctaacaccatacctgcagtatggcccagctataccactcccatgtatataagaactgagtggtcatgccaagagatgcctgcacattcttgtttattgctgcattattcataatggccaagctgagacacccgagaaatggacaaaggaaacatggcatagagatgcaatggatctttaaccagtcactaaaaaaagaagaaattgtcatttgcaggaacataggtggaattagaattgtgctttcagtgagaagcactgctgctgtgaaaactgtatcatacttgactggtgggaatctgaccttggatggcttccctaacccctaagttacatttatgtgtgcaccttcattaatggtacattaccatacaaataaatgggttccattatgatattcataagtatgtgtgccattacacttaactaaaattcacatcccatttccctctctcatagtctcccactttactctcttggtctccttcatcccccccccccccaaataagactgcttccattttcatcacacatgtgcacacacacacacacacacacacacacacacaattgcttttaatctcatgttaccatgtatgagagaagacatgaatacttgtctgaggccaccttatcttttaaatttagatttattttatctttatttccatgtatatgtgagtctccttctgtttgtgtatgttcatgcatctgtgagttcccatggggtccagaagagggtattgattgcttggagctgcgtggattgattgtgtggaacaaggtcatgcctcctatagtaccactccctgggccaagtgtattcaaaccaccacacctgggaacccacaacttgcctatgcctcttctgttcagctattggctgccatcaatcagaatataacttattcaccaatcagaaataacttgagggcaaggccacatagcatctcttgggtctatatgtggattttctcatttcaggtcttgggggcctgcacttaccattacaatacacagcaaaagaccaaatctcaacaatatacaaaagaaagctgtctaattaattgctggttaggggtgtgagtgtgtgtgtgtgtgtgtgtgtgtgtgtgtgtgtgaatttgacacaagctagactcatttgggaagaagaaacctcaactgagagaatatctccttcagattgcctgtaggcaagtctgtgaagcgggttttcttgattaataattgatgtgggaaagccacacccactgtgagtggtgtcaccccttggcagcggagcctgggtggtaaaagaaagcaggccagttcacagtgttctccatgctctctgcttcagttcccacctccaggttcctgacttaaggtcctgccctggcttccctttttgatgggctctgatctgggtgaataagccgaataatgtctgttctctccaaattgcttttggtctgagcgttttatcacagcgatgcaaaataaactgggacagccagctgactcatggtggtttgttttagaaacagtcacaaactgacacaactacaagccatctggtttattataaacagtaaaagcattcttgtaattgtgtcaatcttattagaaaaagctatttttaaatgaatctgagaagtcacttatgtatgtataagtcaaaaatgcttctaatccatccatctgatcttcagaaaggcttaatttcagggaccatgtttgtatatgccatgtatcagatgcatgctctctctatgtcaccacaggatgagctacacttagaaatacttgtactcaattccctggctttctgactgtgaagtctgtattgagtgggggtgcatttagccataaaaggacatccttcaattttatcagaaggatacagactcaaagcttctttcttctgagaaactttcccaagtttttggggggtggggagggggggacttgcctatttcattcaagaagccatcatttcccaaacaccatgcatattaccatgagctgtgggaaaatataaaaagaaagataggaaggaaggagggagggaggatgggagggaaaaagaaggaagggaaaggagaaagagagagagagagaaagagagagagagagagagagagagagagagagagagagagagagagagagacttattagaacccctacctctctgtgtacactccaccatccttcccatctctgtggccagccagtcatttccaaccccaatagggctcattccctatccagccttcccagtcatctactctcctctcacaactgctctcctctgacctgcctcctggacgtggttacccaccccaaatcaagaaacccccacatctaccatccttgcactttctgactaacccagtaacatggcaagtgttatcttcttccgttcatatttggatacacaaatcatcagttacaaaaccaagttgttgccttattttgctcttaccttccatttatttttccatagcaactgtataattacctaatatctcacttcacacattcccacaaaaaaaattaacttagggctgacaagatgatgcagctggtaaaggcacttgttaagcctgatagcctgagtccaatgcccagaacttacagggtagaagaagacaatgagttcccacaaactggtctctgacctctgcatgcatgtattcaggcataaggctctctctctgtctctctgtctctgtctctgtctctgtctctctctctctctctctctctctctctctctctctctgtgtgtgtgtgtgtgtgtgtgtgtgtgtgtgtccgtctctctctgtctctctctctctctctctagtaaatacatacgttcacctcggaatttgtattctgaagcttggggaatctggcaagttcatccccctccctgaactctgtctaggaagacacacctagcagaacacctggcaagacaactggcagaacacctggcaggacacctagcagaatacctggcaggacacctgaccagacacctggcagaacacctgaaaggacacctggcaggacacctggcaggatacctggcaggacacctggcagaacacctgaaaggacacctggcagaacacctggcaggacacctggcaggacacctggcaggacacccttccccaccgctcttgctatcctcatgcaattcagctgaccacccttcttcttaccttcctgtaccacgatttccatttatacttactatcttgattcatctatgaactttcttgagttttttctgttcttcagtcaactttccctcttctaaaatatttaaatacttaaaattaaactaaattacatctattggtcttacctccttttggttctaaatacttattgtctgtttcttgtgaaccaggactatcagatacgttgccgtgcaacatatctcaaagtagataactcattgttcggtaagcacagagaagctagtagataatcatgcaactcatcataactacaaagccagcctatggcagaatgtacacttgggccctggctagctagccacaaacacctgtgctaaccactgcccaacactgcctcttcctctgactttccctctcctttctcttcctgtcacagtcaggtcctcactcttctggaactactccctgaggaccatttgtgaaagctttatccctccttcctccttctcatgaacatagtcacctactcctcacctgggtagctctcctgagatgcagctgtgtgccagctatgtgtggcccggtgcaggtcatgcagccaaatgctctgtgaccgccttgaagtttctgaagagaggtgcacaaagcatcagctgtaggatggctcacattcaaggaagacggcaccttctaagccatcctcattggggcagcaggtctaggtgcacgagctcacatcaccatatggagttctgcagcataacatacagacacagtctgtaagtcataaagcagtgagcagatgaccaagcacaggcatg

SEQ ID NO: 300 - DNA, 2725 bp, Mus musculus
aggttttttccctctggagagagggtcttcctactcagtcttggcggctggcctagaatgtgttatgtagaccaggctggcctccagcatgtagttcatagatctgcctctccctcctgagtgctgagattagtgtgtgcctctacacccaacccgtactctctcttaatctttgaaatgtttattgttgtgtgtatgggtgcaccatgatgcatatgtagagtggtcagaggccggctttgtggagtcagtcctccttctatctttacctgggatcctggattggacgggtcatcaagtttctgtgacaggtgctttacctgctgagtcctgtgatttttactaacctgcttagtcaacctcttccccaccccctcccctctctcccttggtttttttttttgttgttgttgttgttgttgttttgtttttttgttttttgtttttgtgcatgcacatgtagctgatgtgaggaaccacccccaaactgcctgttttatacctcccagatagggtctcagtccagtgcagatcttgacagcatggctagcgggtgtgtgctggaggtcctctccactttcccaggcctcacccacctgcagccaaaacctgctcttcatgcttacagggcaggcagtttaacactgagccatttcccagaataccaactcggtaatattcctcattgcttcctgtgttatattaattatgcccagttttcccttcctagtcctcttatacttactttttacactgacaaggaatggtgacattttgttctatacccattctgaagaggccattttctgattaaatttggggattggtttaggggaaataaagctttgagaacctcattgtccagaaataccctgtttgtttttccttttaccgtgatagtttgctgggcataaaatccctggtctggctgttttccagcaggttttaattgcagcagtcttctgccctgttgccgccagtcagatgttcattgcttgtcatgtctcctctagaagctgggtcatgtgttgtctgatctagtttcctttcgttgtacagagtctttccctttatgccttgtaccagtcttacctttaggagctctggggaagaataattgtttttccagagcctttctttgtttgtttctacgaggctggggtattcttaatagttttttaatttggcaagtctgataggtgaaatgttgtatcatttaatttgcatttgtacatgactatagatgagggttttttttattagccatttgcattacttctatgaactctcaatccatactctgtgtgtctcattcttatttatagtttctacttttgtcagttatgcatagcaaggagcttttacttgtttgtattttgtttttcctttagtatgtccctcctcacggagcagttttcatccccatatgctgttacatttgttcctttttttttagttttatttaggaagatcttttttcatgcatattgaaaagcattatctcatgttttcttgcagtgtttacatggttttatttttacacaatttattcagagcaggctttagtttaatgtaaagttaaatttaaaaaaaaaacccatataatttatttttcatattttgaaacggtctcacactatagtccagactggcccaccaagcttgggattacaagcacacagcaccacgtaggcccccccccccccccgcgccctaggccccccccagcgccctgctgtcatccctctagggtctggctagttctaggtggtcttttcctcttgctttgaagcgacacattgaatctttttatttgttttaaagcattgttttaatatttattttatcttcaattatgtgtctgtgtgtacatgagtgccagtgcttatgaaagcagaggtattggatccccctggagctggagttacagcagttgtgagccacctgatgtgggtgctgaggactggactctggttctcttcaggagcagtactcactcaacccctgcgccatctcttcagccccagtcattttattgtggtggtgctgggggtgggggtgggggtggaagaggaggaggagacagtgtctggctgtgttgcccaggcttgcatatgatcttccagcttgagctgccagagtgtctggaagtactgtatgaactgtacttttggtacagtcttagatctctggctagatccttctccatactgcttctagacagcatgcttaattctataaatattactggttattgtatatgcattatatcagtgtataaatcatcttgaggagagttgatgtttttgtaaatttatatcttttggctcagaaatgtgattttatttagtcttttgtcctactttatagcatcttatttatttattcatttgttccatgatagtctggctggcctggtattatataacccaggctagcctctaattgttggtggtcttcctatcttctgaacactggtattagaggcatacagttcttcatcttaaaggagttaaaaaagccagctgtgccacgtcagtggctggtcagttctgccagaaccactgatcatcaagtaatcatattgcttcaattagagaagcctggttcttcctgtacaaacaatttacttgtgtgtgtgtgtgtgtgtgtgtgtgtgtgtgtgtgttttgtgagtctctaagatatgttgaaggtgacttgtcaatttactctcctttcaaac

SEQ ID NO: 301 - DNA, 2950 bp, Mus musculus
ttacaggcttgttgttagaactaagcagcattgcaagttgcatgcattcagtgaattgtagctattaggatattaaacatattgtgaatcttcagtgctggaaatgatgactagtaaatggctgatacttaataaatcgtaacaagatcagctgcacttatattcttggcatttatttgtggttattgatataagtaatgacccttaagataaaaatgaggaaaatttggagtttctctacattcagacttctttttagaaaccttgataccactcactaataaagatgtctttagttatgaatacaggggtttcagttgatcctagaccttcaagtatcacccatgatggaaaagccatttggcagacatgaaggtgcacctgcccacattgtgagttgtatggaatagaaagaagtgtcttctaaattttgacaaaataaatggttgctgatataaaagaaagttctataggacaaagcatggaaagagaaaaagatcttcagaactttgggagggcagaagtggagatgaccacagagagtgtttgatttctgtccagtttggtttttggtgctgttcaacatgggttcctattcgtcaggagaatcaggacagaaccctaaatctcagttagatgagcttccgtgatctacagaacctttgatttcctgtcctgcctgagtatcatgtagtctattatttagttgataacttcttcaaattgacccactttggtttcactcaagcaaactcaaatgaaagttttataatagagaaatgaaagtcattaccagaggaggaaaaaaaaaactagaatcagtttccataaataggagagaactgtgaaaataaacagagctatcttattaaagaaattcttagctaaaatttcccagtggaaggttggagcctgaatcttctttttctttaataaaaagagagtttgttaagtattatgattttaaaaaatagcataaaaaatctcaggtctcctctttcatgcagtttgaatgtatcaaaagaaaacaggaaaagatgtgcttgctcagtccctcccagctgccattcagtaccccagttcagtcaccatcctctggtctgtcagcagcatggactccactagctaatccagatcatgttcttcacatccaataacatttaccacgtggtacacaaagttcaaggaaaatgtttgaactggcattccagctcaggtgtggggcaacagaacgctcatggttacataatagttttgtttctatagataccttcatctgataattagatgaagctcctagtgtactctcagtctctgtaatcaagtaaatgatggcaatcaaagtaccctaccactacagcctacttcttcccttgcccccaacaacaagatacaacctcatttggtaagctatggataagaagcagtgcgtaccaactatggaatcaatctaagtaatgtcagatcttaggtcactgctctccaggtctgtgtcactgaaaacctacttaatctcatatatttccagctcaactatttctctctcatatcacttatatgcttctatcagaaaatgaaataaatattacttaacaggattgctgtaagaattagagatattatctgcaaagtatgcaatacctaatgagatttcaaaactaataggcttctggatcctcttcattctgcatgaaactgcatttttctcagaggcagctgagtccttgagacatggtgataaagttcaaagcaaatggaattggctgtatcagagtgcagggtcaccaaatctgcttttcctctggaagaaagggatgttactttcattaatgtggccttcattaacctcatctacatggtctacatccagttctgattgcactggtggcaagttcagtgacacagtcaaagctatctatcaaaccttgtcaccaatgaaaagttcatcttcatctctcaggaatgagatccacaatgagttgaccctgtgctgaacatgttgtggactcatctggcacttgtataaaatagagcaggctagggttacttgaggagtgaagctaataaggccatcatctatgtcccttctgcagatacttccatgtgtgtgctggacacaaataatgagaagtctacctcattggctatcagaaatgcctccagcaccaacaagtacttgaatcacctagacaaagcatccatgatgaacttacaaccgtaaaagaatttgtggccataatttatgctgactgaaatctagaatatacctttatggacatagtcacatgatggctctgaggatacccagaacattatccatgcatcttttagagcaaaacaaagattgaggttttcccttagctgaatgaaaaacttcctgctatgcctttctatgtccccacctctaatgttgactgtgactctgactggccatctgaaaaaggctgccacatattgacaaaaattggccaagcagaaacctcagggttccccagagaaccagattatctcctgcaacttaaaaaatcatgtccactcttccattttggaagctggagccagcattaccctcagttagccactgtctcatgctcatttcttgaatttagctgcagcaaaggatgatcaagaaataaaacctctccttgccaaccctggctcaacgaagtccatcagctccaatgataagttaggagaaagagaaactacctcagctcccaggaaacccttggacttagaacattccttcctgggcatgttttcatcccatgcttcttgaagatagtagttctatcttgtcctggagcatcagtactcctcatcccacacaggaaaaatagacaaggaagattcagtgcttgttgctgtgactactctaaacagttacctggtaaataaattaacactgaaacctgggcaaggagacatcaaacacaatgactggaaggtt

SEQ ID NO: 302 - DNA, 3425 bp, Mus musculus
ctagataaaaaaaatatggctagaatacatttatttttcttttttttaaattagagatagcgcttcgctctacggcacaggctggccttgaactttaaatcatcctgcatcagcatattgaatttaaagtcgcacactgccatgtctccataagacactatttaaaataattgcttatttttactttagatatgcaagtgataaaaagcacagtttttaaaactatataatatataatatgggactaagccataaaatatggatattgacttttataagtttatacccttcatataaatggcaaagtaggttttgaggtttttttagttgttttgtgtattggggtgcatctgtgtagaggccacgagacagccgtaagtgctgctcctcaggtgccagctacctttttttttttttttttttttttttgaaataagtctttcactggcctagaacttgctaaggaggtgaacctggcaggccacagagccccacagatctgcctatctctagctctccagccctggaattatgggggtatgatactatatccagatttgaggggatggaattttggttaaagtggggtcttcacactacaaaggaagcactttactgactgaatcatctcctttgtcccagagcagagtttaaattcagaggggtctccaatccctatccacagcaattaagggcaacaaactgcaaaccagtgtactgcaccgcctcagacttcagccaacagcacgcactcatagcatgttcctgactgcccacctcaccccacactgaacaccacacaagttacaccagctggccaagtgacaggagaccagtagttgcttcatcagcagcaaatagaaatgccacaaggaacaaaggaagagttctgtctataggaaggaaggcatgcttttaaggtatgctgccaagaagcagggtgaggagaggcagggacatccagggatctactagatgaacaaggaaaggcggtagtagttggtggcagattggagatcttaccacgtcaggcaggattgcccattagtcacagcctgacttttgtccttcctcctgtaggacatcataggtgaaaagatgtttctaaacccctcactccctgcttgtcttgcagagtatggcattttcctatttgtttgggttttttttttcccccttcaaaaatgactcacaaatgctgtattattttaccctacacaaattgttttccataaatccatgggggggggggggagtcttgaagccatatcataaacatgacacatctgtttctaataatcaaagaagtataataaaacctttactttggaggaatggccaaagtttcatcctaaaggcaaattatatccatctggtccccagagagctggcttttgcattaaggaatatttgttgcttgggtgattagagtgtgggagtcagggagaggggaagttgttagctccaacacttagcgctaagtggagttcatttctaaaattgaagcttccagaaactggtgagtaatcctccgtcgtggcgtgatattatgtcaccagatctgctgagccgagagcacaataaaggtaatcctccctcctgcaaacgctggtgatgtggccctgacagatgtgctacaggggaaccggatagagctcaggagccggggctaaggcagctggtgaatttccggtccacatcactccaagtccttgtaatgtgcagaggcctagaatggccttccacctctgacttccctcgctccaggcattagtgagcatttctgcaaggtctctcaatatttccagccagtctggcaacttactgactatgcagacaacaatagatggtgaggaaggcagtgaaaggattgggtaagaaaatgggctagcatttagaggcatgtgtcctgcaagatttcagtcttgcaggagctacctgcaggtgtaaaaggagccacttgaatccaaggccgaggcctggtgacagggctttatctgggctccaatctaagaaactcaccagctttttccagtgtgacctactgacgcaattgtccagtgtctatgctgaaattattcttaatgatccctactcgtctccaaaaagaaggtaacaggtaaaggaaatttagatcaatataatttaatgactttagtctcttggtgacagattcaagcaggacttacccttcacacaatgtctagtccactgtgtctggccaaagccttaatactgggctatgaatgctatcttgaaaaaataatgggctatgaaagctatctatgaaagctattcagatctggtcgcatgcctacggaatccacgcccaacccctctaaactctagaacagagattctgattggtcaagcttgagtaccaagcatcctggctagggaaggcgtgatgcccttggccagtatgagatagaacgccaggaaaggttgggctaccttcacaatcaatcaatcaatcaatgaataaatattaaaaaaacaaacaaacaaacaaacaaaaaacccgcaaagccattcactgggatggtactttcagaaaactgtgaccatgttcatttggcaatgcttagcatttgcccctccggggagtgagcccctcccaataagacagcagggagcacagccatagcatctgtgtgcatggaccaggcagaacccacgtgttaccgtggagctctgttatgagatgctaagtgagcagagcctgcggcttattaaatctcatactgcagagactccaccaaagttcgctcttctgtcagtggaatctcagaattgaacaggagccctcagaggcccagcagtggcagaaaagtaagtgaggctgatcagcccacactttggagtttcactgaaagcattaaacagcctttagttttaaatagctcaggttgcttcatatgcaatcgtttacgaagtcttcagctgtgtctgaatgccatgaaaccttgacatgttctctctcgctcttgttctctctctctctgtgtgtatgtgtgtgtgtgtgtgtgtgtgtgtgtgtgtgtgtgtagtgccaagcgttgagcttagattctcttatgtgttggagcctcactttaacactgaggtgtaggctcagcccaggtgactcttgttaaaatgaaaggcaggaatctgggacttccacctcactttccccaccctcttataaatgcccatttctgtgttttcttgctattgggcatttctctaaattcctgtgtgagggagcacccaacttatttcctgttacagttacatccctactttgcaattcttccccacattaaataacaaacacatcattctttaaaaccagtgccttttctttgactcagttttaactaaatgcgtctaattgctgaccatgggaatcaacaggtaatatatgttttacctttttttca

SEQ ID NO: 303 - DNA, 1900 bp, Mus musculus
aaggaatgaagtaattttagccccaaatccctctaagtcctttccacaataagaaaatttaatttgccatctctctgaacctacatgctaaattgtattccatgtagtacgttttaaatccttctcttctcaagttagagaacttcagataattgatttaatatattagagattttgcttgctctgatgaaatacctggctggagggacttaaggaggaaagattttcttcagcttacactttaaagagatgcagtccccatggtgaggaaggtgtgatgggagcagcttgactatgggcactgggagcccggcttgcatctgggtgtgtcttagtttcctttcctgtttctgtaagactctcacaaatcagcttaaggaataaagcatttatacagcccacaattccaagttatagtccatcattatagacttgcagcggtaggaaatacattatgtctgtagtcaaggtccgggcgtattaaattgatgcattcatcccaatgtctgctggcttcctctacttctacacaagccagaattccctaagcccgggctggtgcaacccttcctacttcaattaccataaccaaaataacagctcttcccccccacccccccactcccccaccccaccccccccccccccccatcccctgactgaagctcccttctcaggccatcctggattgtctcaaattgcagatcatcacgtgtatcaggagcaatgaaaacacagctccactgcgaatcaactgccagagagaggctcttttcagagactttcacccggggaaagctgaaaccctgcggcttaaagaagaatcttaggatgagcaaaatatagaggacagttggatttattaaaagcaaagagaaaagtgttccaaggaaaggaaagcaccccgcttaggacagctgtgggcttttgaagggagagctgccctgccctggtctccatgcagcaggttcctgctgggattctgccggctctccttacgtctctgagggttgggaagatgctctccctgcctttctaacattgacaaaagagtggaatttgtaacaaactgaaaaattaaaggaattttcccagcaaacaaaatcacgaggtggatttgtgaaaggcattactgagagggggagcatattggcacttaagtgtttacattatgttagcttaaataagctcagtctaattgccgccctttgacatccatgactaagtgtctctgggaacacattagctagtcctaaggtcactttggtcattgctttagacaagataccttttgaaagtcatacattgtctttgtggactatttggccttattagtggtgtctaaagtctctgcctttctcggtggtaaaagcagatcagatttcggcttctctccttcatctccatgactatgccttaattacctgttgttcaatgcagtctcatggggagcaggaaatagagataggatgggatttagggtctggttacacggatcaaagacttttcccaataacccatttcctccactaaatctccatctaaaacttccccaacttcctcagcatcaccactagttggggaccaagggctcaaacccacttccaaggagggctcatttcatgttcaaaccataacacttaacttatgtaaatataatctttttttttttcattaaaatgaaaccaaatgtttaccatgtaaaattataatgttgggtgaaagaaaatatttaaacaatattgttggcatcaaaagaccagttttgtagatctgctccaaactcaggagtcacacataggtgttacctgttgctatggtgaccacaaaccttcccagaccccacttcccacactcacctctgaacagattacaaaagacagacctttctccacttttg

SEQ ID NO: 304 - DNA, 2100 bp, Mus musculus
caccaaggtatcttcctttttaaagcaaacaccaaactaaaggcttgctagaaagttcctctgatgtttgacatgaggcagccctggcacaaggacttcttgtgcctctgcaaagtgttgtttagagtgtgacccaggaacatcacgggtacaggcttctaagaaataccagaagtaaccctcgggttggaaaagctatttctaggaagattccgaaagtgtaataaaactttatcttaggaaagtttcccctacacctaggttattatacaaaaagtgggatttcaaagggaaaaaaaatcacctgtaggtgcaatgaactttacaacccatgatctaaatcaaataccaggcgactgaaaatgagcgtcctacaacttagtggagtagggtctcagcttggcattgtccattgatttagggcttcccttactttccaaccacttcgcaatcgtctcttctctgaaagtaatggagagtaatgccagacatatgtttcttttcacgatgtggacacaaattcaaggccacaaaatgaagggaggcacgtctgtctgggtttgtgccctccagacaatcacacgttccatggcttcaggtccagcagtgaaggcgcatatatgtaagagacagaggtctgagctcccacatcaggctaacaccttcctgccctctggggttttgggttggtcttaagaccacactccagtctttattctgccagctaacatctgggtactggttggaagatcttttaagattcattctcagtccttgtagtcagctgatacatagatactgctgacccaggctggcactcctctctgaagtgtgttgttcatctgattgtatcattcatgcctggtgtcccaccctaccccctgcagcccctacgccttaactctgctcccctccccatctgagatgctctacgttccttagaccctttccaggctcagtccatccagcattccttccaatagacacttgctcaactttcttccttgtttacgtatgctgcatacttacagactcactgcaggaggctggctcctggttattcacatgtgccctgtcttcctcctgcatcataaaccaagacacggtctattccaggtcttaacttctgctctaggatatttcccagacccccacccaccccagccagccacggcttagaaaaaaaatgcatatagtttttgaaagctatttgctacttagttgaaatccattgcacagctgcttccagcttgaattgtctgtgaatagatctgaaaaccgatttaaagtaactgaatacaaggagctttttaagtcttttaaatttattttttatttttaatctctgtgagcaatgtctttggggagctgtctcactataggtgatgtgctggaagtacataggtttgtccaaaattctagaaaactgggttgcttgaaacataagctgatttgcttgaacctaatccttcaacagctatttttaagcacccgctaaaaatgaacataataaaaatctacacaagtatgccatgatgaaaagcagaggaggtggtgaagtgaaaaatcagggcagctcacctaggatcccccccccttcttccttccctagtttcctaagtattcctgtctagatggacgttccacacacccacatacccacacacccacacaccatgatgctttgctttcaaaatcagatcgtttattttgaaagaatcatcatattcagagaatcattacttgctcccttgggttatgtgaccaccaggcagtttctaaagcctccaggaagatctgctttagacaaatggatggaactagaaaacatcatcctgagtgaggtaacccagtcacaaaagaacacacatggtatgcactcactgataagtggatattagcccagaacctcggaatacctaagatacaattcacagaccacataaagttcaagaagaagaaagaccaaagggtgaatagttcagtccttcttagaagggggaacaaaatacccaggggagaagatatagagacaaagtgtggtgaagtagagactgaaggaatgaccatccagagactgccccacctggggatccatcc

SEQ ID NO: 305 - DNA, 5100 bp, Mus musculus
gcttgcaaaagtaccgcatccaagggaagtttataacatgtcatcaccagcctgttatataacaaactattagtaagagaaaactttatttaataaagaagatagaaaagaaaaaagaagggaggaaggaaggaagggagggagggagggagggagggagggagggagggagggaggaaggaaggaaggaaggaaggaaggaaggaaggaaggaaggaaggaaggaaggaaggaaggaagggtagtgtggcatgtgcacattggcacccaccaactcccacctcaccgctctagcaacccccttctctgggggcatcaagcctccacaggaccaagagcctccactcccactgatgccagataaggcagtactctgctacatctgtagtgggagccatggaccagcccatgtgtatactttggttggtggtttagtccctgggagctctgggggggtctggttggttgacattgttgttcttcctatggggatgcaaaccccttcagctccttcagtccttcccctaattcctccactggagtccccgggatcagtccaatggttgtctgtcagtatctgcatctgtcttagtcaggtgctcacagagcctctcagaggacagccataccaagctcctgtctgtaagcacatcttggcatcagcaataatgtcggggtttggtgtctgaggatggaatggatcatacagtggggctgtcagtttctagatggcctttccttaagcctctgctccatttttgtcctggcatttcctttagacacagacaattccgggttaaaaaatgtttagatgggggggggggggcatccctccactgggtgccatgcctatctactggaggtggtctctttagggtctctctccctgctgttgagtgtttcacctaatgccacccacatttcagtcctcccttggctcagcttgtacgaggctcagagacttaatcagtctcatagaaaccttcagccttggccagctgctgccctaattgctctgaaagcctcaagacaccaaggccaatggggttttccctctgtggagcctcccccaaaactaggcttcagagttctgctttcaccatgaatgtttaatcactctaagctttctctctataatagtaagagccatccttactattcatcaaactgttcatttgatccctgtgtatctcagaatgctatgatgatctcagtacatggctatttcccagagtaaaatgtaaatttctacctgtggtggtgagtgttagtgtgtcaccttaaaagacacagctcattgcctgggaagggagtttcaatagggattatataaaccagtttggcctctgagcatatctttagggactagtcctggttatcttaactgatgtgagacaacccacccactgtgggggacactgttcccttcacagagggtcttgaatgatgtgagagtgaagaaagcaaattgagtgaaaacatgtacacattaccccactgtgctttgcttttgactatgcatataatatgaccaattctctcaaccgcccatcactatgacttctgtgctagatggagttaagagataaaataagccctttcttccctaaggttattttaacacaacaataagaaataaaaccaatacataacccaaatcacactgaatggttttcttcttgactagcaacatagactcaagtgataaagatgtagccaaaggaaaaaataatatccgttaccataaggaaaagtatctttcaaaaattacagaaggaagagaagaaaaacagaggaggataagaagacaataggggatagggggtgttggttgatttgggtcaaagtgacacaaagctagacacacccgagaggaggggacctcgactgaggaaatatattccatcagactggcctgtgggcatgtttgtggagcttttttattaacggttgttgtgggagggcacagatcattggggttgccctgggtctggtggtctaggctctatacgaaagcaggctgaagaaaccatggtgagcaagccaataagcagcgctcctcgatggcctctgctttggttcctgcctccaggttcctgcctccaggttcctgcctccaggttcctgccacactggacttccttgcttgactttccttcaatcattggctgtcatctgtgagccaaatcgacttttcctctccaatttccttcacagtgttgtgtcacagcaatgacagaaaagctagctgtgaccgagggtgaagagaggacagaagaagagaaggcagcagagggcgaaaaggaggaaacaaggggagggaagcagtctatgagacactggactatagacatgccatcttctgctccttttcaaccccatagaaccagtacagcatgtgaattctctccatggctctaagttgctgcacgccagtcactaccattgattaaagccactacctttcatttttaattttgtgtaaaagagagttgcaaccagtcttcatagcaggtcactgtgggagctcaaaaagtgagaagccttatgtggagacagaaactctcactctgggtgaaaattaaatgcttaattaaaatgatgttccacagtggctgtaacactcatctttctgaaagggggtgttgtgtattccaacacctacagtgtgaaagctaaattctccagtctaaaattatttctatccagctgtagggatgatgtcaccttaaaaggagcccatggtgggatttgccatttgaataaaatgtagtttaactcgaggcaggatgattcgattattcttttaattttatgctacacacctgaataacacttattctgcttcataatgaagttgtcttaaaaataaaagcaaagagttattgaccaaactcttgcatagcccccactgatgagatctcactagggtcagcaaggggatgaagaaaagacagacagacacagacacagaaaaatctgaaatcaggtggactgggctctgatggagaagtcagaggaccccaggagttcagcatgtttctcatgaacagctgaacagggaagcagcaatactgtatacagctaaacaagggtgcagggttatttcccaaaaataacctaaaaatcatggtcaatgtgatcagaacttcaaggaaagtggtctgtctgcaatagattaagctcaaatttcttggaacagtccagctccatttgttctgtctcgtacatatgcttctgtccccatttttggtacaaattaaaaaaataagtcctaaaggtccatgtctataggacatccatgctaacatctgcagcaagtccttacgtaagtctgggtaaaaaaaaaaaaaatgcatcttttttacccagaatctcagaaaaaaatagatttgggaatcataaatatgggattcaaatccctactagcccacatattatctctgaaatcattagcaagacgctctcattctcactctctcgctctcctcccaggttcttccttatataaaatctaattacctacctgaaaaagtagattggagtattcatgcaaaactacaaggtacatgatgctcagagagtcgttgagacgtggttgtgttttaattgtaaaggttcagctttaattacttacatcctttcatggttcttagaaataccaagataaattaaaaagggaaactacagtaggctggagccaaaactcttccctccatctcaccttactgagacactgtagaatgtatttgcccaggaagcagaggctctggggaagctgctgtgtggttgccttcactctaggagggaaggatctggattccaatcgtgacctctgtgctgctccctagttcgaggtccatgccccatcctaaagcaaacacatgaaatcaattacacatctgaattccaggcaggctcctcttagcaggggatatcgctgtggccaagaaaacctggtttaccacggagagatttctgcagagaatgtaaagtcacatcagtgagattgttacacgccatatcttagcagaagaatgcaacctgggtgttctactggtctcgtgtgtctgtgtgtgtgcaccttcagtgtggctgtgtctactctagaagactgcagtctaggactaagaagaccccagacagagcaggtgaggggaccaatcatatactgctagctgtttggaggagaaatgcaaggattccaatctgaatcacatgtcattggtccttaaaatactcacttctcacttataattctctgaactctgacctttcatctgttttagcagaacttgctatgttggaatttgccaggccttcagaccctccatctcaagacctcccacttaagttcaactgaaactatttttatttttattttcataaactgaaggggagaaaaggatcgcttcccttagcaagaggaaaacaagcagacttattaagaaggcgtcttggtcagtgttctgtggctatgaatagacaccatgaccagagacacaactcttatgaatgaagatattaaactgggcctggtttacagttcagaagtttagttcattactattatggcaggaagcatggcagcatcaaggcagacatggtgctggagaaggagctgagagttctgcatctggactggtgagagagagagagagagagagagagagagagagagagagagagagagagagagagagagactggacctggcttgagaatttgaaactgcaaagcccaccccagagactcatttcctccaacaagatcacacctactccaacaaggccacacctcctaatccctgtcacatagcaccactcctaatgaccaagcttccaagcctgtgagcccatgggagccattcctcctcacaccaccacaagagaacagctggcttcccaagtgagggaagtggctcaaggcacagagtggccaaggcatctacaataaaaagtccatgttttaacaagcaaatgtaacttagaaaagggtggtacaacagaaaacagtctaaagctacagaggtggaaatgatcataaaatttgccattttaaccattagtaaatgttgaaatctaaggcattagttacaca

SEQ ID NO: 306 - DNA, 3175 bp, Mus musculus
gaataagactgaaagatttttgagtcctatactgggactattaacagtactagtggctgccatacttcataatttttggagtgacattcatgaaggtcatgtaaatgccaccccctggagctgtataggtcacaatatgtgtgaccatatgctggggccctgaatttcttatgggcagtctgccttctcctgcattcctatctgacacactttatcttgacaggctcctgttttggttttcattctccaaatatccttcaaataacaccttaagttcatctttcgctgttagtgggggactatggtcgtacaggcatgctaagaatagtggaagttaatcttaaaggagggtgctccatatccctctgtctacacagagtcagtacctgcatctatatatgcaaacatattaactgaataggggacctgaaaaacatttcagctaatagagtacaaaacaatgactgattgatataactacttaaaaccttcttagcaatataatttgctacatctcgtagctttggatttacatgtttactgacatctctgaggaaccccttgactcttttcaaaaatgaaaagaaaaagagagagagaaagagaagggagggagggaggagggagaggaggagggaggggaggagagagggaggaaagaaggaaggaaggaaggaaggaaggaaggaaggaaggaaggagggagggagggagggagggagggagggagggagggagggagggagggaggaaggaaggaaggaaggaaggaaggaaggaaggaaggaaggaaggaaggaaggaaggaagtagaaagacccctgcaagtgagcagctgcaaggcttccttgctccatccccagaaaactgctgagtcgttcctcccctcccacagggcccgaagggatctcactccactactgccattgtctcctggttttattttaatcatatttttcaatccccccaaccgactccaatgtcagcaaagactgctgatcttgagaagtcctttgttgtgaatcccgctgagccactttcctcagataaatgccccctttgaaggcctgccctagcggtctgtctccgcgttggctgtctcactgaagaaataaagcagcatgccttagggaagcctcctcagtgtccttcccatttgcgcactcggtttgtgcactgttactcatcgtagctcttctgcggacctaggaggtttgcagcttggctcaggctctggtagacgctaagaatctccctaggtattttttcactcttctgaaccaagccctcaaaagcaatgacttgttgacaaatattgatcactttcccccccaaagataaactaatacatatgagagggcagctaaatatgaagttgagaggtttacattgtcaaacaaggacaggaggtagagaaggaagaccacacttccctacctccagacacggggagggaacaagtcagaaatgcaacacctcaagacacttgcagtcagtcttccctatacaagtgaagctgaataaaccgggtaattcaggactgttctttcttgctgcacaaagggcaccatttgctattgtaaggtgtctaccattgatgggagctttgggagggggtccttatatttttaattgaaataataagtgtattgtatatttgagggacataatcaatgttttcatagggaaaaaataccatgcacattatgcaatggtcaaatcggggtaatgattatctgtcacttcaaatgtttctcatctttgtgataagaacattttaaatactatccgttagaccagtaaagtatacgatgtattgtacatgtccagattcatcactggggaccttattacaatgaaactgactccttgggtgaagtaatgcatttttctccattggaaaagaatagggggtagctatattatgtttttttgttcatcttgaggtaggccctaattgcaagagcccagactaggtagaattttcacttcttttcctggatgtcctgcaggaggggatgacaggcatgaatcccccaggcccgcttgaatccaagccaggacacttgaatctcacttagaagaaggaggcttaaaatagtcacaagaggcagaagatgggagggaactgagggggggggtagtgagaggaatggaagattcgggatcaggtatgtggaaggacagaggagatgtttagacagccatgaaaataaatggaaatctgcaatagatggggctgaggaggttggagccatctccaggatatgacagagacctgggataagggaggtgcctaagaatcaatgggggtgaccttaggtgtgactcactacattggggatatggaacctgaagaggccacctcctgtagccagacaagaaccccagtgaattctgcatatcataaaagcttacagtctcatgctgttctctgtgcaagctagagaccactcatcaaggaacacaatgaaggacacttgctacttgtgacaacttcaaacagcaaatggctgcatgctctgcaaccaatgtcttctctgaattgtctgtctctgaaagttaggaagggtcagggagtccactcccatcccctacccccaaccccccaatggtttccacccccaggaggcaggcactggatagcagtgtgatacaggctgggctgtctcagtgctgggtgtttcaggttcttggtttggtttttgcattaccagcttcagtgaggtggaacagaggattacaaagggataagctaaatggcaattgctagtgtattgttgtgatcaccagcaccttttccaatagcatttttcatttcttcaaagctctatggggcagctaatctatttaagtgcttttgtaagaaaaaaatagacaatgcccaagtggtgagtgccgtgcaagttaagaataatatttcttttatccccaaaactccagaatgtttacagatcttactattattataaatacaaacgacaaaaagaatttagtccagtgagaaatcaccctgctattagccataaagagcaacttaaagtacaacacactacctttgagcctttcgcccctctccagtctttggggactgagataaaagtccaatataaaactgggtgttgatccatgattagaagaactgcttattttaacagtgatcgtgaccaaagac

SEQ ID NO: 307 - DNA, 2375 bp, Mus musculus
ttcaatccctaacagtgacacgccttcacgggatacaatgacatcaccaggcggcaagacacggtgagcacagggggcccttctcattttcctgtttcctgtcatacccgctatcgctggaggcttttatcccgagtacgttggcagggcctgcatatgcatgtgtatctgtgtgtggtacaagctccgaggccttgtaacagagatgatgtatccccactgaagagaaatgacagtccgaatgaggagaagaagccaatttgtcacttaatgcagagcctgattgtgctgcagcaggagcctcacaccgagattgattacaaacaagatgacatttccctgcgggccgcctcacgcattattataaataaataccactcgctttagcatctgcatggccatcgatcgagaacacattcttctgtgccttgggttcacagtaaatatcccggggaccacgacggcctttcttcaatgtgtaaaagcagcgtggcctcacatgggacagtttcataaagtggggactgtcacacagtccatgagaaaagaaagcacacacggaggcgaactgaccctaggagttcatttccgagaaaacttagccttaaactgtggtggggctttgttccaaaggcttcggcagctggacaaaggcgcggaaacctgtgagcccaacactccagacgatcccggactccacagtgagaccttgcctctaaggagaagaagaagaacacacagtctatagcccctcaacagctgtttgggggttgtttggaagtttgctttttttaatcatttttttgtgtgcgtgtttcacatcagcccaagagaatcagttgtgatctgggagtctttcctgaaaaaaaatcacagtggaattttcgagatggaaataaatctgttaaatttcgaatatctcttttgcccttgccctgactgctccaaatctgtcatcttatgagtttcaaataaataagttattttaaccagcaaaatatagagtgactgttttctatttatttctttacgctttgcttcggtgcaagggtgaatttgatctgcctgcggaaattttttttttttcatttcagtatctctccactcattttctatattcccctccacctccttttgaagcttttctatctgctccatctttccctcctacataaaccacgagtttggcatgtttctggcgtgacgtgagtgccccctgctgtcaacgatggtgaacagctccgcaaccaggcaggttcagaccaataccgcagatggagaaaaaaacactacatccctgggcaaacactggtaggattgttaaaatgaataatttattaaatcgcgattgtttattgacatccctttcattatttacttctcagttattaaacatactcgtggagtgcctgggtgttagcccttggcccactccaacgctttttcccaggcagggatggagccagccccgtgattctctctatccaagacattttcgatctcttttgtcaggtcggggtcaaactacagttgttccatgatgactttatcaattctcagctgatagactctaaatgaaaaactgcccgctgctgcctcgccgccacttaagaagggggttatctgggtaatattctgtcaatcaggcagggtctgcgacagacaccgggagtcaagtgaaataggaggagaagatgatttcaatgtttttattagtcattgtcccccacatcaaagactagctgacagccatccctgtctgtccttccaagtcaaaaagataagggaaggaagccacgcatggacatttgagggcatgctccattctgaaggaaatcagcaagtctgtgtcttacagaacgatacccgtcagccctcacaatggggtgggtccaggtcaaaagcaccaggctccaatgggaggagcatgtcccaaaaagaaaagctctaaccccagacttgaagatacatgctagtctgcacccgggagaggccttggcttttaaggacaaactcaagtttcccggtggtttgttctcatacaatatattcgggtggcacttctcccttctcccaactcctcctcatttttaacaatgcaggagttcagaaaggtgtatgtgtagtatcgatagatagatagatagatagatagatagatagatagatagatagatagatagataatgaataaatgaacctcaaggccaaaaaaaaaaaaagtgaaagttaacaaatttcactctaaaaccccaaatcttaaaacaaagaagtgatggtgagatgggtcagtgggtcaaagtgttcaccctgcatgcctcgagattccacactgaaaggaacaaaccagcttcgctggcttccacactcaagcc

SEQ ID NO: 308 - DNA, 2700 bp, Mus musculus
ccacctgtctgatctctccttaatgcctccctgccttgccttatgctcctgtaagttacggctccactgtcctccacttactgtttgccaatgttatgactgtgttaaaaacaaagacctagacagtatgcactatgcaagcctttggacatgcatttgcttgtatgctagacatagcttcattcattcagtaattatttattcgtaactctgttctagatacgtatgaaaacaaaaacaaaagccacgtatggtctttgtcttcatggtctaaagtctttaataggaattaagtaattaggtgatcattatagaaaagatcacaggaggcttatagaaacatccgagtgtgatatctaagctaaatatttagaggcttcctgagagaagaaagagaagtatcctttctccacagagagcacacctttcctatacatgagtctgcaggacgagacacagataaatgtggcattttaaccttctgtaaaggtttgctgccgctgctgttagtggaagatggcaaggagcctttcttccatacaaccccttgttgaaaatgacaacagaaggctcaagaaggtgctggcaagtggaagaggagaatggaaaatctgttaatgtggacactgactctggaagattgatcattgtcatgttcgtccacatcaagggccaccctttatctccaacctgacccactactcactatactaccagagaagggtgtgtctttcactacctcttgctccagaagaagaggcagagccttgagcatatacccccagtgaggctcctggtggatcagaggtcagatgttgcttgcagcatgagcaaagattgcatctcagggtagggcctgggcttatgctgttggcactgagctgccttgcctgactccttggcctttggctagattgttgggaacacagagcaaagagctatctgtacccggagtatgaattcagtagagagcttttgtatggttttttttgttctcaagtcctcgtggcaacctgggcacactcccagatgtgagatgcctgttgtccagatgtttctctggacaactctcagtactgggtggacctagaggatgctccacacagaaacatttgtccatttgcagttacctgttgtacaggatcggtggctctctccagtgtagttctgtgaaccagagcattttggggggttggggaatcagcaaaggacttatgaaagcctgggcaatccacatgacatgctctctgagcgactctagtcctgttgccgtggtgattcttctggatggagcacaaggcattggctgctttaataaaggtacccctggctgacaaatagaacctcttccttgctttagtggaaacaaagctattaactagtagttttttatttttaactacctgtgctatcttggaaaaaaaaaatctccccgagggaaagtggagtttttgtgattaacttcaagagatgttaaagggtccagcatagacatgatttattacttctcaaaggtctttacaaagcttgtgacatggtggaggcacagtacatactggagcccctcttactttgctccctctctaaattatggataaggaatctaggcctcacctcaggactggcccttaaatttaatagtgccaacaggaacatggcccactgtctgactctttctccatgagagtgaagtttgtggagacctgtttgcagcacatttatcttcttgttgtagaaataggcaaggggaatctggcctctgggtgaaagaggcagccctctctgtctcatgactttagccatgcctaagttaatgaaggcatgttttctcaactgactgctgatcagtgtacagtgagcttggagtctcctggggcctctggcaaactgcaggttacaaatggatagcttgcctctgatctgaattatctggagtagacttcccaatttcatgaaatgtcatacacaagccaagtagttgatgactatgcatgctgacaggaaatagagaggccagagattgtaaattaagtggattaccatgttctcttgtcatggcgatgcgtggctatttgttcaatggtccagttgccaagtgttaagtgatgttcatttcaacacctactagttgatggtccctataccatgctttatgtcaggagccatctaggaagaggctaagcaagcaagtgattttcttagagacggcccaccatctttttttttttttttttctttttttggtatggctttgtgatgggtgagctctgagaggcaacaacccaacatcctgggatttcttcttcctgctgatatgccttttcctgtcactattactgagtataatgattcctggactttagtccactctatttggcatatttcctgaagatcaacacaaagatgaactttcatgaattaatgctctttagatggattaatgattttatagaaattctgatttgattcaaataactttagaaagaaagtttttgggagatggttgctttgccagaaagatggaacaaaatcagaaccaagaggaaaatgtgcccagttctcgtagtaagtaagggctatatgataaagaatacaataagctttcacaattacactacaaagagaaataggcttgggacaaatttatgatagatgaaaagcattcattctaggtcagatccaaggatgaagccacaggtg

SEQ ID NO: 309 - DNA, 2150 bp, Mus musculus
aagaaagtagtcccaaaagaaatctctagcctcttatcactaacagaatctatgttctgtacacatgtaattgactgataatcggcacttagaagtaatatggatagaatctacatatagctacttagataatcaagactgctattgagtgtgtgtatgtgtgtgtgtgtgtgtgtatactcaaatgctacatgtttaaactcataatgtgctcacactgaagcaaatcatggtgtattttcaaccatgtacattccatttgcagttaaataagtttgcatgagaagaagaggatagctatgttgggtgagttttaaaaatagaaatttacaacagcataggacaaggatgaaaccttaaccttccctttgttggttgtcctgtgggataaggagtggtgtcattgcctctaatccacaagtcccatgggggaaaatattaaatggaacacagaatatggaaacaaataaaagatagaaaatgaggaactgcttctggggtaggctttctattcttcagtagcctgcagtgtattgtcctgccatcccagtaattcagtcagcagcagccaaaaaaaaaaaaagccattttatttaattgatgaaagtatacatatatagcatatttatcacaaataaatcaataaccatcagatataaatttatttcacatatttatagtctctgcttacatgagaaaagtaggattgaaaacacagctctacacagtttggtctgtcatcaacatagcactaacagacacaagcctcaacacatgactcctgtagcttcaattctggacctgccaatcagaaagctcagaggcttcaaaccaaggctgctggtatctcctctgtggccagagcatttgttgtggctcagaactctaattcttccaataaaggcctagtttctccttttcttcccactctcctgagctatggttgaagctccctggaagcttctctggcttttcagagaaggcacggtgtgtccatcaccaaggtctatccttcttgaggtgtgtgtgtggcttcataccttttgacatcaaaccaaatattgatgggtggggtttattcagcgccccatccccagataaccacagatgggaaatggaacagacacagatacgcctttgctcccttggccactctaacaacactgcaatccctaagagccagagcacggacggaatgctaaaaggtgacatgcattggttgtctcagtctttctgcctgacatggtcattaaatctgtaatcactgtgttcctaatctcgacttcatttggaaataaataaaaatagcacttgagcaaaagaaggcttttctaaaccacaagggatgtattgctatggcaacatcatcaccaaaaatagcaacattgattttgacccaggatttttcttgataagccaacatggcatacagacaagacctgcaaagactttaagaaaaaaaaaaactcactacaatttagcacacatgcatcatgagactgtgtgaagcctgacctggactgtcatcaaacaaagaaatcagactctactctttgaatctgttttacccattgataaggaacctttaggggcaccctgtagaccagactgttgggtccttgatctttttaggtgaggagtatgtctaagtctcatggtagccaaaccaaaccaaaatatcaaaaataaataaataaataaagacacacaaacaataaaacatctctatctaataccttatggagaaaatactagaaaggaactttaaaatttgtacagttttgtgtgtgtgtgtgtgtgtgtgtgtgtgtgtgaatgcctacagaggctagaaatggggttagaatccccacaggcaattgtgaaccacccaaatatgaaatcaaaattcagatcctctgcaaaaacagccagtgctcttaaccactgagctatctctctagccactaaaactttaatttccatgtatttatagataaactgggaaaattactgcccagcatcttaatacattttcataataatcatatcagcaccaaggtctttttctcttacatgaaatacactaaaataatctgtcagttttccaagcaaacttatttgtctcctctctcattcaacctgcctttcctcctgtacaactctgagtt

SEQ ID NO: 310 - DNA, 1800 bp, Mus musculus
gtctggaagagcagttcattctcttaatcactgagctagctctccagccagtgatctttcagtaagtgtatgttaaatgaagagagtacaaaaccacactctacaaatgtcaatgaatctgaagggatctgtttgaatttatggtgaagagtggctacattttaagtgataaatcagccccaaactagggcaacccttcaataaaatcctattaaaataaacgaaggccttagggtcttctgggatgatagctgctctcatttctgaatgagcctagcttctcattcagccacaagctccaggcatacttttgcccacatctcatctcttctataatcctttgggacagagttcccaggaacaactctttcatggctaggctgtttgccagtggcccaggtaaagcttgaagtattttcttccaggatggctttaattgtccaactactggagtttcattatatttccagagatatctgtgtttctgtcacagagatggaagggcagagtgtctaagaggaaatgagtatcagacatagaaatgtcctgctaaggatctgttttcctgaaatcatagatattccaaagcagtgtcttgctcagccacagtttataacacatgcttggattttctttcccagtaaggatttacttccaggattctatgagtaatacagacacaaagataattcactttctattttcagttagacatctcagtgttctcacctaaattaaacagtaatcagggacagtaaggcaaccagttcctcagacttcagcaaagtgagacaaaagccagccactgggaacagtaacaccaggcttgcaatgagagtgtgtaagaattatgattctatagtgacatatacctttaatcgtagcacttggcaggggcaggagcaggggcaggtttggggatgggggcaggggcatctctgtgggttagaagccagcctagtctacatgggaaactccagaccaaccagggctatacagaaataaacaaatattttaaaattaagaatgttgaaatttgacaatataatttctgcaggatgctaagttggtttaaagaagattctctttaaaaccttcttcaggccccactggatgaagctgggaaggggtggggaggtgggtgtggtatggggaagagaacaaaagaccatgaagagtaaatgatcttgtatcatgtgtgaagaccacattctctcttgagtcgttaagttcggtaatccctctctctttatgtctatgataatctagaaccatgttgtaaggaaaatgaattataagcattggatactcgattttgcaggaattgttcttttccccaattgattttccccctctttcacgatgtcacgtgtttacattctgatcaagctttccaaccatctcaagggactatcctagaagggataaaaagctagttttatgcttttgcttgtgtttttctcattgggtgtcaaagacatttctttcctgctctatagaattcccttgcatctcttatattcttcaaacaaaacattagtgtggctgtaattccttttgagagaactgacatttccagattgttaaacatttttcagctcatggcaaaatagatgacttagatgagggctagtggtgaccagagtcttatacctactccaattcccaaagctgctgactttcatagacacctctctctgctttcattgtttgaatcaataacaaagggaaggaggatagactctcttggttatttgtcttcatatatattaattcataaatgtaaggacttaaagggag

SEQ ID NO: 311 - DNA, 2125 bp, Mus musculus
agcctgtttgtgtggaacctcctaaccttctcttagcttctgagatactgtttgcttttgcaaagctccctacctgattcctgaagctgctgaacaaggtgccaggatgtggggtttgccttcaaaaccctctgctctggacacctgaagtcacacctagatccccaagtatgtgggtgtggtccggggtggttgaaatacgattttcaattggttctaatctgtgtctgagtggtcatttctggtgggctgcctgcaacacaacacaagcagggagttacaatttatgacctctagaagggaggcggtgggtcttaagctaggaaaaggagcaccctcaccccttcctgacttttttccttcccatcagtctcatcttagggatccccattgttcaaaccctgcagaagccagggtaaagttttccctattaatatggggtgccctgtttatagaaacccaacagttgaagttcatagacagaaaacaggttcataacagatctcactagtgggtcctaagatgcctcagagtgatgtgcagagacagaattgataacttccactaggcctgttgatgagctagaccgtatgctggcgcaccaggctctgcctccttaccgccccccaaatagcacacttgctgtccctgtagcagagcccacgtctgtctcttactgttactcttttatgatatttctccggagttttacagctatgtcaggggtttgtttattggttgctaataagtggccaatagaatgtgttccaggctaggtgtaaaagatggaaggagcagatagggatcaggggctgaaagagtggaaggctattggactggctaagaggccagtggtcagtcatactctgtctttgtttcatcgggggctgctatagaagtcaggcaggaaaaaggcaccgtaggaaatgggagagatgaggatagagctggtgggaggagaacccccatttccgaggggattctcagcaaagagatagcctgtgccctgacagaaggcatcatgaatcaagagctacagaggcacacaagacactcagtgagggtttggagtcagaggctctgataatttgccaggcggctgcgctgttgaaatgctgattagaactggtcaagcttccaagactcctccctagaacaggagcattcggaatcccaaggccccatggtgaagtcccaaggcgtgtttaatgaatgctgctgttattcagggacacactaacatctgggccacataatgggagtaagtccaaattcattttttaaagaaaaatcaattctctctacttctgggacttccttaacactccatcaactctgtttccactgcgaggctctgaatcttttgttttacaaccttttccaaagggagagaaccgccttggggaaggtggggagagctcccctggcctctgtttgtgattgctggttagaggagctttcagacttgtatgctctcctgcctccccaacacaaggctttcaaacatctgtgagtgcttttttatttttaaaatttgtgtgtatttttaaaaatagacagtacattgtgtggctcaaaagccagagtacaaaatgtaaaaaggctttttttccattagtctccttgcacatcccccaccccctggatggcctaggaagccgtgtggaatttacctctgtatttgcaggtaatatcaatatagaatcacaatgttctctccttttcacataaaaggtgaaatttacatatatccttcagacatataaattaaaaaataataatacacatagaaatttcttacagatgtaagaccatttatcttatcaagtaaaatgcacatagaaactgactggccggaatccagaatggttgggatgtcaaaatttggaatattatgtgttacatactctgtgtgtgtgtgtgtgtgtgtgtgtgtgtgtgtgtgtgtgtgtgtggtgcacctgtatgtgtgtgtgttaagataccttgggaacagggctcaattatgaatatgaagctagttatagtatatataatgaacaaagatagttggtatgacatttagtatgcctgctttttgactgcaatatgaggccaggaactttctttttgccatatcaatgct

SEQ ID NO: 312 - DNA, 5025 bp, Mus musculus
aagattttttaaaaaattgattccagatgtattaaaaaaaaacatgaaaagcaaactttcatgacttaaatgaaaaaactttatgtagtaaaagcaatggcaaataccacacactgtaaagtaaaacagtgcttactatataatgttgtgaaattactatttgtcatctaaaagtctaattaagaaaatgaataacgaactcaaaccttgaagaaatacaaataatattatagaagtaaatgagtcaatgagtgacgttgcatggaaaggagtaaaaagatacacctaattatagcatcccaatagataaataagactaaactgagaaagcaatttttttctatttcctatgcaaatttaacaactcaatgagatttaatacttcagcaatataaagtatttttaaattggaggaataatgcaaatttatatactgttgtttggtcataaattggagtaactgttatggaaggatgaagtactatttcaactatgcaattaaatatatgggtaatgtttttggtatataactttaaggatttgagtctgaagtgcgtggaggggttgctgagacttgatggccaccagaataatgacccatgatcagtaaggaggaagttttgttcaatactgactaagaagttggtgttggttccaacttcagtagtctgttgctgagtggtttatttcagacatatttaagaacaacacaactgggcaaaatcttttctggggataattaactcgatcctgtgtgttcaataaagctaagtaaatctcctgggggaagagcgtaagcttaacgaggatcagaagtcactacattgaaactctttgtaaactgcatgtgaagccttctgtaaagataggtcatagattgactgagaaaagcaagcttatgatagaggtcagggtgagggttccatgtggtctctggccacacagatagtacaaaggctagaatgcatgtctgctcccaaccttcttggttggtatcatatagtgtactcattttcatgaagaataaaccctgtgtgctaagattttaggtttctcagatttccctagtatatgcaagttctcctagatatcctgtgagcacaaaaacacctgtgccttctacaaaagagtagacttgaaagaaagaggagactgggggtaggagggggttgggagactggccagctttaaagcaaatagtcaattaaaagtacttgtagcacctatctgaatccatactttattcctgactgcagtttggtgaagtccttctaataccaatgctcatccgtgtgtagtgtctcactcaccacatcatcacacatcccactatttgaaatcaacaactgcccataaattacctttttaatagtcaagattttacagctgagtggcatagttgctaaaatagattttattatagtatctggggatctggtcatcatttataaataggtttcctgggacaaataattctacactatcaacaactgacctacaaataatttaattacgattttattctttagtaataatgttaatgtatatataccacgaaagagatttgtactgagatgactcattttcagtcacagatttcccatttgctacccattaatgtgtgtgtgtgtgtgtgtgtgtgtgtgtgtgtgtgtgtgttaaagagagagggaggagagagagctatttgcttggttgggaatagtctccagactcattaaccatgagtaactatagcaacctcaatgccacatcccactcacttctgcaaaagaaagcaaaagaaacaacaacaaaagcttctgagttaaagctagcactgggctggcacatgtcaagtgagctcttaaacatccctttaaattccctatcccatttttcctttcagtagttgttatgggcatttccctttttctctttgtttctatgcacattggtttttttgcaatcttagagatacctttgtttgcactccttgctggagcactgtctctaagctcttgtgatggtgatctcagcctgaagggtttcctttttaactaacctggtgtaactctgctgtctttatttaagcaaaaaagaaatgcttaaagaaagggtgactacaaaatttaaaccttttatgtaatatcatgcctcatcgttttttttaacccacaaaagactcaagcagtggatagttgttctcctttgcatgagtcctgagagctctttccttgtcaaatataaaaacagtttactatatatgacttattattgaccaatgctccataagccctcaagccactctttagcacatcaagtctgttttacatggatctcactcatagtatccaacacctcatttccccagacctatgagcctgtcctattgtgaggtattacaagagaacttcaatgtactttgtgtgcccactgaattgacatttccagatttcctaaaatttcccacccattcctgaagacaatatcacgcactgggaacttaaccttgcctatgccaattttcatgctgttaatgtttcctttaaaacagaacagagtaaaagtaaatatcgtatgttctacccacacacaatcacatcccagatcatctttgaaacagcccacactgctgtggagagatgttttccattttcctaagcaaacacagattattttaaaatttgtcttaaaattctactagttatgttagattagcgctcagaattcccatctcctaagacagagatatacaagtattctaaggctatttggtagagtcttttacatctggggtcattacctggaatagtagttgtctacaggctgagatctgagactctctgaggaaaaaaaaaagaaagaaaaagaaaaaaaaaaaaccttttaattttgtttcaccatagggtaaactgtcctcttgtatctgatatattatccttagatagtcattctgtaagataaaacttttcatcttcagaagttccccatcaaaatgcaaatcaggctcatgaggccacgaaacacatgctaaggggcttatttatcaggcagaatcctggggaagcagagctcaggattccattacctgctaagagtactttgatgctgatgtgaaaatctccttgcttgcaggccagcaaagaatgacagagtgttctctagggccagagcaggaaggagaggaacaagacctgaagcaaaccacagagacagatcgaaaggcttggtaattgtgttctgattcaaacagcattaatgagtcatctgtcatctgaaaatgctctcctcattcatggttggaaagaagtgcagttcagtggaaaaacagagcacttgaattcgaaagccctagactggaggcactggactgaaaaagaagcttgcttctgtggagcttgagtctggagggttttacagcaggtctcatgtgcaccagcagcatgactttaggcaaagccaccagcttgtcagtccctctaccacaacagaaaggcagcagtagtacctatctaaatagcttacttgggatattgagttagtgaagcagatgttctcaatgctagcaagatatgtatctttacccctgccgttgctgctatctgccatagaggaggtcttggcacacttccctaggcattctctctgattctgttaatttaatccccaatccttagactctagaacaggtactttcaaaaccaatatgttatggttaaagaataaaataatattaagcacacaaacttaatactatattaagtagtaaatacagtaaatattaaattaaatattaaaaataaacattaacactaaaatacaaaagtattaagcaacttgaccagacttagaattggagctgagcttaggttgtctgatctgagttaaagttttttaaatgaaattttattacatttatttattttgcttgtgtatatgcatgtacatgcatacacatataacaagcacgcgcacacacacatacacacaaacacacacacacacacacacacacacacacacacacacacacacacacacacagagatgtcataggacagcttgtaaaagtcatttgcaccttgcaccatgtttgtcctaggaatgaaactcagggcagcagatttggtgttaagagccttgaagttgttaaggtttctattgctgtggcaaaacgccatgaccaaaagcaatccgagagggtaggggttcatttcactttatgcttccatatcacagtctcacattcaaggaagtcgggacagtaacccaaggcaagaactaaagtagaaaccatggagccgtgctgctgactgggtcactccccaaggcttgctcagactgctttcttataacacccaggaccactgtcccaagggtgacaacgcacagtgagctgagctttcccacatcaaccatcagtcaagaaaatgtatcacaggccaatgaggtgaggtcatttttacaagtgaccttcgtcttctaaaatcactccagctcgtgtgaaagctgacatacttgtatcaagcacctgccttaactgacacatctggccaatcagacagcagttgggattattaacaaggtataggttattcacatgtcattttcccttcaataattgttgtataattataatattatcagaaaaggttatactcaggagaaagttatcatataaactacattgaggcttgggagtagagacagtaggtaaaaataagcattttccacaaaaccttgataacctaatctggatgctcagacactaagttgaaggagaatgttgactactgcaaattgttctctgacctccatgtgtataccatggtatgcatatatatgcactcttttgtctatgcacattactccttagttccccctcctatgctcatgtgccacacacaccacgaataaaattgagcaaaggtcaactgtaactttcagtgtcatgtccttgtctttggcttcctttagccacactaaagctaaatgcagtaatatgtgtgtgggatgatattggtggtatactggtgagcatag

SEQ ID NO: 313 - DNA, 2600 bp, Mus musculus
tttacttttgtgattctattgttctccactctaacagagcttgtataaatatagagtacagtgtatcccataatctctgacaaccaaatacatagagtccatttgtgctaggggttggaattcaaaaaataacgttaaatttggagtgatataaaatatttcaaaggattttagataattttgaagcatacactctctctctctgggtttgaactataatatcggggcgtgtgtgtattctttgagaatctgaagagcagggggatttgttttggtgagtgtggtatctgaatgagaatggcacccacaagttcatagatttggatgattggttcccaattggtggattgcttagaaggatgaaggaggagggaggctttgttggcaaaggtatgctactgggagtgggctttgaagtttctctgtctctgtctttctgtctctctctctctttgtgcatgtgcgttgtgtgtgtgtgtgtgtgtatgtgtgtgtgtatccagcttgtgagttagatgtaaactctgacctcctgctcctgtttcatgcctgcctgtctgctgtcacacatcctactgtgatggtcaggtactcattccctaaaactataagaaagcccttaattaaatgcttccttttataaaaatgtatggtgtctctttacatgacgtttctttacagccatagaacagtgactaggacagtgatggtttgaaagccagcctagccatcctggaccatccttccctcactggggatgcatgctgtccatgtggatgtcactcatctcattgttcccttcagaggagaagcccagaccaaaatgacagactgcccaattgcttcacgttacacagtggtgtgggactcttcaaccctacagaacttggatcctaacagtcggtgctgtgtccaccccatgtcattcagtggcaggaaacatctatagatatgtcacatttaactaatgctattaattgggcttgggggtaggagctttgtggtttcatttgcatttaatttgaaaatcttttctggtttaatagtcttttgaaagaacaatcagcataaaggctttacggttacatatatacatatttaaataacgttgtgatttttaatgtaaggcaactttgtgtcgtgatgttttttttcctcagttatttgaaagcaaatcatgtaattagtgcattttgcagaagactgcaatagattctattttcagtgctagttttcctgaaaaattctctcagttagcaagtgccctgcaagcaaaatggaagaggggggaggagggattgtagcagccagaggggttgagggcagaatgaggttatggctcaaagaatcaactaagcagggctcagagacagaagtggcaatcacagaacctgcatgagtctgggctgggtcctctgcatcacagaacctgcatgagtctgggctgggtcctctgcatacacgcggtgctgtttagcttatttgtggggctcttaccaataggggagaggctgtctctgactctttgacttacttgatcttgggaccccttttcttctactgagttgcctcatccagccttgaaaagagggtttgtttctagtcttatcgcatcttgttatgccatgtgcagttgatatcaactgctcttatctgaaggaggagtggatctggggtagagggaagggaatggcactgggaggggaggctgagctaaggatacattgtatgagatgatgatgatgatgataggcatataagagagtcttggtgaactgaggagaatccttggttttgtcctaattctgtggcagatttgtgcaacagtgagcaaggtgctagctagttctctgaatgaaatagtgatggtctttaagcatccttctgcctctaacattgagtctataaaccctagagactcctgccatttgtttagtcacctagtctgacccataaaattggatttttttttttcagattctcagacgctagcaactacaatgccacatttgagttcattcaatcagttttcatgaaacatgcactcaccttccttgttggaagttgaaagcttttttgtcccctgagagaggaaaatataaaaggaaaggaaaggaaaacacttaacccagacctttagacacatagaactaatatcccttcagaaaaagctttaatacctccgacaaagatggctgggcagtagctgaagaacagacccaacccctctgtgtctctgatcctgaggccatcagaactcttaattggtgtgaatcctcctggagagtgagacagccctgggagcttgctctgcagtctgaaggcccttgcactgagagacacatgctgtggcacttcaatgcaatccctgagctgaaggaacgtgtgagcttgtttgagcggccacacggtgggcccaacttatgagctcatttagaacctgcagacatgaacagacattgagaaagaagaaacacttccctgaaatggtcaactagaccccagcagagcctaaacctcagaagttgccaaagatgtgactcatttaagaaaagtcccctttaacatgtgattgattcgggatacagcatgccaggtag

SEQ ID NO: 314 - DNA, 1950 bp, Mus musculus
ggtgcctaaatagagccttcacccctatattctagcatctttggtacaagactgtgctctgtatgctaccaaaggaaaatgtaaataccaacccacctgaacacccttaaattatgttggcttttttttttccttccgtctttttgaggcagggtttcaatgcccacgctgaccttgaactcacagagattcaaacacctctgactccagagtgctggtattaaaagtgtgggccactgtacctagcttggttaggagtttataatttctttatatgtcatcttttaggggctgggatgtggttgagttggcagagtgctttcttagcatccttaaaaccctggcttctacctgtagcacctgcatcatccaggcacagaggtgcacagctgcagtcccggcactagggaagacagaggcaagaagatgggagcaaggtataggccagccgactcagctggtcacaccagtcacaagtacacaatgagatttttgcctcaaaacaaagtaaagagaaggaaaaaaaaaaaaaccatacaacaaactaaaaccagaacccttttcagaggcaagctctttgatacatccacactgtttggtttatctctggctttgctccgaatcacagtgagactggcctggaagggcccctggaagagaactcaatttggctttctaaagtacatcccttgacttattcttctctgtttgagccagaaatcaatgtgtcttgtcttttctagggcagctaccacttgaggactcccatctctctcctgatggcttattacttaggaaaacctaattggctctgatttcttacagctaggccgtctgttgctcacaggcagttctcccaaggaaaccaagccctgaaaagttctgctggttgtgctcttaggaagcaaggagctgcacttgaatgtgttgcttgtctttaggacgaaatgaaggtccagtgcagctgcctgagtgcaagggcagggcgctcagccgccgtctgcgctgggactggctcatggttttttactgaggaccttacgcccttgaataagcccttgaacccgattgtcatctctgagatgcaggggctgtgttggatgttttcacactgaaaaattctgctgtccggtccacagatgcagaacatctaaatgattctccctctacacagccagccctcatatccagagtatcccatctcttccttaatctgggtccccatcctgttcaccttgtgcatggtctaaccatgcacgcggataggtgggtaccatctgtgtttaccgaatagactcgccagtctaactgtagctaacaagtgctaagctagttgtaattaacaagtgcttttgcattaccatgaacgtactaagcatttaaaggcctttgtccttttaaaaatcaaaccacagtttcaggtaataatatctgtggaagctgtagacagtgttttataaaaccccggtgcaggttggtatttcgcttgttaaagaaacaccatttgccttggagaaaaaaagtcataaatgtttcttgaaagccagaagcagtatttcagcatcaaatcgatgcagaaacatgcccgaagccctttctggacatattttcttaataatcttcttaaaattttcttaattttacttcaggctttaacactcggtaactgaactgctaaagtggatctatgatgttgttaccacttcattttaaaataaagtaattctgaacagaaataaaaagccctgctttgtaccgtctgaaccttttcccatgtgttatcatctggggagccttgagaccagccagatcgattgattgaatgccaagagaagaagagaggattaaaaacaaagacaagaaacagaaaggacgctgttacaagagtatgtactagggaggtgataaatgaggatagaaacatgagtctgtaaagacaaatgagtttcc

SEQ ID NO: 315 - DNA, 2875 bp, Mus musculus
taacagagggattaccatgtgacgtgtgctcacatccttaaaaagagacgattggagaacacggtcttaatcacacactatgggggcggagcttattcgaaccccagcttgcctatgctcagagtaaggctgtttccatccctctggggctttgtaaagatgtgacaaaattaaagataaacagaggaggattgggccaagcacgtcatcattaactttagtccatttaccttcatttaacaagcttttcattgctgctacaagagttttacaagtgaagacaattataaaagcccaagagtaatgaagcaatctatgttcaagaactgatggtaacaccatttcaaaccttcatgcagtttttatggtatgtttttaaatgtacctcatttctcttaaatgacaatatagcgtgtttgcctcttgggtagaagactatttctgtcagttgctaagatctaatgtctttgtcataaactatcccactacattcctttctcaattattgtcactgtgtctagcgaatgactttatggatgtgtggcagagttaaggacaatagtagtgcaccctggactagcaacaaggggaacctgttaggcccaagccagaagaagcactcggaaagggaaggaatcaagttagttgctagaaaccaggaagagctgaagccaggagagaagacagactcagctggaacagggactgggccacagctgtggcccagcaaggaagactccatggagagggacttcacactcccccttcctccctcctctgtcctctctcctcttgcttgttgttggtggtggtggtggtggtgtcaaactcaatgagagttcagaaagcagagaacttatatgctggtcagccactcagggtaagggcagtggaggagtagagaataattttaggagggcagaggaggattcctaaaggaaattttgtgtttgatatgaatctgtgcaagcgtgtctatcgtgattgtgatttgggtcttaagttcagccccgagactcgtgtgtcgaaggctcagtctctcgctcatggtcctgtgggggcaagagctgcaggctgagtcacctttactgtgaatgtttgatcataattcctggggaggaatatggatccgtgttacattggcagtgatgtggatgcaatgctggccccaagtaatttgttagataattatttacctatttccttgaatcctattttacaaatactcagacttgaaggaaaacatctgcatgggaaaagactctaatctctgccatggcgtgttcctttctttccctttccctttccctttccctttccctttccctttccctttccctttccctttccctttccctttccatttccttctctctctctctctctctctctctctctctctctctcgttttatatttagaaacattatacagaaggaaacactgttacaaattccccagatatttagagaggcttgtgtactcatcgtggcagagatggacggcatacggtgctctgtgggcagttaacacacagtcacttaacaatagacagcatcttgtaattgtctgtggttcggacagtggtgcaggcatgcaggaagtgacccgaggggtgctactgttcaagatgagccttgactttaactaccacactactggtaaaaaggggagcaaccctttgaggcttagggaatgttatacacaaagtacaactgaattaaaatacaaacccaaagagagggcagaggatggctaaggggaaccttggtgtggatgaccaggcgtagtgcaatggccagcgaaggaggtgatggaggttggctttgagaaggggctcagctgtcagtcatgctcctgaggacttcactaagaactttgttttcctacatagcttataaagagtctcttgagaagagaggcaaatacttgtgtcgtaagggataaacttgttgaagaggacgatgcagaagggcctttggcaatattgtaggggtgatgagggcatcggggagaaggaggggtaactgctaaaagatgctaccactaactgagaggcaatacagagaggagatctgatcttggaagaaagtttaaaagttcagttttaaactaatcgaatttgaggttattagaacttttgtcacatataggtgattattttaatcaggaatgcaagaagttgtctgggtcttagaacaggaatccaaaacagacacgtccacctgaaggtagttttttgaagccaggaagtaggatttgctagtgaatgtgtccccaggaagggaagcacaggagaagccattatgaccacaaaacccaccagggggcgacagttggggctgtgttgcctctactgccttctgtgatggactctccccagctaccagggcttcaagttcatggtaaacttgatacagcactactttgagatatggatcatctgtcagccaggctcttgaacttgtgcccatgtaggtcctcagtcttgtgatctttgttctgcggcttgtgtggtggacccaatggcttggccagtgtgcgctaccacaatgtgcgttgggccttcccaaaggcactagccacacatacctatccggacactaacttaaacagcgagagatcacagacatgaacatctgttggaaaggaccatctaccagggtccctctggaaatgcactcagggaacagactgcatacccgtacagagaaggctgctctttgccaccgtggtgcactgaaccaaaggtaatttttaaagctctgaggataaatgagctcttttccatgcagggagctcagagtgagaaagagggccaaagcaagaaccatttaaggagaagttgtataaaaggccgtaaagaaaatagagat

SEQ ID NO: 316 - DNA, 1975 bp, Mus musculus
gacttacatttaatacatgattttttttcttgtcatttgcttttgagtgttgatatttatgagtaatcttagtctgtcaaactattctccctcaatacagtatgtctagatccagactcatatgttactggtatatctggctaggttgagtgtgtgtgtgtgtatgtgtgtcccctcgagcatgcacacatgtgtatttacatatgtagatttactttgtggtggtgagatttgaacccaggaccttgaacattctagtcaggcattttaccaccgagctacatccccaacctaaggttaggtgaaagttttatgatgggactcactaacacagacattccaggctgtgtttatattaggaaaactcatctcttagagcaggagccacctaggttgagtttctgctctgccattcaccactggataattgttgggaaattaattatttgttctccatctcctcctctgtgaaatagtgtgaacatagcagagctcaataccgcttgctgaatgatatggtaagcctttaagtgctggttctcttcactttgaaagcagacacaatggaacctagagtttattttagcaggttgttttctttatggaagaaactcagcttctgtttagcttctgctgcggttgtgaaagcacatcacatctgtctgcactgattctaataaaccatattttaaagtgttttaatggttgtaccgaataccagcttctgcggagattgaggatagctggtctctgatagaaataacgcaggaaactttattttgttcgtgctgtttgaaattctataacctgaggagaccattcttgatatgtatgttggacttagttctatttgatcctagaaatgttttcaaatggctaacaggataaggtccgacagaaagcaaggcagtggaagtgcagttgaggcagagggaacaggaacaggtctgtgtgtccagatgtctgacagtgatggagatggcccgggttgaaagccccgcagagcggggaggagagctggagctgctccttcctcggctgccaccattcctctctcagtgctctgtgttggtggcaccatctcctctgtgtttggaggaccgagaggtcgggtgcttggttggaaatgagccacagctgaccagtttttacattgtgcagatactcagtggatggtcttcctgtcgcctggacagcttctcctgccttggaagcgcctgccatgtgtcacagctgcaggtctttgcttcttgcctgcaatgtcgtttaactttctctgaatggtcccaagccaggagtggcaggaaaaagactgcagacgatctatatacaaaagaatttgctgcatgacttttttgtttatgatttgtaaatggcctaatttcttttcgtaagtgtgcctcttgaggaatgtgtttaatggaagcttatgctattacggatccttcaacctaatcgtgtaattaccatatgccatcaatcctgctcctacagggtccgtcctttttcccttttaaagctggagtgcaataagagcaaatgttttctccttcagcgcattattcacatgaaatgtgtgttgacaagttaaggatatgaagaatgagaaatctagatgatcatttcttaaagtagaacccattgatttccattctctaggaatgcccctgctattctggtataaagcttgttgcactgttcgtttttagacttacacttttagtgtggtaggtttttttggttttttgggttttgttttgtgttttgttttttgttttgttttttgtttttttgtttttgcctgccctcttccctgtgccagagactttttaaggtagtttttctgctgtgtccaaagccaaaatcttggcacaggggaggttaacgcttaagtggctaatacaggagaagtttacatgtccagtcctttccccatttcttcttctctgggagaaaaggatggtgggccgattgt

SEQ ID NO: 317 - DNA, 2575 bp, Mus musculus
gatgcgagtataaggctaacagtgggagaatggagttagacaggctaattatttgtcctttaacctatgattctggggtgtcccagagattattgacaggaaggacggtgtactgttaggagggaggggctaaactcacatatagggcacagtacatcctaaagccaaggtgaagtgggcttgcacagcgaccactttggaagctctacacctcagctctccttgagggtagtgcctattcagaagtaaccatatattgaatatttctaaaaatctgtaaatctcttttcagctttattaatgagataatattgttcattcaggaataccattgacttttcttctcactattgtggtttttataaaatgcactaatcaatctcctagctgatttttttttctttaaaattaactttgtacttgggaagccatagcagacaataatgacagccttttgggaaaccctgagccttggaaagtatggtatagtaggtgtctagcatttaaagctgctgaaagtcaaacaatcattagagaattatcagataaaaaccatatgaacatatatgggaaaatcatatagcatatctgttacatcagaaacagacattttgaccaaaaatgccacaatggcttggaaatggaaatttaaaatttactttcatgctaacaacaaaacattaaatttattgactacttccaaaatatctcatttctcagtcctctaaattgccagtttgacctgtgaaaatgcttttatagaattattttcttggtgtttgtgtatttgtgtgtgtgcatgcgtgcgtgggcatgcaagggtacctatggagaccagaagaaggtgttcagtcccctgaagcgagttataggcagctgtaagttgcttgacatggtgctgaggatggaacctcagtcctctctctgcaagaacagcaaatgcttactcactgagccacctctccagccccagtgaaatctgtttgtatcatcctgtctcattttaatctcaagaggtctaacagttcacaaaaggtattgattctttgatttttcttttctctggattcttcttttcatttattgatgagaagaaaatttaaagatcgtttattcaccatttcctattattaaaaggtgagtagaaagagctagtttttattggaaagccatctgctgcaatctattgtagaatatgcactatttttaggttctagatttattttggtaatctatttctccttccttgtgagtctgttttgtatctcctaagagacaacatgtacaatgagagagagagagagagagagagagagagagagagagagcaagccaccaccattgtcaccacactagacaatgtgctgagtcatatgggtgggagaattcattaactcatggaacagagtaatttgcgtacagatatatggcctctgaatagcagtggcctcaggaggacatgctctgttccagaaggtactgcaggccagacagggaaattcttttggaccatgtagcagccatgccatgcatgaggggctgggaatgaacatgatggagacagaaggggtatggaaaaaaccaccaggaagaatgctgaaaaagatgctgaatttgggggaaaccatgacacaaatacagtgaaatagttatctgtagtcacttagaactagattttacacacacgcacacacacacacacacatgcacacacagacagacagacagacagatacacccacatacacacagagacacacacagacacacacagagacatgcacagacagatacaaagacacagccagacagacagacagacacacacacatgcacacacagacagacagatacacccacatacacacagagacacacacagacacacacagagacatgcacagacagatacaaagacacagacaggcagacagacagacagacagacagacagacacacacacacacacacacacacacacacacacacacacacacacacacacacgacgatagccagaagctgatgttgaatatcttcttcaagctgctctccatgttgttttttgggtagggtttctcactgaacctggaggtggttgactcggctacattggctggccagtgagctccagggctctgtttgccttcgcttcctctgcacggggcttataagtgtgtgcccatgcctagcttttatttgagttctagggatctgaactctgttccttgtccttacacggggcgtactttgctgactgtgccacctttccagctcctccagtagacatcttaaagccttaaaggttcacaataagattcaaaattaacataataacgtatattacctaatgccgtttcctagagatgattaaaaagcaggactgggaatgtctgctttgttcgtgcctgctgtgaatatatttgtttctacttacatgcctttctaatgatggctacccatacatgggaaaagggagagtttttttttatttaaaaaaaaattccatctaccactgtgtgatgctgcctgccaccgagtgagtgttgggaggttctgggggaagggggaagg

SEQ ID NO: 318 - DNA, 2125 bp, Mus musculus
tgctaacgtggaaagggaaaacctcgcagagccctaccttagacaaagaactacaggcaactgacaactgctgagggagagctagccttccccagggatgagtttcagacctggttatccagtgccaagtgaccagccctgaaaacaagtgcatgttagcaacactttaaaggactgagctggtttgtatttgtgaatgtgtgtgtgtgtgtgtgtgtgtgtgtgtgtgtgtgtgtgtgtgtgtgtgtaaaattaagaaaaagaggccatgaatttgagagggagtgaggggaatacatgagaggggttggaggtgaaagagggaggaggaaatgtaattatatttcaattaaaatcgtgaaatgaaaagaaagctcccaaaggagggaaaagctcgagccataaacaaagattctctgcttctgtcattgatagccactcattaaaacaaatattatgatctggatttaattttcaatcttttagtgaaagaataaaagcctttctcttgtagtaaatcttaacaaaacatttcctcccagtgctaaaaaaaattagggagaaaaccaggaaggttctaacccatagccaaaaaagaagcattttatcattatctttcaaatgattaaaaatgctccttcaacatcagatataggcagatgttcaggggttacagcagtttaagattggctaggttaccggtaaggtgacagtcatgtcatctgtcattaagaacataagagggttcatgctcttattatggtgagacccaggaagaggcgattggcaggaacgttgctttcagactgctcactaatcacaaatgtggaacttggaagaggcctcagaacagggagttatgagcattgtcaaggggacgaagtctgcaagagcagagagccttttaaaactgtggagtgtttacatgtgtgtgacactattgacagcaggccaaaagactgctcagtggcttcatatcccagagctttgttgtcatgttaattaataactctctgcaatgcaagccatcttcttgcccaaagctgtgctggaaatagcaggttgtttttgttgctactcacaggacatacggcttgtgatgtctgtggtaaactttttcatgatactgttgttaaaacaggacatgaaggtattttcagcctgcaagtgcctgaagtattcaagccattgcctctgcaggcgtgtgtgtgtgtgtgtgagtgtgtgtgtgtgagtgtgtgtgtgtttgtgtgtgtgtgagagtgtgtgtgtgatgtgtgtgtgtgatgtgtgtgtgtgagtgtgtgtgtgtttgtgtgtgtgtgagtgtgtgtgtgatgtgtgtgtgatgtgtgtgtgtgtgatgtgtatgtgcacatgtgtgtgcatgtgcctgtcagtgtgtctgtcagtgtgcctgtgtgtgtgtgcgcacacacatatgtatatgcacactgggggcagttccctcctctgcctcctcggctagcattttctcctactctatcatttgtcaggatttggcacagattttcattagtaagaacaattcttccagggaaaagtttagtctcagccttgaagcatttttagggaatggaaaagacgaatcaaatgttcgtgtgaccactatgcagcttcagctgggggttgggggaagcagaaagtttgttccctgagagggttgtctcaagagggccagtggatatgatgtttgaccctggatttattaactgagaagtagaaattatctgtgaccgaggaaagccaatgagataggaagacaaaccatttctaactcaattagaaacataactcttttcacagctgaccttgaaatagaagggagcctcatatgtaaggtagtgagatgcctttcacaccagctatcctgaaaagagtattatcaaaaacagtttctttaaaactgtataattctttcagacctgtgctggaataaatagctcttaggagcctcaacagatgtaaataataggtagtaatctttgtaagagcaaacctgtcaattgtggaatcattccgatacacaaaggagctgtcccagacgctgtgaacttgaaacagtgttactgtgtaataactcagtgattcgtaaggcacatgg

SEQ ID NO: 319 - DNA, 1975 bp, Mus musculus
gatagagtgtggaccgtgaagaacacagggctctggtagagtcttgactgggccaatggtatcctagtgcaaatgcccagttgttggaacactgtgtaggaatggcccagtttttgtacccaccaggctgtcattggttgggatcagctgaggagacattgttccaaggatcttagtgcagcagttagatgctgttgacctgtgctctcagaaagctttctcctgtgggaagagccacacagacagctcacactccgactactgacatagggcaatgttatcaatggtgatactgaccacaaggctacagtattgacattggaagtgttcactgatgagaacttcatcactggtcattgggaatagctacagtaacattcattttataggaaactagagtaggcagagctaggctacattttctctgtaagcctggtagctaatcccttataacgtgaaggcttgtattttaatatttgtgttgttctatgtgtagaatcacgaaaggaactctagccatctttaaaaaatgccaatagctttctttaattctaaatataacatgcattcattttagactaatgcgaaatatagaaagctttagaaaaaaaacagaaatgactctaattccatggtagaaataagtacagttaatgttctgtggcagctgctttacgctttacaaaacatgttcgcacatagcagggattgttaaaaggtgtctggaaatatcgacagaaccagtgggaaggcttttgttgttacaacagcgttccagccccagacacagctcatccgtggctgtttcaagactcatggtgttaggcacaggtgagaagccacaacaagtgaaggaagacccaacagaataaggtgactcaacaacaaggaagctccagctacttttggagggcggcctcttcacagtggctccccaggcctagagatccagctcaggtccttgtgcttatgtggcaaacaccaactgagctatctccctctgtggcttttagtagtctgacttattgtgtcttaggaacctacacgatatctctgcagaaaaactcattctgagtgttaccgcagatgtgtgtgtgttcatatgtgaatgagagaaagagatagacagtcccagacagaaaaggaatgtatgtagttaatgtcataatcagcccttcattttgcctatttcaataaaaattatattgaaagttttttctccaataatttagtttttcttcaaagcacagcttaactgtggatgtggctgtttcatcatatgtgtgtgctgccatctgtctgattctttgatttatgtgtgcttaggccttctttcagttgcaaggtgtgatgaacgtatttgtatttaggttctttattacacttccattgacttttagatgtaaattccagcactgggatggctgggtcgaagaatgtcttcatgtaaagatttctacaccatcgtccatgctttcaggaagctcactcccttctgactcctagattctcctctgacactgcatctacctgaaaaagaaacaaaaaacatggtccttccccatataaaaatattgggctatttaaaacttttactaggaacatgaacattttctccttgtttttctctggagtcttgttgaaacttctgttttagccatctgtccatttctttcagagtcttgtcattaattatattcattagaaaagtgtttttttgtcatatagcacaggtatcaacattttgtagttattcttcattcttttcagagtttccctttctcttaaattctgtttataattgttttcaatgtctggaagttccagacccttatcagtcagatttctctcttgtttccttttaagatttttaaaatcttccatcactggatgaaaaaaagccagttaagtgcttggaataaaataaggttgggatctcaaatcaaaccacatgccaaaatcaattccagttgga

SEQ ID NO: 320 - DNA, 1975 bp, Mus musculus
ttcaaatacttttattaaaaattgtctatctacctatggcctacctgttcttttttttttttttaagatttatttatttattatatgtaagtacactgtagctgtcttaaaatgcgccagaagagggcatcagatctcattatgggtggttgtgacctaccatgtggttgctgggatttgaactctggaccttcagaagagcagttagtgctcttacccatcgagccatcttgccagcccagtctacctgttctttatgtgtgtgtgtgtgtgtgtgtgtgtgtgtgtgtgtgtgtgtgtacacgtagtgtatctgtgtgtgcacatatgtgcaggtgtcctatagacaccagaagaggaagttggattctccggagctggaggtacggtggttgtgagctgtctttcacaacccgagagtcatttctccagcctatccaattatttctatctctgatgttacatatttgaagtaaattgtagaatctgaacaaatcttctttgttaaggtaattaaagccaaagtaactcaggataatatatttctgggccctgaacagtttctttaaaaagttaccacacccttcctatgccttaaaaatctgtatgaagccgggcctggtggcacacgcctttaatcccagcactttggaggcagaggcaggcatatttctgagttcgaggccaacctggtctacaaagtgagttccaggacagccagggctagagagaaatcctgtctcgaaaaatcaaaaaaaaaaaattctgtatgaaaaacagggagttaatgtattagatgacagtaataaccctttcatttctgcacctatatagggtccttagcaatgtgtgtgggcatttagatattccatattgaggtaaattggacgtgcctttacctctgcctcatgcataactgatacctgagctctgcagaactccagcgggtagatgccactagtgctctgtgtcttccagggagcctccgatgctcagggagtgctgcgcctgtctcctgtgagatggttaggtggagcaggcatcagtgcgtcctgatacagtgggaaacttcagatgagcagagttcgtctgagaaagacggtcaaggaaacaacaaagggagaagttagatttcatttttcaccagtccacccagatacactggcatcagttgtgcattgtctaattttgttttctctaaagtaccaaaataaagcaggcttctgttttattattcacgcagcatctgtcagttatcttgttgtttattttctggatggtaattatagcagcactgagacacatgtatgagtcaacctttggttacaactgacacacacacacacacacacacacacacacacacacacacaaacacacacacgagtttctctataaagactataattttctttagccaccgaaccttaaatagacattaaagagcagcaataatgtaaacatggcttcattatgtatatttaatcttatttttaaatatttcaaaaatagtttgtagccatcgtcagaatcattctgtgaagaagagaaagatggtatgcgtttgaagatataagaatatggaactctattctattaataataatgaataccattaagtcaaatctgtacagggccattgattctatattaggctccacagaccaaaccaacatggaaccacacatgatgactccctgaacagtatcaagagagagatcatgctctgatccataagtcagacaattttagccaacgtgacaaagaattcccttttgttttaatctgactcttcttggttcacgtcttgttagaagaactctagttattattgaaagccttcagtttcatgcagagaccctagcacaaaagcctacttcagaggttgcaagtacatacctgttttgggagcagatctttcagcctattctgctgtctttatagtgatcttgccttcagataatataggatgctt

SEQ ID NO: 321 - DNA, 4050 bp, Mus musculus
ttcctaaacagcataggacttgcagtttgagggcacctggtaaacctggaagatggccattactgtatttatctcctgtgcatcgggctccaaacaaacagcatatcacgctgtaaaaacctctgagtagcttgagtttcataaaaagccattaaatgaattttggtttctgattaggacagaatgtccaaaatggccttaaacattctctgccattatttactgaatatttaagtgatgtggagttctcggcattgacaatcacaaaatcaaaaatattgatcaatgctgaaaaacactggaaagggtctacattctgcagtgtcaaatatttggccaggatttaattctttatataaaaataaacaggcacctccatctcattagtatgcaaatttgctttcatctttaataaacggtaaaattatatgcatgttaaagaactgttttaaaatatattcttatgataaattaccaggaaatgtttaagctgtatgactattttagagatctacatatctagggtggcatacaaatttatcagatgaaaaaagtcacaaatagaaaaggttttagaagctgtaagtcctcattcactgagagcagaggtatgtgcacaccccttccccacccccaatcctggggtaaatctgcctgtggaagatcacctctaagtgagtaagcacacagaattatctgggaacaggcggaaaatttgtctctgttttgctgttaaaaggagaattacaaaagcctgcacacccaaacaagtactcacaccagcgctagggaatcttcccccagcattaaaatgtaagtcctttcagttttcagtcaccaagacggcagcccctctgtaccctaggatcaagctgtttaccggtcccagcactggactctgagaacagaagcaactcacggagactttgaggtgaattgtgcaactcatggcccttagccacccgtgtgtagtggagctagggctacagctctgtggcagatggtttgctgtgaggatgaagctacagggtgggttcccggcacccccatgccccactccagatgagtaatagaccaaggcagtaggaacagtctagggttttttgggggttttttggccaataaaatcacagataatccaaataccataactagtcatcactatgacaatattacaatagttattggacctgcacaggctttactaatgccttaataagaagcataaatattaatatattgcaaatttggtttgtttatttagaccattgtatttcactataactagtttttaatagcatgtatttaattttatgtacttaaaatctttctgttcatatgtttcacaagactggggtcccattacacaaaagccctcaatgaccctagggtagaggaacctttccggtccccatcttgaaccactaccaaaaaaaaaaaaaaaaaaaaaaaaaaaaagcctttcccaactcctgagatcccaccattagagaacattccctttgggtttttaagattcccattaaaatgcaaatgcccccgaaggagaagaacttctctgagtgttattagttaaccccttaaatggggttgtttagcagctagctgagcgcagcatcctacaattcaattaaacaagcgtttattgacctgcggtcatggggaaggatccaggcttggggacaagggcccatcgatcctcctctgttcctcccctcaaggatgtttgcagtctagcaggggaaataaaagaggttcaaaagagacagagcagaaaaacccgctttcccagacttacaaagaacaaagtcaactcgggcgagggggagagatggctgaggagacaaggcaggcatttccgtgtgttctagaagggctgagtctggattcagccaggcctgtgctagggcctgtgccttccacattgaggggtgaggataaacagataaatacaagttagttgctgttgttggcttttctactgggacatagcagtccaggaagcacacaagggagtgacttagagcttcctgggaccaggatgaaggatctagcgtggtaataaaagggtgaattctgggaggtttagagttaagaggggcaaccagacaagagatcggactagaggttagatgtaggaccgcagtgtacggtggaaggacgacgtcacgtgcttcgtatcggaccccttaccgacaaccagaaggctcttacaggagcaggatatatttaatttgtccttaaatttatcatgagaaaattttcaacaagtagggacagggttggtaaaaagtgtatcctagcttcataagataggtagaaactgaactagagtactgtggggttcccaaagcacagagccagttggttcaattgaaagcatcgtaactgtgaaggttcagggccccagaggaggtctcttgagtcagaccctctgtgggcaaagtgggcttgcctaagtctactggtgttcctgttgctctgtgcctagaagaaggttgaccagaaaggtgggtatggggtaggagtgggaggggcgggaggggatggggaaggggtaggaacagagtcagaagatcacagccatgacaagacttgagggggcagtacaatttaggacgtatgtatgtatgtagagactcagctcacttattccacatgcccacgtaagggcaatggggggggggggggagcgtggactgtggaaatggcagaggaagggaagagaaagaagaaatgtgccttactgagtaaatgaagtgggcgggagggaaggctgagtcacaggtaacgtcagagagtggagatgggtgttgcgaatacccaggggcttctatgaggaaagcaggggctgagatgcgcaggaaggaagaccgtgtgcattaggcaggaaagtgttcagcacagagggcccagtaagtcataattttgatttcaggggagcatcctgctgtgggatgtgggcttgggcacaggtggtacaatgacaggggacacaggctgaacctattaccattttgttaagggtcccctaacaagagggcaggcagaaactacggactgtaaattcgggcgaatgcctccttttcttctcatctcaggagctcccggtctgttttcttgttgaaaaaccaggcaataataaaacttatcacccactcatctcttgggagtgctgcaaagagcaactgatacacatatataaataagcttaaagctctcagcaagagtgaagtgtgctagaaatgccaaacaataataaatccaaccaccttcaccaagatagtaaacaaggtgtctttttaaagagcaaatgtagttaaccaggcactaactttgagttatatagcttctaacaacaagtaattaaatctaaactcctgatttgagttctttcattagagggtctcagagtgaccctaatacgtacatcaaactgaggccccagactatatagcgattaattaacatgaacattactttatcatcccttcccttgcttagtatcctgctatgccactaatatcaacagacccaccacaggcaatctctaccccagagctgcactctttgtcacacccctgaggtccggctcttggcagaatgatgccgtataaaatattcagaccctaggtaggatgcatgcagtctacaaggggagatgctgtcagacagaaacacaggggaagaagaagaagaagaaaaaagatccactactaaaatgacaaagacagcaaattcgattttaaaggaaggagcacatctctaattatatgttccacgcatagcaaagctctcctactaaatcccatcacaagctttgctcccctgaagagcagacctgctaggtaataactccccttctccgtggtaaaatccaattttcacacctggtaaatgaaataactccactgtgaaccaagggcaggttggggtgagtcgctaacagaaggttaggggctccgcatcatggaacagctcttctgggagccccttcgtgggatttgctctttttatgctggttgatgctatttgtccagaaaacctctg

SEQ ID NO: 322 - DNA, 2875 bp, Mus musculus
ggaaggaagaaacaagggctggggagagaaagggagaaggaagagaaggaggaggtagccatcgagccatgaaattaccaagctgtgaggtgacatgaaggacactcggatcggagggacagcagagacaatcagtgtagatgctgactttttgagtccatctgcataacactctgggaaaaggggcatgagtggaggtaggtaaagatgccagtggttgccaggagactggaaagaggaccagcggaggagatgctgcacaggggactttggagactgactctgtggtggctgaatcatgttgtgcatttgtcaaaacctatagaacataagccgccagtgtgaaccctgatgcaaaccgtgacattcaagtgactacaccatgacttcagttcacacactgacacgtcactgtggtgcaggatgttgggggtgggagggtgtcttacattgggagaaacattatccactcaattttgctgtgaagctaaaactgttcttttaaatgtttatttatgctacaaccaggagatagttcgggggcaaacggcaagctgtgtcaacgtgaggcccagagtccagatccccagtgcccacatagatgttaggtggatatggctgccttcttagctggctcgattaggtgagctctgggttcaagtgagagacgttgcctctgacggcaagatggagagagagagcaggggtgtacctaacacttgtccagacacggaaccatgcagacaagtttatactttaaaatcatgaaaatagatgtaaaagtgtgccatcccaatgaacaaccaatgacctatttcacatccttttccccactataaatctttgaaagtcagcacatactttatacagcatatctgaatttggactaaccatttttcaagtgagtaacagctgcacgaggcagctgattcccacatagcaaagcaggggactgggaagtggctgtgtgggatgctctgccaggaccgtcctctactcttcctaactccccaactccggagggcagcattgctccaagccttgtacaaaatgaggacaaactgctgtttgttcaataaaagcagcttccaagccagtctccaagcccacggtggctctcagccttcctaatgcagttcctcgtgctgtggtgatcccagccatcaaattacttttgttgctgcttcataactataaacttgccactgttatggatcataatggaaatatctgttttcagatggtcttaggcgaccctcgtaaaagggccattcaacacccgcaagaaccgctgttctaagcctttccaccaagattgctgtctctcagcccctcatatacaaatatttggcagcctcatcctgtacccccacctcagttcagacctaccacagatccacagcaaccattttcttagcagagcaacacggaacgttgagggcagaagggcttggctacatcagaaattctggaaaacgacatgtgttgctcattaaataagagaaggaaataggaaatgttgcctcagtgcaaaagatagaaagttcttccaggttctacataccgcgcaaataaatgaacattttattaaaatgagtgctgatttaaatgcttcttaggaaataggtacttaaggaaaaatagctgctgtcaatctagaatgcatagctaggctctgcctgagtaggtgagggagatttatattttcttgcagctgggaacattatttatatttcctcccacatctctggaactaatgtattaacgtctctatatactatgatgtattataatctactcatgctggaaatgctgttactaagctgtgggcgacctgtgctcggaaaagttggctgtcgtcatctgaattagaagagatgctgcattcaaccacagcctgtccttttatggtcattctcaaggtctaccactcagtggagtgaggggagagaccgtttgtgtgtgtgtgtgtgtgtgtgtgtgtgtgtgttaatagctctgccaaaggaagggaaagaaaagtcagaagggggttcaagtataaaaacaaaagccatgcagcccccaaaatcctgcagacaaagcagaatagtgtgaacggcacatgtggcacgtggggggagtatgcacttgtgtgtacatgggcatacactgtgtgtgtggtcatgcacttgtgtgtatgtatgggcatacacttctgagtgtgtatgggcatgaacttgtgtgtgtgggaggcatgcacttgtgtgtatgtgtacatggctatgcacttgtgtgtgtgtggtcatgcacttctgtgtgggggcatgcatttgtgtgtgtataagggcatgcacttgtgggggacatgtacttgtgtgtgattgtgtgtatgggcatgcagttgggggggacatgtacttgtgtgtgtgtgagcatgaacttctttgtgtggggggcttgtgtgtgcatggacttgtgtgtgtacatgggcgtgcacttgtgtatgtgttcatgcacttgtgtgtgtggtcatgtacttgtgtgtatgtatgggcttgcagttgtgtgtgtgtgtgtgtgtataggcatggacttgtgtgtgggtgtgcacttgtttgtatatgtatgggcatgcagttgtataggggccatgcagttgtgggggcatgcacttgtgtatgtgaatggctcatgtggtatttgtgtgtgtatgggcatgcatttgtgtgtcaggggggcattacataaattgtacttacagtcaaaaaaatcatcattagatgcctaaccctcacctgagtcttccttcaaatgagggacactgaaaaaaactaacaaaatgttagatatatggtatgtttaagttaagaagtcttcatggaaattttaagat

SEQ ID NO: 323 - DNA, 2900 bp, Mus musculus
aagctattaatagtgaggttccagttgtctgtgagtggtgtgtcacccatttgggaggcaggaggtttcctaatctctcgatggccctggtcttgagacaccgatctctctgaagtattggaggtcttcattcaccttcctatcaaagcttcccagaagatcccagcctgagagatgagtgagaagatacactgctggcaaggacatatccaagtagtgggcctctctgatctttgctcttccttgctctttgatggagctcagtgtctagggtataatgtggcacacttgagttcctttgtcagttctgcaagtacagatgtcgatggaatgaccaactgagattgtgacaacctgtcgtcctgttggagatggcttcacctgacagatatgccggcatgggtccattcatccaccaggctgtgagttatctagcaagtctgcttcaggtaactgttgtcaatgggctaccactagtgttcacaattttaaggaacatgttgctactacaccctcaaacaatcttttggtagcctcagtgtcctgacctcgaagcaggagcagatcagagcagtgagtctgtgtcctctgtcagcaggccattctcctacccctcccttctctgataccctcctattctacaagtatgtggtttctttctttgccccttagattctctcataccagatgtaaagattgttgcctcttctttcttttaaatcatatgtgcttgatattcatgctttttacttgtttaaatgttattacatctatctgtgtatctgcatgtatgtcgtgcatgcctgtgtcgtggcgcacttacagggatcacggctcaacttgcaggagttggttctcatggtctgccatatgggttctaggaatgaagctcagagtcaggcgtggcaggaggtgcttgtaccaactgagcacctctttggccctattcgtttgtgttcaatctttctgtattcttttgtgacaaaggcatcttctgtaaataatatactggtgaatcttttagaccatacatttagaaatgttctattttgtaatggccaaatccatttacatctattgtacttatgttatattaagatctatttctaccatcttactccaccctttctacttttaaaattctctttgcccggggctggagggacagctcagtggttcagagcactggttgttctcccagaggaccaagattccattcccagcacccacaaggcagctcagaaccatctacaactccatcttcaagaggcccaacaacctctcctggcctctgcagactcaagggacacacacagtgctgtctgtgcaggcaaaagacccacgcacagaaaataaaaataaataaaaatctcaaaaaataaaatacatctttttgccttaaaccaaacatatttgattttcttttgctggtataaagtaacaatttatttttgttcttgcagcgactgcacttgaaatatatttactcatttatcccgacttattaaatttatgaatatctacttcttcacccacaaagtacaagtagttcaggatgttctctttctcttccgcccacctggagtacacaaaacagcgacgcccacacgtgtctacccacccacaagcacacacacacacaccacacatactactcatgcagtctgaagagaattctagtttggatttcttatgaatataatttttttcttcatttccccacctcaatctttgctttttttttcttccaagaataacttccattttctttttctcagattttttttaactctgtccttatgaagtgacctctttacaagggctcttgtggaggtctcagcagagcatcatcaggttaaatcaccgtgagagtgttcagtcattttcgggcttcaggagatgggcgcctgactcccttactgcgactgtcatggccctcacagtaacggagctcgccacagtgagaagcacatggcatcaaagtcgcttgtttcagatgcatccctgacggcagtggactttacaatgtcccaagtaatgccattctcgtcatcaggcacactctgagtgcaggttgtacagtgaattggcagcacacggcccagggccacccacccatcctttatctttggtcatcgtggagccacgacccaaaacagctttgcttaaaaaaaaaaaaaaaaaaaaaaaaagacaacactaaatctcagtctatttgactgtcctaacttgacattttctatagcagtggtccccaaccttcctaatgctccgatcctttaatacagttcctcctgttgtagtgacccccagccataaaattattttagttgctgtttcataaccataatatcgctactgttatgaatcacattgtaaatatctatgatggtcttaggcgacccctgttatcgagaaaatatcttgtgtattgtacgaatgcatcacctgtcaattaaaaagcttatggccaatggattaggcaagaaatagaaggtggaacatcaaagaggagaaagaattccgagacagagccaggcacgaagagacctgcctggggagatgcgaggagacagacacatggtgcctgagcacaggtgaccaaccatgtggcagaaagtaggttaaaataactgggatacttgcagttagatctagtcagagaaaagcctagctacatgctcaaggtgtttgtaagtgtattttgattgtaaatatagttcttggagcatgggactgggaagcagaaccaggctaaacttctacaccctatgaaagggtcatttgatccccacgggtttcaaccactgctctatagcactgttgggcttatattccattagcttgaatatttcttcctatgtttcttaagagcacaggttctaaaaacttcatgagcc

SEQ ID NO: 324 - DNA, 1750 bp, Mus musculus
ctatgacattgtcttggttcattttggagaaccctaggtagtacaaggcttatgtagacattagggctgagatactaagattaaaattcagaagtggctatgttaacttgtacatgtatttccagatcaaattcaggagattttcccccctaaagataaaggtgtagaaagagtcaccatgtgtctcaaaatcaggtgaattttgtgctgtgtctcagaacggctcacttaggagagtcagtccttcatttgtggtcctcaccatatgctcctgagacctgaaatgttttctagaaaaacacattggagctttgtgtagcttagtggaacagcacttgattagtgcgcacaaggccctaggcttgatctttagcacttgtatgtttgaagaaccacacacttagattccataccaggcagttaaatgccccatccgaagctcagctcatttctagcaagcatttcaagcaatcttcacacacagacggttctgtgacagccatcaggccaagcagtggcacgtcttctacaccagatggcaccacaaacccagtctagaattagctgtccactcagctttttttctgcttgcttctcttattagggaagagaaagtcgcagctaagcccaaggcacagtcattctgctaacagtctgctagtgaaaggcctccccggaagaggctaaggttattggcacagacaggtgaggactattctcttctgagtgaccacctgggaccacactttagtccagcccgcagttcgggtgaggagtcctatgaaacactgaagactcagtcagaggcagacttgtgcagagcacagagagactgcacccttccaaaccactgtccctcctggtcagtgttcacttctccccatcagagccaggtacaagtatgttgacgctccatccccgcagagccaggtatccctgtatcctcttccccagaagcaacccctctatgtggtttgaatgagctatgtccctccccccaatagcctcacttggtggtgcagtttggggaggtctggatgggggagggaggccctgctggaggctgttttgagagtttttagcctcgccctacttcccattcaccctctctgcttcatgtttgcagctaagatgggatgtctctgctgcctgctgcagccacctgctgacacgcctggcccaccattatggactctccctctggctccctaagcccaaataaactctttcttctataagctgctcttggtaatgatgttttatcacagcaacaaaaaagcaaccaatatagcatccttcttcctttcctaggataattgctggtgttgcactgggccccagcatccgagtgccatcatccagactccatcatctgggctctagcatctaggctccatcatcctggccccagcatctgggcttctattgttccctgtatctaggcccatgcattcttccttgcttcttgtagaagcaggaaccacacatctctgcactctccgccttcaccctcaggctcaggctcaggctcagagttttacactcaggtcatttctgcagtgttcactttcacccatctttgtctctgtcatccccatgccctttggtgtgtattttctgctattggatttttacaaaatagataatttttaaactctatgtacatgggtgcttttcttgcacatatgtatgttcagttccccaagaagccagaagagggagtcagatcctctggaactggagttatagc

SEQ ID NO: 325 - DNA, 1775 bp, Mus musculus
ctgagccatatcatcagcctagaccatgtcatttgtgttgtatatgcaccttccagtgccatggttgacatgccagtagtttgttttattgatttctgcattaatttttaattccttaagtttcatatattacctcagcagtttatcctgtctaatagatagtaaaacatgaatagataaaagcatgggtgctttttctcctacaatcgtatagattatattaagtaccaaactaatctttatagaatgcttgtttattttcttcctcttgcgtgaagagcttgatttagaatacatacacctcgtactcttaaaagctctggaggaacgtcgtcaggactgattgcacaggttttgggtgaagaattcattcattgtcttcttagcttttagtgggtacctttcttggcacatcattctagtcttctgattcagctgttgtgctgttgcgtctgcgtctgagtgctagagtggtgactcagtggctaagaatgtttgctcttcttccagaggaccagagttcagttcccagcattcatccaaggcttaattaaaactgcctgtaatttcagctcccaaagacctaacacctttttgtttttgtttttgttttgttttgtctgttttctgagacagggtttctctgtatagccctggcagtcctggaactcactctgtagaccaggctggcctcagaaatcccggctgcctctgcctcccaagtgctgggattaaaggcgtgcgccaccacgcccagcccctaacacctttttttttttttttttaaatctcctttgggtacctgaatacatacacacacctgcctcattcttacaggttcactctgaataattcagaaatcattctatattaagcaccttgatgagatcttcctcctcccccaccctttttgagacagggccttaattatgtaaccccagttgtcctggaactatgcagattaggctggccttgaactcagagattcgcctacctctgtctcccaagtactaggattaaaggcatgtgtcaccactgcccagctgcagtttcttttatccatttataggctttgaaagattagcatttcttttaggactgtcagctaattctgtattttaataaaaatttctagtgggagcattttaatacatgttttcctttcccagatgggtatcatttttctccagggaaataactcaaactgctttgttcatgtctttggtctttttttgtagtacacaagtggtttccaaatgggctttatgcagactttcctgcttttccttttgaagaacattaacccctgcttcctcttcttttttttaaagttggtgtaatacggtgtccagtatgtcgtcaagaatgtagacagatagatcttgtggataattattttgtgaaagacacatctgaagctcctagcagctctgatgagaaatcagaacaggtatgcacctcaggttctctctatactcatatatatttttcttgtggttaaatgtaaattataagaaacaatatttaagtaatttaggtacttctgctatagctctatctttcaaattagaaataaagattactcttccacaccctaagacttggtagaataaaatagttattatttaaaaagttaagttttatatagatttatgttctgaatattagatttttacctatctaaatgttattgctaaagaaatgtttttgaagattaaatgaataacagtgattttatgcttttgtataattaatggtttttaagagcaagttac

SEQ ID NO: 326 - DNA, 2150 bp, Mus musculus
agcccactgttctggtcagatgtttctcgttagtacccgagtacgcacacgctgctgtcctgcctagtacatgtaggagttcagtggtgcctctggctctgtggatcaggtgctacaagcacaccctctgccaccgggtcagcactgccatctctggagctgctcattgtagcttctacagagccagctggaccctgtggctgtgttggttggggcttggaatcaggtacaaagatttttctccttctggctttgactcaaccatagtcatgcccaggatcacacctagcttctcattagacctgctctttggctttttgtcctaacagtctttccacttgagctaacttgaacctaccagactgtagttgacaggagccagccaaggtgaagagactgtagtgggctaggactttctctgtcctttctcttgaacctcccacctccacccactccaccaccccaaccaatcttcccaccatttacatctgcacatgcaaatagacccacaggtcagaagcctgccagtgtgacaatggcattgtgaattcagcctagtcaggataatggttatctgtttgctttctcagtatccttctcagagaatcccacagtgtgaggtcaaacaggacaaactgctacatagaacagctaaatgaagcagaagacattgaggagtcagaaggtggctgtgtgtctggtacgtctacccagtgacatgggcttcttgtaggaactttagggctcttagaagtcaataatgcttccattacgactgtgttaagtagacatgataaatgagatgctcgccatccttaattgaagatgtagatttctaaaacaaaccatcaccaccaccagcagcagcagcaggagcagcagcaggagcagcagcagcagcagcaggagaaggagcagcagcagcagcagcagcaggagaaggagcagcagaagcagcagcagcagcagcagcagcagcaggagaaggagcagcagcaggagcagtagcaacagcagttcttgggaaatgaaagcctaggccccacctgcccactcactcacctgtcccaccctgctactctgagtcctgctactctgagtgtatacttagctcagtcacctaattaggttaacaagcattttaaatggactcagcttctactgcttgagataagatcagatttgagatttatagaactcaaacagaagctctgggctcaggcttggcagcccttcaaatatttgtctatcttgtcgcttggaggaaaggatgaattcaatccatgtgcccctgctctcgtcctgcctactttcttctgacccttggtgttggctgtccttgcattttaatttaattggctcctagccaggcatggttagaacaaacaagatagcagttcagaatccttccatggctgcctggatgcctaagaacaagaatgattttttttttttaaagttcaacaaggattagctggatatggtggtgtaccgaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggaggcctctgtagagagaacctgaaacaactgttgacaggaatgtgcacagaactgaaactttttttccacttaaacagaaccaaaagggaacatgggggaaatgactttctcaacagatcagtcaacatcattcaggcctgtgtgccagctcacattagcataaaaaccccaacaacaagtacaacagcaacacagagatcaaagcaatctgggaaataatagttgatataaggatccaatgtgagagtcagttgtctctaaggagaagaagcacattaaggatggagatggggaattgtgtcaacattataggtgaagaaaactcgtgtaggataaaagcataaaacaaaccatcttaccattgaaatatggtgcaaagactcactctaggatttggtttcagacataatattaatatagaaacacttatgaacttgtaaatatgacgacacatcagaaattctgaagtcaatgaagacactgtttcttt

SEQ ID NO: 327 - DNA, 2775 bp, Mus musculus
agtaggacctggtacatttgtcattgttcgtcagtaggcagatcagttctgtagggcagggcaagatgacctgagctgtgaataaagagctgcatggcattgggctagttacatgcagaagactggctgcttagaaaacaaatggttctgtagtgttgaactctgtccatgtgaagtttgctttcacactcatctgggcgtcacaaaaatcttcagggaaggaagaaatgctaggcttatagaaaggagctggcttgctgtggatctcaacgagtaaagtggcagagtcagggttaggatgctcaaagctctcaagtaccagtagctaaggtggaaacatctctattaaacatcttctagaatcaccctgcttatcggggagatgagcaaagaggcttctgaagagcttggtctctgagttcttaattattcaagacaatctactcagaaaacagatgtgagtttctgagaatgcaatcgttgaaaaatcccaagaacctcacagactgcatttgtctcgccagtctgattgcttgcatcccaggactcagccatttggcatcttcttcaagtgcataggaccgacattgagcagtgatgagattctctcccttgttgcctcctcccctttcagaggctcatgtgtaatgaacttgtggatatgtctgccaggtgaaaattaaggagcattgccactaacatgctttccccatcccttgtcaggatcagaagagatcaggaaggagagagaaagagcgagggactcagttcagaagccagcataagcctccggtcttctctgctttccggttgggttctcttctggatgggtgtgtggcagagcggcaggtgtaaggtctggctcggtctcaggatcactttcttcaaagttctcttggattttttttttttttgcctttaccctcagaaaattaaaatgttctcattaaatcacgatgatccatccacccttccatctagccacttgtctaattaatcacctgcctatctatccatctgcccagctattaaacagttacttagcacttacccactcagaaaatcactcaccgtatcaggtgttggaggagactgaaggatgactcagaagcagtctctgcattagtcagagtgccagtgaggggagagagagagagagagagagagagagagagagagagagagagagagagagagagagagaaaaggggagaagagaggagaggagagaggagagaggagagagagagcactaacactaagtatttacaacatggaaaatttagtataagaggtggcaatagaaacatttttaatggaagccaaccagaaaactgcatggcaacccaaaaatcgtgaatgcttggaaggcactaccacccctaaactagggaaggatcaaaggagcatgggatgctaccagcgttcaaggctgaggtcattggaaggaagctatggtgcttgtgtttggactaggataaatatatttaactggagtttggaaccatggggctccaaccatcagccttagagactccacatgagatagagaagagagggcagcctggccttagacttctctcctgtcctctatattcccgatactaccactaattggcttgactcagccagaaatctaggaggtgcaaacgtcaggggcaaggcattttgtctctaccacagtacagaatggagtacgaggacgggtgtgtgtgtgtgtgtgtgtgggtgggtgggtggggggtgagggatgactctgagggttgatagcttgggccggaccaggcctgggacaaggactggggacagagcatccagggtctacttgagtctagtcaaatctgtctgccttttaagaatggcctccagaagaaaagtgggccctcagtagagtatcccaatgatcctttcagaaacccagtaacagactaagtgttcttcccaacatggctgtgctatgcaaggtctaaccgtgagtggggacaattggattgggtgtacacagtctcatggtgcttctccgtgggttcagtgtccagcaaatgagtgttcctgatacttgagcatcgaccccacctccaggtcccatgcacccccctaccccagcccaaccagccatgtgcttccacagcctctcagtggctggaatggctccctctgccccaggtgttctcgcccctctccttcctgggtggattctttacttctcttttgacatccagatttactgtcacatctttgtaaagacatctctgttctcctgcctctgttttccattggcgtttcttatgtctctgtcactgtgtgtagtatgaggggtgtggtagttgttagttatacccactggttttcttcatcagccaatagttcctggggcacagggcctcatatttaccacaaagtctgggctcaaattagtcaattgatattgaattgaggtcccaacactattactgttgtaaaggggagggcaggaagcttcccctttttggagagctgtagtctttccttctccaccagggtgctgtttaccagctagtaagagtcatccagaccattgctgagtcatgcttcaggctctagaattctcctgctgggaagaaattcctaggagagtaggtctgagagctgagaggagctaatggtgccttccttttgatgttttatagatgtgacttctcagcctggtctggcccagcaccaccaggtagagcttccttatactggaacagctcagacagcttggcaagcttgatcatttaagtgaagttttat

SEQ ID NO: 328 - DNA, 5950 bp, Mus musculus
aaacctgaccatgtttctcacccctgttcctaccatactggtgagaaccactgttatctctgtgtcactgtgagatcacctgctgtcaccattggcattctggacactgtactcatcccagcaaccaacatgacccttttcaaacttaaataagcaaaccaccactggaactgtccaggtccagatttaccatctttaccatgtccttaatattctccgtgatgtgattctcatggcctccctaaatccatctcctgcagcacttctttttggtcctagtcacttggtctgctgtctctcaccagtttaggaatggcccactttaggcctttcctcttgagtcttcccatcactaactctggagctctcaggaatgacctcatgcagaaagcccactctggcttcccaggcttccccgttccccttccactgctctggcctttctccccagcacattccaacactggtatagtgacttattccattgacacataatcccatcctccactagaccaagaatggcagaggagtgagaatctttattttatgcagtgatgatgtaagcacctaagtccagaggcagtgcttgcaggcacctgtgagcccctgtctagggacttgcttggggaaggtatgccagcttcaggacaaagagtgccacggccttccatcttccttcttgcccaatcaaggccagactctgtgacaatgacccattgacaagcacctgcctccatattttttagcagccatctgcccattcatggtgacatgtgtactttgtagcctggtccagagaagagcagcagcttgctgaacacggcccataaaccccagcccagcagccatgctagctcagacagatacatcacatccaccaagataaacagtcctgatctgaagaggtcctagtgaagagctgacctccctctctgccctgcaggcacagccagagaaaagttgtacgtcagcaaagctgctgtcagtgagtgacaggacactgggctgcaatgcccaccttgggagaaccggggagcttctgtcgtctggggccccacctcagccaagccaggatctgcctgcattttgttctcttccctctcctggtgctcactgtctcgttgcctttctcctttgcagtgcccccttcttgccacactcttaggaagagcttcctgcttcctcgtctttggtttctctgcatctgtgtctccactaagtttctcttcacactcactgtgtgtccatttgcctgccccccccccacacacacacataccccatctctcatctctgcctttcaccccctatccaattctctttttacaatccctctctttccatttcccttcctatttcgctccttcctctcctgtttttaccctaccagccctgctctggtttcttggcctctgacctgtgagaacaatgctccaggtcctttgccacgtgtctggagaggcctgtacttcttccctccagtcccacaggtagctctctgtccatgaccctggtctctgagcagggggcagccctctgtccatccctgccctcctagctccttgttctttctgtagtgagttcaggaaatactcttatgcactcaatcaaaatgaccttgacctggactcactctgttgacttttctggtggcctgtggtctcttcaatggggtggagctttccctcttctgtcaaagctgacctgtacttgggtccacaatgcaacttcccaagtccctgcataaatcattttccaagagcctatctagagggcgccttctgcatcctggctgagcctgagcttccccagacactccagagcagttccttcttgcatgtaagccctggctgacatctttccttttacagcaagagtatcaggccactctgtaaggtttggctttatctgctcctgttcagtcagtattgcatctggcttgtgtgttgcctcttccttctgcaaagccttgaatttctacagtccctcaatggaggaataaaggtgtcttagttgctcttaactgttggagtttgatcagcttaggaatatcattgcttgtgggcagctgagcggggctgtcaagacccctagataaggccaagaatcgtcacttctttcccctcctcttcctgattcatcgttctctatatgaccaccaattttgttggccttcccccttccacctctgaagacatgtctcccatcctttcatgctcccaccctgccgacgtgatatttccttacaaggatattggtgagttaaatgggaatgtattgatgaagggtccttggaaactggagagaatagtgtgtagcagttgctatatgggatagcaggagatacgctcacacacagacacatgcatgaacgcacacattttgtaccttttccatcttaactaagcactgaggctgttacttctgcagcttgaggtgcgattgtaagactggctcacttaggttctccacaacttcacagatggaaaatttgttctcaccattgatcttaacaatctcagtgtacaattcttttctttccttattaaagaaagaacttttaacttgaagaaagcactttgcagctactcttcgacatatttgaactgttggccttattaattttacacttgtatattgtgagttcctgaagcccaaccatggcggcatcagttctctgtagtaactgaaaagccactgactgagtaacgggaaggtagcaagcacactgtacggatacacttcacaagggcatgactggtatcctgggaagaattagaatgatgggctggctagttttatgtcagtctgactcaactagagtcatctgaaaggaagaaacctcaatggaggctccataagatcctgttgtaaggcatcttttaaattaatgattgctgtgggaagactcagctcattgcaggtggtgccatccttggactggtggacctgggttctataagaaagcaggctaggaggccagtaagcagcacctctctatggcctctcggtcagcccctgcctccaggttcctgcattgttcctgtcctgacttctttcaatgatgaacagtgatgtggatggctaagtcaaatctaccctttcttcccccaggttgcttttgatcatggcattatatcacagcagtagaagccccaactaaagacaagtgggttggtgggaggcttcatcatctattcagaatgatgtgcagttttaaattggtggattatttatttctagaatagtccatgtatatttttaagtcaagattgactatagctaactaaagtcacagaacacaagacaaggggtacaaagagataacacggtggcttaaatgtgctgtcataagccaaccgtctaggattgggtagtgtctcaaattggcttactcttcactgatgtgctactgatctgagctcaaaacacgtaactatgagcttgctttcacttctggctctctcacacacgcctggagcttagctttctagaaggctctgcattaagtgtaaaacagggctcttctgctctccacagggatttcctcactgcagtgtggccagacgtggttgacatctcagctgaatggtgcttatcccggacaccgcagcacctttacacaataggcttagtggtgcataataggtgtgttggggtcacagcagtccacagtctgcttattgtgccacccccagtacatttactgaaccttcctgaggcctgatttttccctgttgttaaaatgacaatgaagaaagcacatttggcagagtgttgtgaaaagccaggaagataatgcggggaaagtgcttatcccatgcctatgatgtaagtgttcggtaagtgtaactattttattattatctcacaaggcagcctttgcatggctctgagctgaaactggcctcccaataaattgaagagtgcttgcttctgcagttgggagccacatggaagcctttaattcttttcgcagaaacccttcaaatatgtagggacagctttcatgtgctgtctaagtcttcttcaatagaagcatcttcagtttcctcctcgattcctcatctgggaattcccatgatccccagaccctttgtcatctaggtcactgccttctgtgcacatctgtcaatgcctttccaaaaatatagcagccagacctgaaggtaagactttgaatttggtctcacctgcccagagtacaatgggacagtgacattgatctggatcctgtgaaaagttgaagctgccatcagtgtgtgctggtgtatctctctgttaagtggtggcttagtgatttgtagccaactaaaagatttttttcatgtgaacttgccaagcctagcctcatcctacttgctaaatctaaccttttccatgaatgtgaacatgtgttcagctgtgctttattattttgactaagagttgggatctctttttaatttcagtgcatgaatagatcaatacatttccatgttgaaaaaaaaccaagatataaaggcaatgagaagccccctcaacatcctgttccagtctgtccagtcttccctcccttgacattggccatgactagaacgttctagtttctgatgtatcctctggagttcccttttgcaggtataaaggaatatcaatattagcccttatctttcacccatattttatgtaattggtagcatctaatacacacagctctgaattttgtggtgatcagcagtatcgcactaaccaatgtgtgaagtccctttgactcttcattcttttgtctgacacacttgtgaatattttaagcatgtagtcaaggtctttatctaagttgttgatagaaatgtttagaaagctgaggacctctcactatggatgtaccccaggctgatgttgtcatgtatccgcaaacctagtctgaggtgcataatgttctgccactcagtggtacaaccgaccagtcttgtttttcagttcacttctttccttaattcagaggctgggacccacatccatctcatatctcactaaagaactaccttcctagctgggtgtggtagaacatacctttaattccagtatggcaggggcagaggcaggtagatctctatgaattcaaggctcagtgagttccactgagcttaacaatcagaactacagaaagagaccccatctaaaagaaagaaaggggaggaggggaagggggatggaggggaggggagaggagaggaaaggagaggagaggagaggggaggggaggggaggggaggggaggggaggggaggggaggggaggggaggggaggggaggggaggggaggggaggggaggggaggagagaaaactagcttcctgggccaaagagatgaagatggagccaacggagacctcagtcaatgaagagaattttcatcatgcaagtgcaaggacctgagttcagtccccaggacccacataagagccaactacatggacatggacctgtcaagtcagtgccgggtaaacagggacagaaagtccaacagcactcattagtcaggcagttcaactagatcacaagctatgggttatgtgagaggatctttcccaaagataaggtggagaagtgtggaagatacctgacgtcacctgctagcctttgcacacgtgcgtgcacacacacagacacacagacacacagacacacacacacacacacacacacacacacacacacactcgcacatgcacagaactgttttaccaatctatcagtttaaaatgaaggttctcagctaagaaagttttttttttcttctctctcctaaatgacatatggcaaacctggagacacttttgcttgtaaactgacagtggttggaggaaacacaagggaagagaccagggaattgttaaacattgtatgatgaacaagactgcccacagccccaaatgcacacaccaaaagatcttcagtctcagtg

SEQ ID NO: 329 - DNA, 2375 bp, Mus musculus
cctgataggtatcccagtgctgtatatgagcatagtctcccagggccaccctacagactacacatggaatgggacagaatccagacaaggacagataggataagtgaagtctgagctctagtcccatctgcttgctgaccccttgttgaccttgttcactttttctcttagctcgtacttatttccagtctgtaaatgggaactagagacatcccagaagaatatgtgagctagaccatatcctgaagtcattaacccaattgtttttccaccaattggagtgatgggtctgatagagggttagtgacactggcagagagcgaatgtttgggctgaggagagatgtggagtgcagctcaagaggacacctttatatcaggttcctgggctcccagagacagccacgaaagcctaggagttcttctgcctgatacaaataatatgtcacctctgtgtctcgtgagctaactttagaagttctcaggtctatgcagtacagttacatttttatttaattattattgtccaagtgtatgtgccacagtgagcatgtgcagataagaggatgactttgtagagtccgttctctctgtcaacctctacgtgtgttctgggagttgaccttaaattgtgaagcttgtgcctacacaaacgctgggtaagccatctcaccagcctagaggcaggtgtttcagaaaggaaagcccaaacacagaaaaggaaagaggattctagctttagtcagatagtgctggtgctcctgctaggatatggatggatgggatatggaaggaaattaaattagaattaaagggtacaggctttggagacaaggctccaaagttcaaggcctgacttgctgcttttgattcctctccctctgggaggaaacactttcattccctggcctcagtcttcaccactatagaatgggaacgatgcttcaaagagctgttgtggagtttatatatgcacagagcactttagcagtgtttggcaaatagtaagtgcttaataaatgggagctattatagtcagctgcttaaaataataatagcaaccacttatggagtgctgagtgtgccaggcactctgctaagagcttctcggactttatttcactgaaatcagagagctcaatgaggcagctgtgaggattatccccctgcttggcagatgaggcagaggtttcatacagcttcttcaaggtcagccagtttgtgttcgagggtgggcacagctggaaccaccgagggtctatctgatgccaaaggccatgccgcctgctcagccaccctggcttctacagagctaggctaggatctccactgcaggcagaaggtcttctgccagttagcccaacagcttgcaacccacttctatcaaggcacctgccacgagagattcccctgacaattccttctaggaaactgtagagctttccttttttgacatgcagaaagaggggagctttgtcttatgagcaagcacagcaccccatccctccacagccttcactgcatggtgtcaactgatgctccagaatgatcctaaggcctgtctgctttccgacgttagtctcactccggatgtagttgggctgcactgcatatctaggaaatatgtcaaacacattgatctcaggaatccaaagaggttatagagtattttctgtcttcagtagatcctaatttgagacctctggctcctataaaggttaatttgatattcttctgctttgattgacaaatacatattgagtccctgtctggtgccaggatcaggaccaagctactactctgccttaacacaagatttcccctggggtgtatggctcaatggtagaaccatcaaacacagtctgttatcagtcaagggcccgctgtgaaccagacattgctctaggcatatcttatttgcagtaactcatccacactatgatgctagccttttctacaggttttttttttttaatgaaggcacagaaaagttaggtgactcagtcaatatactacgtggcagagcagaacataaagccagcatgttttagctccccaacacaggattctttctacagtatatacttgaaagtttgcagtgctttcaaaagggccttgttgggaggacgcctcttgtaatccaaggttgtagcatgctgttatagagtgcttctctggaaatagccattagagtatactcaggaatcaaataagaaagccactattgatacattagagtcacatcatggttttgacccccaaatagcactattgcttgtctgttcatctattgtaagtgggagtcgggggggagggtgtttgcaggggggggagtgcatttgcatgcatgtgtgtgtgcacatgaacacacaaaat

SEQ ID NO: 330 - DNA, 2775 bp, Mus musculus
acatgggagagcaaagtagaacacctagcggtagacagaatatgaagtcaattcaaggcacctcagacaagctttgcctttcgaaggcatgcctccagtgactttcttccctccagtggggccacccttcctggtggttccttccttcaacacatgagcatatgggggacatttccaactcaaactataacatttccttatcctctaaaacatataaggagactttctggtcagttttgcagagtttctgagaggatgaaggtaaaaaatcatgaaaaggcactcatggaagtagctacagtgaacaaggtatatgctgttattaaaaccatcttaaacagtcattaccttagtgccagtgcagggctgaggggagagcacaaggaactatcatttgaaaatacttgcctttttagacttcagagcaatcaagggcaagggcaggacacagggttctctttaaagacgaagtatgattcaaagataagtgcatactgaatggtggagaatagacaggtcttgagagcaaggacaagatcttgggaaattaacccaagttctctccatctgcaaattcactctcccagggtgggaggaccgtgtgcatgaaaggccagcaccccggaagcactcagtgatagctgttgttgtcatctcctagctagtagcactgggaaatggcaaggttctgagaacaccaatccattggtctgtagacgacacagtcacttcccttggaagcttctagagaaaagaaaaacaaaagcccactctaccagacagaaaccagactaacattgagtccaggtctacagagggaagatggagactgccgacccatggcttctttacaccaaactcttgctgactgagaaggttctgggtaaaaacagccaaagagaacaggatggcgaaggaaaagggaaatagggctggtagtctcaaaaccaccctgtggtcattgtgacagggagtctcgagaaggcaacgaatccaaggtggcagcactgtcccgtcggcagcactgtcccgtcggcagcactgtcccgtcggcagcactgtcccgtcggcagcactgtcccgtcggcagcactgtcccgtcggcagcactgtcccgtcagcagcactgtctggggcatggcagagaagacaagtgagccagcccttcagaactcctgctcagctgccatgggctttggataatgcaaagtctttgttttgtgtccttgatgatgcatatgaacctcagggtcattcagagcctaaagttcctgtgttaggctaaaatctccagtccccagccattgctaaaggatagagccacatgcctttggaggaaaaaaaacctaacagctatgtattcaaaaatttacagtctggagttacaatagacagtgacagatggatctgggtttacataaaatgacacagacactgattttctgagtatttgttggaaaaatcaacaacaactaaaatggatccctcgcccactcacacacacaaccattccacacaaacccactcacaggaacagccattccacacagcagaggatcccagcaccagcccatacagagatttgaaagctatttccaggtctggggttcatcttattaggcgtggcccctttcccttctggcacaaccctgttggcacaacttccgtccctgggggatggttagcctttggagaaacagctctcagcttgagtttcacatggaccaaacatcctctgaacttcacagtactgcctgtccttccaggcccacctgagcccagtaggtacaaagaggttggctaatctgtactcagaatacccctccccaatttttagaaggatattgtcagactgaagaatatccacagatgtgtaagcaggctacttggagcctacattgtgccctgctgggaaattggaagagtggtctcttcacatgcagggttgccatgtaaaagatagaataaaactctactgcattcttgcacagctttggagacacacctgactgggggtgggggaaggaatgaagaaaagacaaacgcaggtttacagaaacatgggaatggaagttgggattagatagactaggctttctaatagagaagccacagcatcctggaagctcagcgtgattattatatacagttgagtcagggttatcatatacaagataataaggagatgggacagtggatacaaataaggaatcaagtttactggatatagatgaacaaggtttagatattcttcataggagaagtctctgtaacagagaagtcttcaggtcataaatgtaggggtgtggtgtgctatggtggacattctctatatacacaatatcaacatacacaggaccagaggaagactttgccatccccgggaaacggaaggagctttgtcattttcccatagttatgaggctgtgcctatgtcaatagcacacattcactcaggactcagtttcctacaaaactcccctgtatatcctcagaaagctctcttacagttagaagccagggaacatgggcacacaaatactcaaaaggtacttttgcgtatttcagttctgcggcagattctcagttggtgtcttagataagctgattgcataggaaagtaattacctcagctcttcattgttgcaaggttcagagagtgccctgcaactgtgcttgcttttgggagcaggggtggggataggagagctcccctttgggtggagaatggaacgggaggtctcaaagtttctttctaaactttagatgatatat

SEQ ID NO: 331 - DNA, 4225 bp, Mus musculus
cacacacacacacacacacgtgtatgcacgtgcctgaaagaacaacgttaggctgaacagtcagccccaatatggttagcagatgctggaaaactagaaacaatgaagaaaactaacaagtggcttggtggtgtgaaaaccaaactaattacagctctttctgagagtgcaccactagtgatgctcagtcatatagccacagtggctggcttgcccatcactgacaggctgggtaattcctgttataggttctattcaaccacagcattaaattgtgtgtctgtgttcccaggtctctatagattgtattatctgcccccaacttttcacactgaggttacttttattagacgtgggagggagatgttctttcattgaaaaaaatactaaggggaaaggattaaaaataaaaaaacaacaattgggtgttaatcatagagtggtcacccacattcagccactatcaatattactgggttctttttcttggtcattttcctctgtgtaacttaattagctccttccctccctactgtaagtcatttgggtcaagaccaagtttgtgctacaatgagcaagactgtgttgaacacttccatgcctttccttctgaatgacacttgggtaaaattattgggccactctagtcttgggcaatttcagacctcttaatggatactgccaagtgcctttcggaagtgctatgccaactggcactgagaatgtccgtctcatgcctcttaccagaactactgatattttctctctctgtctctctctctgtctctctctctctacctccctccctccctccttccctctccctccctctctctctccttccctccttccctctctctttccctccctccccttccctccctccttccattcctctctctcccctccctctctctccccctccctctctccctccctccatccctctctctctccctctctctcccctctttcatgctgattttaggtaatttaataggctgaaatcatagttgctacttttttagcacataggaaggtgagatatgtttctgtgtgtttattgattacttgaaatgttcacagcattcagcagttagagggaaacccttgacttgcttgtgaatgtgtgtacatgtaaagtgcttggtttgtgtgcactcaactgtgctgacacttgtcacagattccagctagggagcgggatgctcagctgctactattcacactgtgaggattccacagctaccctttacccttccctcaaatgatcctccagagtccctagtagctgctggtaggagaagtgacacaaaagaagggggaaaagtttgtggggagacactgaggacaagccagaagctccttccaaacttttgttcttgccccctctaagaagtggactattgtgtgttggaagccagagctaggcagtgaagcagtcaacacagttgttaattcaaggctatcggaaccggaggaagtaggactcagggcagagacaggcttcactgaatacagcaatgataatggagaatttatagcctggggaagggggcattggtagatgaaaactcatgaagatcaagcatcaggaacaggaacagggtggagtctggctaagccaagttaacaggattcttgctgggataggccagggtgatctggaggatgaggaacgagttggatgctgaggatgctcaaatactgacttactaggattttctagtagaactgagccatgcagagacagacacagatgcacagaaatggaggccaagccctgaaggtgagtcaaaggagcctcactggtagggtttgaatatgaactatcccctacagttgcatgtgtcagagaacttgtctcctcctagtggcgctgtcttagaaggttgtagaacctctacatgtggatgtgtgctgggggaagtgactcactaagggtcagatgtcgaggtttctcttggtctgatttcctctcctgtctctgcttcctgttcccttgaaatattaggtagcgagtcccagccgtatgcttctgtcgctgccatctgccatcgtaagggactgttcccctgtaatggactattgttctctcaaacaggagccaaataaatcttcctccctttaaattgtttccttcaggtatccggtaacggcagtgagaagagtcaccagtacaatgagtcaagttcagtcaagagcttgtcatgtggagggaagtgactgggtacaagagaaagaaagaaggaaggggtggaggggagggaagagggaacatgaacgggaacttccaaggaagcaagtggacctgtcccagccacagtgctggaggtgacacaccgaggtgacacacagagggggaaggctcagtgtttccaggtatccactgacacaaccccaccttcaaaggttgtggtccaggctctgcctcactcctcctttgacctttctgcctcatttaccacattgagcgaattagctgtttctccccagtgttaaactgatgagatgtctcctgcctgtactttgggttctagttacaaagctatccgggtgtaaatattgtcaggcataacgatatagcttgataaagatattcattctcagggcttccgtcatatggccgaacagacacatcctgacgactcaggcaagaaagataaacaagtgtctgtcttgaatagcaaagctaaaggctgtggaaatgtgtctgtccatccagaaatctggtcactgtcctggctgtagagcttgtctccactcctaccaggaggacattggaagaaacacaaaccataatattagcatcacttctctggcggaaacttcaggctcataagtaaagcagatctttatccagcaattggggtttctgtggtaatgaagtctctgctttgagcatttgttaaaacctgattcatctgagtgataagaaaatgtgaggatgacagaggcgcctcaattactcgtctccctgctaatccttggtacagtgtgtgtttagcaagagcctgctgttcgcagctcttctgctgctgggtcgtgtccgctctgttctgctcaggtctcgctcatgtgcatcatactggattcgcagaggatgcttttctttttctctcttcttaccagtgcattggactgtgcagtagtctaagcagctggagtctgataagggtacccgcccccagtcgaaaatgtttgcttcagattcttgctaggttctggaagtgacctggggctcctcctctaagtccactgtgacccattcccaaaagccccaccccactgtgcccctgtgagttcttcacaaaatgactggattctcagaagcctgcagtttcttcagtaaatagggcattgtgttaatcagggtttctattcctacacaaaacctcatgaccaagaagcaagttgggaaggaaggggtttattcagtttacacttccacactgctgttcatcactaaaggaagtcaggactggaattcacacagggcaggaacctggaggcaggagctgatgcagaggccacggaggggtgctgcttcctggattgcttgctcagcctgcctttttctagaacctagcccagggatagcaccactcacaatgggtcctcccctcttgatcagtaattaagaaaatgccttacagctggatctcatggaggcatttcctcataactccatcttgtgtcaagttgacacacaaaaccagccagtacaggcatcaagtctgcattcactttggacctggacagactcctctgcctctactgtgttttccaggtgaccccatcagacttgtaggcctcctcctccaggttccactgcagtttgttgctacctttattatgaagctcccctgaccacatggtgatgcatctgtttacatggtgggctgtactaagctccaggtctcattgcttttcatccattggtgccctgtatctaatataatgcctgggatatcacagatacaaatatcttcccatgtctgacaacttgtgggctgtggactactccagttctcacctttttccctggagacctaccctatggtaagtcggtaactgttctctatttgataaatggcaggtgctttcagcaaatcacataaaaactcagaaaaagcacttgcatgtaatatgttggaggatggggcccctcaacaaagggacatacttgcatatgaaatacttacctagcacgtgcctgaccaag

SEQ ID NO: 332 - DNA, 1750 bp, Mus musculus
agggtctgcagtcactcaaacaaaattgcagaggcatccagcacgctccattaaaacctgtctgctttaaaataactttcctggatctgttgtttgttttgtttttaggaattttgaatctacattcaatgtttttgtttttgttttccgagacagggtttctctgtatagccctggctgtcctggaactcactctgtagaccaggttggcctcgaactcagaaatctgcctgcccccccccccccccccccccgcacctggcctgaatctacattcatgagtgaagctggtctctcagttagccgtcttgtactgtttatatgtttctaagggtgatgaagtttctcagtgatctgtaagatgttgtaaacagttatacagatggtccctggcttatgaacatttttcactttaaatgatataaaaatgactcattcagcaggaactgtttactgactttggatcttaacacaggtaaacgcagcaggatattctcatggtctgggcagccgcgagtaggaggcagcttccggatcaccagagaatccacctacactccacagtcagtggcactgcttagctttgatgtttggtattccaggcatgctaagtgcattctgcccacctgcgaataggctcgtgcgtagcctcagcactcaggctttccagggggaggcttttagaggaaggatgggtaggtatttaagacaggctttctcgggctggagagatggctcagcagttaagcacaccaactgctctttcagaggtcccgagttcaattcccagcaaccacatggtggctcaccgctatctgtaacaggatccgatgcactcttctgatgtgtctgaagacagtgatagtgtactttcataaaacaaatatataaatcttaaaaaaaaaaaaaggcaggctttctctgtgtagccctggctgtcctggaactctgtagattaggctagccttgaacttagaggtctgcctggctctgcctcccagtgctatgtatgattaaaggcatgtaccaccaccacccagcaagggaagacttttaattactgacctattgttatgattctagaaattgatatttcccccaggttttgaaatggattgtcctaagattactctgagctctcaccccttcagtctgtacatccactgctatgccccttctctctctctctctttcaccctctctctttttaaaaagaatcttgttgtagatttgctcacattctttttttgggttttttttttttttttttttttgagacagggtttccttgtatagctctggttgtcctggaactcactttgtagaccaggctggcctcgaactcagaaattcgcctgtctctgcctcccaagtgctgggattaaaggcgtgcgccaccaccacctggctgatttgctcacctcttaaagaaccaaattttaactgtgaatgcaggtgttggatgtcatgttgttcctgggaatggaacctgggttttctggagaagcagccggtattcttaactgctgagcatcttcctgccctgagaacttctctaccattctaaaatgtcctactgaaggcactgaactagagcctggagaggaggaagaagcataagatctgtttctatgatagatggtaaacttcgagggagggaaggaggagggagggcatcccgggtaccgcagatgtgtcggatggagcatgaagaggagcacaaagagctgtgagtggagagctagctgtg

SEQ ID NO: 333 - DNA, 2050 bp, Mus musculus
tttgataaaaataaggttttagtatctggaaggagtcaaataaatatatataaacaaaacagatagtgaagatcgttactacataagtagcagcatgagggtgcggttctgctaggaatgtgtctctgttgggagtgtgtctctacggtagtgtctttgctgggagtgtctctcctggggatgtgttttggctgggggtgtgtctcttctatgatggtatctgatctgtggggagggtcctgtgaatgtcagatggttagaggctcaagaagaatcctgaagaacaaggttgatttgaggaacaggaataaagttctgtgactgactcaagctaaggaatcagagggcaaatacctttggaaaaggcaagaagtgagagacaggggttcagtgctggatgtcagaggtcagtgcatgttatctcagacactgggggaccaccggagggtgttaaacataaacacattatgatttaagtttctgaaaatagcatttgaattgaatagcagaacactgattttcatgagctccaagccttactgacagggataacaacaacagccaggtttttctgtgagctttttaggcactggacatatgacacatccccaactcattaaagggaagcaacgtttatttacatcagcatgacatgggctgatatgcttgaattaagtcattagatgactatcacctgtggccatcatcaggagcaatgggagaactgtgagcactatgaatagagacataaggaggaagctagcatggcctgcaggaggcagtgggggataccactgacaaaggaggttcacaacagcagacatcctttggtaatgagaacagggtcggtcccacatagaacctggggaaactgagatacttataaggcatttaataaggattccagtgaagggagattggaggaaaagcatgacccagtcaccaacgagctatagcagatctcagctgaatgcaatgcatggggctggcacctcctgaacccttctaagctatctattaactctcctacgtgagagataaagacatttccccaagatgcacagatggagagacaggttaaagccactgtgctgagcacgaaggttcctggcagaggctgagatgctcccccacccccgtggagccattttggtctcactataagtctgtctttctgactttcctgtccttgctcttcttcattgctctttgtcctccaaacccatatcatgccacttcagctatgcctttctaggatcagtgcaagtctcgcaaacaaaactcagttttctaggatgggaaagagatgatgtctggggagacaggaaactaaaatagaattgctcttctttccctattatttaaagaaaaatctatgttttgattctttataaatgaacatacagtataaaatcctagctatcataggccaatgctaaagtgatctttcagcaattttgatgaaatgtgtgtaaaataaggggtgctttgcaatcagtcccctaaatgctattctagttccataagccaggatcggctgctttttaaacctgctactgaacatttatcttggatataaatatttcacttgttttgacatctctgaagagccttttttaactcaccaaaggggggggggatctaaatatatataacgtatttgtgagactaccttaaaagaaatgtttgagatccagagaagactccacagcctgtgtaggcaggatgtcaatcagaaagaaccacaggccatgtctgtctgggccactgcctggaacattcttcctgggagaagtctcactcagctttgtctcaaatgaatgatctttttctccagcctatgtggaccccaaatatttcacaaaattaccttcatgcccctggccagcccattctatcaaacttctactccaataaaaggagattttccttagagagttgaagtgtccagggagcaatcgtcccccaaagccacattctccatggaggaaaaaaaaaaccctacattcttttcctgttggccataggtctttagagtgcagggtcatac

SEQ ID NO: 334 - DNA, 2050 bp, Mus musculus
acaagggcaacatgaattttgcaagcaaatggatagaactagaaaatatcaaactgtgtgaggtaacccagaactaaatgaacagggatggtatatactcactgataagtggacattagccataaagcacagaatatccatggtacaactcacagaaccaaggaagttaaataagaagtaaggcccaagtaaggatgcatgaatcacacttagaaaacaaaatagtcatagaaggcagagggagagaactaaagggtgaggggagggggaggggaacaaggaggcagggtcacatgctcaaagagatagtagagtggctcagtgggctaggagaatgaagggaaatctgcagctctctggggtgttagggaggggagaatctctagacaatctcagagacctggaataggagaggattcaaggagtcagtgtgagtgactttagcctacacacctaacagcatggacatggaacctgaagatgctacattctgtagtcaggcaggacaccaacccacccactaaacttttgatgccaaacttattccatcctaaagaaatacagataaggaagggtccaactcaaaacccattccataggcaaacaccaatccctgacattattaatgatactcttttgtgcttgcatcactgtcctctgagaagctctattcagcagcagattgaaacaaacaaacaaacaaacaaaaaaaaacacccatagctaaacattagataatggtcggtgaaatttatggaaaaattggggatggattgaaagcccagaagtagataggaaccccacaggaagaccaacagaatcgacaaacctagacccttaggaggtctcagagtctaagccagcaaacaaagaatatatatggcctgtaacaaggttctttgatatatatgcaaaagacaggcagttcagattttacggctgccctgtctggtcttagtgagaagggatgcacttaatctgccatagacttgatgtgccacggttgggagatacatggcagtgttcctaccctctcagaggatggcggtgttccttccctctcagaggaaaaggggagaggggagatgggggacgaactccatgatggagagattaagaagggagcagggtttgggatgaatactaattaattaattaattaattacacaaacagacaaacaaccaggcagaataatctggtatagttttatgttggagaagcagttattgatgctttgctgtcagtagaactaccagatttgaaaaggaatgcaaaccaaaagagctaaaatggaaaaaaaaattcaaagatacagtgaaaagtctgagttttagcatcaaggccctgcagacagcgagcgtatccttttctccacggagagcgcttcatgaaggacatgttcataagcagatgcgacaatctgtctttgctaaagaatgttctcttcagggaaaaaataggttctgtttcaacactccacaagtgataagtgagactttttcaaaaacagaagcttctagatgtgttgatgagacaatatgtcattgctttaaaaaaatagaaaaataaatctgattgaaagggctaaattttatcctccccccactgtctgctattgaacagtttccagctgtttgagttggcattccttatggatcaggaggtgtaagaacagtgagccatattcttacagtatttaagaagtacttgaaggtaatgcctattcttacaaaatatagggttacttttactagttatgcaaaaagcaaacatcttaaagaggggctccgtaccacaactggtgaagaaaagaccctcatattgtaatgtagggatatgaatatagcttggtacttcactttacttaggagcagggaacctagggtctcattcctcagtactttgaaaacaagtatcctctggtgtttgaagaggtaagcagagaccacatgacactcatcgggcttcatcaggcagtggctgcagttgttctgcagttgttcttgcctgtctgcacaccatttttttcccacctcagaaatttcaaa

SEQ ID NO: 335 - DNA, 3025 bp, Mus musculus
tacatactgataacatgagacagaacattaagtagtggtaaataagccgggcgtggtgtcgaacgcctttaatcccagcacttgggaggcagaggcaggtggatttctaaattcaaggccagcctggtctacagagtgagttccaggacagccaagactacagagaaaccctgtctccaaaaacaaaaacaaaaaacaaacaaacaaagtagtggtaaataaggcaacttaagggaaaccagaattgctctttttccaaaaggaaatctttgagatgaagtaacgtgaaggaattggttctcggttccaggaacagtgggaaaatcttagaattgtatcctttgtttctattaaaattaccagcttgacagtttgcagtgctgaaacacagcactcaatctactcagagcatctcaaactattttctatctcagctaaataaacttggtcacgctgtgttcccatgaagaggaatgcagtgtctttaaaatttgaaagacctgttatttgatctatctcttgttattttcatgactagaagggttactggcaagccttaaagagcagtgctagctcaagcatgcttggcatgaaaacttatcactcaacatggcgagagcactgcctaaaggtgtgaagatctgagttcccttcagccctggaacacccaggccaaaggtacctacagggggcgtgctttgaacattgctcctcacaaagtgcatttcagaccagtgctcttcactgcatttgtctatggttcagttgctcatttgtgctgagcaggagtccataaccattaagatccccgtgtatttaagaaaggtgggcgtcagggagatgatatgactctgtggctttagtctccccaaacctcaaagctcagcacgtggggaggggatagttttgatacaacacgggtgtttccttaggtcttcacagaaaacctcagcattcactaatatcagtgactctcaagtactatctccaggaactgttgggaaatagctccttatgatagaagagactgtatattaatgtttcctgaaaaatacattaaaatctgaaccatgataggaccgtccttcagtgtagactggctagacatttttgaagaatcagcatattatatgggaaaaaatagcagatgtagaatccaaaaaaaaaaatctcatttggagttgacaggtgtgctttaaagttgtttttttataagatctatctaggccactaaatctttgtactattttaagactaggttactttagctataaatggggattgtagtagttatagaagacatgcaaagcaacagaagacttgaaacacaacaggtcagtcatcataatttgcatggtgtttatgaagctctacccatgggagcagggagcttcttttacaagaagagcaacaacctagctcttgcaggtcaactgggcttccagtgtttccattgttttttcccagccctttttcttatttaattacatggtcactgagataatcacgaagctcaaagctcgctaagaccgtataggcgttgatgtattgtgttaagtgaatatctccataacaaccaggctccttgctgattttgaccgattttacatacaattggtggcgggatggcaagtgaagtgtatctccttgcactgctaaaggccagcctcatcctgggtttatacagtgcctctcgtctagtggaaccctgagtggcttcagaatactcctgaccggtgtctacttttccagccccacccttctctcgtcccctgcctgtgtaaaaagatccttgattttatttttcctcagattttcccaataatgaattgtatccatctggcatgggctcacaaacagatgcttgcacatgctaaagaaaacagtcaagaaattgagacaggaaagaaaagagcagggctccatttataggaaggaagaggagatgaaaataacacgagacaaataagtacacagagaacagcaaaaggcagaaggttgtctcactagaacaagccccagatggtttctagaaggctccacggctcctagaacataggtgtgggttgtctgtggacattttagaagcagcccactttaggaagttgcacgttgatccattgctgtctgctatgagtcgggaccagctgtcttgttgctgtgagataaatttccacctattgtactggcatgtgaaaacaaaaatatgcccatcagtgctgtgggaatcttcatcctcagaataatgtgtgtagtgaaagataagagagatgatgttgaaagttacatttgatgtttgagcttcaaatgacataaaggggaaaaatccttttgacagcttgaagccaactttgaaataaggcatattgtttagtttagtttcttagtatttatgatgaattttaaataaaattttatgcaattgaaaatataaacaagtaatgcgattgtgggcctgtccacaagtccataagtccgaagcattttccagttcatacttcttgaaaatgaagtttgtttgtgcgttaatgagagaatgctattaggggagcttaataagttcagcaaattaagtgttaatttcaggggaaaactgaatcagttgaaaggaatattgctttttttttgtgactgaaaaggggtagagccgtgggaagtcattgttaatagcttttatctatctagatatataacaaattcactcagattttttaaatgttagccccttttggaaaccagaagtccctgtagaaaattccaaacagttacatcctcctgtgctcaggaagatcctagaggcgcagaacagttaaactctagaaaactggactttataaaaagaatggtgcttactacagttacgtatagctcattctagagtgttctagaaatacatagaatactaggaatactttcttttgagttgtaggccttctcaaacagtttcattcaatctcatgccatgcgtctacaacaccagggaccttatcatttcatgagttaacctttggagtcacctttattt

SEQ ID NO: 336 - DNA, 2325 bp, Mus musculus
gatagagggactaggatgcaatgtgcttctgacagtatttgtaacgtagttacgcacttggtttcttgctgagaccaagcacattctgaaatgtatgaagtctatttagagactgtattttaaaatacaaagtttgggagctggaaagatggtgctgtgaagagcactttctgctcttgtagagggcccagagtgtggttcacagcacccacatggctaagacctgtttataactcccgttccagaagccctgaggccctcttctgaccttgatgagtaccgcatgcatgcagtaaaacttgcaggcagaaaaatcatattcacacatgaaatgaaaatgaataaatactaaaaatatataatctaaattttcttttaataacacttcttttacagtaatctagtttaaaggtttttgcaggaacattttattttttgtatttttaaaaatttaatttaattttttaattatttactttacatcccagctcactggcctcctccaggtcacctgtcaccccttccaccaccctttccccttccctcttctccctccccttctcctctaagcagatgggcgcctccctaggtatcccccctcccagcacttcaagtgggagggggggtgcagacggtggactaggcgcttcctctcccactgaggccaaacaaggcagcccagctagaagaacatatcccatgtccaggcaacagcttttgagattgccctcatgtaggaacatttttgtagtgagaaacattcaaagacaaagatagagttcactgcaatatagtattaataacccccctcctcccaatgatttgtcagagctccaacagacactttggtggaatagacaatttttgtgcaatatttttgtttatagtatttgacataacatgccttaataaatctaatccttaaggctgtgcattttaaagacaaggacatttctactactcccctttgtgctgggaatttaacctagggcctcctcacacacgctaggcaaagacactaccatttaactgtgttatctgccctcgactaatgctctttagctgtaacagagaaaaagagaaagtgccatttgtcaatcaatccaaggccacggtgggaactgccaaacatttggcgggattcctgcacacatctgagcatcctctctgctgtcacccagactgtttactgtgcctcgactgtaacgggctctcagcagacagcgttggctgcattcgctgtcactgttaggcacacacaccatatttgggagactcggagtctgttgaagaattccgctgtgtcttcatctgcatctgcccacagatcattctgtattagtgtaagcctgtacgtcagtaggctcaggatatcttatttggcctcttgttattttttttttaaatatcctaagggtggccgacatttgatattgtgtatgtaattacgagttctgaaaagctgttttaattaggcatgcttagtgaggagagaggaggacggtgggacatgtctcatatgctcatctttggtcttagatattctgttgttttgatccaaactgttaggttagttagtatccgtcaaatgcttacttgttctaacctcagtctatattttgtctatcctctgggcgtggttagagccgttagctgttactaggtgatgtgaagacaacagtaagctgacggccttcagaaacagttcatgtggtagatggtgcattttaaaacttctcggtaggagtgatgacttcttgatattcattttacatttgcgcgttctcatccttagaaagcctttactgctacactgccaagcatgccgtagttactgttttcacaaaagaaaacttcattataagcttgacataaacgtgcgacatgagtctctgtttacattgatttcattgctaaatttagcaagctatatttctgtaatgtagtaaatcattttaattttattatgctaattctattaattcctaatttcataatgttagtagaacacgaaggaggaccttaggagactacttgtccatgcatataaattcaatgttgtacgtatactccaagtaatattttttttttgtttaagaaagatgtcaaaactgaggcttgctaattttgtttttgacatcaagcagttaagaaattatctgagcctctcaactttatgcctactttcttgacttggaattaaaattgagattagatggagggaatgaagatccaattctactttgctgatttggctgtttgcaaccaattgaacatcagtaacaccaaaatggcaaaaaaaaagaacattttcagaaaaaaaat

SEQ ID NO: 337 - DNA, 2500 bp, Mus musculus
aagaccacattgctgtcaaaagcaaatgcaaagcaaaactcaagccccagtttccctgcctggtgatgcctagttttgctagtgtttttccaatcaattcaatgcagccacatgaattgtcagtagaccaagcatccaaggacttggtgctaggtaagataaatttttaaggcagttcagaggagaaaataagatgacagagaaggctgggaggatccaaagaaaatgaagcattctcattactgaggtaagccaatatgttaacagccagagaacaaaccattcctgttaaacactcttaacagaaggataaaatgggaaaatatcacagctggagctaggacctatagatcttagattaaaactattattaataataacttagactgatataacaagttcagtttgtgcatcactgagagataaccactggtgcccaagatgtttaagaaaataaatgacctggtcagagggcactttgaggagattcatttcatgagtgaacagactcacaaggagagaaagagatgatgatgtggaaggagaaagctagtgctatcctaacaagctgtgttagtttgtgtgtctgtcgatggaaaactatgaaaaaaaaaaaaaaaaaaaaaaacttggtttggagaaaaggtttatttcatcttacagcttttagcccatcatcaaggggtgctaaggcaggaatgctccttcctgccctgctgtccatagctttctcagtctcaatcatcatcgctttcttatatcatccaggaccaactgcccaggggtagcactgtagtcaggccctcccatatcaacctttaatcaagaaaatgccccctcagacctgtagaggccaatgaatggagatattttctcaaatgaggttctctcttcccaggtgacccatttgttgtcacgttgacagaaaaactaaccagcacacaagccaaacaccaagatgagaaacacagcccctggctcctacagatcaaacgtggtcagttaagcctgagcttagagttgacttccttttcccaggtcagggtcaatgctggtgtcagctgtgagctccacaaagcagggaatgctggcttaacttggatccctgtgtctagcagagcggctgccatgaccttggcacttgaacatatttactgaataaaagaatgaaggactgagtcaaagtgaccgaggaaaaaaaaacacattccagacttcacgtgatggaggtagaatgaaaccacagagaaacaaaagcggaagggcatacgttacacagaccatcgaagtattttgacacaaagcacactctcctgataggaagatgaagcaatgcctcatcataacaaaggcaatgaaggggctgaatccgcaccaattgaacaaaccccattcaaaggagaggcagctttgaaaccatcagggagatctggatctatttagtgataataatattaaagattagaaaactgggggaatggctcaggggttaaagcacctgccatggaaacacaaagctggattttggatccacagaactcataaatgctcagtgagtctcgggacccatttgtactttcaatgctcatatgatggagaagagggggagaccctggagtaagctggctaacgagacctgtcaagcgaaagatgttgcctccctgaataaggtggacagcaataaagactcctgccaccagcttcagggaggcttctgcacacacatgcacacatgcgcatgcaccaccatatactcatgtactctcacacaggcaaacacatacatggggcattgtgacatacatctgggccctcagtgatgggagagtcagagacaggaggttgttgagggatcacaagaacaccagtctagtcaatcaatgaactccaggatcaatggcaccctgtctctataacaaggtagagcctaggcacgtaggcatagtagcagcagcatttaaaatatgatgcatgcaggaatgtttaaaatgcaatctcatttacataggtcttatgatttacttccaataaaataactcaagagggtacaatctgtcctcaagttctagaaagaaaattgtgtagtttttaccctactatctatgttaatggcaaaaaaaaagtctttatagtggcatgtgtgaaaaaagaggtaattgcatatgtgtgttcatgtaagcaaaagcattaatttttaaattactttggatgtcactactgaaatatgtaaacacgcacattgatttatgtaaagggtttgttttaaagggaactctttggactcaagtgtagagaatcaatctaatcacagagggcacatctacagtccattaaggaagtgacttcactagctccactagcatgaaaataagacaaatatccaaataaatgctatctaaaaatgtacttttcaacattcctttcactcattttgattgatttggtttggatttgtgttgctggagaagtagcccatgcccttgcgtgttccatgccggca

SEQ ID NO: 338 - DNA, 2125 bp, Mus musculus
tggggggaaataggggctcacttattcatttgttgactttctatcactagtttgagaaacacaccttctttttgagtagcagagaagccctgggaaaacaatggctgagccatctgtgggtttgtctccttttgctcacctcatcaagatctcaggaggggtggagacgcattcatcagagacatttataagaaagtaatcctaccctaatcatctcaatcccagaatggaggcatcattagttaatgatgctggccaagtcctttgaagttcaaaagtacaataaacacactacaaattattagtagtcaatgagggagaaacagttttccagcacccaacacaaaaggtccagggactccttagtggctctcccacaccttgtcatttactgaatcttcaggacatgccagctggtgctgcaaacagctcagctctcttgagtcttggaagaactgggaagagaccaagtcaggcagatctacaaaatgctggtgttatttggcaagagaaagcaactgcattggccagcagacagcagagtctgagctggaagaattggactggttatatgctgaggttgaggcaaggcgttcttaatcaagggatcacagcatccttaatgagggtcctatcgcatggccttctccaaagggatacctcagaaaaaaacacaaggagatgctttagctcaggtgaaaagtagtttgtctttatttaaatattgctatttcccctttctagtgaattaaatcagcaagccacagtaaagcactggtgagagtttttgtttctaaatgaaccaaaatcagtaatcctcaagtcacatgacaggaatttcagccttcttgaaaggtcattgatgatcgtcagcatcagaatgatggcagcttggggtcgaccagatgttgtgtatcaataaagacaggtacctagtgccataccacaaatgtagggaagctttaataggcttttctagagctgttttggattcttagcagtgttgagtagaaatcagagactctgagcacactcaggccaagggtttgagccatgctgggccagatgtgtacagctgttccactcagtgaaccaacactgacagccaccatcatcctcagcccatagcctgtactttggtcccctcttgatgctgtgtcttatcggcttccggactgtatgatgtcatctatcagctgtcattgtctgttattaattttactgcctgctcttcccaaataaaagcagtttctaaaaattataagtactttcctattactgtataatcttctatattttatatctttaaaagaaatgaggaaggtcccattgcctttttgagactccagaaagaacagagagaaaagtaggaagccctgctcctcactgccctgtgttctctgtggtctccacccttcctctccgcacagtttgcttattccagcttctctgtagtagaccctacccacctcttcctgtgaactggcccagtctctccccaggcactccttagagagtgaatataaaatactttacacagaagagccaagtggtgattctaaacaaagaatcctttagttaccaagaactacccctcttaagggtcgcagaaattatatctcacatttttttccatattcacattaagagctagaggtatgttgtagtctcagaacaggagccagagcgtcttatgtctcaccagatgcaaaaggaataaggtggcctcgtatttcgaatttaccagagggattgccctgcatgccctttccggaaaggtactgtgagcccaggtggttgaccaccttaattcagcttagcctccattgctgggtcttccccatccaactggccctgcacctcttctgctaggtaaaatctcatctaggagatattatgccctgaccccagacactctcccctctctgtgcatctagctcctctgctaacatccattaggttatttactaattgattgtgtttttttttttttactagcccattcttcatggtatttccacagaagagtatagattacagccagatataatccaaactgcatgataacttggatataaccacaaaaaaatcatttcctatcaagttcttcctttatttgcagccg

SEQ ID NO: 339 - DNA, 4500 bp, Mus musculus
aataaatatgttgctaactctcacatgataaaataaaagctcatgaaaaaaatttcacacagtataattgtattctaggaatatggacgctgaattcagttgtagtcacaacatacacaagtgaaaattgtatatgtgaattcatgtaatttcttgaatgatttcaaattcataagctattaaacctgcttcattaatcaatcactcagatcagtaggtataaagggagagtcagaatcttttaatggtgtgactccattgatgatacatggactaatctctaagacagataccaccccaaagactgtgtgtgcagcacaaactggagatggtgggttttaaaagaggaaagagaatgcaccattgggtgggtaggaaaggtgcagatcttgaaagtggagtagatgaatgagtgttatcaaaacacatggacaaagtaaattctcaaaaaaatattattttaaaaatattacatattgaaatatataatttatatatttttatatattttataaaagtttaatatatttttaaagttttctatatttaataaaaaatcattttgtttgaaaatagccaatatctattatattttaaggcagggtctctcactgagtagccctgggtgaccttaaacttgcatagatgaacctggcattataaactgatagaaatctgctggttctgactcatgagtgctggaagcaaaagcatgtgctaccacatacaacagcccccaaaaatggttttaatctttcataaaatattaagacttagtggatctcagaggtaggataggttagttatagagactcagccatgatgtgacaagaagtctagtcttggttctgtgtgtgacaagcttggccaccacagtgaacgtatgttagcattggtttctccatcagacaatagagaaaggtatattctccactcatgctacaaggcaagagaaatctactttttaaatgccatataaactataaattcccattggactatttatgcttatggtgactaatattgaaatcacagagtcaatgaacagaaggatttagagacttcaggattctttcttaataattggaactctgccatcccagcccttctcctatagccacacgccttatgctgttgtgtgtgtgtgtgtgtgtgtgtgtgtgttcacatcccaatggtcatgttttaaaataatgcttgagttataaaaatcacacacaaaacacagaaaaccatttgtgtcacacattggctttatttttaactgaagtgggaaaagaaatttgtttttgtggcaagaagtgtgaaattgcactcctagagtgtcgagcaagtgtgagggcacagactgtagctcctggattctctccccagggtagagaggccaccagcttcactccagggctcccactcctctctccagctctggcacatggctcctggttttgtttctctgcaaataaattttaaaagataagattaactttcttaaacacacagaattacctaattaggatttattaatagcaatcacactatggagatcgggctatttaatgactaaattgtgtgactcaatgagctttttgtaattcttttgtttttttcagctttgtttacttgatctaattttatgtcagattctaaaacttgtaaaggttgcaaaataaaataacgataataaaagacaatgatgccaatcacctaccctgcccctatcaggaggatcaatccaccacttaactgtatatgaattttctgacatgaagaacaacgtttcatgatcccttttcctttcccaggctcgcagtgtgaacatagtagacagttagtaactggccttgctttaatgtggaaaactgtatttcactgcacgtcatcaaagttaccaagacacagggcatcccagatgtgttctcatatttgggagcgtgtttatttttatcctgatgccttaatttgtttctctgctgctgcaataacacatggtgactgatgcaactcaggagagtatgtacttggcatataagttaaattccatcattgggagaaaccaaggcagcaacttagaggcaggaactgagacagaaaccatgaaggggcattgtttactgcattgaccccattctcaagttcagctacttgcccagggatggcactgcccatggtaggcaatgcacttgcccagggacggcactgcccatggtaggcaatgcacttgtcaagggatggcactgcccatggtaggcaatgcacttgtacatcaattggcaattaagaaaactggaattcccttttctaaggtttgtctggatattgagttaacaagaaacaactgtgacagtaggctaacagaatctgtaaggtctttctttttgaggtgtgctcttggttggttccatttacttggcaggctccgtagagctggcccgccaccttagtttgcctgatgtacattgtgctggccattcaatcgatgcatctccccaaatcacatcagagtagcctgcaactgtggattcagaccttcttacaaagaaaaacaagagatcttgtaattctctgcaccagctgtcaggtcattctgatctagtacagatcaaataaaagcgcattcattaagttcttcacatccagcacttctgtagctaacctcagtctaatcctgcaaaagttgagacattggatcctttagtcattctgaagttttacatttccataggaccaaaagccatttgtgtggttgatatgggtgctgagtcttctttgcagtaaaagaaagacccagtccttcacctcaaattcatctaagtattgttttaataagaaattgcctaaagtacctttaaaagtttgaacatactgggtaacataacagaatcctttttttttcctagttgagccctggttggtgtcacaaccaggactaagcagtgtggagaaggcactgtcctctgagccaggaagtccttagtctcagctgccagtggcttcagtttatcttgtgtctgaggcaagcagagatttcatgttctccaggctgaatcttccatgtctagagagcaaatgaattaaggctaaatgaaggtattgctccttccagatctacagttttatgttcttactgtaaccaacaacgtctgtgcatcttgctcctggttaccttgcctctccttcaccctgacactgctgggaatcgctgttctggagcagagctcagctccagagagtcttatctggctgcctggtggaggtggcttggcatgtgaaaggcctcttctgtgctgccagggatgacataaacagaacacccttctgttttaatgacaccgttcttacacattggcatctgggaagagtagtgacaccattcttacacattagcatttgggaagagttcctgagagagaaaaggagactaaaaaaaaattatctgaaaaactgactcagacagcgagagggcctgtgtgagagacctgggatgggacagatgcggccaatggaaggagtccccaaaagttctgctgattgggaggagagtgcccaggcctgaagccactggccaggcatcactcagttcactatcccacatctcagcacacactggagagtttgtttttcgagcaaagtgtcatattctccagctttcagggaaagatttggtatgaattcattatttatttgcttgtactagtttaagataataggaaagtaggcaaggccaaaaaaaatattatttgaactaccgaaattccccctaggcagcacggcttaaacccctgttttctggccctctcctttcaaaagattcccttcagcactgactcatgagaggttgctgttcactccccatccttgtccttcttcccaccatgtaggctactcaagaaaattttccacttttaataataacttacttacggaaaacaacgccacattctcttcggagttgagtgggcagtgggaatgtgtctgataagtcaaacacaaactggcttccacattacgttaaaatacaaaacgttaaggtacaaaatgttcgaggacaattcagaggcagaaatggcattaacagagagactgtggctgcagagagaaatggaggaactatgttattacaaacctgagttacatgtgcacaaaaatgtctactactggaagatgacacctgatttggggcagttggttcactaccctgataacactcagtaaattaggatcaggtatatggagggcttaggaatatccccccagaaatcagaaactagacatccttgacatgaaatgagaagctgtgtcatttgtccacaaagtatttaataatttcagggcatatttttttaaaaaaataaaatataataaaacagaatagccttaaagaataaaggaaaagaataataggaaagagaagaggtttttcctgcgtgtccttagtaaccccagcactcatacttactcatgcattattcttgaattgcatgtaccctggggaaacatggt

SEQ ID NO: 340 - DNA, 2925 bp, Mus musculus
ggtgcagtttgctgcttttgctgttgctaaagaatgaaaggcacaaatcaagctgccaaccataagtgagcaaaagaaggttaacagagcaaaacagcaattagcagaaaatgaacacaaataagccttccttcatcacagaggccctggggcgcaccctcactctctgcctgcaatagccagcaacaggaaaccaggccagaagtccctactgtggccaagacttctcttatagttcattagtgaaaaagagttctatacgtgagtagtagggtacatacattcaggcaatatacccccctcctcccacaatatcacctctgtgatcgaatctcttcatagaaagtgctaatattcctctgtgacagatagtctcttcacacagtgctaataaagataatataagaccatggataaaggcttagacttttttatacacacattaaaaacaaaggattaaagttaggaatgcaataatataaaccaatatgtataaacaatattgtgagtttttgttttgtttgtttgcttgcttagttggttggttggtttggtttttcaagacatggtttctctgtgtagccctagctgtcctggaactcattctgtaggccaagctggcctcaaactcagagatctgcctgcctctgcctcccaagagctgggattaaaggtgtgccccactactgactgcctatggtgtagttttaatatgcatttaatattgaaatatgttctaagtctttggaacatgagtgtcttttaactcttttcaatttagactttcttccttgccagtgctcagcagcaaagtgtggccagtggctagttatctgcacttatctcctccactctcttctcttttcttttccttttagacacaggatcatgtggaggagaggctagccttaaatttgctatttagatgaaaatgatgttaaacccttactcctcttgcctccatctctggagttttagctgtatagacatgacccaccaagtccagtttatgtgctgttggtgttgaatctagggtttcatgcatgctaggcaagagctgagtcacatccatagctggcactgtgaagttcttctgccgcccgccccctctccccccgccccgcacctttctatctagagtttggtgtgttttttaaaacacttattagattttaaattaattcataattcttattaatatcacaatggagactgaaatgtctctggtttgtaagctgttttttaaattaatgggtttttaaatgtcactaaaaaatatctgtcattttactcagattctaggaccacggggaaagaagacagtttttagcttattaaatttgcttctaaatacctcagtgttcaactgaagtgctcatttagggtatattataatttcatacataagataactacattgactgttattttagacacccaaatgtttttaaatcatgaaaggggtattcatgctgatgttagcaggctgtcagcaaaccgaaggctcattcagaaaatgtctaggttcctttcacagcctgcagtgcttctgtgaaagaatctattcactctacatgtttgcctgtcatcagtggaattttttagccattcctagggaagataatactcaattattttccagaggtacaatctatattccatttctaatctgtaagctttttcttaggaaaaaaaaaaaacaacaacaacaaccaaacttctaggtgcttactatagctgaagaatataggcgtttttccctctgcttaattatttttaccataatgatctaaattaatctatgtgaaaagtataaatatcaaaacaggaaagacaagaggatgctaatctttgtgcaagtaataatattcaagggtctgagcagcatcagggacacactcttaattatgtatttctgcttcttgagaattagcattaatgtttaaatgaagaaataattatactttatagaataaatatataggacatttgatgtgtcaaatatccacatgtaaccccataggaagaacagcaatatcaaccaaccagaacccaagagctctcagggactaaaccaccaaccaaagagtacataaggagtgacccatggctccagtcacatatgtagcagaggatggccttttgtggcaccaatgagaggggaggcccttggtcttgtgaaggccaggacagagaggtgggagtgggtgggtgagtaggagaacaccctcatagaagcaggggataggggatttctagaggtggggaccaggaaaggggataacatttgaaatgtaaataaataaaatatcaaaaaaaaaaaaaaagactggagatgaagtattaacatgcggttacctaatctgacctctttcaacagtgtgtaactctgggatgtgacattcttttcagagccttggtaaccttacatgaaaactggcggttaaagccttgcttgatctagcctactaataaagatgcaatgatgtaggttagggaagagattacctaaaatgtcaaatgatgagttgaatgcatagccttgtgataaatctagctttctcaacagggacataacttagcttaattaaacaaggataaaatacaaagtttgattggacttactcttatgccttcttatgcaatcatgaaccacaccatactttgaatgcttttgaatgggagtttgcaatttttttttaacattaggaaaggccttccagtatccctgtggatcactgagcccacacaactttgcccactactaagctgccagacactgaagcagtgagtattgtaaaagagagttgagtcattttgtgagctgatgaagagaagaggagagagtccagtctcaaatccatctttcttggaccaggatttgggacaggtagggaagtcaggtgatttaagatagacaaaggt

SEQ ID NO: 341 - DNA, 3125 bp, Mus musculus
agccttgagcccaaattgattgctctggctgctgacatctgcttcccatctcactttggagtctgcagtgagatcccagtggaatgatccagcttggaggctttgctgcattctagccactgtacaaatatagctgtaaatgcaagttggaaaaaaaagtaaatgcggggaatatgatacttttaattgtactgtactgtactgtcttcattgcacatacagctttttgtgatctctgaacagttttgttgtgagaaggatcctaggaattaaagcagaaagcatggggctcagttttgaagttagttcaagttggttattaacagagacttttgaccagtgtgaaaagttagcctttccatgcatggctacattcctcaaagtcttatacatgaaggtataaggaacgtataagttgaggaacttatacttgaaggccttggctcccatcagtaggtgagttcctgctttcagaaagcagagcaaagacaaaggctatcagcacactggtgggtgggagcggctctgaaaggtgggggattttggcaatccgcctattacatcaattatataacctccccttccctacctcctaccttctctactccccacggggtgcctaagaaaacaatcacgttatattaacttcgctttatggaaaaactcagctaccatatttaacacactggttatgggttcattaaaaactgccttaaaaagttggccctgatgctaagcaataagaggaggaagaagcaaattgtattgaaaactcaggaatttccagctgttagaatgaaacaccccaagggctgcggagatggaatgtctgaagaatagaaagaaagtgctgacagcgaccatttctgactgcacccacagttagtagacatgcaggtgatgctggtgagctaaagcttccttctcagtcgggggacagacactgcaactgtaggaataatgggtgcataaagagaccccagcaagagtgtaagtgaaagggatggagcgttcctaaagacatgaatatcaaaggcggatgcagggataggacacagtcaatcagcttagctggtgatggcaagatcccgctgagataaaaaatatgaggcaaaataggagacaaatctgataaaacgtttatttttaaactgctgtgcttgggacggcatggtttagtgtttgggctctctccacagctcagcttcaaacagctgtggctctcggtgcctctccctgctctggaaggctgctcctcaaagacagggcggacatttttggcatggtacgggtgcagaagtttgccttggcacctctgcgttgaaacgggactctggataaacaaagttcagcccttcccagtcccgccagaccttcaagctccacaaatacgagtattcaaccccctgccctccccactgaaaaggaaaatgtaactgcctaagattgtttcccttaaataaacaccaaacatgttcaaaaaaagctgctcaccattctgatattaaacccagtaattactctgggaacctacgcctataaattctcttatttgggaaggtaaaaaatgtggagagggagaatctcagttcaaaacagaagaaaatgtaaaaatgtgtcctctctgcccatgggtagagtactctgctttgaatgctcttcagcacaatacaaagctcactctactgcagggaaaatcattacaccccactgtttttacaaggtacctacctttcatattcaggaagcctggctgagggcagacgcattggaggtagaaggaaatcgatgccctccaatgtgttagagtttattgtctgtgtctgggaatgcatgtttcccccagatttctgaggagatggaatctttgaaagtagaagccagggctgtggcatcctgttggaagagaagtcccttcacgagtctaagcagaatgttctgccttcagagtagactcagtgtctgcttgtctcttcgggtggcctctgtcccactaattgaaataatataactcagttctccacccctctctgtctacagtaactctcctcctgtggtcactcagggcagaaccaggataatagtaacttacagtgtgtgtgcaaacagtgatgtgtgtgtgtgtgtgtgtgtgtgtgtgtgtttatgcatttgtgagtgtccatgatcacacaagggtgtgagcatgcacgtgcccatggaggtagaccgtcaattctagatgtcatcccacagcacacagttccctggggtctctcactggcctggacctctgattcagctaagctggtggtcccgtgaccttcgcctgtttccatcctctcagatctgaggttacaagagcatgccatcacacccaactgaacttccagtaagttctagatctcaacctcaggttctcgggcttacccagcaacaaagtaagcagcttaccttctgggtcatttcctcagccctgccttccccccaaaataatcttttttgttgttcttttgtatccacctctccatcttaactttgcctcttgctacaagcagcattgattcattagtaaccaaaaaatactgtgggtttgcatgtacagttaaaaacagcttagtataaaaaatagtttagaatagcataggttgctaaagaattatgctctttctaaactaaaaatcttctcacactttcaataaaagcagatctcattctatttaatagatcgacctttataccaaaaaggaaaaagacaatataacaacaaaataaatgaacttgtcaccacattggccaatttattttcctggggcactggctttcctcagctttgtatttaacgggaacttgtctactcttccatgtgcttctctgtacttttgccctttcgcccaatccattctattaacaatatctttcttcctctctttccagaaagatgcgattaggttcttatctcgcttttttaatgtctttctgctttcttaatttaggtcaaaactacagctttgcagacctgggctttgtcctggaccatcttgccacatctgtgggtggagccacttgctagaccacaaggtcaatgcctcctagctgtatgtggggcatcccctttgactgacccaaattggaaacaatttaga

SEQ ID NO: 342 - DNA, 2250 bp, Mus musculus
agtcattgcaatggatacactgtgggcaaagcggtacactgtgggacacacagtgacacactacagcttcttccacaaggaggttttttttttttcctctgctggagcggaggtagcaagggtggagggtaggtatgaggggatgggtagatgagtgggattgggctgcatgatgtgaaactcacaaggaacctgtcaaaagctgaagaaggaagaggaggaggaggaggaggaaatgtgcgatgggtaataacactcaaacaacatacagagtctgtggggagatgctaaatgccacccaacagcctaacctgctagaacagaagtggaaatgctaattcggtgccaaatagccagatagcctggaaaacaaaaaggatgtgagccactgagagtagcaatctcggtttgcctgactcaaaccctgcagatttaacccctaactgcaactggggaagaggtctgtcttcaggcaagagcagcaggagactttcagacttagtgagacctatcacccaacatatctcaggatcagatatctcagagtctggcttggcaatgccagcaccctcacctaggtagagtgttcaaattcctctggaaccctgtccatcttaggaggaatttatatctctactgctaacttttctgcctcctaattataaaggatccaacttgctttatatttaatcagtcaggccttaaggttttcatactaattgctaaattaattgcctccttttccaaagcacttatgcccctacctcctagtaataggcactcagtactatcgttctgactgtttctcagcacaccattccagctccattgttgatccgcttcggtttcgagagcctccagaggtggggcccgcattactcatggccagcacgaaccctggctccagaatctgactgcacatcaccttgctcggactactcctgtaccagctccttatggtggcttccctgagaagcagcagagtgtgaatcagatatttgtgtacaagagcgttattagtgtgttctctcagggaccgctatttgtagaaaggaaaacaagaaggaaaccgggcgggaggggctgccatagaggttgagctctagtggaatcagagtaaacaccccagcgaacctcaccaagacctctggagctggtttgaatttagaagttgccccagactggggtcagggaaccaatatttgtatcccagcaacaccagtgtgtgagacagacttttccagcaatggaggtgtggtactgagcaaagaggcctccttcagcagaggacagcagtgacgacagatgatgctgcccgtcagcagcaccgacaacggctggaggaacaagcccttcagtcccaaagtgggattagaaaggtacaaagcaggatactgccgaagccagcactggcttttggttgcttgctgaacaaccttgggtgaatcagacatgttctcagggcctgagcttccttatctgtaaaatggaaatggagaggaaaaaaaaaaaaaaaaggcctacctcatagggttgtcatggagattaaatggaataataatgcaatgcaccttaatacagagcattgtacataataagcactgtagcctcttttagctataagaagcttagggcttatatgggaagctaagactaaattatagagtacaatgaaagagttgctaaattgtgggcattaggagcttagatgcagtgaaaaccaaggaagcaaagaacggtttcaatgaggaagtgatcaatcacacggggagttgggaaaggtgtagtccaagaggggatgatcaatatcacgaggagtttggaaaggtggagcagcaataacagtcttcaacgtgagagataagtcagagcaaaggccccaggagcaaacacggcgtttcaggaccgcgagccgtcagcctgatgcgcacagggcttctgattccgaaccggaagcttggagatcggtccagaagccgctcactgccgacttcagctgagttaagccctgaggaagtttgaggggcttccagagaaatggaagactgatggaaaagggggaagaggaggatggtgaggggtgagagaagaaggagaaggaaaggacagagtggagggaggtgagctaggggaggtgagcgagcagagggagaaggctgagaaccaaccggagaataaacgcagatccgaaaggcaggcattgagtgcggtttgcgcctataatcccaacaccaggcaggcaggagcaaa

SEQ ID NO: 343 - DNA, 2875 bp, Mus musculus
aagtggaagctctggcatgtcctccaggttgaaaattctccaagtgggtggggggtctagtgaaggacgtttccgaattacactgaatgctcttgtctgttcttgatgcattcataaaacataccctgtgagctcattgtgaaaaaaaaggtttgcacatagtttttgtcaagtctcaggtttcatactgttatacgttaatatatccctagctatcttcatttgaaaaacaaaaataccagttcactagaacctggggatcttataattggactaatgatttttttcaataaggaggaagctaattaagcaataatcagttttaggagcctccattgcatgacagatttttttttctccctgacagctagaagcctgcaagttctgaattaatttgtatgactatgagaatggcaaacttattagcgtaactcactctagctcctaaattgtctcccagttctgaagcaacagtaatgattaaaaagttctattttcaaatgttcatcagctctgaggttggcacagagcatagtttaaaggcaatgattcttgctcttggaggttctgaaacattaaaaatttaaaaaaaaaatgaactttcttaaaatgaagcagaatgcctctatctggagcaactaagcttccccaggaactgggtgactcccagttgtgaaatccaaccctgcttacgcagtaagtagttaagggcagcaatctgaggtggctatttgccgtgtaaaagagaaaagcacagagtaaaagaaaatgtcactccggttgctgtgagaggcacaggaaggggcaggtttccgatcatgccatttgaagccactccctcagaggcacattgcaaacctcatacctgtgatgcagggggagctggccttgtcccaatggactggctgttggctcagcaaaacttagcctgacctctgcctcacagaagcttttccgctgtcagcaatttcttggacaccatgttctctgatctgatttgacttttaaggaatggtaatattaaatcagacaaataaaaagatgagcacatcacacagttcttgacatagggaaatcatattttcctagaaagacttagctataaaaagattctaaatacatctaagaggaatcctacgtgtgagatgctgagcaccttattaatttatttctgagtgttaatggaagcaactgaagcatgggcagaaaatagcggtggctcttgctctaagatgcaactaaatcaaaatacctgggagacggaagactgagaagacagccacgaagatcatgtgaccagatagctttgttgcttaactcagcaacaacaataaaacaattatctgagcggatgtcatgactgttgcttaagaaacaaaggaacactgtcatctagacacctctatttaaagaaaatctcttaactctacaactgtgtgtaggtgtatgctcagctaaaatattgaactcatgttcaggttctccatttttaatctttcttttcaaatactcaaaggagtctcacttataaccctggagaaggagctctgtgtttgaaggagttattcctcactctgctgggaggactactgctgagaggacttctgagcagcaccaggcagtaaagtcctaccttcatctgctttctctgcactgggcctgtttgaaggtagctgcctggtcaagtcccgtgacctctttagagcacagccaacatctgctgggcagtaaagtcccgtgtataaaatctcggctgcttcattgcatgttggaagtcccttgggagtcactccaaattcagaacttgcaaagactggctgggacaagccactttcatccatgctttgttcccttcatacttgttcatcctcaaaccttgattcagtgaacactgactcctaggaacctgtgcttgattgcttccagtctggagtacttttatcctgactcagtctctgacagtgcctctttgagcttccctaagaatcattgttgaagctgaccatcagacagctagaccactcagaggctattctccatcttctttccattgttctgttcccatgatgcacctttctctaccttttcttaccacagacatgggaatgggtgtcaaatttcctacctgagcttctgatgtatttccttacacacacacacacacacacacacacacacacacacacagagagagagagagagagagagagagagagagagagagagagagagagaatttctgaaggtatgtattctgaagctatgtggattgatatctctcatggctctgggccctttagttatatgcagtacttagaacaacagagtcaaagacaaagatatttacatttgatgagaaagcaatggacttgtcatcctgccagggtgtcacaataacaacacgcagaatttgggtttagatctgaattaatttgcctcaataaaaagttgacacttgtagctagtttttctacattatatgggtatctatgaaacaaacacaaagtcaaggaagagctagaaccaggctgggagcttgagaatcacactatggcacaccagggcaagagcagtgtttattaagattggggctggacagggccaaaaagggggagtgggtgggtaggggggtgggggtgggtggctatgggggacttttggtatagcattggaaatgtaaatgagctaattacctaataaaaatggaaaagaaaaaaaaaagattggggctggagaatttgaaaacgaaaggagatcaaggggatacaaattggaaaggaagaagtcaaaatatcactatttgcagatgatatgacagtatatataagtgaccccaaaaattccaccagagaactcctaaacctgaaaaaacagc

SEQ ID NO: 344 - DNA, 1800 bp, Mus musculus
gaggatgaggactgaaggagacttaagtctatatacttgggacaaggttattgaaaggtcttgggttgagattcaagggaacattgaggcagaatgtcctttaaagtaaaaggttttgagatgttattggttgttgttaacgctgtgttaacagagcatcctggaggctcagaagagaggtcagtgttatgagatgaagtagggggtcccttcttataggccccagaaggaggaggttccaccatactgtttgtagtcaacctttctctcattcctgggtggcaggtgagtctgggagcttccttgccgcaagtgaacattcaggtggtcactgctctcctggactgtgaggcttgtggaagaggctactgaagaggcccatcagcctccagttcaaacctgacaagcatcaccttggtgtgtaaattcttaattgttttgttttgttgtgatttgtttggatttcaaataaagttcacaagatactggaggcatctatggttctactatgttataaattcatcagagaaaagaagagagcatatgagcaagatagagaggcagacacacattgtaatttaagcattctcttgtctgtgcctctggggagaaaactaaagccattacaaaggaaataatgtggagagccttacaagcttttttggtaaacagaactctctattgaaacactgagatgatttagttaagaatagattgaaaaaccatcaactacatttcagtgaaaacagaaataaattccaaaataactggaagcgattctgagccatgcttgggtaagtgtttacaagctgaacggggaatcagcagggcagaatacctccagtgttgcctcacctgcccatactctctcagtatgtgtgcctatcccctctccacattgcataggcatcctggctgctatctgcttttcctttgctactgcaaaggaacctacaaatgctgatggtatactggcagctgcagaatgaactgtggggaaacaggtttggcagtgttccacagatctaagtatttagctacagagcagtctatgtgtttggtgtgtgtctgtgtgtctgtgtatctgtgtgtctgtgtgtcgtatatatgtgtgcatctgcgtgtgttctatgtttttttttgtgtgtctctatgtgtaatcatgtgtgtttttgtgtatgtgagcatgtgccagtatgtgtttgtatctgtatatctgtgggtgtgtgtctgtatgtatgcatgtctctgtgtagctttgagtgtacatttgtatatatgtgtgcatctgtgtgtactatgtttatctgttgtatctttgtgtgtatccatgtgtatttctgtatatgtgtgcatgtgtctgtgtgtctgtgactgtgtctgtgtgtctgtatctgtgtgcatctgtgactaggactgtgtctgtgtgtctgtgtacatctttgtctgtgactctctgtgtgtctgtgtccatatgcatctgtgtctgtgtgtgtctgtgtctgtttctgtgtatattatttctcagtaggccctcaccctcacacagtaaagaccaaggaaagctccctttgagtcagtcaatgatgctttactagttcaggtagtgactcctatactgtatttgtggttgtctgaattgtttgtgtattgtgaagataagccctgctttagtctgagtcattgtgaaataccatgtcattatttatgaaattgtggctttgacgttgggtgatgtgaattaaaatttctgaaagaaaaagctgtgtttgactgtgtccaaaaactcctggaaaaagt

SEQ ID NO: 345 - DNA, 2700 bp, Mus musculus
tgcaatgccttatcaaatccaatatatgaatagtaagtgagttaaatatttatttaatttggtcttttaatggtcatttaaattgtgtcattcctaccagtcacaagaatatccccaaatcctaaggttatttcactgcttcataaggtctgtgatttttcacccaaaatacaacgtatgtcaagcagaatgaatgtattattaacataaggccagccaactttctattctacagtgacccccagcttcaagaagctggttccactttccaggtcctcttttacaaaactgtccactttcatgtaccacatggtgtaagttagtcatatgactgtccacagataacaaagaccctgcaagtgttctaagtaatggatattcttacgagtttcatgcaataaacatgcagtgcagaactccaccgagtgatcaagacagcagggtcaaagcatttacctatactgtgcttataataaaggtggtcaccaacatctactaaatttctaagctctcgggtcatatcctaagccagaaaccagaaaaacacgcacaaaagttcctaaagttcctactaagtctaattcttggaagtacaccatcagcattcttacccatgagggaaactggttttaaaacatgttttagttaacagcttgtgtgttcaagtaagaagtattgtgaagtgagtgatctttgaatgaacccctgagaagtttctatagtaagaaattccttacaagtttatttctgaatatttacaaatcctcaaagatctgcctgtctcccgagcaaggagatgagttcttgtatgagtgttgacgtctcgagtccttttgtgctctgaccatgagatctaccattttccagatttcaggcacaggcaaggtggccagttgtttatagtctgagacgtagctgttgtttgtacctggaaacctgagaaaatgttttgctggttggaaaagtaacaaagtttaagggggtgtgaattcatagtgggagttgttaatttggtctcacagggcagcagggaaggtggttaatttctttcctactgtatacttttgtctttgtctaaatcaagatttttcttaatattgtttaagtaggatctgtctttttcttgctttacttctctggagcctccttattacccaaatcatcagtcttcagatctcttcagaacatccttctcattttgcctttggactcttctgtcttcacactgatttttttaatttgaaaataattttcacttgtgtttcatattttacaaaaccaaatctggacagcatctgttctctttcttcaagttttctattattgtctctggaaaaaaaattacccaacgctaagaagtgcttgcttatattaatagttacagggactgcgtcttcccctctgctgcctcatttcccaaaatccctctcttgctcctctttccttcctcatcttccttctcttctccctcttcctcctctacctctttgtctctgtgtgtgtctctctgtctttctctctgtttctcttttgactttgtctctctgtctctctctctctctctctgtctctcatttttaattgctattctttacatttgtgagcccacttcctctttttatatccaggtttgttactgagaatacattaaaatatgagcaccaaaatttcacatacctattgttttgaagtcagacaaagctgaaggtactggaggtaccatctctgtcccatatttgttttccacttttcagacttcagtagcacagaacacttggtctgtcttttgactctgtgaggccaagggcatgaagagctcatcacaggccaacccaatgctgctacctccaagcagattgtgtttccaaggaaccctactttctggttttctcccaggcttccttgtcaataatggctggtgttctctctagataaggcatggagtgggggtgggggtgggtaacaggaaagtgagtaaaagaaatcaatagaagtgtattttcaagagtcttctagggctgaacaccatcagaagcctgtacctctcttcagtttacatgtctgccgtcttgatggtttacggatcatgaagtcttttagcttggagttaaaatcagagtttgagcatgcactgcctgtccctgcagcactgtccatggtgcttctcttaaggttggtcttgtggttttctgccatctttttgttagacaagttcacaccttagtaatcagctgtgtctttcttgcctttgctttcctctgttttaaaaggacagtatacagttggtacggactggagcttgttctgattttagatacctcttcttgttctctgtggctctccatctgattctcattcttgtgttctgtacttgagccctccttgtccttgtccaaagctataggagaagaaaactgtgtatcctacagcgactcttatccttcaaggaagaaatacgttttttaggtttgttatcacctttaccttcttagtccagttcacaactttcaaactttctctttaaaaaaataaatagaaaaaataatgtatattctcttctgttatgtaattgaatacaaatatatgtaacttataatagataaaatctaaaataatattttacagtattcattattatcaaatattttattcttatttatgtataattgatatatcatcatagaatagttttaaattcaa

SEQ ID NO: 346 - DNA, 2450 bp, Mus musculus
agagaaggtggggactgaggagcaagagacttgaagaataaagactgtctgatcaaggatcaagtcgcaagtcttgtttcatggaaggcaactatgggtatataagcaaaagctggggagcacagctggagacacttaagcacaagtccaggatgtataggataaaaacaagatgttatcagagtgtgttcagctgtggtgggcttcttgtaaaaacatcatgctaggaaaacaagtctctcatcagggtggaaaagtactacctgtaagtaaatagcctgagatggctgcagagatgatagccactttctgctaagagttggctctcaacatgacccagacatttttatacaacccagttaaaataagcatatacataagttaaataagtatacaaatctattcacaaaaaaccacagatacattttaccttgagataatacttttgtaaatgtataaatttaccacatattaaagatgaaagggcatttgaattcttacactagaagtgcttgctgacttttatataataaattaattcctaactgaattttgatgctgaaggatgcagaacatcttcggtcttttatagggctgatggatgtttcaattttctaattgtcatgctgggaacttactttatgtaaatatgtggtacaatgtcacacatgtgtttagtgccatttcataaatagctggaaattatttctcaatcctatgcccaaattcatttaaaaattttgtatgaaaatcaactcgacaatccaaacaacaattttttaaatttaaattctatcgcagttctatacaaaaatatggtaattgggcacttatgtgctcaggaggaatgttggtgggaaactaataaaagccctgtttttctgaactagaccatatgtctctccaaaacagaaactcttttggagtgtgataaacactctgtcatcttgaatctgctgtaggtgttgcaccagtgttcattggagacacatggtgaccaccagctcagagcatgctgtacacactctgtgttcataactgaggccatagagacatctcagtgcaatgcaggtgagccctgtgaaatgccccgactcccaacacctgagccttgtatcctctaaggagtatagagtggtgattataactgatagtaggcagcctccctcccaagctaagcaggtattcctgcgtggggaaaactgccttctccagtgaaggacttaaattgcctttgttccttcattaataaatggcaatagtatgaccagatgttgctaagaaaggtcaaaggtgtgttgcatacttccctggagctgggattcttgtcagtgtcatgtttctggaaggtgtgtgtgtgtgtgtgtgtgtgtgtgtgtgtgtgtgtgtgtctttctgaaaggttttaagacagatctgagctgcctgcttgatgatttcctccaacccatcactagggttacaatggagcggattcagaatcagatcagaatctttgtccattgtatttgttaccatgaaagaaaaataagaaataaaacctcaccggaatgtaaatgaaaatctttcaagatatctgcacctaggagtgccctttgtgctgagaatgcacatggagaagtagcctgcctaaacaaacaggcaagaacacattctataaacatcgcacagccttgccatcccagcaataaagtgattaatgtttttactgtgtttttgtgttgtattcttgacatagtgttccagggagaatactggtcctcggatggggactcatcacctaccaggactgaactctctcttaagtgaataacttggaggaaggtggagagaggggaactggagcatgcgctgtgttgactgtggtgttctcttggtggaagaaaaactgattttaaaatgtgacttttagaaattggttctctctctctctctctctctctctctctctctctctgtgtgtgtgtgtgtgtgtgtgtgtgtgtgtgtgtgtgtgaagagccatttctgccaccagttttgcatggcctatgatgggtgagctccaagggaagatactaaaagacttcatctcaagttgcttcttgcaactgatgtgcatttccttgtcattcttacatagtctaatgattcctaggcatccgtccaccctaatgggcatattttctgcagaccaataagatgtaccatcatgtagtaatgctgtgtagacaaagtcatgattttataattcctgatagtgattttatagaattcctagtttgattcaaataattttaggaagcaaattttaagagattgttctagttatttagcagaagtaaataataaagttagaatcaagaataaaatgtgtgcactcctcctttatgtaagtaaactctacataacaaggaatgagatgagctttcacaattacactaaaagaaacaggcttgggaaaaatttgt

SEQ ID NO: 347 - DNA, 3075 bp, Mus musculus
gtccaaaactagctgcctaaggatggcaccacccacagtggactaagtcctcccacttacataacagatgtgcctgcaggtcaatccaatgaagaacattcctaactgaggttccctctccccaggtgatggaagttgagccaagttgacaataaacactaatcaggagaacccggttagactttcatctttagaattataccaatcatggtgactgttctgtagaacagccaccttctctgggaacctacagcttagtctacagatgaactctgtaccatgacagatttctactgtgtgtctaccccactccaaatatttgcattcttaataggagtgagcagttttgacaaagctaccttcgagcatctatttctgaagtctattctctattgtctatatttaaggacaacacttttctttgatagttttgtaagtcgtgaatttaagcagtataccttccaactattgtcattattcagaaaaccatgccaagattgactgagaacaaatagctaaggcagtttgtcctgctggcaagactacactctgagctatttgaacccactctctatagtctcaccaggatgagttggccaattaggaccccagtaagtggtaaggcttcccaggctatacccctggtatctcagaatcatactatgggattccacattcggtgtttccatgtgctgtctctagtaaggtagctctggggtggtcaggctaactacacagtatcccaagcctccaggtgtgagtgttcttggagagcaaggcaggagataaatgccattactttatgacccagttatgatttacccagctttcaactctcctgttgtaataagccagcttcaaaccaaatacatagcaagcagtgcggggaggggtggagcctgaccttaggggaagggtattagtcatacatggcctttgagtgggtaggcagagtggaagcttgagaattctgttcagtggcacatggcacaacagccaccaccaacaccccctcacccttgctataggcattttctgtcaggcacttcgccagtaagaaaggcatcaagccaaagcaaacattttcagtcccgcccaaccacactccagcttactctcaaaactacacaatctgtggagacattatttatttttatccgaagcttcatcctgaatgagctttttggaccacatggaaatgttgagatctatgtaaaaatgcatgcctaaaagtacctaagtaaaatacattaagctgctaataatgattccccctaatggtggtgtgatatcggatcacatgacagcacaacagtactttattattttaaccaccaaagtgcattccagatgctaccatctatattttccttcttatttttttacagtttttcatccattaatttcagcaaattggtatcatcttcataattaggataataaatattatttacaaagaacaaaggaataagcttacttcaaagaagacattatttttctaatggtactgaaatggcacatttactttgcaaggataagaacaccacaacagcttttagacataaaatctgataacaaataaataaaacagctacagagccctgggctgtgaggaaaactcacactgaacccagtgaaccagagtgggcgttctctgctaaaccaagacaggtggtgcctaagtaccctacagctacaaaggtacactgggacccttgggtcttaaaaagcctagagcaaacatcctggtgtgggagacgtttgcaaagcaggtatctgggttctcgtttcacacagatgtgctgttttctctggtttaagaaaatgattcactctaagcaccaaggataaggtgagaaaagtcttctgagctgggcactcctgtggctctgctccaaagctggccagcaggtttatgggaagagtaactgtactgaaagcaagcaccttcatcccttgatctaagttcctggaaaaggaaacatcatagctactggttcagcttttttaaatatatcaccaaatggtttccaggaaaatgctcattatcaattcttaataaaatgatgccgtctcagcaggtttggagacatggaattggttccgggacagtatagcctctgtggcagtccacacccacaggctgtctctgagccacacagctttgccaagtgtgacctggccttgatgatgctgctgctgctactgctgctgctgctgctgcagatccagtcctgaacatccaagaagttaaagctgatgccagtctgaggtgcatcagggatcttaactccaatgtgcaaacattccctgcaggatccaacagctttgaacctaaagcccaaatgaaaaaaaataacaaaatcccattcccacccagatggggaaattcttgcacaaaaatgttgcattttatttcttcagtgttttaaagcaaataagaaatctgccttccaacaaaatataagaactgttagttaagcacaaccaagcttctttggggacaaagggctatatcaattcttcagtcacacttaattttagtgtttactcagctttctcatgagcctgtttatttccctttgccactgaaaagccataacatgggaacatttcagtgggtaaatatgtcttaaatttgaaagattccttgtgttcttattccaaagattcactgccaccatgttaaattgtcaaggaatgatggcaagagaagaaagaggagatggagcccatgttggatttagccagcagtccatgctacatggggcaaatccctccccagtgtccatgtgtactttctgctccagaaagccttccctgggcttctgcaaaggaaataacctaatgggaaaagcttcccaagtgacctcactgggacccccttcctcatacaccttgctgctcttaacatttaataataaatgcaagcagcctggccccttctcttctagactgcagacaaagtaactgtgtcaggaatgaaattctaaggagacaccagcactcattatagtaaccacatactcactcttctgagatctctctgcttaaagctcctcccatccaggatta

SEQ ID NO: 348 - DNA, 1875 bp, Mus musculus
tctatacctattattcttaggtttggtcttctcattgtgtcctggatttcctgtatgttttgagttaggatctttttggattttgcgtattctttgattgttgtgtccatgttttctatggaatcttctgcacctgagattctctcttccatctcttgtattctgttgctaatgctcacatctatggttcctgatttctttcctaggatttctatccctagagttgtttccctttgtgatttctttattgtttctacttccatttttaggtccttgatggttttcttcaattctttcacctgtttggtagtgttttcctgtaactctttaagggattgttgtgtttcctctttaagggttctagctgttttcctgtgttctcctgtatttctttaagggagttatttatttccttcttaaagtcctccatcatcatcatgagaagtgactttagatccatatcttgcttttctggtgtgatggtatatccaggacttactatggtggaagagtttggttctgatgatgccaactaaccttggtttctgttgcttctgttcttacgcttgtctcctgccatctgattatctcaagtgcttgctgccctcaatatatctgattggagcctattcttcctataatcccagttgattcaggactcctcagagtccagctttctctctgaacctgagattctgggtgtgtcagagttcttggcaatcaagcttcctctgagaccctgagatcctgacgtgaccaagctcctagtatcctggtatcctgaattcctacgatgctgggtgtgttacagtgcctggaagtggtgtcttctctcaggaccatgggactctctggtgtgttcaaaaccaaggtatactagcaccgatcagaaggaactggtcaggcagggctcctgtatccttgcttctgctgtcacaggctcctcacgattggtttagaacagatgttgtgttccactcatcagtgatcctaagatcttgggcattctagagtgcctgcagcatggagagtcctctggggaccttgggactgtctgccaagttcacacccaaggtagcccagagctgccaccgaccagaaggcttctgttgaatttctaatgtttcttttttaaactattcctctgctgacttagaagatatgtatttgatattcctgttcattaattatattctcctgcactttagcatcagacttaactaaaggctgcttaacaaagcttaatgtatttaatactgtgtatctattcagggagcaatcatctctcttactgtcagactttcacaagcatttgcatgctgctctgagtttttattttatttgttttaataagcacatgtgcgcacacacacaagtcattcattccatggataattgccacaaagggagcatggagccgagaggacaactttcaggaatctgttctcccattccatcccaaatttcatcatgtgggattgaactcaggtctacccattgcttctcatctgggccaatcacccctcttatttcatccaagtttgcaaacacttcaggatgttctgacaggaatggagatgaaaatactgctttcaaaatgaacttatgaatatactcttttaaattttggccaattttatcatcagagtctcagtggagaagctgagtgtgctgagtgggtgtgggctgtgcagtcagaaggacaagaaaacagaggacctggcttcagggtggactggaggctgatgggagagaacacaggcagggtgggaacaggggctaaccacgcaacaaaagcaaatttcatttgaagggttccatgaaaatatatacttaatatctaatttttaagaagaggaaaacatctgcctgtat

SEQ ID NO: 349 - DNA, 4350 bp, Mus musculus
tggattgtatttgttagtatcagaaagcttagcccacacattttttgaaaaataaaatccaaaattattcaatgaaatgattatctttgttaccttgaaaaacccagaggggcctggaataaaagtcccagtaagggattatctaccttggcttggcttgtgagcatatctgaggaggattgaggataaattctttgatgtgagacaatccagcccactgtgggcagcaccattccctaaaagggtaatgctggactgtagcagagtgagaaaactgatacaagagcaagcaagtaggcacacatgcattttctcctgctccccattctgagtgtgatatgaccaacagcttcacattcctgtcattaggacaccccacatttccttcttgccagagttattttatcacagaaacaggattgtgacaaaaagcaaatcttattccaactttttaaggttttaatattttttgcttttccttgagaggcctgaactagtacgagtgttaaaagacagaggtctccaagctacaattgattggttaaatccaagacccacatgtctccattttccatctctatgtgggattgtgaggagaaaatacatatatgcagaaatcttagactagtattttaatacatactttctgtaagaaccagctcctggttggtctgttctgaatgccaggagcccccagccaagcatccatctccttacatcttctctttactacattatgcctgatacccagacttcttagagttgattcccacttacctgagacaaggcaaatgttacaggctagtgaagatgagctgggttttgcatatgtgtgtgtgtttgtgaagtgctggcttgaacagtgacaaagcatgcatacttatgagacagagttagcacgggatgtataggcagccagtgggaaactttaaccccacagaacagacatggccctcagattctaggaccctttcggcaaaactatgcaccagggccggcctgcccactcttccatctgcagtgaacctgagaggttcttgccatgttctgaaaggctatcttgtgagtcatattctggaattgttcatcttgccctcagccatggctgtgcgtcccagtcccccctttgcctgagctaaagtgtgtgtgtgtgtgtgttgagtgtgtatgtatatgtgttttgcatgtgagtgtgtgtgtctgactatatgtgtatgtgttgtgtgtgtatgtataagcgttatgcatatgtggtgtgtgttgaatgagtatgtgctatgcatgtgtgtgtgtgtttgtattgaatgtgtatgtagatgtcttacacatatgtggtgtgtgcgtgtgtctcatgtacaattgctttgtcctgctatctgtaagtcattgtctctggcagttcacaccatacctaactcaacgttctgtctttacttgttctgtaaatgcctgtacattatctgtcaattgctttaaattccagagtgctcaaattagagtctcacaatctcattttatagttggcacaattccttaaaatgaaatttatagtattgctttctgagtttaccaaacaagaaccttttccttaactcatatttaactacactggtaacatcaaaattagaacatttgctctcttaaaccagtactcaccagtacaagaaacattacatatttgtattacctaaagcaaagctagcaatttcacggtagtttaaactaattgattaatgtatttgatcagttcttcacagaaaagaaaaggaaaaatgtttctctgcctttctgtcaatacacagtaggaggttagtgttaaaagaacacagaagatgagggtgtctcatatattaaaatcaattaaaatatgtcagtgcaggttcaaaatagcattaaactgaatggattgccatcagcaccaaaagaccttgttcagagcgaaggcagcctgaggacagatacagatcctccgctgtgagttccctggtgtaagcttgtgtctctggctcccggttggtctccactctgccagagacttcagagaacaccacacatgagcagaggctcagaaggagacctgattctgtacatgtgcctctgcccaggcaagggtgacatttcggataaactagtacagcaaacacaggttaaatgtgagcctgtgggaacagtgggagctgggaagttgagcgcagctcctggctggcacttctttgatcatggttttcaagcaggcactatgtttattgaagtcccactgtcgttcttcattatgagaggcaattaaacctatgataagttaagaagttatgtcttagtttggtcattttttggtttttttttttccatctcacataactgttgatttgttagattttgaaaacgggaatttttcaattacacttcaaaaaataactgttgtcattctgatccagtgtttttgtgttaataaacctggatctgagttagcaagcttaaagagatagcaggcacactgtaagaaaatcagatttgcataattttctgcttgcttacagaactttaccattgagagcatatttcacatttggggagagcgtttattagtatgagatgaaatgccacctacagagtagtgcattgtcttctaatttaacttctcaaaataaattatgagcagatttgtcacggtgactaaaaaatcactgttataatcgaaaacaacaattctaaagaaagccatgttttcctctacataggacaatttggctttattccacacttccctctgtggggtttatgtactgttactttacatggtaggaacaccaggatccaactttcattccttcattccatcccttttctattcatgtcagaacatgtcgaaggacagcacaaatatagggatggcctatgcaccaagacagacttgaagttttgcaggaagaaaggatcttttaggaatgtgtgtgtgtgtgtgtgtgtgtgtgtgtgtgtgtgtgtgtgtgtgtgtgtgtgtgtttgagtgtgggtgtgtcgtgggtcatgtatggtatatcatgtatggtgtgtcatgtgtgtatctgtgtgtcatgtgtgtgaatcagcctcatatgtgtatggtgtatgtgtatctctgtgtatgcatgtgtgtgttttgtatatgtgtgtatgtttatgtgcatgttttatgtcatgtttgtgttgtatgtcatgtatatgtgacatgtgtatatgtatgtgtgtagtatgtgtttgtatgtatgcatgtgtattgggtgtgtcatgtgtatatgtatgtgttatatgtcatgtgtgtattgtgtgtcctgtgtgtgtgtgtgtgtgtgtgtgtgtgtgtgtgtgtacccttttccacccaatagaaaacaatcagatagcaaccttagggggaatgaagtaagctgagggatttcctctctttttcatactgatatgacattttagtagctgctgtgaatagcaagtactccaaagcaagcatctttgagttgtaggcttgtgattgctggggaaagaggagggagtgctgtgccaggggatataggcccctcatattcaatcatgagcctctgggaaatgtttgatgtttttgtcctgattctgccttttgtactgggagctctatgcttgactaagctttctaccacttgttctaaactctgctcaaattttccacggtgccttatttcttgtatcatctgtattttctatctgaccacaaaggagttcgaaaactgaacataattgtggtctgaccagaattagttagttcctcattgagcagagttcagacacggtcatgttacatatgtgggttcatgggattctatttgagtcaagcttcctctctgaactctgtgaaaactgtatgtatatagaggcattctctctcccggggtgcagtggtgcagagtaagtttggctttgtaagtggctggtaattgtttgttttcagcagagcatcaatcttgatctgagtctctgatagattttcattggtgaggaagggtttgtagaaaacatgaatgataaatatagcttggaattataggacattatctaaacgaagccctggctatggagtgttatttgagtcataagaacaactgccctgccacactttcttaggtgttgagacctcctggtataggaagaattgcttatacctgacagtgtattgcaaaacttccttatgagagccaagacctactgtgtgccagtgaggtctcatatacactgggctgacacagaacttgctatgaagctgaagatgaccttcacattctgacctttcagcttctacctcagaagtgtcatcagatccagttcatgtcatgcccaggg

SEQ ID NO: 350 - DNA, 2025 bp, Mus musculus
taataataataattagaaataataaattatttgtggattcctgactatgtgtctgaatggcattgctgaatctatatgccttattttattttgttcatggcaatctcaaaacttagataatattatctttattattattattttcttcattttacaggggagaaaaatgagagctcaaatactttccaggagcatcacttttcatgaaaggagctgaattcaatcataagccagtgtggtttcagaacttttatatttgattcataagttaaaggaaagtttaagggctgtctttagcagttattagtatgaagagctctgagcctctaccgtttatgccagaaacatatttactgagagcaaaatctcaaaacaaagcaaatccccaaagattttggggtttatgaaaaataaagttgggtcagtgggatgtctcagtgggtaagggaggtgcatttactgttaggtctcatgatctgagtttgaccactgggacccacgcagtaggagagaagattccacaaattgttctctgacctccgcaggctatgacatacctcctaacaccgtgaaaataaatgtaataaaaatgcgaagaaaaagtttaagactaatgaattaactatataaaatattgttaatttattatctgtaactttaattatctgcatatcctggccagaactatttgtatatacaatgctgttttatggtggatggcctgcagggggcagcaacagctcacagttgtctcatcagccttcgcatactgtcttcctgtttcccttatgatagctataaaagctataacccatttcagttatccatgtgccccacggtgtgattttctctaacattttatattgtccgggttttatattccttgtgtgggtgaagggccatgagcagtaaattatttaattaaacagaaagtgtaccgagccacagctgaccaactcagctacaatctgggcccagatccagtgctttgagtcagtctaccccaacatctacaccatctgcgagccgccggagcacgtgaaagggccggtcctgcagaaccagagctgcaggatcaccatgactctggcaggttctccaataggggccagcaatggtccagtatgtctggtgcttcagaaaccagaaaccgtgaaccaaagactcattgcaatgaatatttgcaagtacagccatcttggctagtgtgtgtgtgtgtgtgtgtgtgtgtgtgtgtgtgtgtgtgtgtgtgtgtgtgtattatgacacccacagtttccagtgtcacaatgaacaaatattccatacagagatagaaaagagagcaacggagcagtgagcaaatggtggagagggtgcagaactagaaatgttatggtggtaatagaagtgagagaggcctgcggtggacggtgggggtgggggcggggcgggggggggagacacatgtagttgccaagtagggacgataggggatagggcggtgtgtagcagcctggagcttgcactccaatttagcccctccccctgccccctccacaggctccccagctgcacagttgccatggttctgagcaacagcagggtgtccaagaggaagaacagatcaatttttggaatgaacctgcttgaaagacctctcttgaaagacctctatggtctgtgctgtcccccaaggccactttggtattcacggtccactgcttcagactgtgttgaagcccgaggttcatgtggatgtctgtgatcttacagcagctgggagccatgttgatgtccctggcccaaggtaccattgaatgccgcacagatgtactgggtctgagctgcctcctgaggccacgctgatgtctgtctgggtccctgttcctgcttcagccagggtctgtgttggtgcctatggctagtgttaccaccaaaggtcatgtggatgtccatagtctgtgctgcaacctgaagccatgttgatgatgtctgtgatggtttgtatatgcttggctcagggagtggcactattaggaggtg

SEQ ID NO: 351 - DNA, 1800 bp, Mus musculus
tacaatattctacttttccttgcaacataatggaatcagggatgctcagctttcgactcttcagccacatgagcatcagacagctacaactgtggcccagtgcaaaaatcacatttgtattctttttttaaaaaatgccacaacacagttctccagtgtgaacttaatggattttttaaaagaaagtgtcaaaagtgatgagaggttgttggtaaacccagtacccagtatacttaaccttttttgtgtgttatataataaaattagctttcttcagagaagtgggacctctatgtttgtttgtttgtgtgtgtgtgttgggggtggggactgactttaggaattcattgatatgaggaagaggaccagcaaatgtgaaatatatgagacaggccagcaaactggatatgtaggtgactgtcaccactatcaccactgcagtcttgagtctgatgcctacaggacagttcacatagctggaaactccggcaggactcttatagtcttaggatggaattcctttagggggagaatcagtctttatcattaacgcctttaaactgctggacagcgttcactcacatatgaagggtagcaggtggtaaggtcagtacacattattcaaatctaaaataacaaaaaacaaacacacacaaaaaaatccaccttcacagcaacctgtagtctagtgtttgatagacaactgggaaccacagaggggccaagttgacatacaaaattagttaccagtccaggattgtgtctcacactgcttcacagcccttctcccacaggatttagctttagtgtcttactggctttttaaattttattctttgccctttgtttctaaactactctaacaatagtggtcttaatgcttctgaaggaagctgtgcatttgcatatttgaagaacaattaattttcacagtttgagacatttatttgttggatgtttcccacagactatcctaagtttcgaatacaattatcctttaacagtcagtgtggcttaactgggtccagcagctgggggatatgggaatagagaggctaacccaatttcccagtcagggaaggcaagagcaagagcgggaggtggaagaccacacatctgatgctccctcacaagcctggggaggaaggacagaaactgccagaagctttgagaagcttctgcaaaagcacaggcagcaaattggctccagcacagtggcactcgcagcaattccctggcatcgcggggcagtgctgacagcgctgcttcaggctgtgtggaggctgtcttgagatgaacaacaagcccttcatttgtcttgttcccctggcaagggaaggcaggctggtgaagcaccccttcatttcaattttcttttgttttctattgaaaaacagaggaccgagtgtggacatcagagagggactgtgaatggatgtgggatataagccaaacaacatgttacaattgtttttagcatttagtatacctaattgcatgaatgcataagagacaatttaggtcctgtgaaagtccggtaaacgggtaaggagattaatggcatgaggtctttcaaattttcttttccaatatgatgaccctagtttggagatgtcaaactaatggattgtttccatatagccattcatgtgccctaggaatagaaaaataacaaataagtttaattctaattaaacccctccattgttttaaaagtcttataggtgctcactcagttgagccttttagtatgtctatggcatatgcaatactgtatgctcatttttcaggcaaggaaga

SEQ ID NO: 352 - DNA, 2475 bp, Mus musculus
attggagacaccgttaataactttctcaaagtgagccaatagaactctgtaagagtgcagggtggtaagtatagaatggtaaattcgattgagtttgataagacagaaatacagaattttgagctttaccacaggcagtaaattccattttatcttccaaagattgatagtggtgtaaaacttttgtaaatatagcccagtcagttatcacttctctttgatcaaaatgtttaaaagctaaaaagataatattatatgtagcttgtttcctgttctacacatagcataaagaagagtaatttctcttggattaccacgtaagtatttgtgatttctataaatttgtaacaggaaaaaagtaaacattaatttttctcaagtttgtacaagaggaagcactcttctaggttcaaagtcagtgagaggaagttatttaacaaggtattcagcacaaagtaagtgcttagtaaaaggttgtgtgaatgaaccaggatatgtaaacatgtatttctgaaataagaaaattcaaaacttatttttaaaagctgtaaaatgaatggagcatatggtgctatttgagaaacatcatgaatttttttttttttttgtggtgaacttaaaaaaaatactgtaccattaaaatagatttttaaggcttttaaaaacacaaataatatgtttatttccaaaaacgagactgcaaacatctggtggcaagagccaagctcttgcccttggaatgtattccttattttaagatgtatcccctgatgttgccatgactacgggctgtgaagtgaaactgctgtgtaatgtgttctctcccccatagtgcgtgtatctgaaaccagcagtaaatttctagtaattagaggagacagcctcaaaggtggacttgacaaagtcttcaaacactgtgttaaaatcttctcctggggtttggtctactggttgttgatttaaatggctcattagtatggacaggataattaaatacaaagctagatatctggcctacgagaaatccttttgcctcatttgaaaatgtcaaattattcaaaaaggaaagagaaaaaaaacccaattcgacagtaattgggtggacaggagataaagctgtgtatttggtagataaatgctgcttttctgagagtgtcaaaaacagatgtctgacagtaattctgagtacaagaaaggagatggcatgcagtgttctgctccccagagaggagagaatgcaggtgggtgtgtctttgcccaaaacacctcatcattttttctagggtaactgctagggtggtttatattatttttgtaccagataagaaagctctgcaagtcatgtaggagaaagttggtcttgctctaatagccttcttctggaaagcaggtagatggctaccttttcctggtgtgattcaaggctgcctaggagaagacagaggctgatacaggccaatacgctggtactgtgactgcggtctgctctgtaccagcagagccttgttttctttttgtatttggagttaagaaccacagattttccaaggttagctctgtttccttttccagaaatactgttgacagcagctgttaggacaattattttaaatggtctactaccttgagttagaccagtggcttttaaccttcctaatgctgccacctttaatacacttcctcgtgttatagtgaccccaatccataaccttatgtttaatgttacctcatgactgaaattttgccactgctctgaattctaatgtaaatatctatgttttcccagtggttttaggtgaccattgtgaatcagtcattcaacccctaaagagggtttccacccacatggtgagagccactgagttagataatgggttaagaaaaggaaagtacagccgggcgtggtggcacacgcctttaatcccagcactcgggaggcagaggcaggtggatttctgagttcgaggccagcctggtctacaaagtgacttccaggacagccagggctatacagagaaaccctgtctcaaaaaaccaaaaaagaaaaagaaaaaaaaaaaaaaaaaaagaaaagtactcatgttgccctaatcctcatagcatgcagtagtaatggaggcaacacaaagaaaaaggagatggagaagagaaaaattatatcatgctagactttccctcttaaacttaaaattctgattcagtattttggcagtaaacaaaattgaatatatatatatatatatgtacatatatatatatagagagagatagggatagatatgtagatatagatatatagatagatatggatttttaatcatgagaattcattagactttggtctcagacttctgtctacactgaatacttgttactcataaatttgagagagagagatagaaagagaaagggagagagagagagagagagagagacagagacagagacagagacagagacagaaagagacagaga

SEQ ID NO: 353 - DNA, 1850 bp, Mus musculus
gaatgtaactttattttataaaacacattggctaagaccctaggcgcatcatacattcatgatatccctagggctccgtctaagttacttgtcttattacccactccccatatttcaattacagggtaaaactgtgatctgatcactcccagaactctgtctccatacctggctgctcccttgaaatatcagtcatactgtcttgccgttaatagctaccactacacagtgagctcataggtattgtcaactcaatgttgtccaatttgccacatatgaatccataagctagaccaaactgctcttgttttgctcatttttcttagtaagaggcacaccataaatgagttttcaaaaccagagacctgaaaatgatttcaatgcatgcgtctctcttatccacactctgcatccattctctcgacaagtcttgaaaattctgcctctctgtacacttcataaactccgttgccacagttgttcctagacattttctgcacctctacagtctcagtttcctctgcttagttcttctcttggaagaacaatctcagtgtgtttgttgttaattttgtttaaggtacatttttagtagatttattctgcccattatctaccaaccactcagttaaaaaaaaatacttttcagctagcatagtgtgctttctatataatatctcatatttttataccaggttggacacttgaccccagattagtcagggggttaagattttagacttactagattttttatttccctatacatccttttaaattgcacacccagtctttccacattcccattttctctgtctcacacagtgttacctctctttcccccagcttgttaaaatttgcctcacctttagacatctctccccagcaaggctagtcagactcccccctccgttttacccctcaggtcaatggttcttgccatagtagcgactgcacctttgttatttgcccctacaccatcaaaagcactatcaggtttgctgctaagacgtctttctggatcacccctctgctttccctgcttataatctgccttcctcggaagctggcatagtgactagaattagaattatcacgatttataaacacctttataaataggttcactcctctgctttctctgtgtgtgtctagtcccagaacagccagtattttctccgagaaatttagataactgctgtgcttagtcttgcctctacagactcttttagcagatgttgcttataaaattctgagtggtaaggtcagagtgacttttaagatgtggactctaaggtagactacttcatcgactagttctgagaaatgacaagaagtagatactgcagttattattcggtatttaaaaatctatctcctttctatcatttattctgaggctgatgaaatagagtgtcaaagcccagtctttaagaattgatttcatggcaagtgagtaaataatactctcattaatgttgcttgccagggagctggggacacaagtcatttttcactcatttataccactttgagctgacatttctgctccttcctatagatctctgtcttaggtattttattgtgtggtagactatattgtgttatacctttaaaatataattttaagatttattttcattcatgtgtacagttgtgtctctctgtgtgtataccaggtgtgtgtgtgtgtgtgtgtgtgtgtgtgtgtgtgtgtgccttaggaagtcagatgatcccctggagctagggtttcaggcagttgtgcattctgtacacatttaataaaatacattttatcaaatgtacatttttataaacatttctaaattttgttttgttttgtgtac

SEQ ID NO: 354 - DNA, 2475 bp, Mus musculus
aagtttgcaggaccaatgggcctctctttccactgatggccaactgggccatcttctgatacatgtgtagctagagacatgacctccggggggtaatgactagttcatattgtagttctacctatagggttgcagatccctttagctccttaggtactttctctagctcctccattgggagccctgtgatccatcgtatactgtagctgttttcagacacaccagaagaaggcatcagatcttattacagatggctgtgggccaccatctataatggctgtgggatctgaactcaggaccttcagaagagcagtcagtgctcttaaccactaagccatccctccagcccttaattatactcttttttttttttttttaggtattttcttcatttacatttcaaatgctatcccaaaagtcccccataccctcctctccccccaactccccgacccacccactctcacttcttgaccctggcattcccctgtactggggcatataaagtttgcaagaccaatgggcctctctttccactgatggccaactaggccatcttctgatacatatgcagctagagacaggagctccacggggtactgggtagttcatattgttgttccacctatagggttgcagacccctttagctccttgggtactttctctagctcctccattggggccctgtgctccatccaatagttgactgtgagcatccatttctgtgtttgccaggccccagcatagcctcacaagagacagctacaaacaaacaaactagcaatgccgagtcatgcattttctgcgattatgttattttaaggcagtggttctcaattgtcctaatgctgtgagcctttaatacagttctttatattgtggtgaccccaacataaaattatgtttgctgctacttcataactgtaactttgctgctgttatgaatcgtcatgtaaacatgtatgttttctgatggtcctaggtaactcctgtgaaccttggtttaactgctggaggggttgttacctacttgttgataaccaatgccttaaagccttgtcttacatttttatcttgccaccacgtcacaatacattatgttgtctttatttatttatatattacatctgttctcccagagcaagagcaaattatttttaacttttttattctcttttatttttagtgtgtacaataacactgatgacaaggggagattaaacagatcagacacggatctcaaatccaaagtcacagctcaggctcttgaccttggctgtaagttgcaaatgttcttgattctgtccttgtcggtctttttaatgcccgaagtatttgagggttttggctcctgctcaggtttcttgctttctttcctttccttttatatagccctagcagcacttcctccaagctgaatactgtaaggctaaaactgaggtacaggaacaacttataggtggaccatctggccttaaaatccccgcagatggaaagccggggacccatagcttacgaccgcgcttgccacagctgcttgctgtcttgaaagttcttctctgagaacctgtaataaattcctttcaaaaaacttgctctcttttgtctgggaaatttatcatctgagttccctaaggaaggacccagaaaccactagcccagatggcttttggtggctattgatttttcagatctcatgcctctgaccccacccttgcacccatctgaggtaagatagccttacttaatatctgggaagccttcttcatcttatcagcagcttcatggactaaatgctcagtaaatatggtgggtaagagagggaaatgtttaagagagtcaaaataaaagaaagtcctaaagtatattctttacaaattacgtagagattgggcattttccaataagcaacatgcctctagcacattccaacattatttctcacctcacaggcctgacaaagtgttttgacggcttctgtcatgtactgtaaaacagccagagctacgggaaggaaaatacaatataaatgcaaactaataataaagggcctctgcgtgatcctcctaataaagtatgtggagttttcaatgatccggtgaaaaataaattagggagcttgtaagagtaaaacatagatcaagttgaaatcattagagccgagcgaagcagcaagcttagagtataaaccttcaatatttcagccttagaaatttatttccagctcttttcaaacttcctttctgaaaaaaaaaactttatatatatatatacctatacatacatatatatatatatatatatatatatatatatatatatatatatttgttatttttatagtaaggcttaaagtaattagattccattcttcaaggccttcattacaaatgcccaatactactacataaagaacatcttggaaaagttgaatcaaattgcctattgtctttccaaagcaacacatctaaaa

SEQ ID NO: 355 - DNA, 2075 bp, Mus musculus
cctatgtcctctatatcagctcctgctttgtatgagtttcagtcctgaattcctttggtgatgaacaacgatgtggaagtataagtagaaaaatcctttcctccttaacttgcttattggtcatggagtttcattgcagcaatagaaacactgactaagacaaattggtaccaggagttggatagtcctatgagctcctgaccatgtctttaggaggaccgagtgcaactttgggctagaagagccattgggtataaggagcttgtgagatgttctgtaggagcttggaagataatattgagaacagtgcagaagatggagccttttacatggatgaaatacatagtatcttacttagggttttattgttgtgaagagaaacatgaccatagcaactctttaaaggatgacatttaattggggatatcttaccatttagaggttccattcattatcatcatggcaggaagtatgcagtgtgcaagcagacatgatgctagaggaactaagagttctacatcttaattcacaggcagcagaaggagactataccacagtggtcacagcttaaacataggagacctctaagctcacagtgacacacctcctccaaaaaggacacacctattccaacaagaacatacctcctaatagtgccactcccccatgggtcaagcattcaaacacatgagtctatgggggccatacctattcaaatcaccacacacagcatataaaccatacatctggggaagtgttaatgcacagcacaaacataatgaacaataaggtagagataagcactactgcagacttatggaggccaggagagaaaaaggatggcaccccatgtagcctgaaaataatgtctctcccactgtgatgggttgtatacgcatgggccagggagtggcactattaggaaatgtggccttgttgtagtaggtgggtcattgtgggcatgggctttaataccctgtcctagctgcctggaagtgagtattctgctagcagcctttagatgaagatgtagaactctcagttcctcctgcaccatgcctgcctgaatgcttccatgttcctgccttgatgataatggactgaacctctgaactcctaagccaggggaagcaagccagtaatcagcacccatccatggcctctgtgtcagcccctgcttcctgacctgcttgagattgagtcctgaattcctttggcaatgaagagcaatgtagaagtgtaaactaaagaaaccatttcctccccaacttgtttcttggtcatgatgttttgttcaagaatagaaaccctgactaagacacccactcatttttttttaaaaggaaagtaatttatcataaagtgttctactgagatatatactctgtaatggttactattcatcattagcttgacaggatctagaatcccatagacatcaaagctccaacaaacctgtgaagaattatctggattatgtaagaaaacataattgttaattatgtgtggcattattatacatgggttgggattctggactgaataaaaaggcaaaagcaagctcatccctggcatctttcgcttttgtcttcagactggaacacaatggaagcacttgtctcaactcccctcctctcctgaaggaccacacacttggactgtgagccaaaataaacaagttctcccttgatttgtttgtgtccatttctgttaaatcacagaatcaggaaaactaaggcaaactctctttccttttttagtcctttctgttcttcatcgctgcacttcatttctttatactgtatttttatctggggctgaagaaaatattttctagcatgagattactgactttttagttatgactctattttatggtcattgctataagattttaatagacattgttaacctgtcctactctatcttgatttaatattatgttttcacacatattttgaaatatttcatacataatgttctccccattgcttcagtgatgtctaccctttgggaggtgggtatttgaccttttctgactaccagttcttgaggtcatcccttccactgcaatt

SEQ ID NO: 356 - DNA, 2300 bp, Mus musculus
caagtagtctctctcttttaatcatgagcgcagaagagagttcattgattcttgctatgttaaagcacattgtcttatataccattttaacatgactctatttctggaaaacatgaatgtccagtgtaatatcagtttaatatcaatatagttttaggttaaaaatgtggaaagagctaggcagtggtgatacatgcttttaatcccagcacttgggaggcagaggcaggcagatttctgagttcgagaccagcctggtctacagagtgagttccaggacagccagggctacacagagaaaccctgtctcagaaaaaaaaaatgtgggaagtttctgcaatacaagtaagcaggcatctaaacttgctatactgtcttataaagaagcccctccttaaggtggctcatgaaaggtccacatggtgacattaaataataactgtcatagacaatgcgtatattaataaataaatacaccaaaccttgagatcacattcttttctttaagacacaataaaaaatttcaactgaaagaaggcagttcccataaaaccccaaagcattggaaagcacagaatgtcagagcagagtttcgtctatgagaacagcggcaatgttaccatggaggagtattaaaaatcacagcagtgctcactcgagtgctataattaaaactgtgtcaacattttgcttgtaaaacagatttttcaaggaaggttgcacattaaccattagagctgactgcagacatatgacgcataggcgatttttcctccgagaaacatatttcaatggaatcaaatcttatgagggaggtcccaggatcatgtgttgtaggaaaagaaaaaccatgacaggttttaaacaaagattcagcttagcagatgtgatgatagcatgttctttcattgctcatttaaaattttatgaagttgggacattgataaatgcttttattttcacccctttgcatgaaacgtgtgctctaataaatgtctttatatagacatcaaggctccaaaggcaagagcccttgacaccaaacacgagtctcacctacagaggagaatacagacccaggctccaggaactgtgatgaaaaccatcccaaggcctttcccaagccctaccacacacccacactcccgacagtcaggactttaaaccacacgcaatcgaagttgtcctttggtttagtctttgggattcttctttcttttccttttaaattttttagttgtacttattcactttgtaatgcactcactgccccctcccagtcacaccctccacaatcactgccctttccctttctcctctgagtgggtgcccttccaccctggcacttcaagtctctgtgaggccaggtgcttcctctcccattgaggccaaacaaggcagcccagctcgaagaacctataccacatacaggcaacagcttttgggatagcccccattccagttgttcaggatccacacgaagaccaagctgcacatctgctttatacacatgattttttttttttttaaaaagcagtttctatacagggaagaagagaaatttcaaatgagaaaagaggaaagttcagtatttattgttgtagagctagctggttacccagcatttatctgcttttaattcagtctgatctggctgacctttgcatcactgaaagagagaagatacctaacaggttaaggaagagaagacggtagactgttggtaaggagaaagtcgcaggggagaaatgccacatggaaagctctaagctgaggaagaggctgaataaagacaaaggtaggagagagagagagagagagagagagagagagagagagagagagagagagagagagagagagagagagagagagggagagagagagaaaacactaaaataaagatgtgatgaaaagctatatagaaactggtatcctgtgaccaagttaaaaatataacatatgaaagaaaagggaaagctgtcgctgacactggaccaaccacttctcctcgattataaatgaggaagttgatagcagtctttcctttctctgggttcctatcacctgggtatcaaaaatattttaaaataaaattccccaaaactcccatctgtgggataggaaactaaaatgaactgctgtgaagattttgctgaaaggaccctgatatagctgtctcatgtgaggctatataccagtgcctggcaaatacagaagtggatgctcacagtcatctgttcgatggaacacagggcccccaatggaggagctagagaaagcacccaaggaactaaagg

SEQ ID NO: 357 - DNA, 2150 bp, Mus musculus
gctggttactgccaaggtctgtgtgccactgctgtacccttggtgttctcttgccacgctggttggtattgtggttcataggcatcgccgttgggtaggaccgttcttcctttgcaagcttcatggtgccttctggtcctcaaaggaggaagctttacaagttccagctcaggggctccgcgtctgtgtctgaacaacagtgatttaccttccacctctagagggcaaccaagggcagcagcaacagtctgtaatgtttggagactcttggagaaccctgcctaccaactcaacagagggcttctcatgcctgatgctgggggtttggttgatagtcttcagctcttgaaggaagcattatcagcccaggtgggaaattttcatttaaactatgtatttatatacagacttaagtgtatggtagatacttaacaatataattcctcagacattctaactgttattttaccctcctctctctcctgtatttgtctccctttccctctctaattagacaccccctcccactttgcccagtcagatcacgtgtgccctggtatcccctctttattgcctgatcaccaacagtggcccccttttctttttacttttctggtttctgcatttattttaagatatgttctcacatctgaagacgttgagctgaaagtctcagatgacagagaacatttggtattcgtctttatgggtctgggttacctagctcactacgatcttttctagttccattaatttctttgcgaaactcatgatttgatatcatctttctttacagctgaatacatatacactgtatgtatactacagtgtgggtccccagaccagataagggatggtagaacattgctcacacctcagacatctctcagagaacagagcaggaatgggatctctctctaccctgatgaggcttggacctactcacctccatagagacaaaagccacatctccataaagccagataggccactgtttccctccagagaactggcttctcagaatcatgtgaccggcagtctgctaatgtagctgatgctctcggaaggcccttgcctctgctgcagctcctcccccttgccctccctctttcttcccgcccccctcccctgactggagctatataagccagccccactaattcaacaaacaagctgttctctaaaacagtctcacaggtcattcacactcacccccacctgaaaccccactgcccagctcctccttatcccgagcctctggatgatcaggggcaggggaccgcacaccacattgtcattatccattcatctttgaagggtatttaggttgttattaatagaacagcaatgaacatggccaaatcaatgcctgtggagtcggacagcaagtgctttgggcgtgtgccaaggagtgttagagctggatcagatggtaggattatttttagctttgtgaggatgctccacaccggttcccaccgacagagaatgagggattccttcctccggcatcctctcctgcatttgtggttagttgttttgctgacctttgccattcccactgggataagattgaagatctcaaagttgttttgatctaaattttcataattgctaaagagatgctgaatactgttttagatatttttatccacttttattttatttttttattttgagaactttctgttcaagttccaggtccattttttaaatgggtccgtccttctcttccttccttccttccttccttccttccttccttccttccttccttccttccttccttccttccttccctccctccttcccttcctttctttttcagttctttgtatattctggatattaatcctctgtcagatgcatagttgacaacaattcccccacactctgtgggcctccgcttcaccagggtgattatttccttagctgtgcagatttttagttttatggcaaagttgttgactttaactcttgggcaaatgagtgctactcacaaagtcctttcctacacctatatcatgtaaatcatgtaaggtactgcctgtgttttcttctagaagttttggtgttcaagtttcttaggtctttgatctatttgcagttaattttcatacaaggtgatagatttgggtctaatttcatcc

SEQ ID NO: 358 - DNA, 4100 bp, Mus musculus
taaaaggaaaattttcaaaaggtaagtgtgaaagacagatgaaagaactatctattgaggcaaagacagaaaagtggtgaaaatattagcacactggagccagagccaaagtcagagtgtggctgcataacaaatcacttatgatatggaaaattaacttctgtgtagttcagcaagatgaggctgaaaggggagttcccctgcagaagggcgttattctaaggttattaatgctctttaatgagtgatcctttgtgggggcaatgattacacggagttaaaggtaaggcttccagtttcacagctcacctagctccctgtgccaagattctgctcatcaaatgagagaggtttctgagggtgtagcagagcaaacaactctgagaaaggaaacttggatatggtgccaacacttgcaaattttctcaagggttcctgctaatttgcaacacatagcaaaacaagtgtgaaagtgtgaaatgacacatgctagagggaagagcggaacagatagaggaagcaaagaattgttctattttaagagggtgcttaatttgttacagtcaaccgcagccccttccttttcattacagaacactgaatgactgtaattttctaaataagcttttgtctgagttttgctcataaaacactgtgaaagcaagcagataagatttattccaaggaaatttttgttggccatagacttctaatggaggaaaaagtggtaaagtggaggggatttgaaataatataaatggaacctagtattaatacgttatggaaaaatgagggatatagggggacaagatgaggaaggggcagagaaagaaggggggcaagaaacaacctattgattcattttctttatggaaagaaaagcattgctaggtgatgcagggtaaggtgaccacatgccccattaacacacagtctggctcagttgaggccagtaagttacaatggcatcattgaaacgccagtctctcgctccattgcccccatgagcatccacctgtccctgctgggggtggccgtatttttcctgctaggactctgggtgctctgccgcccttgctcgactagactagttgtctcattttcatttcaatttatataaaattgaagaaaaactttatcaactcaatatttattcttctatgtttacttagctgagatcacttgactgagcacttaattcaagtcagagcaaaagggaagtatttgaattatcttgtgtatcacatggggttagctgggatggagacaggtggatttggggaaagccttcagaggataaggaatttcaaaccaaggacattgtacagctttctcaatgtgaatagaaatatttcttccattgactcaaaaatcttctataaagttcagaagtaagtttcatctgcattgatgttgtttctagtctactaatgaatagtctttggaacacagagcagagattttcaataatttccttctttttcatatcaccttcttccattaggtacttgtcaaaagttatttttatataaaattattttatgtggtattaaaaatgaacagtatgaatgaatctggatggttttgtgttaagtgcatgataccatgaacagatatacaagaactcatctgtggaagctaaaaatgttgatgttacaaaaggtaagagtagaacattgtcaccagtacctcagaaaggtgtgaggagggtgatactgggaggtgggcaggaagaacaggtttctagctaagtatgaagaataatttctagtatttcagaatacagcaaaggacacactgatatttgagaggattttaaatgtgtccaatgccatgaaataaaaaaaaaatatggcaatggatatgccatttactctgatttatcatgaaatgttatgtccatgtactgaaattaacatacacacacaaacccacacacacagacacacacacacacacacacacacacacacacgcacacacacacacacagacacacacacacacacgtatgattattgtatcaactgacagtcatatttaaaacctgtgttcttattacaaagatgtgctaataaatggatatatatgtatgtgtgtttgtgattcttaaaaatacaacaaaatgaaaccggtattctaggccacacagtagcagtgctcatatgctagagagatagtaacaccctcatgaactggcctagaatctcagctctctaggcctaggtgaactttaggcattaaccaacccaataatgtctttcaactaatgatgaaaatcagatgctctgatattaaataaaataatgaagaggaaaaggtgagcagagaagagtaagaaggaattgattcatgcgtcttccagtgattcactgttggactggtgagatgggtccgtggctagaagcccttcctgctaagctggatgacctgccaagcatgcctccctgagtttgacccccaaaaccctcatgctgggagcagaacaccaactattctagtctccaaatgtgtatgcacccaaaaacgaaaatgtaataaaaactttaaaaagtgttttaatttatagtttgcccacaaataaattaacaagcacacagaattggacagctctttgttatccctggtcttttgctatgaacttgacgagactctgtcatcctgaaaattctgatagtccttaatagaacagcagaggcataaatacggaaagattttgttattgcctaaaccagatgcaagccccatttagatgttttactcccctgtaaaacaaacaaacaaacaaacaaacaaacaaaccatacaactaaacaacactgccagagtcaagagtcccatgagatccctgtgataaaggagagcctgaacctgctgctgtgtgactgccagaggcttgctgccaccaaaatgaagattagatagtagggcaggaacacattattccatgtcagaacctcatgtgagaccgaggagagccagcacaatgaggaggcaacacagggctgtaccccacctgctctctatggcaaacaagctttgtgaatgtcctgtgataatttgaaattctgactgttttttccccacatttctataaaaccatgcaaaggcaatcgttgggcaacaacttaaaacgtctgttttcactcaatacttctgtaaatgaaacacgagtgtatgctttcacagtagcttgtcatgaggaaaacagtctcgttctcccacaaacgcttccctcctactgtcgcaagtccaagaaggcatgctggctggctgagatccaagatgctgctgggagtttacagatgcctcctgtgaagctgctgctacaaaacccagtccccagtgtaagcccccatcctggagaatcctctttttcctctcccttaaaaacaacagcttcttattataaagcagatattagctgagtattgaaggagataaagttatgacaattctaacaggaatatgcaagtttgctaagattcattatggaaagactaagcaaattgacagcaagatatttagcaaataatgtacctctttatagtagttaatacaatacagaatttggctgggaagaagggaaaaggttctttgtggtattattttcagattatttcatatttttgttttatatatatatgtatacacacacaaatagatggagatggagtatatatatatgtgtatatatatatatgtgtgtgtatatatatatatattgaaatttgccacattagtatttctttttttaatttgtaaaatagatgaattatatattcatatctttccaccctactctctccctgtccaaatcctcctatgctgttcttgtgacctcattcttatattattacagatttttacatgtgcatgtgtgtgttagcatgtatacatacatgcaagtggacctacatacactctgctgagtccattaagtgttgctgatatgtttatgtgcttaagcctgtttaaataggattgagtaacctatcaggttgcttcttattaatgagaacaagcagctattggttgcctgtatctcttcatctaatggtaggggattaagtagagatcagcagtattaagcaacattt

SEQ ID NO: 359 - DNA, 2400 bp, Mus musculus
aaagagctaattatgtgaccactccacacaaatgttaaattttttttaattttaattttatttatttatttggtagggtctcactgtgtagccctggccaggctgcagctccccctatagatcaggctgacctcgaactcacaaagatctatctgcctctgcctcctgggtactggaattaaaggtatgcaccaccgtgcctggctaaaaaggctccttaaaatatcagaaagcattactaactccacccatgatgcgagacatgcaatttaaactgatctgagacatcacatataataaatatagtaattactataggtagaaaagatttggggaggtgctataagatctgtgcagaataaatccgcaggtctgcccaagaaaatgttaacactgttgctcgtagggaaactgtggatgtgagagtgggaactgctcctagggaaactgtggatgagaaagtaggagggagaggcatgagatcagtgtctttcctttggtgcctttagaattttgactctcatgaataaagttgaagtgtgaaaaaaggaggaggagggggaggggagggggaggggagggggaggggaggagggggaggagggggaggggagggggaggggaggagggggaggagggggaggggaggagggggagggggagggggaggggaggagggggaggagggggagggggaggggaggagggggaggagggggaggggaggagggggaggagggggagggggaggggaggagggggaggagggggagggggggagggggagggggaggaggaagtgtttcattctcttttcactcttccactttgctcagcgatggtggaccttcccccagttccctggcctcccttcaaggactgtgtggcctgttcacaatcctcccgatgcccagagctggttttgtagctttatgaaatgaaagtcggcctcagaacattgccaaatggtctcggaacacattttaatgcgatgtttctgacagagcagctgtgggcttcatttagcagagcatttgaacatcatagtctcaatgcagcagttgggttcctagaacaaaagctggctaaaggcacagaagcgtgaaaagcgtgaagagggtaattctctgtacggtatctgtgtcttgttttattcttccggttagatttcacattataaataagagttacccccattacaacacataggcctatattttgcttttcaactcagttcgggtataataaagctgattattctccccaacagcactatgtgatatactgtaggcgttaaagccagggacctgggagctcatttaatggggatgatgcttttgcagtctgtttctgggaagacacgggaatactaggtgccccctctctgtgcacttgaacctactgtccattcctgttcaattgtaacaatccctttcacatagaaaccatgagggtttctatgggcacattttaagcttccagaagatggtaaggagtccaagggagagactctagtctctcagaaactagactcttctagtcagaatctcagagaacatcctctcctgtcagcagccatagtgggacaagctaataactagcaggtgatcgtcctgagatggccgcttcagattattatataatctgggacaggttcgcccttattaagcaaggctgtaagagattcattttatgaaagattcctgctattaatatgatttcctgttattattaataatcactaagtaatagcacacccctttggagcagatctctgcagatccatgaagatgtactatcttgtagtgatgctatatagacaaataaatgacttaagtcttaatgatgatcctataggaattcctaaaattatattgtgattattaagctctttataatgggactgctattaggtccttttctgatagtcaaaactgcaatgagaactctgccagtcttccaagcggcaccaattaattgctcttagtaaccagactttctcctactcagagcacattgcaagaggttgtaaaacaattaaccaaaggtcataaaaaaggaaatagtgatttattataggtgctaggacagaagacaaaatattgactgggtttatctatacaaaacttcacttataacttagttatggctttaaaccttctgtgaccctgtggagctgagacaggtgatggatgtttagccagataattactcctaacggatatgcatctaaacattctctgttgtaaacttctatttcaatttatgatttgattttttgtgtgaacttgtgatgaactttgtaacatgtgatcatatattctgaaagatgtttaagtactgaggacaacaagaagagagagaagaatttttttgcctttccccacttagagtagaata

SEQ ID NO: 360 - DNA, 2025 bp, Mus musculus
agagaaaatgaaactgaaggatacagcagtagtcctcgtgggcccacttcgtagcccttgccagccccctttgtaactcccttcgtagcccttgcggaatagccccctttgtagccctcgctggctctctttggtagcccttaccagcccccttctccagttaagttcagatttctttttttttttcttttatattaccattctctgttaaatttgaccctttgaagtcccaaacaaatatttctacttaattgggttttattcaacaaagacaatacgcctaagtaagttctgacatgcagcttcagggaggcccagttctgcagactccacaatacttcagtctgtctgcttgagttctgggggaacagaatagaggctaagtcatagggcagaagcagtctgcacaggcgtcctctggtttgtttccaagggtctctgcctcggtaatgaaatcttccttgtacctagccagagaacagtccagaaagataaacaaaggggtaaagtacagaggcccaaaccctgactcaagagacttcgaggaccagaatttgaggcagagtcttctataaggactgtgcctgtcctccctcgccaggccactcactgttctacttgagtaagactgtatcaagcacttacaggggctagtaactccggatagtaactccggatagagagagcacatgcacgcacggacgcaaaccgcctctaacaacctgcaagtacaaatgagccacgatccatccacagcagcatttccaaatgcagaaaaccaactcaaacaggaaatctaaaagcatatgaagtataaacgaaaatgaattagttatttttactgagcctataagcagagctgtttttaataaccattctccaaaacaatggcgggagcatattaatagatttttagaatctgtagaaactgacaagaggtggcgagggattccagtaggcctagttcgaccctaaatactataaatgaacaaataccaggggtgaggagtgggagtgggcggtgagaggtgagggagtcccggcgtctgaggatgaggggtgggctgatgtgagggtgaggctccgaggaggaggggcagagtcagggcgcatgcagcgcgcgcacgcgcggagctgaaataagctgaaacagcttttccttgaaataagcgcagctctggccagtgcatgcgggaagactaacaccttcctttatgctgctgacctggtttttcaatcatgactcagaaatgaccttaagagggagctaaattgactggcaaactatattagaaagaagagttcagatagaaaatatctcggcatttagattgacaagctgttcccaatataaccctctaaactccacaggtacagagagagagagagagagagagagagagagagagagactactttattaaatcatttcttcctttggtcttttaacatcctgattagttctttgagatttttatacaaatacttttatcatattcatctccattcttcccctaaaccctttccagattcaacccgacctccctaatccttacacacacacacacacacacacacacacacacagacacacacatacacacacacagacacacacacacatacacacacacacagagacacacacacacacagacacacacagacacacagacacacacacatacacacacacacatacacacacacacacatacacacacacacacacatatacacacacacacacacacacacacacacatacacatacacacacacacacacacacacagacacacacacacacatacacacacacacacacagacacacacacacacagacacacacacacacagacacacacatacacacacacatacacacacacacacacatatacacacacacatacacacacacacacacacacttacttcaagtctttttttaaagagagagagagagagagagagagagagagagagagagagaatccaatttttactgtccatacacccc

SEQ ID NO: 361 - DNA, 1925 bp, Mus musculus
tcctgaaaaaccaacccccccccaaaacaaacaaacaaacatgcactctacatgatgatcacttttactgtagcagactagagggcagaaaaattatgaggatgttactcagggaacacactgaggacccaaacctgcaccatacctcacaccaaggcgatcagctttgctattggcaaatgtccgaacctcaaaatactggagataaatcatttatgtgtgacgccttttgttttgttgtactagatggggtcttgctctgtagcccgggctagcctccaatgcagtctacttctgactcctgagtgctgagattaaaggagtgtgctcttgtgtccagtcttcttggtatctttgtgtgggggtgtagacaagctctcatgtagctaggctgactttcaactatgcagctgagacttccattgaacgcctgatccttctgctcccatctctcaagcaagcactactggcaacaccatgacttgtttattcatttattaatttcattttttccctccaggttttcgtgtgtgtgtgtgtgtgtgtgtgtgtgtgtgtgtgtgtgtgtgtgtgtaatttgcctataggtagctggtcccattgttttagggcctgtggcaaaactgaacttcatagctgggactgtgtgttgaagaaacccagctggggagaggagatttgagagtacaagaaagaaaaaggagagggtcctctatcttcaagtacagagcccagtgctctaatttccctccattttctgtcacctcctagaagactcaaccgagtactatcagcaggggaccaagtctctaccaagtgaacctggggggccacttaggatctaaatcttagcactagattcactattcccagtcctctgactggggagttgtgagggaggtcacagaaggcagtagttgagttttcttcctgactgcagcataggatgttaattacagatctatacacagttaatgattggtacagaaaacacatgctgagctcaggtgatgagtattagactctgaaatccttaactctgtcaggtgtggtagttcatgcctgagagccagctctgagggggctgaggtagattagttcaaggccagcctgtgctctgaccacgatggatatggcctaccccccaacccccaaatcatagaggaacaggaacattagtgaacattgaagagctagtaattctcttcagccaagaacccaggggatgacaggaggagccagcagctcctgaggaatgaagcaggcagcgcgtggctcggaaatgaacaggagattctttcatggcctggcaggaggggctgctggcagggccagggcgccataaaacccacaaagcccctctgtggtatgtagcttgctactaaatctgactggaaaaggagaagagggccaagattccatggaggccagaggtccagggcaagtccacggcacatctgctaaatcagctttctgaacatgttccatagtgtcctacagtgacatagccgccttgtttggggtaatcgcagcacttaggaggccatggtgaggaaaataaggccttcaaagtcatccttgcctagacagtgagcacaatgccaagttcacctcacaagtcatttaaaaaatttttttagcattttaccatttttatgtgtataagtgttttgcctgcatgtatgtttctgcatcacatgtatgcaacacacagccaagtacagattcccctgggactggagataacagttgtgtctcgtgggttcttggacttaaaccctagttctttggaagtgcagccaggtgctcttaagtgctgaagccatctctctgggccatcagtggtcattttaaaaaggtgatttcatgagtgttttacctgcatacatgtgtatgtaacatgtatgaatgcccgctggccttgg

SEQ ID NO: 362 - DNA, 2000 bp, Mus musculus
atgtggagggccgtgtatggtctcataagcgtatagctagcccagcctggagttggaaaccattctgcagcagatgtcgaggcccgtggctttgacctcatctcagagccttgctacttcttttaacaactgctctttttcccaaccagccagtgtttctatggtctctgctccctcataacttagtatttctagttcatgacgcctgctctggcttcctctgtcgcatgagcatgccatcagtatctcagtctgactaccagttctctctttggcaccagctcagactcttagggaaggggtctgactgaccttagcctagtcactttcgtccatggagtctgcatcaggctctgtgaggagtccaagctggaagcaggcagtttcctctagaaagagttagtcattttttgtttgtttgtttgtttgtttgtttgtttgtttctttcaatgtaaaatataacttggtttacactaaagtaactttttcattatttctggcaaatctcttctttctcatgaattgtgcacgaaggagcctcagatttcttctagtccagtgccttcattcagggctgatatttacattacaacggttaagtcctttgcaaaagcttttactgtagaacctaaaaaaatagcacatatctgtagtgaattttaagataccatatactttctatgtgacttgtaaagatgttactataggaatcttgcattcttcctaccatgaggcagttaattcctgactctcaccccccagcccaccccccacccccctgtgaataactataaatgtgaatgcaattctaaggctgtcattttagggcactggccatgcgcagttcaggacattgattcctgcaggaagggagacagccaatgtgagtcacacatttacccgtgctctctgcctcctgatactttcttgatcatggcatggggtgtgtggagcagaagacagatgctgaggagagcgcgagagtgtgagggagaagctgtggtgattggtgagagagcaggcagaggctttcaggcaggcttgtaagcatatttacagaattaaagacgccgctgtcttaatggatggacagacaggaactcttagcagaagcatagaaacaacagggaaatgcactaccagaaatgaaattttcattggatggcctgacagctatcacagtggactgtgttgctaagcaatgcatttggtatcttagacgcattaaaagcgttttgactcacaatgtgtttatctgatgtaaccctggtagaagtagaggaacatctgtatacatacataccttccagtttgctaggcctatagaggtgcattctgggtacatggatgaatggaaatgatccaatttgcagaaccagaaagaaacaagatttttaaaaaagacgctatagtaacctgtgggaatatgtcatgtgtataattggaatttgtgtgctattggaataccagaaggaaaaataaaagaggaagaaaaaaatctgaagagacagtttcagagtttccccaaatgatgggaaacctttgggttgatgaggagctgagtgagcccaagcaggttacacacagtagagtcaggtctagctccctaataatcatggctttgaaaaccaaagatgaaagcaaatgcattcatagcctggactgtgctcagcagtttcctgaggactgtcctcagaggggcctggcaagcatcttggggtcccgtgctgctgtagagtattacacctctcgttgccttgagttggaagcacgtcctggggtcaggagagctagtccccaagaatcttctgaaggtaacccgaccctgctctgcccagtgcccaaagcgcagaggggatagtgaagagctggctcttggccttggcaccctgcgcccttcccttttgcctcaatccacacatttgccccctcccaggaagccatttttaatctgtgcaactcatgttcatcctagcagtcttgtagttttttgcatatc

SEQ ID NO: 363 - DNA, 3500 bp, Mus musculus
caagggaataaagtttggggggcttgttgcctgggtggtctgcacagcttttattacagaaatcattattaaaccacagagagaaaatgatgcataaaccaaacaattgttcagctatttctcccgaatctcataatcctagattattgtagatgagaccaggcccccaaacatttaccatctgctgcttcaactctgctcatctgcgtcctaattccaagcagcctcaggaccgctttagttcttgggaagaccagccttaccctctgttaaggtgtacctgcccatcattcccaatacttgcttccagcttgggattctgggaactgggatcaagtgggaccctcttctgcacatgactgttgtgtcggatgtagttcacttcagtgtataactaggactgtcactatttttttttaaattgttcataaaaataacgtgaaaaaaataacgtgaaatgccttgttgcatattttgctgaagttgatatacatagtgtctgcctcaatctgctttattattctgttcagtctgaccttaaaaaaaaaaaaaaccaaacaagcaaaaacaaatgttgatagtgtgttcatgaagccagacataatgactatccatttgtgtgtaaatgcatagggccaaattgtatagtcatcacaaagttgacttcctaaatccaagtttagaagagtgtgttctgtctgtctgtctgtctgtctgtgtctatctctgtgtgtgtattcagaagtgtgtgcgagtggacacgtgtgcacatgcacatagagtccacacctcagccttggttgttgctcctcagggactgtccaccttgtttacttctttgaaacagagtctctcactgtgacctggggctcactgatcaaggcagcctggctcccaggagcgctcctggctctccagtgctaggatcatgggtgtatgcaagtatgcctaggttttcacatgggttctggagattggcctcagctcctcattcttgcactcatagtgctcttttgggcttttaaaaaatttacattccagccattgcccacccccaatcaaccctcccacagttcctcatcctatacttcctctcccttgcctctgagagggtgttctccctcccagctcccaggagtcccccttcctcggggccccaaggctcttcttctcccactgaccaggcagtcctctgctataaatgtatgcagagctcttttgtatttttaatcacatgaaatcagtagactcttgtatctgcaacacacacgcacacccccccccccaaacacacacatacacaagttgtcatgtgtatagctggttctcatcactgggttccagctcaaagatatccaccccagggacgacttctgcagtaatcttctccataactctgactacgcaatacttttaaaagatctgaaataattttactcattcgttagtataaatagaagctgcctcataacagagttgctgcatttttctcgtttgcggtactagcacggggcctagcaattggtttcttacatgttgtacatgtagcatggggcatgcctgctggctcaagcatgtgatgaatccaggtaagtatggtcactggcttagaattcgaacggtccagcctcctgtgtttgtgttcttggctttcacaaagcccagggtgacactgctgctctccccagaggtccctgtcatatccactttgctaagcaatctttcctagttggtcagaattaagtccaggacagaagctccctaaatttcttctgcttctggctgaaagatgaaattatcagccaagctgaacgaggcaaaatagatctgatgccctgggcgaggctggatgaagtgcccagcagttactgtcccatgctggttgtcaaacaaaggctatattcctcagaagtctcttaataccttgcatgcccccctcaacttcataaaaagggtggacctgctcagccactgtcaaaaccaagttctcaatgacactaatgctagtttgtgatttggggctttgatgagtgacgttagaccatactgatagctactttacctatggagttatagttcaggaaagctttggttgtatgagcgagaagccactcagactcaataaaacaagaagggaataactgaaattcaacaggggcagccataaagcacagaggcattaaacagcaagctattattgttgactgttcccacgccatgccgtctccatctgaagcaacacagccttgcatctcttctgacttctagagctgagtcacaggttggcttctattcttatccaagagccttattttctcccaaaacactgacttatatgtgttatggttcttcctttgtcatgttacaaagtacatttcaagtctgtgagacttttcagcataagcacccaccaatgctgacttcagtctgctggatcaatcactcgatagacataattgtcagaaagttcgctagctagttaatgtggggacttgtttcggaagcttgttcttgttttaaacagctgtgatgggcagcgctgtcagcttgacagaatcaggaggtgggcctctagaaacgtctctggggcataccttggttgcattaattgaagcaggaagatccacctcttttgggtgacagcattacctggcctgtatcctagattatacagttggagatggagacttggttaatagcacgtattcatcgcgcttagctttctgattatgggtataatgtgctcatctatttcaaacctctgttgccttgacttctccacaagagatggactgtagccatctgtaagccagagtaaatcctttctcccgtaagttgctttggtcagaatatgttataacacaacagggggaaaaaaaaactaggtcaagagatccagctagagagctgtgatatataggatgttcctccaagttagtctatctgttagactctttgagatggactatattaatgagagaggtctcagaacattcaaaaatgcacagcatgatgctcttgctgaagtgatgtttcacgtttggtcatgctttgcctctgtggtttagagcccacatcaaaggtttgccccatcctctacctggacattatttcccaaggaggaagtgggcttcatccgtatgacgggctctcatggtgcttcactgttgtattctactgtatgtagcatcaccaaacacacagtcacatttgggtgtggacaccttctgtcttagatatggaggctttcaattatgaatgacagcaccactgccacaaggcacatctaaaaccacatggagttgtttcaatgactgagaacagctactgactttcagtggacaagggccagggcacctcacttcctaaagtagtaagtcccttgcaacaactacttgtcttttctaaagtatcagcaggaggcacactgaaaagcataagaagttggaaaatcacggactggtgagatggctcagcagttaagagcactgactgatctt

SEQ ID NO: 364 - DNA, 1975 bp, Mus musculus
ttttattttctggagtccaccttcttgcgttctttatatatattggatattagtcccctatctgatttgggataggtaaagatcctttcccaatctgttggtggtctttttgtcttattgacggtgtcttttgccttgcagaagctctgcaattttatgaggtcccatttccacattgtattcttaataattgactcatgtggtgtggattcaaggcaagctgagtatgtgcacgtcatcatctgaagtagtgcacatgtgtccagttccttagcctgctttatttgcttcattcactcactactatggaaaacacatgttgatttcccctgaccttgtccacacctccatctctttccagaagatgagctagaagggcaaagatctcagctgtctcatgagccaccatggcacctgatacatgcaaatgtctaactgtaaacatggaatgacagggatggtggctgacccactttgggtcaggaatttaaatgtctgcctgtcacttgatcatctcttggacaaatttcttcttaagacagaaaagacacagactgtgagacctgagacttctctgaatacttgtgaagggtattgaggatggtttaagatctcatccaaataaaacactttggttcaactagtgtgcacacacttcatgggcccggatcttttggtatgtacagagaaaatgtaggccatgcctgcaaggtacagcctcattataaagccttaaaattctctaaaacaagaccactctctgactgaaacatactggccgtgactgcttttactcagtgaggaagattggggacagtttctggaagcagcctctggtggcagggtagtactgtgtatggctagaattaaaggcgttcaaaggcatttggggaaaggtaaagcatcagatacatgcacaaccttaacctaaggagaagtaagtcaggctgagtggctcaaacctgagaggtgggagccataggaggatcgtgagcaaggggcacgggcagaaatccttctctgtgaggcaagccagcagtgtgttccgagagactgggcccccattgctttcctttttagttccttctagactggagcctcggaaatggagaggagagagaggcagtgtctgtaaggtggagaatccttttaccacatgctgaagcagtgggggtggaggggaacaagcccgggtgacaggctctacttgtgccactctgattagctgggaaaatgcaaatcggcacttccttctgcagcacagctaacaagataatgaatattttcatcagctgcagagaatacaaacatctgtaggaacaccaaacctactctcccggggtgggggaggaagggaagatgtgggggtggggaagcacgattctcagcagttttaaggaagaggagctgttctgggagcctggcagagtagctggaagatggaagctgaggttggagtctccagtctgtgacacattggggatcttgtaactgtcaacttgctccatgtctaaccaatccttcatggctggtgtaatcttatagtcctggcggaatttgtggactaccagccagtctattcatatccatccctcatacgtctacttgtcaattcaggaaacaagtacaggatcctgttgtggaccaggcctgaatcaaggaccacatgggtatcttttgcattttgttttgtttgttatttttgcttgtctccaagaacccagttcattaatatatacattttattatttcatatcatatgtataactgctacacacactccagtgaagtttgcttggcaggccgagaggcctggaagcactctcgaggcaaagagtttcatggaaaatcacctcctggagttttggcgttcttattaacctatatactcataccctatcataccctatccccgcgttagtctggtgtatggatccacgtgctctcttttagtattattttattataagtgccc

SEQ ID NO: 365 - DNA, 2725 bp, Mus musculus
tttgcagccactctaacacacaatttctttccaaaccctttgtttagaaactcaaagtgtgagagcaaatgggaatcagtgaggtctgggcatactacaaaagacagacagggaaaaaaatggtcaggaaataacaaaacagtgttgaggagccaagtggggaagtggagaataaggccctcatagttatgacaaggaattcactttaacaagcttgttttccattctttccccccagctgatctgctgacaatctcattccaagtaaattctctggtgtcatacatctctgtttttccatctcattttctcacacctattttatttccattccattaaacacagcctcctcttccttcctgaccactccatttttttttttcctgggctcaggatgcttcccaagtggcagacttctcagacattccagtcttctttttgtattggttaactaattgctttcttttgatctattggccatctaggggccagggcaagcttttctcttggaacagaaatcattttagatgatatgaggggaatgagatataaagaaaaaggatgaaaagacaatgtactccaaagacgacaggaagaaaacaaccagaaagtaaaattaaagatttagcagctattcacagaaattagaaggtgagaaagaaaatgagtgataaataaatagaggaggagagatgaggattttaaacagtgagagacaggagatgcaagaaagcagacaaacctgagcaaacaggaaatgaccgggatgagggagaacagaaatgtagccaggacagggacaatgaaaatgacacaaagcaatcagactggttgaaaaagcagtaagagagagcaagcagagagatacaggagagatgagggagagtgaggtgaagggaaagggggagacagagaaagagagagacccagcaggaagaagatagatgtaagcaaaacaagattgaaaagaattcttagagaaaaatgaacaagctatttttttcaagcccatctcccaagacctatacaaacaggacatttcatttaacaagaaatgagtgcattaaaatagttgaaaaaataagaaaggccatagctctgtatattctggggatattgtttggttgctgatgtctctcaggaggctccaagttttcatctaagctttcagaactatgcaaacatcatcacagcagctaataggaactgaaaatggactaggtgttcacactgtgcttagcacattgtgcatattgggattctcaccagtaaagccatgatggagttactattaatacactcgcctggaagacaaggatttggaaggttagaggggataaaatagaaaagaaaaggaatgcctaagcttgcagtggttctgattttaaacactatatcaaacttcagcaacttaacaccataagtccatgcttttaataccaatttctacaaagaaagcaaatagcctgggagccgaactcctcagtggacaaaagtaaacaaagcttgaggagaattgtgcatataacttctatgcattacatggtcagaaaataatggaaataaatgagacagaaccctggcttccaagagaatggtgtggtaaagattggggaaaagatattgaaatgtatatgttggatctactgaggagagcagaggcctgaaaaagcaggagagctgctggggcaacgtcctacagaactacatctgcacccagaaggcagggctgatcctcagccctctgtgcactttccctcccaaagaagagcttgccttcagaaagtgtctgacactgggactccagcgaggtctccattttctctctggtgactctctaaggctggtccacttaggggcacacgggctgcagaagtggcagaacagttgggatagggccctatgggtctacatctgtagccaagaggtggggctgttccaaagccctctgtgcactggtctttccaggagagagctggtctcaaggagttctgacaaaggcttacagactcacaggaggaacaagctccagttagagacagcaagaacatctaacaccaaatattaccagatggcgaaaggcaagcataagaatcttacaaaaagaaaccaaaacccagtacttccatgacagcaagtcctggataacctaccacaccagaaaagcaagattcagatttaaaatcatgtctcatgtttcttgtagaggattttaagaaggatattaataactaacttaaagaaatagaggagaatagagttaaacaggtagaagcccatatagaagaaacacaaaaatccttaaagtagtacaggaaaactccaccaaacaggtgaaggaattgaacaaaaccatccaggatgtaaaaatggaagtagaaacaataaagaaatcacaaagtcaaacaactctggagatagaaatcctagggggggaaaaaatcaggaaccatagaggcaagtatcaccaacagaatacaagagatagaagagagattctcaggggcagaagatttcatagaaaacatggacataaaaattaaagaaaatgcaaaatgcaaaaatatcctacctcaaaacatccaggatatccaaggcacaatgagaagaccaaatgtagggataatatacccaaacttactgtccgaagcttcagatggatcacaattggattttgtcattacaagaccctgctcagaataggtgttgcctgtcattgccttgt

SEQ ID NO: 366 - DNA, 5075 bp, Mus musculus
tttcttactgcattacttgctcttcatcttgcatacattgatggaattcaaccacttcctcagcaaaacacacacacacacacacacacacacacacacacacacacacacaccacagagagagagagagagagagagagagagagagagagagagagaaagagagagagaactaagatgtaagaagtcacaatgttaaattttagcatctaaactatagattacgatatttcaattcaagagtaagaatttgtaatcacaaagacatcaaaactcttaaaaaggcttcatgtcaccatcattctaacataaactcagagaaaaatgtaaaactcaactctcaagtaccccctaataattgctaaggcactatcaagttagtaattttagaaattctcagtgaacaatgatggataaccgtaactcaaaatggttctctttctgaagtgatagtcctgaacaaaagcagtattagctgaaaaatctaaacgagctaaattggctaagtgatattttccttcctactaacaaaactgtgtattttcccttcatttctgctttcatttctctcattttctattgagtgtatcaacagtcgcagtaggacgatgagacagtgcaacactatagaaaacagtatgacaggctgggtgtggtggcactgttctgtaattctagaccttagaagtcagaagcataaggatcacaagtataaggccaatctggactacatagagagatccctctaaaagaggttagggcagggagagtatagctcagtaataaaaggcttgtccaacatgctcaaggacctggatttgattcccagcatcacagagaaaagagggaggaggaagaaaacgttctgtatattagttatgcttctccatttccatggtcaaatacctgacaaagtaacggaagaagtatttattttgggctgttctgagaggttgcaatgtattatggcaaggaaattgaaggtcaatactacccttgcaacaggaatcaaagagttgtgaatggtgctgctcaacttgccttcagtcaggtaccccagctacctaccatgtagaatgggtctttcctgcttagttaaacctttctggaatcaccctcacagacacactcagaagtgtgtttccatagtgattctaaatttcaacaagttaacaatcaaaattaaccatcacatatggcagttctcaagaaattaaaaatagaccttcctgatgacccaatatttctgagtatctatgtcctgaagcactgaacagggttgcagaaagattccttcccttgtcactgtaacagactacttgatagaagcaacttgaggaagtggggatttatttttgagccttccttagtaaatatagcataacatgacaggcaaggcatggcaacagttagcacaatctatgggcacaggaatccaggctgtctcccaatatctcagtggttcaggatgcaaagtgtgtggtccagaagaggcattaggtatatccttcaacacttacactacagtgacccctaggctccatctcttaaaagttcccaagacagggagggtatcaagtcctcaaacacatgtgactgtggaggacatttcactttcaaagcataagaatccaactgttcaatgataagtaaatggatttctaaaacatggcacgtgttcacacacacacacacacacacacacacacacacacaaacacacacacacacacacacacagagagagagagagagagagagagagagagagagagagatccaacagcatattttaaaaatgaaaggttgtggcatgctttaacataagtgaaactttcagtcactaaataaagtgaagccacaaaaagacactattgtataattgtacatagggagattatctgcagtagttaaattcgtaaaaacaaacctctgaattaccaggacttagggaactataatagggagctttagaaggggcacaaagttgttcttgagataatacaatattactgattgtactttagtaaattccaaaggttttagcggaaaactaacattatatactatgcccatacacatgtcttaaccaaccaaggatttgagggaatctcaatgctgccacttgaatatcagctcacatctaccacttccttttttctactcttaagctgaagctgagagaagtatgcttattttccagaccaattttgaagctaggcagtcttaaaatccaggcaagagtatggagatgttcatatggtgttaaaggaaagtacagtacagctcatgcttgctgaaagagaaacatctgacctggggacaaagaatgagaaggtatgattaaggcaaggagacagcatgaataggatttggggacaagaaaagtaccctagagattttctttcttttttattttattttattttattttttttattaggaattttcctcgtttacattttcaatgctatcccaaaggtcccccatacccaccccccccaatcccctacccacccactccccccttttggccctggcgttcccctgtactggggcatataaagtttgcaagtccaatgggcctctctttgcagtgatggccgactaggccatcttttgatacatatgcagctaaagataagagctcccgggtactggttagttcatattgttgttccacctatagggttgcagttccctttagctccttgggtactttctctagctcctccattgggggccgtgtgacccatccaatagctgactgtgatcatccacttctgtgtttgctaggccccggcatagtctcacaagagagagctatatctgggtcctttcagcaaaatcttgctagtgcatgcaatggtgtcagcgtttggaagctgatagggcaagaagaaaaagcagaactggtgattgcgagggctgagtagccatgggagaattttagaatcacaaacctgcattataaaattatacctctggagacaatgttgaaaatgtctgggaaagaatgaaggcaaacaaattttagcagcctgctaaaataattcactcaagagacaaacacaccaaagaaaatggccaagactatgctcctactaatctggccacaggaagttcatcatcacctgtacctgaaggcagcttctgtcttaaaaacctagggttctttttacgggcagtaaaaacaaataaatcgtgtcagtaaattatcagtgcctctaatccagaaggtaaggaggtatataaaagcaaaaaccctaatataacattccacaaaaatgctttcagatttaggctgcataattcacaaaaatcattacacttttcacataagaaagcaccttcacctgtacagtttgtccaaaaacaattttcatattttctcttccccaaacaattttcctaaccactttaatagcttctcagacctggagatagtgcctggctatgtagaggcaagtactgcttttcagctgagtaaacaaagacagacaatgagggtaatgtggcaaacaggcctgcccactcagatattttccaaagtaggaattcatgctgggctccctcagtcggaaagctctggagaataaacattccagatatataactgagctaatatcaaagccatactcgatcagcactacactcttattaaatggacagtatgaaacatgttggcaggtaattatgagatccaagggtttgaaaattcaacagaaataaaaaggtaggcaaagtgcatattttctgacaacaccagacctagcacacataaaacaattttgcttacctagagaaatcaggaaaaataaggccactcacaatgaaacttatttgtatctgaggttatactcttaagatcaatggcttgtatcaaacaaatagaatatttgccttggatgatgcaatgtttgaggcagcttctctatccttttctctcattcaaaatgaacagtacattcctatccaggtctgctcagacacccagggtgctaatgaatggcagtccagactcctcagtgaccgagcaacaaatatcctggactttaaaaagaacattttgtaatgagaagttcttccaccaatagactatttgcttgagttgttttcatagttgcgaatggtcttctgttgtagatcaaaatatcttctttattagctctaaagtgtctcaagttagggtacgacagaggaagaagaacataaaaattagatatttaaagtaaaaaccacataattgtaaaaattatgtgtgtaataagcatctgaaaagaaatataagggactggaaagatggctctgtggttaagaatactgggtgttcttatagaggacttgggtttcattctcagcacctacattgtgactcacaaccttctgtaattccagttcatggggatacagtgccttctgacctctataggaggaggcacatttgcggtgctcttagatacatgcaggcaaaacatttatgcacattaaataatatctcaaaaaaggagtacaaatactttctcacatttaatatatatttatggataagcattgttcaaataacagatctcaataactacttaacatattgatctcatgttgataaatcatctctttgaaacagattccttacaatcaggaattatattataatctgtagcaggtactatcaaaacagtcccatggttccttgctacctctatcctcagttgggctatggtagatatttaacagtgcataagagacaatgacacaaagccatcaatttatattacaaaaaccagttaaccaagcagctcaatttttgctttagcaaggtaaatgggtggcagtgttgataaggcagtgctcaacttggggtaatggcagttcagattggtagcaaaaaaaatggggtcactattttgtgcatttttttctatgttcaaaatcaagtttctaaatttatctaacagtaagcaaacaaaaaaaattctttagtcaaaaaagaaaatgatttcctgaatctccattaaattacattaagaaaaatgttaggttttatttaaatacaatttggaatggagaaccca

SEQ ID NO: 367 - DNA, 7850 bp, Mus musculus
cacccaaggaactaaagggaactgcaaccctataggtggaacaacaatatgaactaagcagtaccccggagctcttgtctctagctgcatatgtatcaaaagatggcctagtcggccatcactgcaaagagaggcccattggacttgcaaactttatatgccccagtacaggggaatgccagggccaaaaagggggagtgggtcggtaggggagtggggtggggggtatgggggacttttggtatagcattggaaatgtaaatgagctaaatacctaataaaaaatggaaaaaaataaaataaaatacacaatttatgatggtaaaacaattatgttaacatctactgcaatgccatctctttccacattctatgaaatacagtctttgcagtccaaatttaatgctactgtgactttcccctcactttatgctaccctttatgatcgcctgtgctttcttatcacatagaactatggtttcacttcaatgctgagtctgcactctaagccttggatgttaggtatctgcattgttcttgccaacgacatttctgtgaggtctgtgtaagtccctcttaaatctgccaccccctgcataatgtttccttctgcttagaagaagcaatagctactccctgacaaattgcagacagaatagaaaaatcaaaaatacaaatctatgatcacaaacttcacgcctcaacttcctcctcagggaacatgttatttcactattctatgcataaatccccctataaaatgctacctaaccccttcttcccactatatcaacatcacggtccaagtctgtctttcactatacaaacactttaagacaaacattatggtttcattcagtttcagggactgaaaatatccaatatacacagaaataagataataaatacatgcattgcaaagacaatactatttcaccttatccaaatctttaaataagtataactatctggcttctctcgtacaacccttaaattcccttagtgatttaagagacaatgggatctacagactataaatgtttacagttcagaaggtcaatattgacattcaaaggatatatcattttacaaattctgttcatgtgaaagccagagtattaatttgtaatgaattctctactggtttaattcatcttgcctcaactttccatggtctttatctctcctgtaatatttatttcgtccttctaaaaaaatcttgcaaagtattttacaaaaatataaaatgatcacatttatactttaatccctgtaaaacgtatctgtgacttatgccgcaatgttacagcttgattactttaaaattcctagcataaatagaaaggagaaataactgctgtgttatataagaaggtggcttcatatgagctcattttgttaagcacaagtatttttaattaattttaagtgaatagtgcattgacaaagctcaaaggtcacagaatatgaatatcaccttctcttcctcatttctacatgttctgccacctctttataactttggactaaacaccattgttatttatatctgcttatcttttcaaagaatatttactcatataaaagcagactctttaacccacttccattttttttttcaaatagaattatataacccttgatgcttaaaaaaacgtgcatattaaaatcatagtgacatcccttatactccatcttaaagtaactgtttctagaaaatatgagttatatactaacaagagaattcggaatttatatctgattggtttatagtatgtaaataatgctttaatccttacatattatttgataaaaatatgtacttcagcattcaatgctctcctttatcttaaatgtattaatttttaaaaataagcaaagatctaagttgtcacccttaaagctaaattcctgcgactatctgtagcatggacaaactcgttctgggaaatttttcagaaactgcttaacagttctaagtacaagcaatgttcagatttatgctacccagtagagtgcttccaaaagaacctatttaaaaaaaaaaacacagaacactaaccacttatgaaaacaagggttttttaaatagtataactgttggctgaaacacttcgggtagaagtgtttgggtagaaaataactttttttccaagatgctgtgatattttgtgctaatatttcacacctaaggtgttgttttcttcatgcagaggcagcaatcggtgggaaaacagagacaacacaaaccaacacacttttttttatcttaagtcttaagctaatttgcagcatggtgattaatgctttaatcaagattctcagggttgaaaattaatcatttcatcatctgaatatggaatatatgtggatggaaaaaacactataaatcaaaggagaaaagtgggacagttgggtgtttttaaattgttcatttttcaaagaaacctctgcccactttcctgctaaaactctgcccactgtgtagtagccaagatgcagtgatatattcttctacttttagtcctttcgtgatcattacttaaaaaaaaaaactgtattaaaattgatacatcagctcttcctctgcttgtaagaacaatgaaattatttacaaagggtcatggacacagagagggaaacatgatcatagcatctgccattgagccttaatagtgaagattctatggctattgataaagatgtatcagaaggcaagagaaggtaatggagaagggagacagtcaatgcacatgatctaacatgccctatataagcagaactgtgcactgagacggaaacttaggagtaaatgtggaacttgaaggttatatatagtgaagaatactgagaaggaatggcccaacataccatccacacatatatatgcctactaaagacagctgtggccagcaaagccaacagtcatatgtatgattagttagccagtttcttggttatccactcatttaaaggtgctttggggaggacaaattcttaaagtagttactccaactatatataagaagagtatcttctaagaattgctaagtgtagtgacttactagggacaattagccaaagagttcatgtcagacaacttctgtccaaacaataggtagcctgaacatgttgaagttggattcccattcaaaggatggccccgacattgctgagatgaacaatttctgggacccaggctttaatgcagatgatctgtaggacaacaagaagccaaatggatgtgcaaaaatctcacttgtcccaagtccttttcaatctagtagctactttgggcaagtgatctgcctaacctgcttctgggaatacccccttatagaagtaatagaaagaaggaagatatagaagactgtactatatctttctgggagagatactgaatgtatttcttacttttctattgccatgataaaacaccatgaccaagtcaggacacaggcaggtgtggcactagagaagtagctgagagcttatatgttgagaaaacaaccacaaggcaggcagagagctaactggtaatagaatgggcttttgaaatccacaaagtccacatctaatgacacacatccttcaataaagccacacctcctgatccttcccaaacaatgcaagagaaacatttaattatatgaacaaataggggctgtctcattcaaaccatcatactgtgtttcaaaggaaactgcttagatgtcagaatgaaactaagacagctatatttacttactaatacagaaagctgagctcctcttaagccactcctgtatttcactgacattggggttttataaatacttacttaaaattacttttaagtcttagcttcagaaatactttctaaaactaagatgagtcattgtacttttccagtgcggtgataacaattgaatgaagtttattgggaattaaatgaaacacgagatgtttagcagtgtctgtgacctgccatctgttgaattgacagtggcttctgttcttatgtccttgaaaaggcaggctctcagaaatccttactggtacagtgtaaaaacaaacaaacaaacaaacaaacaaacaacctccgttctctaccctggcaactaatacaatggtagatccatgctgaatacctcatgcttatcacacagcctgttgctgccaaggtgaaatggcaagctgatgcataaggagacaaaagtacagctttgatgaatgaacatgacaactatgaaaatggatttaaaaatgtgtatgccaggggctggagagatggctccatggttaagagcactggctgttctgccagcaaacacaagttcataagggagttcagaactgtcattaataactctgatttcagggttttctatactttactctggattctgtggacttcaagcctgcatgtgaatgaagcacagacatagatccaggaaaaacacctatatgtgtaaaataataagatatttcttaatcactcatgctggcccataaggttggtatgatcacatatctaacaaaataagtcaattacaagtaccaaaggagataccacccaaagaatacactttcccaactgagcaaatgtcctacttaagtgctttcttgtaatacatcacagataactagaatttgtgagattgatgtggaagcatttgtgctcaacagtcaaactgcaccagttccaggggtgaatcatggctcatttgttgactataccaaaaataaaatgtgtcttaaacctggcctaccacctccttactaattctggtttctaccaccattcccgaggaaatgctaacagtctcataccctggagtacccagggcccataaaaacatacaaaaatgcttctctgagaaaggacatgaggtttactagtcaatgccattgttcaatagtactgatgttaattggttttcatattgcaaaataaggaatataattaagcaagacagaagttctaaatctatggtttgttttggacaattgaactgcttatttttttgcttaaattgtactgttgagaagaataatttttgtttgaaggatttagattgcataaatgattgcttctctttcctactgactccttacagcactcaggaagcctgcctaaaactaccaccatggccccataaaagtagagaaactctattaagcagattggaagtacttgacacaattatatattctgaaatgaaaaggcaggctcgctgaccctggctcagtggagacttagggaccacaaatttggtaggtaaacctctcctcttcattttccaagtacaatgtactgacttatgaatactagtttagtttgcaaatatatagtatgttatgaagattctttctatgtgataaacactattatgtaacttacacaatgtgaaattactcattctatattaatatagtgagatccatgctgtaccatattgtaatcgatctgctagttgctcatgatagatttctgttgtgttcacttttcccatcaaaagcccaatcagtacagaccaacctaggattgagcataaagcttaagtagccctggtcaagtggagtaaaaggatttttattgaaagtggctacaggctaactggtcctattttagacttctttgatgggtggcattttaagagtcggtgagattaggccaaagctatcctagattttcttgtgagtttattctttaatattagattaacatttgaatcagtaggctttgtccaaaatggatcacttttcataatgtatacaaactttatttggtcaacttctggtcttagaagaaaaacatgtaagtctcccaagtcaggaaagataaattcagccaagagatgacttcctgagttgtgcagcaaagtctcttcttcgatagcactgtcccaagcactgcagtcttaacagcttctaattcttcaaaatgaaacaatttttcagacacaaggacacatatgaactctcagtttgcaacagacctgtgcaagtcagggaaaagtccagcatggaggggagaagtgaacagaaattcccacccctaaatgaagaactgctggtcatgaagagcttccagaaggagaattcattgtttataatgatgtggcccctggtaggtctaatctgctacagtagatagccacacactactactgggattcattgtaaacaatgaagactcatagttgggtggttgcataagactggtgagccttagcttatgggtacccccgagtaaaacatgtggagctgggaatcgatgaaaaaagcatgaagaatttattgttccagtgcactagtgtcatcctagacctgaaagtgaggcagcaaccccatgcagctcattcagtgagctttttgtacagttttcagggcagcagccattaggcacaatgtgattggcagaacagtgtgactttttaaactgattggtctttagggaatgagatggcaaggacttcccttgtctgatggtggcctatggaatgtgtcccacccgaaggttggtaccccccccactgtggtctgaggaatattaattagcctctcccttccagaggggcaagtgttccatgactttccaaaagtttatgagctgaccttttcagatgtagctggaggaaatttggaaggggatgaagattacaaaagtatagtgtatgaaattctcaagaaattaataaaaatattttaaataaataaatattgtatatacaggggtatttgaaagtgtgtgtctatgtgtgtgtgtgtgtgtgtgtgtgtgtgtacacttgcatgtgtatgtgtctctgtgtgtgtgtgtgtgtgtgtgtgtgtgtgtgtgtgtgtgtatgtgtgtgtatataatcactaataagctcatgcatgctgagctgattctgtttctctggagaaggttggcttacagctcattaaaataaaaactagtaaagccagttgtctgtattttcacaagccttgcttaacaatactgcatcaatttcatttgcatagagctcatatttcaccaggaggaattggaaactgtaccactgtcacaaagtccacattggacccttactattccaaggtccttgtgatttccattgaaacagtgtagacaagaaagtgtagagcagaaatcagagtctgttctacattagggcagaacaaatgttcaaagggtaagaatgaaccacggccaaagggaccactgtgtgtgttgtgatagtcatgtggttccagaaagaccacaccaggacaagcagttccacttgaagttcattgagagagaaaaggacaaggtggcagcagaaagaaaagagggtaaaaaaaaaagagagagattagacaagcctcccttttatatatggatagtgacatagacacaggtaaaggtgggaggggagccaagtggattctgggaatatggtggctgttgccttggcaacaggtgtactggtctagttgtcacctatatgtgatgtcactggttttggaggtcctgataccaacagtagtggatatacttcaggccaactttataccatttctaattttcctgagggacattatcctatccagataattgccagactccattggattgactcctttagaagtctttgctatttaccagaggatctcttgctaaataaatagcttcataagttataggattcttggaatcaagtgtatattcttatgaattaatgattctccatccagtttagccttgcaaactgtggtggtttgattgaggatggccctatagactcatatttgaatatttgattcctagtttctagactatctaggacaaattaagaggtgtggccttgttattgaatctctctctctctctctct

SEQ ID NO: 368 - DNA, 1800 bp, Mus musculus
aaagatacagaaagaatatatgattataaattgtaaatggtgaagacaacagtgtatacaagttaacagttgccaacacacacacacagcacatacacatgcacacacacatacacataccctatacatatatacacatacaaacacacatatgcacacatataccacacacatacatacacacacatatatacacactcatacacacacacacacacacacacacactcacaccccatacacacatacaaaaatgtgggacagtgagctgcacacagacagtctggtttccagtcgaacataggtcttgaaccccggggtatccaatgggtggtgatttccacctacattggacagaaggtgttcaatcatgtctcctggacccctggctcctgtcgaagttaccgcccccacagcacacccctccccgcaggacgggtgtgtgactatcagtcacacagacaatgtcccaagctcctagcattctggctagactccacccccacatttacctgactatagccaggtatgctcctccccatagttacctggcaacagcaaaatagcccagtccactataaaagaggctgcttggctcctgcttgctctctttaagctttcacctttcttactctcatctctagccctccttctctctctccctttccccctccctccacatggccatggccggcctctctccctcttctacattctctctttcccctgcctttctacaataaagctctaaaaccatagactgtctctgctcatcaaggcccaccgtgcttgaatgatgggataggctttcccctaacaagcctaacctcccgctagaaagccctcctgtgttccagccacagactggaccaaggactcttttgagaaccacacagcacctccctctccctctgacctcttctcccttcggccccagggctgactgatctggggtggggggaagaagggctcccatttattctcagcttttctgaggtgtccagtggtgtctgggatgaccgaggctgagaacctgatacctaggactgccccttgttcaccacctgctgagttggggtttagtggcttcacacagccagacacccacccagggctacatggaaagcatgcggcagtccttccacatccacctgcccagagcaccagaactctggcaggatgtgggccatctcccactccctttattccctcatgatctctccccccccccgacaaaaacacatatacacacacattcacacatacatgcacaaacagacatatgaatatacatacacacacaaacacacacatgcacacaaatatacactcacacaccatatacacacacacacatacatacatacatacatacatacatacatacacacatatacacatacatgcatacatacatacacacacatgtgcacacatacacgttttctagagaagagtgacagtccatatgatcagggaaactcgtactataagtgactactccatggagacaataaatttaaaactgaatcttggaagattcagaagaagacacttaggcaaaaagccaaggggttgggggcaatgtagctacttcaaagggggtggagagcatatttagaaagagattctccagaagaaatgaaatgccaatagttcactagctgttactaaaacatgtgttttgttcaaagcaggaacagctactgtgaatggaaggaaagatcaagaagcctgctttttcaaattcagagagtgctttgagacagtgaaccagagaaagcactgagtagagttcag

SEQ ID NO: 369 - DNA, 2050 bp, Mus musculus
acagttccttgttccctcttcatttagcttttccctcttagcagatttttttaaagtatgaagagcagtcactactctcaagcactatgccctatgctcaatccctagaacttattcatcttgcaagaaatttaagaacttccatattttctccccctcccccactccccagagatctcggttcaacgcctagtctctctgaattgagctcttttaaaggccacgtttaagtgacgtcaacttttctttctgaatctaaattagctcactaggtggtatgattcaaatccatctatataacaaacgacatggcttctttcctttgtaaaggctaaatatctcattgtgtgcatgcacatttttatctaatcctttgtcactgggcatttgtattgtttccatgcctctgcctttatgaataatgctacagcaagtttgagtgttcaaacagctctttgagattctcagcattcccagaaattaggctcctggatagtgggtgcctcttttatctgcaccctcacccacacatgttatcttttggtttcaaagtgcagcttagcagatgtgaactgatgtctcttcagcattcctctgacattagcgataccgagcagtttcacagactgttagcttttcatattttacaaaagtgtacactcaaattcttgtcatttggggtcatgagagttccaccattgagctctatgccattcttatattttacatattaatccatcaaatacgtgatttataaatattatctcccaatctgtctttgcagttcattgttttctttactatgcaagtttttttttttcatttcttaacatttacttaaaaaaaaaaatatggacaggtatgctcgtgccacacacatgagcagacgtcagacaacaacatatatgaatcaatttcctctttccacagcttgagggtcctatggtctgaactcaggtcatccggcttgtgagcagtgccctttacccagtgatccatctcttcagtctgtctgtctgtgcagcggaggttctcaggtgacctctggccaggccaagcaggaaggttcaagcaaagcaggaaaggaatgagcagtgcctccatctcctctgctgcagctgctgccttgccatccactgttgctgagatactgcactgagctgagcctagctgggctgagccagcgggagcaggagcaagagcgggtgggtgggtgttagtgaacagagcgcacgggagcttctgctggcgaaacctttgggagagcattctcttcctaggcagtgttacggctcttgtgaccgatattctcagactacggagtaattctcacacacctttattctttctgcataggtccttgaggggctggggctacctgacagggacctggagtccggagcaggtgaagctcttaccatcccttcagggtccttggggtttcaaacttagctcaaccttaccaagcttcctctcacggtcacctgcctcacaccagtccaggattattttattaattttaatttgttataattgatttatggtggatggacagtccatggtcttatatattgattttataattgggatgtttttttaaagttttaatgtgtgtgtgtgtgtgtgtgtgtgtgtgtgtgtgtgtgtgtgtgtgtgtgtaaaatatttactaatttctgcatgtacaagcatgttttctgtgtccatagggagctggtttttctcttcctgttttggatgctttccctccctgcacattctgtctcaaatcttcattgttatgctgactagacatgatgcccgttggcctccttgtttgtactgaatcatagtttccttcctgacacgttatctataagtttacatttctggtccttattaccttaagtttccttggtatctatctattttaatgagagtttgacctttgtcagatgtttttctgaatctattgaaataaccatgtattttccactatttagaaagtctagcctagagttcactatgtagatctgactaacatacagctcacagaaatcctccaccttct

SEQ ID NO: 370 - DNA, 2400 bp, Mus musculus
cagagccacaaagtatcatagctaatagtcatgttcttctctacgtatcaaatttcttctatgggaagatttctctcctcttatttccaggttgaatgataatcaaaagaaaccatcacaaggatttgagactaaacaaacaagaggtccgacaagggcagacggaatcacaaaaggtatgctgcccggagatgacggcagaacgtcgtttgcctggttgcagcacctatcaattcacatagcatctactgcttccagtttcttaaatggtgacccaaactcccaactgcctgccccgtttggagccgcaggcaggtgtttgaggggaggggcagaccaaggaagagcaaccaggtgtacactggtcatttcctggaccacctaactaatgccaaccacactcacagactccaaaaaggctgttgcttcacggacatcagcagaatgaatatcttctgatgaaacaggctgggcacattgctatggctgcaaaaactacaagcgttactaccgtaataaaagcatctctacagcattgcccacactctgcctccacatcttcctggatgtacatctctaacctttcctcttcctgactcagatgcacaaatctcacttattttaacctaagcaaactaaagaaggaaataacttaccctcagcctctctgtgtatcctaccatggcatctttgctagtttgcatctgaaatgcccccaaagaccgatgtattaaaagcgttcgtctccaaaggtgtattatctgggaacggtaaactaagaggtggggcccaagtggcagatctttaggcgatggacagacacccttaaagggaactgtggtgctctggcttcctcctcctgtctccttccctgaccatgatgtagtgcagtattgccccgccatgcactccaaattccctccacaacatgccccctatgacagagccaaaagcagtggggctggcccatcacaggccagaaacactgaatttatggtttgtgagacaacagaaacctttctaagttgattgcttcaggtagtttctatggtaacaaaagctgattatgcttagcacacctaccaaagaactaaacagtggcatctgtcaccaaagcccaagtcctgccccaatgtcctccattctcatcaagagctgaccacgaaatacaaagaataccttgcagagggcaccatgcacgtcgctttacaacatctgccttgtggaccacattcagagctcgcccaccctgaaatccttgtctagcttgtgtcctctgctgtttcactctcagcccctatgtctgtggctctcgctagaaccctcactctctcagctagccttccccccttcccaaggtccctctgcccatcccctccccctgcagcctctcccttcttatagcctgctgtctcccagaaacagcatccgtgatccaggccttccagctaagagtcccaggccttagctttagtcgagctgtgaccttactcattagtactttcagttgtgtttattttactacggcttttaaacagctttataaatattgatgcattagtgacctaggaaacataaaaattaaaggataactctaagaagtgaatattttttctagacaaaaaaacaaaaattccatgagcaaggacatttggaattttaaaaagcaatgtggaaaataaaattttaagactcttacaagttatttccaccttcatctccatccctcaaccccttccatattatgacaatttgccaaactcatgagtaaattggacccacttgtaaatagctaattccaattgtgaactctcacatgaagacctgatatataaacttcaaagctctacaagcccatgagtaagaatgcacagtgtttcccatgggttttaagagaactttaacaaaaaggcctgtaactcatacaagatcaaccgaaggctcaggaaaggctggatggataaagcactgggcagaagttcatgtgcccagaacccacgtaaaaccagatgctgtgactcataatcccagcattgctatagagatagaggaagtggagacagaagccagtagccggctagcctggagtaaacagctagcaaaagacatcctgcttcttcacacagagtgagtggtaagaactgacctgtgtgtgtccgtgtgtcctctgaccgccacacacatgcacacgagcacccacattcatgcacacagcatacacaaacatgcagatacatacacacgtatgtgagcacatgcattacatattacacatactttttgaaaaaacattaaaaaaatcaacttagacaatcagaaatctgttaattctggaataaactgaaaagacaataactggcaattaaatagtattataattttaatccatgcctattaggg

SEQ ID NO: 371 - DNA, 2300 bp, Mus musculus
aaaacacagacaacagcaaaaacaacaaaacaaagcatagaaaacatctcatcatggaatctgtggtgtgtcacagtgtgtcccatagcatatccacacatctttacttgcaaacgttcattgaaatgagtcattgacctagttcaagatctctggcttctatgataccatcaatattggaccctcttcaagactcctccctgttatcctgttgttgccctgtaccacggagatcctgaagctttgggcagcaggactggcccttttacatgtcccaatcattccagatgatatgcaatcttggcatggaccaattctgagccctggatctgggcctgaattgtagttgagctggtgagcctgcctgctcttcctcatgttcaccactagggtgagctctccaggactgatgtggttgtcagggtcagctctcccactctcatgccctgggatgcagggaggggaggagggcagctcactcgcacccatgtctccagagtgagctccactgtgctgccaagcagaggcttggggcctactcttcttggcagtgctgcagccggtgatgggatgggctaactctcacacccttggggctggttcacgtgtgggttcaccatcagggttgtgttgctcaggtgaggtgcagggacaattcgagtgccagacacccgagggcatcacccttgcacgcacaccacctcagggcagacaagttgcagggccagctctccggagccctcgcccacgaagctggctcacctgtggccctcacccaaccagggccagctctacagtgctgcacaggagaggtgcagggccggctctcccaagtgttactaaaatagggaccagctttctagggtgctacatccagtgggggtgggagtgggggtgtgggtgggggttccaattatacacagcccctagacattcacatggtcctggcagtggcctggaccagacatcctcatgttctctaatggtaacatgaggcatggacattgacaccaacccctgctgctgtgtagctatggattcagacatcgtcctcagtggtagctcaggctgggaccttattaccatggccccaggtggcagggctgaccactcacaacaggcaagtcctctccacccgtcagttgagtctccagctctctctctcttcataatgctgctccacttctctttgtctcccacctgacctgcagcattgtggtggctcctgctgcaggctggccatgtgactgatgggccctgggtgacgttcgccattcatgctgtatggcagggtggcaagcaggtatctatggtctatatgtgccgtgcgctagagggtggtctgcaggtcttggtctgtcttcatcctcttgcactgagtgaactacatggatttgacttgatttgatttttatgagtgctaaacataagacagccaggtatcaagctaggatgatcaaaggactgacatctgctctgatatctgatataagagcaacactaccaacaaggtgtctcttttgcccattgccagggcgtgacagggtggggtggggaggtctttgattctttttgtttgtgtgttgtaagctattctagtctccttgatttatttgactctcttatttttcttttcaggtgccgatttgttttctaaatatagagaagatgtgggtttgggtgggtggtgaggaccatgaagaagcggtgggaggaggggaactgcatcaaactaaaaatctactttcaattaaacaaacagaagcaagctcttccctctcttgcttgctcattctgccacctgctttaaaaaaacacaaactttcagtcttcaaccatgggaaaatgtacagaagccttcctcgattttgacgttccattccatttttatttcttaagatttatttatttgtgtgtgtgtgtgtgtgtgtgtgtgtgtgtgtacatgtgtgtagtagtatacctgtgcacacgtaggccacaggaaggcagtggaaccctcttagcctggcttgcagggaatccagtcttgttatatggggcctgggatctgaactctgctcctcgtggttggtacaaccgtgttgttaactgtggatctgtctctctagtccccgcccccattttataacgttagagttttggattgtatcattactttcctattatgtaatatggtgattactatcttgatattattaataatccttgcctgatgtctatggagacagtctcgatttgggccgtaaagcgtggcgggaaacaagttcctcaaaacccggtgaaaaggttctagtact

SEQ ID NO: 372 - DNA, 1875 bp, Mus musculus
aattgatcccatgagttggcctctgacctacaccccccaacacacacaccccagatatcccctcacctcacagccctcacatacacacccacggcagaaaacccaggcttatttatatgatcacgttgtaattaatgttctttgctaacttgggttagaagatgaatgatgatgttccttcattgtctcataccgacttaaaagagagtgaaggcgctcagagggaagcacaatgcgctagctatgaagactacacgagtcaagtgtctacccctcatgggcaaataagacatgtttttacattttactgtttttctttatgttatctaactttgcttcaactaaaatcaagtgcaagttaataacggatgggaaaattaaagtgccttaggtaaatttccgttgtgctttctctggcacactggtttgtcagtatcttgagagcgaattgcttgggactggtctcagtaggtggaggagacccggtcttacagattgcttctgccccgtgttcatggtctgctcctccgtggtcctctttggatgactttttttttttttttttccccaacagtgcacatggcatctcctggaagcagtgtgctccaggctgctccttctgttgcttttataaagtttcattatggtataatttaaatatcatgagatttatcatctaaaatgtaaatctctgtccctaaatttcttatatctaatgctattaatcatcatttgcagttgtagccctagagaaatatttctctgttttggggaaaaatctatctgggctggtattaagagcactggctgctcttccagaggacctggacttggttcccattacttaacctggcagcagcctaacaaccatctgtagttctggtccaggcgatcctgtgccctcttctgacctctgagagcactgaatgcatgtggttcacagtcgtaaatgcaagcaaaaacacccatatgtataaaaccaacaacaacaccataaagctgtttctcattattattgtgtgtgtgccatcacatgcatggagaggtcagccgacagcgcattcttcctttcaccttcactgttccagcgctgggttcagatcaccaggatctgcaggacaaggacttcatccctgacccagttcattgaccttaatgtcttttgtcctcgccttggagatttgccttttcatataaatggattgcaattgttttattgacataaaaatttccaaagctctagagagactgcgtttctaattttgaagttgccaacgtgttttggctcatgcacaatagaaaaatgacacaggaacaagcaaatgctttgagcagctgttcgctcacagacttttatttctcttgtaaaccaatgcctgttttgaggttatcttggttaagggaataaaccacactgaaaattaccgagacagtctgtcatttgaagctgtttagtatgttgggaaactagttttcaaaattaatagataatcaagagaatgtcattcatttcacgttcaaaatgcaaccattaacataatatattatgtacttaataacactagccttgattataagtaataacttatgagaatatctgggtaatttataacaatattgagtatgtgtgttatgtgcttcctattcttttgccaaaaggtaatatatttttaaatgacttgtagacaactatggattaaggccaatattttgggaaaatatctcatagtaacatgtgtttgtatttcagctcaagttaaggtttgacttccaaccaatttaaaacaaaatatcgacaatatcacattgtttaatttaatgcccagaaattttttttttttggtgtagtggggaaattgcttgattactttgaca

SEQ ID NO: 373 - DNA, 6875 bp, Mus musculus
cagccttgtttataatagccagaagctggaaacaacccagatgtccctcaacagaggaatggatacagaaaatgtggtacatttacacaacggagtactactcagctattaaaaacaatgaatttatgaaattcctaggcaaatggatggatctggagggtatcatcctgagtgaggtaacccaatcacaaaagaactcacatgtatgtcctcactgataagtggatattagttcggaagctcagaatttccaagatacaatttgcaaaacacttgaaactcaagaagaacgaagaccaaagtgtggacacttcgctccttcttagaatttggaccaaaacacctatggaaggagttacagagacaaagtttggagctgagatgaaagggtagaccatccagagactgccccccttcccccgtgaatccatcctataatcagccatcaaaagcagacactattgcatatgtcagcaagattttgctgaaaggaccctgatatagctgtctcttgtgaggctatgccaatgtctggcaaacacacaaacggatgctcacagtcagctattgggtggaacacagggcccccaatgtaggagccagagaaagtacccaaggagctgaaggggtctgcaactcgatagatggaacaacaatatgaaataatcaggaccccaagagcttgtgtctctagctgcatatgtagcagaagatggcctagttgtccatcattgggaagagaggccccttggtcttgcaaactttatatgccccagtacaggggaacaccagagccaagaattgggagtgggtggctaggggagcagggtggggagggtataggggacttttgagatagcatttgaaatgtaaatgaaaaaatacctaataaaaaattgggaaaaaaattaagatatattggtggtcttctaaccccaggcctggggaaagaggtggagacaggagagttgctgaggctgtctagttagccaatctagtggaattggtgggatccaggccactgtctcaaaactcaaggtggacaactctcttgatgaatataactcttaaggtcagactctgacctccctctgtgtacacacacacacacacacacacacacacacactccaatgcactatgaggcttgtatacacccacctggccacacacccccaccccaccccacacacactgaaatgtacttacaaagtgtcgacctctcagcatcagttgcctttgtccctggactgtgttcccggaagtagactcctgcaaccccacactggctcaggaatctttcaccatttccttccattgtccccactttctctctgctttgtcactgtcctgtttgttgttggaattccattaatggagttttcccagtccccatagaaacaatgaaacgatttggcaaaccaagtggagacctgcagcttgctcctacgtgggcgactggcatgcatcttgggatggttggtttgctgcttgcagctgaagtttgagctctggaaaggaaagcacatataaagtgaaagatgggcaggaggagcctgacactcagcagcacagccactaggggagctgaggaggatgtgggtgtcaggagacctgaggtttatcagttatctgtactgactgtgtgtgaccttgaacaaggtactactttttttttgttgttttgttttgttttttgaccctcaccaagttcaccagtaaaaatggggatgttacctatcctttgtatatcctggagtgaaaattaaccccctagggtctagcttcttaaactgtgttgcgtaactagagatagcggtggggaaaatctggcaacagtgaaaggtttctgcatgcaatgatcaaaactgtaattgaaaataagtgtgcaatgaatcagaggtgcttcccgcagcgctcacctgagcttcattcgtagctttactgtagctttggaacgcaaacacatgcccactttgccctgtgcacgctgtcaagcagtgcaaacagacactaatcaaaatgccggagtgcagattcatgtctgtgaattcatgctgtgaattcagagcttttcttttctgcacttaccaagttttctgatcttagagaaacacactggcttaattatgaaaaaattataacgatatttttctatcagcatttcccagcacttaagtagcaaattagtacatctctggattgaattgtgttagagtgttttattttttaaattgctactcgtgttgtgtacgttagtttcaaaaaaaattaaactgattttggctttggattaggacagaatttccagtaatttctgaaaagagatacttctggcactttgacctgtgtctttgtgggaagttgcattctcagcattgtgattacaaaattaaggtatcagccaactctgaaattattcagtaaggttttaacctttgtgtgcgaacaaccaagcacttttgattgtaagtagtaagtcaagttgcctttgataaacagcaacattgtatgtacaacaaagaattgttttcagttttcaatttttatgacagtattagtaagtatttgatgcatatgcccattttatatgcctttatacccaagagcacataaaaatctcaggcaaaagggaaatgcgtacgaagtcctcccttaggggatatgaaagtgtttggcacatgctggctgtcatatgtttttttccttcagggtcatttttgacccacccctctcacttgcacagattctaaaggtgagcctatgaggtggacaagtgaaggagacagcaataggtcaaatagggagcttcaaacattgacagctaactcttagcaacgatggcatgtatgtgttagtatgcatgtgtgctttggagccataacttatgagaagaaaatattacatcaatgaggctgtttcatggcttgctttgagaacatgtaaaaataaacctgtcactggtgaaatgatgaagtgtgtccaatgtctcctgggtgtcttattcgtttagttcctaaatccatcttatagattagaaattggaattaggaattagagatcaattcctataggaagaattcaaattcaaattcagagaattggtcagtaacagagttagggctatttttttgcctttacttttcaattttgatttatgggtatttttatccttcttgtctgaacttgtatgcctttaataccttgtatcagactttagcattcagtcaatgagctatcatgtgctgggggtggtattctaggtgggggatttcaagttgcaggtgatggtcttgacttattgtataacttcaggtagttttggtttgtttgtttgcttgcttgtttgtttatttaaaaaaacaaacctgtaaatggaaaggtatccatttacctgaatctttgggaagattatatcataaacccccaaaacttatggaaaccacctgagaatacatttggcatatgctagatatttatgtgagagtctcaagcacttgaacaggataatttgaggagctattattaggtagagaaatcagcgaagggtagaacggaactaataccatgtgtgggcctgagggcgaagagggtgcagccgtagaagcagaagagccataaaagagggagaagccttccaagagtcctgctctgtgatggaaaaatccagcagacccagcagcctggcagagaaggatccaggagcatggatgcccccctccccccacccttctccccactctatcggtgcctacagcccacctgcagcaagtgttcacatcacagaacagggtgtgatgagcacacagcacatcggagttgacctggatttgatgctactttaatttgacagcctacaggtgtgctccaaagatatacggagcatcttgaaagtagatcttaaagaacctccacattggggagttcctccttgggttgaaggtcttccttgtacttgcaggggtggccaggtcaccttgcttttgtttgcggcagtcccttcataaaaccagggtatgggggacttttgggatagcattggaaatgtaaatgaagaaaatacctagttaaaattttttaaaaagtaaaaaaaaaaaaacaacaaaacaaaaacaaaaacaaaaactaaaaaacatacctgtgagctttggtgcacctacattctccagcctaggggccttgcccctctacctgcccccatcagcaccaatgtctgacatggagtccttctctgctcacttccattcagaggttcaacagggctttccctgtgcttctgaggcatggtgcttgcttgtttgaggcatgcattattcaagaaatattctattcaacatgcattgaatgtctattgagcttttggccctgtgcaaagaaaggactatcaagaaaactgggctgtctcccttagtatacttcctgtggtcgtaagtcttctctcacttggcctttccctctttagactggcgagtatcctgagggtgggaaatctgctcagtcatctctgtgcgctcagtacttcagagaggaggcttccgaaaactgaattactatagaaggaacggagagaccggaagacgggaagtaactgatgcagttatttgttaagggcctaaaatgggccaggtgtttatggatgtaaacaatgcaggctgcatacatgcagaggtgtgtgtgtgtgtgtgtgtgtgtgtgtgtgtgtgtgtgtacgtacattgcaagggctgaggaattggctgtgtgtgaatttctctaggtctctgaggacaaatcaggggttcctcccttgcccagacttttgaatagaaccattctgaaccctaaggacagacactaaggggcccatttagagtctcagtgtagctggctggtggttaaaactcttcaaacagtttttgaaagcaggtgatttttgaagttgaggacttgtaggcatatggtatttgagtgatataatttctttaattgaaagtgttatcttaaccagtgagttttgcacccccccccaaagacatctgttgctgtttttgtgcttttccccagcaaacaatctggtggtgaaaaataggaatgactaaatggaacaccaggaaaaattgtgggtttgaaaaacaaatctgcatgtctttaaggttgaagcaattaatcaaggtacaaggcaggaggctttggaacagagacttctgcgagatcttgggtcatttactaataattatgaacacaaaaccagtaggatgagtatgaggaaaattcagtgcatatcttcgttgtttatgtgggtgctttatctataagctttgtacactgggctcttggtgaaagcatgggaccagatctttggattcaccatcatttccatgatgtttcatgggcatcttcaacatggcttatcaaggctgggatcatgagtctctgagacccacatatccttctgagctccccatgttgctgacctcacaaagtattttaccatgtcagaaatcactcagaaccatgtattttctgagatacagagcagactacaagcaagggcttgctccctgggggaagggctcttcattcagcttgttcttctttatcgtgctgcctctgttcagattgccaccaaggcctttccatctagccttgtgccccatgaatgacagcaggattcacttaagtggtccaaaagaggaggcaagacttacgaggctacacagagaggtaggagaagggttaagggaacaagtaagggatgttgaggggcctagaaaagagaacagctggaagccatgtcaactctaggaaggaaggatcaagaaaaagaaatacagaccttgaacatcagtgggagctgaagtagggaagaggcaagttgccaggaagagtggcagagaggtatgtggaggcaggagagtgcatggaagaacccaaaggaccatctccacctaccttccattttttacttgaacatcagttccaggcagtctagaagatgtgggcacagagcaaaggtagaaaacccactgagaatggttccaaacccatggagaagaagagggagaataacaaggcccttcctcttacacattcttactctgataaagagtccatgttgtagtgccccataacagtctctcatctgtctgaacctcttagagcctccctcttacacttcaagcaaaccatgcgcttccaaatcaccatggttcagtcaatattccctctttctctgggattctgaaaaaactccactttcagtctcaagacctactactgttcctctcaggtagcttcagaagatgcttgctctgggaagatggctcctacctctgagcagcctccactgtacatatctctttatttcatgatgcactttgtaattttcagttttatttggcataaaattcattgcatttatttaatgtttacaacatgattttggggtatcttagataatgaaacagtttctatagttaagacgatcgctgtctcatagttacttttgtcacaagaacagctaaaatgtgtttactcaacaagtccccaatacaatacagtttgcatagctttaactgtgttgcaaagaaaatcccaagacagtctcactatggtggattaaaggaaaatgacccccataggctcaaagagagtggagatactgggaagttgtagccttgttggaataggtgtggcctccagtgtcattctctcttcctgctggtctgaatgtagaaatctcagctacctctctagcaccatgtctgcctgtgtcttgccatgcttcccaccatgatgataatggaccaaatttctgaactttaagtcatcctcaattacgtgttttcttttataagagtggccatggtcatggtgtctcttcacagcaataaaac

SEQ ID NO: 374 - DNA, 1875 bp, Mus musculus
ctcaatggtggacatggaacaaaatttgaattactttaaataagatatttcaatatccattgctaatcactgttcctgatcattaaaagatgagataattaatgcactgttgttagaacagagtgtctgaaaaagtatttagggtgtcctggtggagatacatctgaaatggaccacagatgtcctgagaacattttagaatgatttttcatttcagaaatttattaaattctatatgagaatataaaatgttgttgaaatgatagttctgtaggtgaagttaaaggctgctctaatactgtaaggttttttttttttttccttttggttagtctctcaggggcaaagctaaatttatgactttttaagatgggttggttgcgaaaggaacaagtcatttcctgacaacatttttcagttgaagtattaggcttaatgtaaactcccagcagtattgcagggcccgatatcataaaatctgatggttctagcgaaaacattgtaaatcttcataaatgcatagcattctcaaggaatcctgacttttaaatcattacctgagcattggttttcttaaagggtacaaactggtaagagcttgaaggaaaaaaatgcttggtcttctgagtaaggaagaatgagtaagaactgaacgatttttactgctccattatctataaccaaggtagctttaactacctggaagaatgctgttatatatttctcactacaaatgtctactcttgggacaaagtagaagtaggcagataagagacaggctccacagacacacatctgttcactcctaaacaagccattaatgtgactgctatccgatccacaacacaccagtgtggtgcctgcagtgaatgggtgaggatgcttggtggctgaggcacagatgcagaaatcaattctctgtattctcattctgcttacacagtagcatttagacaaacccgagaactttgacttctctgaggctttcacgtgtctaccttatagtcttgtcagaaaagcacttgaatgagatgtacagagggtgaagggacgtaatatgtgggaaacactcagtgcaatcctctcccgtttctattaaacagcaactaggaggaggggagttaccattggcctcacactgcttcagctgtgtgtgtgtgtggtgggggtgcgtgcgcatgtgtgttaagcttatgtgtcacagagcatcaatgcagctgtgtgcacaactgctgtgcttctcacctctctcatgggaactgatggagactgaagagcagcagtgttcaagcttgggtcacgactcctctggagaccgaacagccgtttcacagccttatcacatagcagagtccctgcatagcagatatttacatttcaattcgtaacattagcaaagttacaattatgaagtagcaacgaaaatgatttcatggttggggtcatacaacatgaagaactgtattagaggtcacagcattaggaaggttgagaaccaccgctagagaggtttctgaaccatggatgagagaggtcaagagctaactatggcagccaacgtcaacagagctgaaagtgactttgaagcaaatgaaaagccatgaaagtcaccatgagtactaagccatctgataaaacacctttaaattaattatagacacatgatgaagcaatactgccttcatcaaacattcaagacagacagattcttgccattgtggaaagacatgatgcccaagattaataaaagcctttttatggggctagtgagatggctcagcagattaggggacccagtgctcaatctaacaacctgagtttgaatcccagaactcatgtggtggaaagaaagagctgacttctccaagttgttct

SEQ ID NO: 375 - DNA, 4675 bp, Mus musculus
acccaaggttgtcttgtcttcagttgactccagctccagttgctaaccatgatgatacaagaagcttcaaggaagaaccactcagctgagttcagccaagggatgatgcaagagttattttatcctgagtttaggcagtttgtgatagagtgatcagaatccagaacatgaatagatcctgtcagagagttagtggcagatgtagaagcaggtgctttcagcatatggtgtctgtgccactgtagtgtaatcagatgacgctatgggctaggcttgaaggaacaggaagatgctctgtccatggctggttctgctcattcttatatgaacttggctgagaacccaccgtcctgagggctctctgctgcctcttcaagagtgagacccaattgttgcatggatgttttgctatttatgagcctcagtttacttctttataaggttaagaaacaaggaacctagaacaagctgtacacagaggacagacagacaggctaattgccctccatctccctgagaaaccagaaggaggcacaggctctggtcacagaagcctggcctggagttctggaagcacgttctcccatcagcgtgactccacctctatcaaaagtcagaaatgaaagttatctgatctctctgctatctattcatctttcttgacacaaggatccatgctgcttgtcttgagtgactagtctttgacctaatatcaagcactggcttcatcatgcttaagctaagcagagctgggtcatagaaacaagagagattcccaacagccctatcactttcctcccctgtctgtgcttaatcccaactcttccaatgcatctcgattcaactgaagaaaccaggctgagtgagagtagcggcaatgccatcaacatcataaggcagggagccatctgcgttcatagcaactccaagcaatatggagtactggcagagcaatctgggggcgggctggaaagggttaacaggaccaatgggccagctggcatctgtgctggcactcatagagagaaagaaaaggaacctcggtgtcaagacaagaaagagaaacaaaacaaaataccagagctttagccaaattcccaagttaccagatggatggcgagggaaacatctagccaaatccatgtagcagcctctggccagaaaagacctcaagcctaggcaagtctgtgagcccacctggatagcttgtctctgttggatagcattccagagaccaagactgtcactgattctatgtgtcaaggagaagggctgatcttcccctttattaactcatgcatccacacagctacccaccatccattcacccatctatcagcttgtgcatatttaacaacaaacatttattagacacctacatcaagccagacattacatattaggtgactctacagacaaatcggtgtgacaaagatgaataacgcaacatagtctttgccttggaggacaaagatctgtcaagacgagatattgtgggcagctctgaagtgagctggaagaaagtttgtggtagaaaaaaatatctgactcttgctgatgatttattgcaagccagacaatgttcttcaaagatttacatgcattatctcatttaaccctcaccattgacattcaagcttggcagtgctattagccccatttagagccaagcaaccatctacaaggatgaagtgactctgtctggattcaggtctgagctcattcagtactgtggaggagaatctgggcaagagcatggtgcaaggcctggcacccagtatgctgtgagagtcttgctacttggtaacagcggatgggggtacatgaagcagagtggtcaatgatgatgtaagcatggggagggaaacagactctgccactggtgcccaaatggcagagtaaatttgagggggtcattccaagctgagaagacactaccccagacgtcccaaccctgccctcagctttggcagaaagtgctttctgtcccatggctgacaacatgctcatgaaatacaaattcctcttcttctctgcttcctggcttgcctcttgtatgcatatgtgcattgacagatggataggctaccgaggcagctgagaatcaaaatgagggaggagggtgctgggactcagggtgcatgtggaggaaagactctagtgcaattttgccaagcaagttgcatgtctgggtgttgaataaatgaaaaaaaaatttttaaatcctgtaagccactatcgacagggtggcttgagagtaaatgcagaagggttggagggatggttcacctgcaaagtactccctgccagcttcccagccaagttggcttcttctccacaagctattttccttgtctggagtcagttcacacctaatatggaagaatggcttttcagcctctacttgttgctatggtagcttgagaagggctgtgagtgagctgttgctgcagctcccccttctccaaacatgtttggcacggggctgaacacgcatggtttgaagacgaggcaagtgtcagtggatggagtgtcttttatttggagaagcatctttgcagagggcagagcgacagcttctgatgctccttcagagcctctgctgtgctgattctaacgcatcggctccctcagtctgctcccatccctaccgctacttgtttttggaacaaaggctggaaatgtctcttgcaaatatttctaatgatttaactggctggattaaaatgcaaaccattgttaagtttttaaaaaaataatttcgaataaatgagtgctataaataagagggacttatttcccacaggatgaatgcttccttctttggaaatcagaggatattgggaaaggaagtactgtgaacatgatatgcctttaggttggagttggtgaatggggcacatgggtggtgtcggctggaacatgtttcattcttgcccctcggaaggctgtaatccagcaaggaggagagatactccataagtaattgccatggagagtatgaagcactgatggacacccatctgacaggtccaggaaggctcctctgagagaggaagcttaaaagaactacagaggcacagtgcatggatctgagagttggctcccaggaaagggctcagcatatatgactttttgaagggaacagcaattggttagtaggtcaggggaatgcaatgaaagccatagcagagagtaagaagggaagttgatgtcaatgtctgtgacggggagcgtcttgaagggcactgtcatagctgagggactgtaatgtgctggacattgttctaagtcttttccacaggttccatcctttagtcctcacagccaccttataaagggtgtcgcattagtacatacattttgtaaatgaaaaggcggagaaacagagaggcaatgactttctaagatcttaacacaagcatgtaaataagcctagtctatcctatatagtagtgggggcctgctgcactaaagcactggcagtccaggcttacgatgattagaagccatggaaagttctgagcgggataaggaaccctgtactgtggccaggactgtggactggagggagcagagaggacagcgaagattccaggtaggactgggctctacccagagggaaggagagcaaacaagtctaacataggagctggaaggcagaatccaaggaccgtgggggcagtgtggatgggaatggggcaggcagtgaagggtggaccccaggatgtgtgcgttaccatctgagtgagctgtgaggcttgtcttgtctgtagagctgggtgaggggtgggagcctcacaggacagttagggctgaatgcatgttaggtgggcaaagacggctctgtctacatcgaaagtaacaaatgaaagcctgtctccttcgtagctctcttctctgtgccttgtagcaacttagtctgaggagagtcctccctgcttcttgcttccattattttcttcccgagcgtgcagaacatgtcgatctcactgtgattcggatgctccttgcatttctgcccgccacgtcctatcgattaagaaagtggtccatcccaacatatgtacatcacttgtatgaattgtttgaggtcttacggtctctgtatctctcaggaagactaccttacggatggtcagatctcttcttaagacgtgctaatgtactaaacaataagatcctcgacaggtgccccagctctctgctcccaaactttcgtgcatattacttcactggaaaccattattcatcctaagaataatcagcgtgctcatcacaatcatcataggcatcatcgccaccgtcaccctttaatacagatgaaaagctaagacctcagaaagacctaaatgattcattcaacaagacatgtctggaaagtgagaggatttagaaattccaaatccctcatctttcaagtgtaagctttcaaagcatctatcaggagtcaggtgtgtactgcatggtaggtaggtattaagctcagcgctttatgcagtcactttttgattcccctaaggtggacattggtatgatcctaaggttaatgtaggaagaaactcagagatggcacatatgttgcttaaagtctagaaggctgaaccatggttggaatgtgggtttttcccaaactaacgcgcctaccctgcgagtcaccagagtgcactgactc

SEQ ID NO: 376 - DNA, 2600 bp, Mus musculus
gggacaactgaaaatagtcataaagaaaatgatgtctttaaagaatcaaaggaaacaagcaatcaaggtgtatactcaatggtagtccacaatgactgctggtgacatcactgtcatgaatcgtcacctccttcctgcctacttttttgccttttaataataatagtgactcctgtataaaagctcttcttggttttggcatccagatgccaaccgtagatttcctctccagaatttagttggtttatatgtctgccaagcagtctgggctggggtgctgcttagcattgtctgaccatagctttgttacccatttgtatgagagtgtcacctggctgtagataagccactttaataccactcgacatgttaacatatgtgctctattgtacgagcttccatctggaatgttcatgaccctttacagatgttatcatctggcagctacctcctgtctgtcaggggatgcagagggaagacttcttttgcagaatgacatagggaatttggagaggtgtgcaggggtgggatggaggaaggggaggcactgtcttacagagggagatgtcctaggctaaggagggcagcattcacatcctcagcatttaaggccaggcgctttactgacccatcttgacagaaggggacaatgcttccctggtcttcctttccctttctttcatgggcaagagttctggagcagacctgtctttctctatcttaagaccaacagcactggtgtgtgaaggatgggatctcactgtcattaggggatggcagtagtgatgcagactgtggtgatgggaggatccaccttcccttctgctcatatatattcatcagctagtctttgcttcacaggggaacgggccccgcccatagttgtatgcatcttgcttttttttttttttcagtaagtcaaaagccacattttgaaatggaaaagttcatcgaccaaaatacatcctctgattgaacatgacccagatcttcactgtcatgtaatctgctgtttctacctagaatgtttacatcagatctggaaaataactgatgagggtgtgatgaagggattctagtgatagtgaaggttggattgagtcactgttgaaattccctgtctgtctctgtctctgtctctgtctctgtctctgtctctgtctgtctctctctctaccagtttctctccctttccttccatccctcctcctgtgtgtgtgtgtgtgtgtgtgtgtgtgtgtgtgtgtgcgtgtgtgtgaagtgaaaggacaaagaatagttagtgtccatgcccagggatttagccactggctggctgtcctcaaaagcacatcctgaggaacacttttgttagagtgtgtgggtgagaatcacagcagtgttctctttggagacaagtgttgttttaatgatgattccccagtctaagaaggaggctattagaaattatattagctaaacaggctttggacccccccgcccaggcaattggaaaaagccttttcactgacttcctgctttggagggttgtgtggctcacctgtcaccaaggtgaagtaggtgatcctgaggagtgctgaagccacacttgtcacagtctttgctgatacacgctggctagcaatttcagtagcttccatctttgcgaaacaaagaaccttccatggaaacggaggtatctctacccagtgatgcccggaggatggctttacaactggccatggaattcagagctcacaaaataagctcttcaagcatcctgtcactcctctataatgacatgtgtatgcacatgcatgatgtttgccagatctctggtgcaccgtttaatagctctcattgtatacatctgtgcaatgcatcccctcttcatggagtatgcagctaccatcatctatggtcaatagttttccatttctgtctttaagcctaacagctgccctcaccttctgtttggataactgtgactagccaaaacgcacagagtttattttcgggcacttcaaactagagagtactctccacagactacaagttcagatacttttcaaagctgctatagtagccttgaacatctctcactctgtcccctaccccacccctattttgtgagctctgtatatttcctatgtctcaggatcatccaggaatgtgtatataccttggaccacctgagtacccttagctagaattatgcttgtcttagattaccggagctatgagagccgccatgcagaccatgagttccaaggagatctccctggatttgaatgggcttcaggcatccatttcaatccaccaagctgtttctctcagctaagaagtcatcagcagcctactctgccctcttgggacttccttgtcaactaaagcctgaggtgggtggccctgggggacagtgccaagcaagaaggcagagatttccacttctcagacacaaagttcaggagccaatcaaggatgatgttttttctcaggttgtgtattgctgttgcatcatttccagcttggctgcaatgggctaattttattaaatctgtgcagtcttacagatgtctggggtctggacaaggatttgcccatgtccttgcttgtccatc

SEQ ID NO: 377 - DNA, 3075 bp, Mus musculus
agacaccatgcttctcctaccccagggtgccatgtacatccgtagagaagaatgcgctattgtgttgggatgggcctgactacaaataacccgaattctagcttgctgcaggagctctgccccccacaccatcctccccgaagggccctaactcagaaatcgtgatgcaccattcccagccaagatgtcaggcttataaattcttaccctaatgaacaacagagacttgtaaaaactgcacacagagagaaatgcaacagcccttgtggcccgggggcttgagtgtaccactgaaatatgtttgctaacttaacccctcaacacccccctaaataataatgggctgtaatcaggtgataattaacactggatccagactcagcaggaacagcccgaagaggtttcatattttgggtgggagagatgcatcttgaacccgtagggactctgtctgtggccggaaagcatgaagtgtccctgccttctggctgcaaggcgagggaagtgcgtttaaggattaaactagactttaaccccaaatttgccattttctcactgggcaagtgtatgggatctgtgtaaattctctggccttaattccttacttctctgagatgctgcaaataaatcgcatagtaactgacagcagcctagcacgccaagcttaaatcaagtagttctgagaaagcgggtgggggtgggggtgaggggtggggggtgctattaggattgtacatggactattcctcttctaaataccaggtcactcttgtaacagtcctatgggatgggcttgcttgttgtagcttcttgcttgttgggtgagtgtgcttgagtgtgctccaccgtccttcttgctatctccccaccttcctggcccaggtgaacatagcaacttggtgctagcttttccctggaggatgggtttggagaggtgtgacccacaaactagtgcagaatcattacactgatagttttatatgtcacccattgagttctcttactaagaccccgagagctttgtggctcttgacctaactgactcaggctgatcagttctatgactgtgacacagctagagtgagcaatctagagatttctgttgctttgcagctggagatccttagcagctgcagacagaagcatcatgcccacacagtgctgccctcacacggagtccgccgggagactcagaacacaggtggtagagttaaacagtccagattccactcagttatttccttcttattttgcagtcttccctagatcaagactaacacattacagagttaaaaaagaggctgggtaacttaagaaagtctagaccctaataggtcacctttgccttcttccctcagggtattttaggactctaggcttggaactcaggtccagttcctcactctgagccctctagggctgcattggaaccctttgcgttcacttaactcaggctgtgctctgcttccctagcccgggcacctgcatcacaccttcctctgaattactatctcagctttcttctgtcagcctgtcagtctcgctcccagctaaatgtcatgtgcgtgcttgtcactggggtattccatactatttggggcatttgtatgtcattaagcataaggcagcccaggttaattgaaatagttattttaggattggaaattatttttttttctaattaaagctgttccccagaataaaaatgtcatatgctttgtagttcacagctgtggttctgaaatttagcgtacattatcgtcagtgaatcttaaatgctgattcctgggtaccacctcaagatgtgcaagttgagcgtggctccactgaggcctagggatctgcagttttgaagcaagaaccagacccatgcctgtatcattaagctattttcattcttaaatgcccaatagtatgtttaaagttttcagcctggtgcctggctttatcatagaagctaggcgagtaagaacatggtgacttgtgtccgtctcattcaaggcctaaccttcaacaggctcaactggaactggctcatgcaggttttgagaatcagagccagaagggtggcctccctggattccgtcttcctccacattttcatccttatcacatctctgctattaacacagccgatcttgagcttcagtactgtttgtgctttctctcaatagcacagagccacttgtctgagatccaaatcagatggtatcaccttcaaccgacaaaatgaactcccctgtgatttcagtctcaggtcgaagattcgacttctcccatatccctgcatggggtgggctccgcctgacacacgcttctctcgacctcatgtctttttgtcacctatccacccaccatgagtcctctccagggcctcccatttacgctcctccaaagctttggctatctgataccccagtcattgaaccatgccggctcctttgtcccgaggagccatagtcttctgttttcttcttagctgtcattcctctgtgaactgtcccctgccctccttgaacactggtctgttttgttttacacactgtggctttaccctgcatctgtactgttctgtaaccttctccctatataaaaggtatctcagtactcctctggggtctcccaaccacgaattcagttctaggtagcagggccttaaacatcgtggttcagaaggatgcctacccatagtccatgccagatctggatgtggaaaggcaggagggaccctagcttttatggaggatttagagaccttcatacaattctacagaataaagaacttggaagcatgaggtagaaccataggcttagttcacagctaacttctctttcctaagacaccgagggcctacaagggggagcccttgattcaaatcaccactccacctttacgatgttgtccctgtcactgactctcccttgagtggacaaatcgcttcattttcctggaaactcggcgttcccatcttgaatacggagagggtaatactaccaatagctggtgtgaagataaaatgagacaagttttactcgaaagtgctctatgcaggtaagccagggtttctcatctct

SEQ ID NO: 378 - DNA, 2175 bp, Mus musculus
tactcagggacacaagagttagtcatgtgtggctgtaggctatcagcacgtgctttgacaaaatcgtctctacataatgtggtggagcaacagctcaaagctgccttgcttttcaacatcagttatccatgcagtgatgctccaatatgtcggtatgctctcctgcattgctccttctgcccactcaaccttgatattctcctttaactgcccacagagagcatagcctccacaaaccaaagtgttttctgtttttcctccccagttcccttcagacatccgaatccctttctctgatatctcccaggacacatggacccctgagtgcatctcagtcattctctatccgggtgatcggaacccgagtcacccttcatgtcctccctttgtgagtccccatgcatgtgcctgcaactcccacattaagaccaattttgctccatttcctccgtgcccacaaccatctatgcttattaggtcttgtttcttccagttctaaatgggttctgggtatcatatgctcccccaaatattaattgggaatgcctaataacagtccagtatggtcatttaacttccctgcttaaaaaaaaccaaaacacttcattttctcatcacagaaaaaaataatgcaggcttgttgctgattatatgtgatactctgcaggatatgggcacaacattggtctattttgcataagaaaacaaggagtttccatattaataaggggcaacaactccaaggctaacattcagggtcaaaataatcacccttaatatcaaatttaaaatttgttaagggtaaaatattatactgacctccccccgccccccataaagctttttattcatatctgtttcccttactctccatacagttctgtgtatagatggaatcattgttctagctttacaaacctgaatatgcttaagtcacttcaccaaggctacacagcctgagaagcaaggtcagagcctaggcagaccccttttccctgcccgtgatccatgcgagtcactagaggagggagcaagcagctgccacctccttcctcagagcctagctgtatcaggctgttttaccgtaagttaagacagctctgctcctttccctctccggagaaagcagaacttaacagcagccacaattaggaattaactgtttaaaactgataatgcttctggagggccaggatgatcttccaaagaggtgattcccggaacccagtgaggacggtgccgacaatggaatctgagcagtcctaacggaaatgtcaaaaggataatgtgttttgcaaatgtttattgcaaacagacaaaagtaggttcaattactcttcacagcctacacatttctttctttgttggctggaaaacactcaggtgttttgtttttcaaaacgaggcggggggtgggggggtgctgttttcttggatggcgagaaagtatttttagcttcagatttttgatcatgtatttcgatggcctgctttttttaaaaaaaatggcaatgtggctttgaaatgagaaggctaacaaaagctagagaagatgatgaatccacaggacatcatatatcatctgtcctctgcccctcccccgccaacaggaacacgttttacacctcatttgtgattctgggcactttgaaactagaatctatattcagcacatgtccctacatggttaaataacaataataatcatctttctgacagttggccctataggagagattccttttaaccacaccttggctactttgctccttgtaagcccattggagtgggaacacacattaggatttgtggaaataaaagtttttaaaaagggttataaatcataccaatttttactgtataggcacctttcccttcccagcctcaatctcctgtaatatgtggtggcaagggtgctacgggctaggcagctgggaccttaacgggagccactggaggagtgccgagggcctagtaatcctcactatgtgattgcactggtcagtgagtcagatgtgtttacctttagttttcctttcagtgtgactccataaagtgagaatcattgttcccatttcacagattaagaaagagagacaggggaggagagggagataattacatgcatggtgtcgaattgcagttatccctccctacctacacaatctgaaccct

SEQ ID NO: 379 - DNA, 3650 bp, Mus musculus
tttcactcttgcatttatatttttcaagttttccataataaacatccctagcttaacaaaaactaaaataagtaaataaggtggtattcggttatatagttggtcagggtgtgtgactggaatatttttagatgcttaaccatgatacatggtacatagcaaaacaaactttgtgtaaaaagattgtccatttgaattcttgccctatcaatttgaatttccccacttctaaaagccagcaggtctactgtcttgtgtggtatatgcttgtgtctggcaagatcagtgatttctgatgtgattaaaggggctcatgcaagtgaagaattattctaaaaaatagatgctttgggtaattgattatcttgtgtgtgttgccctaatgatgctgtctgcaggatgaaatatctctcctccattttccaaagcagcagtctgtaaccccaggtgacactaggatttccttactagctttaattactcagtacagaagctgccgtgccgagcttcggcgggcttcacccacaatgtgaatgcccactgatgagctagcccatcattgcgcactggggtagtcatggaatttggaaaccattagaaagctaggcaatttcattattcattcacttgaaataatcccgggactgctttcagtgacatggttccttcggcaaataaagataagccaaatccctgggcactccaagaaggggcagattctctaaattaattccaggctcaaataattcagcagtatttgtaatattctgtgcataaattgccaatttgctagcgagatcaggaaatgataaaggcttctgccccctccccccctcctcatcttaacaagtgccgaggcagctataaaataaaagaaatgttttattcttaataaatgtcctatcaggtagtgcactgattaaaggtgtccaaacatggcatccctccccctacaaagcaattatttttcatcagaaagactaaactatatggggagctgaggatggctgcaattgggcttttccacacaggaaagtttatgttaataataaatgtacttgcaatgtgaagtattatgttaataataaatgtactcacaatatgaacaagtcggagatgaagggtgataataccacaggtgtcctttattcattgtagcgaatgttttgttttgtttgtgggttgtgaaagactgttggctctttcctgatgataaccgaccccaggcacccctaaatccacccctcatttctggaatctctttcctctttcccactcctactgccttttgggcatcctgatcctggctggggctggggttggggctgggggcggggctggggcggggctgggggcgggactgggggcggggtctttgggaggcccgcttcataacggaatgaaaaggttccactgttctgttcctgggcggtggtgctgaagctgggctacagcgtgagccttagatccctccagttatgcccattgagtgaatggagatccacaaagctgacagtcctccagcaggtctgcccctctctcctccctgcaatcagtacacaaggctggggactcctgctctgctgctgtctctatgaagggccactagcagaaaccgtccattagggggagctccacacctcacagctctttcctagaaatcagagaaatcacccttcatatggcccccagcagaagggtggcgctaaagagtggatgctgccttcctgctgagtagttaatagagggtagatgcccttttgtttgagttgttagctcttcctccatttcccctgatgatgcatcctgttcacttgggcaagagctatctgcagtcacctatgtgaccagagtcctccctactcccatcccataatccaattgggtaccctctccacccacctcctggggaacctccccatcccaggaccctcccagggaatcttcctaccccttacagcaccaacccttcatcctccaaggaactgtttttacccctctactctccctgggacctgtcacatcccaccatcttcccaggtgggatgtgacattcccagaatgttaaagagaggccactcagctccctgagcctatgccagaccaccattgtccaggttgaatgccttcttctcggtgacagaaacatctcttatttattttatatccatcattactgtaaatcacatcacaaatgtgatatcattctttgtccagctaaagacatgagaactcatagtagtacccagtgtttatctgatatatccacgagactgtttttatttttagctacaaaccatacattgaacccatctaagattgtgaaatttactttttaaaaatttccatggaaataaatatttcttaatgtatttttttactatatgtaaaatagtcatacagatctttgttatcaatggaatcaaataaggtaagtgcctgcacctcttctctggtccttcaggttaagctattatgagttcttaatccagtacttagattgcaaggaaagaagggttttacctgagctgaaatgttatccacctggctacagaatcaacttggaagacgttggctgcgggccaggtttgcactggtaattaatcagtgctggataggagcttttcagtatgaaaaggacaaatgaatggatcctgaggtgggtatcagtgagattcccctattattaaatgtactcttaagttatagagaactcggctttgcagtctttgggcccgtggttttgaaggaactgtggctatgctttatcctcagggcttcgaggggcaggcaggcagctgggggggggggagggggagggggcgttgctttcatcacatcccggactctgctcaacagttcaggactggagcttctaccacagccctcacacagggatctctactcctcttcaggtcccttggtcacacagatggtccagagttctctgttgctgaaattgctattgacacatagggaaatctcttccccagctggctttgctggaagaaaagtgtttcagagaccagccaaggaaaagcaaaaatcatcttttccatttcaatgcatggagtgaaaccctttttaattaatttttttttcactctgtttaaatggatctgataaaagtcttgaagtgagagaatcaagggccagaagttgcatgcccttgtctggtgatgtctcgttttgtctcctcaagagtgtgtttaagcttcttactggctgtcctagtgtacttcaggtgattggttgtataaaacgctaaacctttaaatacttctttacaaaattatccagctccagcaagctagacagttttaataggcttgtccttaaaggagccatgtgggtataagagggagctgtgaacaactctacacgtctcagcgtttctgtgagttctaaggatacccatgatgaaccacagtgtcaaggcaataaaatgactgagtttccccacatccctgcaagccaccagacctaaaaccattcttttccttctggcaataatggctttcactggaaaaacaaaagtcatagacagttgagtatttaaactaatattcatcatggcttgttaggtgggctggaagggctattttggtaattagatgcctcacagtctttattgacaacatgtgtttttt

SEQ ID NO: 380 - DNA, 3500 bp, Mus musculus
cagatatctcaggtttcactgtagctttgggggttcccttggccctgagcacctggctgaacaaagaaattgggtggtgagccagaccgcatgtaaccctcatctttttctccagtgtatttgtcccaaacctttgctctgaactttgtttttttgtcagtctggatacaattgtcttttttttccacgatggctttgaagtttaaatgatctaacaagatgaaacagctgtgttaggagctgactcatgctacctctttctgaactctgatactgacgtcctaactcctggcagctgatattctctatgaaagctacttggttgctaagagtctacagactgacccatggattggaatgttgcgactgggcagttaggatgtttcgggactgtgtcaggttgtccttaatcctcattcattgctccagcctctctgactggtatcttgggctatcacatggggacacacacacacacacacacacacaaaacaaagaccacctttgggactatattagttcagtagaacatgggctccactcacttgggtgctcagcatgttctatgataacatttgaaaccaatagaagaaatctctccacatgtttgatctgcctacctcaagtccccaccaacgtttttgataaatgcatcaatttatgatgtgctcttgttctgtgacttatgcaatctcatctacagtggaccaacatgcagtttcagggcatggttcctagactatgcttactcatatttgactctggataaaccacctcttgttccctttagagaaaggtgtttgcatcagcaaactccatgtcttggaaaatgacctgatttcagggaaaataccatcattataaatgagcttccttaagctgaggccattggcttttctccaatatatgacggatacattaataaacgaagaagctgtggacatgacaggtggggagaagacataggaaggtgtcctcggagagcagggagatatgacttcaaggcaggaagcattaagtattggcagcggtagcaagccagtcagaggcaggagaagacagaaccgtttccctcagcctgagaagccatctagcccagctaaggcccttggtcttagatgtctcaccttcacagcagctagaggtgagtttgtgttaaggcacttgggttgtattattttgatacagtcaccttggcaaacgaatacacacctctcctttgatgttattgtattcctcttttactgtgtcctatttcctcccaccttctgtcaggtagcttcaaatagactgcctcaggaaccctctctctgcaagacagaaaccagtgtgttcagggcttcctggttctgatcttgcattgggcacatgggagtgctctccttgtcatatgtaatgtgtaggtggtaggtgttgttttatgtcctctgggtagtgcctgcaggtctctgcacacacatcctgctgtggatgattctccagtaaaaatctcttcatgaggctaacctgaaaagaagcagtggttgcaaacacttcgccatgcttgtcattttgaaacaatgtttaaagcatctcggaaagagttggggaaagacgggttctttgcttctaggtctcctgtttccccctccatcagggaagatgtttggaggtgtggagaagtcagcaggggaatggatttcctgaaaccctccttaggtgactaagtgaccaccaatcacccaactttgtcattcatgttaactgtgcaatttcaaattttaaaagagtccctttaggggtttgtgatcaaggctgtgtcctgcctagctccctggcatttctttgaaactgtttggtacagctttgcttttgattgatgttatatggaaaatcctccttctggttgtacaatagacccagtattacatctgtcagcaacattatagtaaagaaattctagccaggcatccgatagctcagagggatttttttttttttaatttggcctttttcccccatccacaacacaaaattccattctgccaagcagtattgaaccctttgccttgatctgaggtcctagaatctcagagacttcaagtgttgcaggctctggtgagggagcctggaccctgcagtgcaagctgcctgcaggctgtgacttccagcagagagaagggtttgaagcatcaaaagcctcacacctcagggtgatttccatgcagaggcagagagggagagtgaccctgcccctgaccctccaaaactcacatctgtacaccctcccatctaggggagaattatagcctttgttttcctagacactgcaggaatacaaagaatgggaaagacccttgaaagtctggaaggggaaggggacagtagggcatgtcagagggcactaaccctgcactctgagacttgtgttctaatcccacacctgccctccatctagctgggaaaccttctcaaagcccctgcacctgcctggacctttctctatttataaaaataggttaataacaagtacttgacctgacagctctctccctggaattatgtctcgttgtgagtgaatgtgccttgctatttatccctctgtcagcctcctctcttccctccatctgtctcctgccacgtttatcacatcattactacatgccacgtgctttgctaagtataataatgttcattaattacatggctcaatgaggcactatcctgcttgtgcttaaaaatcgcattacttgggttcaaataaatcccagctgtcagcatgaccttgcccagatcccttggcccccagaagttcagatttcttactcataaatggagagagcaagaatgactacatggggcgatccttgggaaaaagaaaaacatgtgtgtcaagtattccaccacacacctgacagctattaagtgctgttttaaaaatcaggaaaaacaatagcacgcacttgtggaaaagtgagtttctctataacatccaaagagatgtgtctaccggaaggttatcagcctcatctgggactagaaacagttgcttgataaatgagttaattcctgaagtcgtgttccatttctatttcagtttaagcaaatattggtctcaccgattttttttcttttttaaaactattttttttaaaatgtggttttaattgaaatagagctgcatcacccccttctttccttcctctaagcgaactccctcaaactcttccctcgtcccaatcctgaaatcaaatgtctctttcgatgatgatgataatgtgaatgcacaaatatataaaaatacaaccagctgagtccatattgtaattccttctttctatatatatgtaatttctatagtcctacatagtttcagggttgaccagtctgcattagacatccagtaagggggttcatattctgctagcagtcattttatagaagttttcagagggcactaaggagaaagaacacctcgtcatgtctgggaatgggcagctataagggtgagaaaacagcaa

SEQ ID NO: 381 - DNA, 2150 bp, Mus musculus
ctgactgcagagtatggggctttgtagcctctataattacatgaatcaatctttatagtaagtcttctcttaattctatctatctatgtatctatgtatctatctatgtatagatctatcatctatctatctatctatctatctatctatctatctatctatctatctatccatccatccatccatccacccacccacccacccacccacctacctacctacctacctaccatctatctgcttctcattggctgtatctctttggaaaagccaaatgaagaaaccgtgaacccagagtgtaaggaggaagcctccttttcctgagctgaacacaacagaagttgggctgggtggtctgcacctacttcctctttcactgaaaccctccggatcaagagtgggtataatttctaagttataagtgagaatattgaagctcagagatgtgacgcatcatacccaagatcatacaatcagcaagtgaccgagtcagattaaaacctcattgcttctaacttcactgtcatttctctcctacccagccacatccttctctgcttatttaatttctctattgcacagtaagttttttgtagacacacaccaagtctaattgtctaattgtttattgctattattattattattattactattattaattattatttctacctgctcgtttttaggttttgtgcataatctaaaatttagtgcatgtgaatgaacaagagacaggtggtagcagccttagactattgcatggtctggtgtattgtcagagtccctgtaagaagaactttggagaccccctaactttattcagccttctatgaagtcccaatcctttgcatacccatgctgttgttaattatagcatggctatgaaagcccacagaagttgtgaaatgtcctgaagtttggcccctcaggttgggaatcgcacctcctcaggaaacaggtcttagggccggttcagcacctcacctctccataaccacccactgcagccagagcagggaggagagaggctgtgagctgaagaagacagggagaccctgacagacgctgggcctctggtggttggactctgcctataaatagaaggaatacggagcagaatgtctttttaatatgcacacggaattcatttatttaatgaagaattttcctggagcagagagcttgccatcagagctgagctattttgagtaggatgtgaaggaaaaactcgggagaattatttgctctttggatttatgcatttaaaataggctgcaataaaaagtaaaagtgtaagggtagaaataagaaccatgcttgccaaggatgggggtagggctaggagatggcctggagaggggcatgatgggacttttggttatcatggagacgctttatctctagtgtggtatttatttacatggctgtatatgtttgtcaaaacctatataactatttagccccaaataaatgactctgactgtttgtaaattacacttcaacaacgatgaaatatacaaatagcatatcacaatatgcctttggagggggaaaggggggaaaagggggtggatattgtcgaatgcctactatgggtgagggtcacagtggctccttttcttgcctggcctttgttaacacctgcaaagcacactatgccagaggtcacaggttattttctaaagttcccagggaaaaccacctgcagttctgaaaatcttaattcattccccaagttcacacaacgggtcccccgaacttacaaggaggatttagaatttcaaaatggcctccctccacctacctggagtttcagggacgaggcaagcatgaagccttggagacaggtttattaatccttcaataaaatactgttgaacacatccatgctttctctccaaaaatgttcctctattctgtattctttggctgtttcagactacatctgggaaaaggtcttaataaggcgctaatggaccttaacagctttatttaagtcccccggacctgcctttttatcaagtgttcttggctttgagaagaattcaaaatcctaaagaaggtggcttgtgatctctaggacctgccttcgttcctggatccttttcccatggctgatgccattaatcaatcaagatgctctctga

SEQ ID NO: 382 - DNA, 3425 bp, Mus musculus
agaatagagaaaaagacatacatatacacctagaaagagaggttatcataaaaattctctgtagagtacaatctaacagtattgaataaatagagcaaatgtgtatttttatctaattatgcaagcttataatggatttttttgtctccactgggaaaagagcatttttatcttcaaatcaaatgcattcatattattttgcctctaatgttatgtatctctctgatgttatgtcattgttgatgtcatatcacacacacacacaatgcaaatacaacctcctgtagtttattgagcccatccctgtgttgcagtgctatttttaaagattctcccagaaaccctttctatggatgaacaaccgagtctcaagacagtaaacctatctctgtagttggcggagcagaatcttttgcaggagcagctatgggaggaattacagttgtgtgacctccgtgcctttctatatctgcacgggcttgaggaagattgcatccgtttatcagttagatgtgccagctcctgaacacattactttttgttagagtgctctctggaggtaaatatttggccaatttatagggaagatttagcaggtagaagaagagctggcagcctccaacgtcagctaatgcactgctcctcccctcccccgcatcctctccctctctggtcttttgatgtgcaacctttctgttcagaacacccacgcttcttcttcctgccatttcagttcttcggttttgctttttcccaagccctccctgatgggcagtagcctgtgatttgtagaatctcatcacccgtgctgccctctgcttccatgcttcactcctctggttactgttgcttactggaaggtctcttccatcagactccctgaattccctgaggttcataggttcttgaagaggacctgtcagattcctgtctgcatgcaaggtgcctgaggcaaagcaaatgctcaataaatgtttgcagaagacctcactctagtatcagatctgcaactttgaactaagtgtccaccaaaaggtgacttccttctatggacctcagtttccctatctgcaatatgtaaaagctaaagtaaatgaccagttagtcattctagcctaagccttttttgatatttagatgttataaaattaagaaggaaaccatggtgtatttaagtaggactttattacttatatggcattgttttcctaaggagaagctattatttttaactacttatttagttcctatgtatgtgtctcagtgtgtgtatgtgtaccatgtgtgtgaaagagcctgaagaggtcagaagcagtatctcatcccctagaactggagttacaaatggtcgtgggccaccacgtgggtgctggaaaacaagcatagctcctctggaagagcagcagatgcccttaactgctgaccatttttctagacccaagagaagctccttattttgatatgacttaaattatgtcaggtatggcttatatcagtactcttcaccttaaaagataattaagattgtgaactttgaaattctgttttaatctcttctaccatggagctcaaggctcatgatacaaggtacaactcattgaacgcatttgttgggctcagtcaacatttgtcaagtgagtggataggaactgacaatgcaatggcttagacaaaaggcaccaccatgccatctcttcactcgttcagcaaggatcttggcggtctactctgtgttacacacgggacacaatggtcagcacaataaccatagagcacaggaaatatagacattgttcaaatcatacacaaattatagaacattacatgattgacctattattaagtacccactttttaggttataacgggcttttcacatgtatggcttcaagggaagttatagagtccagggcttgaaagtacagacttcagtgttgcatagacctggatgcaaacctggcttgctctcttactcataaactgggctcttgagcgagattttgaatttcagtttcttcaactttaatggaaaaaaaaatagggcattcatcacggggctattatgagaacgcagggagagagcatgcacacccttcagcacaatgcctgacatatggctgctaagtagtagctattttttctttttaaaataccattcatttttaaaaatctttttttagtagctattattatagtgcatttttttccatataacacttttcttcatctcttccagaggaaagacagctttgaaatcagacagatttaggatcagatctcaagtacaacatttactaggtgtcccagtttgagttattgttgctgtaatgaaacaccatcaccaaaaccacttgggaaagaaagggtttatttggcttatacttccacgtcactattcatcatcggaggaagtcaggacaggagcctggaggcaggggctgctgcagaagccatggatggtgcagcatactggcttgctctatatagcttgttcatcctgctttctgataaaacccaggagtaccagcctggaggtaaccccaccgcaatagacttggccctcccccataattaagaaaatgccctatagatctgtctgcttatatcctaatcttatggacatatacttttaattggggttccctgctctcagatgtgtcaagatgacataaaagtagccagcacacaaagtacaaagtggaaataacgatacagaatcatctgtgagtatggagtgaagctttcagaaaaccacatgaggacctaacatatactgactttcaatctgtcttttggcttttgtatcaatccttatccttcagtggcttaatgatgatcagagaagtaggaccactttttctgagccactaggacttctgggaccccgctattaagagggggtaataaactcgctcaccaagacctattgaaccctgagaccctgagggaaacaggaagactttggaaagtgttgggggctgggagaagaattttaatttctcccctttctggatgttttaaaacttatttgttggactagagagatgactcagcggttaagagcactgactactcttccaaaagtcctgagttcaattcccagcaaccacattatggctcacaaccatccataaagagatctgacaccctcctctggagtatctgaagacagctacagtgtacgtacatataataaataaataaatcttaaaaaaaaacttatttgttgttttcttggcaaaccagggtcatgtacatgctaaccaagtcctctagcaccgagcaacccccctttttaattttaggtaagtttatgatttttggttttttaatctgagaatttaatcaacatgtataagatagtttaacaggggaaaagcatatatttatttattaaatatgtttttatccttatcacagcatcc

SEQ ID NO: 383 - DNA, 2800 bp, Mus musculus
gcggcaccactgaaccatctccagctctaaaaataatgttttttaagtaaacaaaagaaaaatgtgagagctggatggtggtggttcacacctttaaatgtcagcacttgggaggcagaagctggtagatttcggagtttgaggccagcctggtctcctgagcacattccaggacatccagggctacacagagaaactgtcagaggagaaggaagaagaggaggaaggaagaggaggaggaggaagaagaaaatttgagctctatgagggaaaagaagttgagctttgttagttagcatttatgtctggtacctagagtgctgcctgatacatagtaaatactcaataaatatttgttaagtgaacaaacaccaatgtcaacttgcccataaatacaaatagataagcttctaccacaaaggatatttgtaaatatttaggtcatttatttgcaagaaaagaaatgttcgattgattatgtatttataatattaattatgggttgtttacatgtgtttacaacagaaaaacttatcaaaccatcattaatcagaaaactccactctctggttttgtcaactttatcccatttgtttgttaatttagatttattttgttttaaacagggtctcttgtagccaaggaaaccgtgaactcttaagaataactttgctttgacttacatgtattggtgggcaagagatcacatgggtacaggtgcccacaggggtacaggcagccacggaggtaaagcagggactatcctatcccctggagctggagtttcaggttgtgagatgccagaatgggcgttaggaactgagctagggtcctctgctgctgctttttaacttctgagtcatctttccagttcctaccctgaattctggatcccccggcctccacctcccaagtgcagacatagcaagtacgcactcaaatgtttaaagacagcaatgcatgagtccctcggcacgctgaggagactaagtgttaagcttggtcctccccctggtagcaccgtcccttccgactgcaccagtctggctggaggtctcatttctaaggtgtaggaaacagggcactccaacctgaaaaggctcgtcctctccagagagaaaatgctagctaaaaaatttcaaagagatccaaaatgactgagggggcctttgtctgatcagctctgtgtggcttttgtgaatcagaaaaatcaaggctggagagacattgtcctcctgttcataggaaatgtcgtgtctctgctaaatcagttctcccgacaacagtggctctcctctgggaacatttttaaatctaggtcacgaagaaattgtttctgactgctgctggtataggaccataaccccgctactgcccctcccccactttccccacccctccccccagcccttacccccccttctgcccaccccagaaacatgctactattcccagtgtcatttccaatacctccactcgttccacaaatagccaccaccattaaagggctttaatgtttcatttcaaatggattagttcctgtgaccaatagccaatgtaatgataatgaatgttgtgttaatcctttcgaaatttccctgagttcaatatatcactgtatctcaatctttcgctcttcggctgctcaattaccctattaggctgttggtggtcttttattggggcttatttcatctgtggtacacgagcttgcttcgggctcctcggaatcggcctggcttgtgtgatgaggaggacattaccctggttgtgcaccacttccagtctctcccctaagccacattacagaatcccagagaatcggtggaatggggaagctttggacattaactctccccacagatgatactgctggtccattaagaaaacagatctaacgttttagaacaaggtggtgatgtcacatagaataatgttctagaagacgctgcaaaagagatttctgccactaacagtgtggttcacaagatatttcaaagggtggctctcctgcttgaaaaaaaatactgatgctaagtttaaacacatacatattcatacactttattagggctgtgagaaactcagaaactgtctaagagcctaaaacagaacaccccaaagctgagatcagtgtgttcccatgtagaagccaggtggtcttggaggaaatgctagttagtacaggtcctagtgtctgagaactgctctccacagactggaagaccaaagaaagaggcaggcagatctgggatcccacagaatacagttagttggggacaggcatgggggttacccacccaccatctgagcccaaaggaggacatacatactggttaggaggaccctacccacgttggaaggtacctggtttatcttaagctgagaccaaagctgttcctgcagccagggtctgggtgcagctctatcttctactctaatggctttgtctagttatgatctgctgggaaactatttgggataaacaaccagagttacattgcggaggtcatggcagttatgacacaagatggctgcagtcatgtcaagttgaatccatactggtccaaagaagggagaaggagcagctagggagatggtccagtcagtaaagagcatgtcacgcaagcgtgaggaccttccttcagaactccagcaactgcacgaaagcctggctgtgttggcagggggcactgaggggaaatagcatcctggagcacattgcccaaccagtctaaccaaattgatgagctctgcattcagtaagagattctgcttcaaaaaccaagttgagccgggc

SEQ ID NO: 384 - DNA, 3925 bp, Mus musculus
taaggaagttctcctagcagagaaagaactctagccccaaatttggagagagcatagactctaaagcaagtcgttgtccagactgaacctgaggtataggtgctacagatgtgggaagtgtcaggtctgttctgaaaccaaagatgctaaggaagtgatagcttagagagcaatgagctgaatgtgcaccagcatgattctgctgtggatagtgagcagaagccagttagagctaccctggaagtgatacgctctcatggggcactgtgcaaaggattctgggatgagctgacctccctgggaggtattaacaatcactccatctttgcacgagtctctacagccctttcttctccacatgatgagtgatggtccacctcctcctttgctaagcatccctggaactcagaggaagggtggaagagtggatggttggtcccctatgaagacaagaaggggcaagcagacaatctgggcagtgtgtcccagggtgacagctgcaagaaggaggaagaagaaggtgcagggactcccagaaatgagcaccaacgtgggccagaagagagaccctggaccaggcttgcactactgtgtctgtggcatgcagaggctagtcctggaaggaatgtgaggttggcacccaccacagctgctttatggggacactggcattattgcagacagaagggcatgaggtgaaggtgtctttacacagggccatttccatcattataaccaggacccttcgggacatcagaggaggcctggggatagaacaaagtctgtaaggggattcctgcactattggtaccccacacccagccagagatgctctgtgccctaagaacagatgcaaggaaaggaaatggggaagagagaggaagctgggcctcaggacactttccatcttcactgggtcacacaacagcccttgaaggatctcagcagaggctcacagtggtcacaagaagcttgtaaggatgtacagagcagaggcccacagactgtccttacattgtccagtcaggaaagacctgtgtactgtgaagacagcaccagatgttgctgaatttgggatctgggttgcatgatgtctagtgcccacggcctggtcatgaaggctgcaaacgctcccaggtttcccaggaaacaggaatggtgccatgccagagcaagaagataaggtgcaggaaagggctgtggctttctggagccaccgttaatagatacggacagcgcttgacagtgcagaacggtccaaattctattactgaaaccacagatgagcatcttggtcctggacaaaagcttttgaggctagaacaacgggccagacgtcctgggggcaggctctagctgcagccagacagtcttcctggtggccccccgagctgaagaggagcctggcagcatgaagctttatttcttgattgtgttaccaggagatttaaaaaaccaactgaacaacaaaagccccaggcgaagcctcagactgcagcactggggtagaggagccactgctcccagaacactggacccctttagctggaagtaccacatccctaggtctggcaggacactcctcctagaaagcgcttgccaacagaattgcaggcccagtagaacggtccctcagcagaacagtggctctgcttgttattaagcatggagactgctaagatcgccatagaactccctgcaggggaggcagatgtagttggacatctggctcagttggtagaatgcttgcctactgaacacaaaacactggattcaactcacagcaatgcatacactggatatgatggggcccacctatgcttccagccctagagagatgaaggcagggggaatcagaaggtcaaggtcagctgcgcagccagtccacagccagtctggattacatgagaccccatcacaaaaagaaggaagcaaactttccccttcatgatggcccaactgcattcgtgggaatggagcagaatatgttcgaaagaaaatagaagctagcaagacgttcaaatccaaaatcgacttgatgtttgcacctccattcaattggtgtgtatccatgcagtcaaagcaatgatcagaatgtcaaatgtagtaaatagctctgccccaagcccctgggtatcccttgataatgtcagctgcccactcccctccactggaaatgcattttatggtaatccagcctgcccgaggatagaccagtacagtggcccctgtctactcccttgaggtatcgggaccatacagattcatggaactaccataatttgctcaatgttacccagctagcagatgtcagcactgggacaccctcacaatggaatgttccagaatccgctacaaacatggtaagccgtcctacctactgtcacggttgaagtcgctatcccatcatgatagtcccccttacaaagcccaggcgtggcctcggattctgcaggcagcatttcaggagcctgtcccagctggaggtgcatgaaagttggaacctgatttattaactgctctagaggaccatcgctttccagcaggtgtgcatggtctttgatggtccttcactgatgctatggtacggctccaaggaggccagcttctcacctgtctccagcggaatatgaggatgagaaggaggaggaggaggatgaagaagatgatgatgaggaggaccattggcaccatgcctggcaacttcaccgaaaagggttcctgagacacagtcctgggttctacccttaaggcaaggtgcagaaacctctcctgccagtaggtggcactgcaggctggcacacagctgtgcctgtagtgcctggcttatttttctctccttctatgctactgattactgtgctgggctctggcagccagaaaggacttcaggtgctctgagaatgttcgtgaaacatctctgtatgatgagctgatggctctcaccgaaaaccactgtgatggtgtgtgtggagaaacacctatggatgtgcgcctctgtacggactgagtatgcgtttacaagtgtaatagctcgtgtttctctgctgatgactctgtgtgcaagtgtgtctgtctcagtgtatcacgcacgcacacttgcaagcttggagtatgtacagacagttcagttatctgaggatcccgggccccacttgctgatgaccagcatcgttcctggggactcacatcatctcatgggcattgcatgcgcatcacccgaggcccccgaggccaggcctctcagtcttcctctagctttctgcttcagttccacttctgttgcctctcacctctcggcctcctacccctgcggctctgcagctttggggaggaagtggcaggatctgcctccacctgactcaatctccacgcatctcacccctcctcccaacagtgccagggttaatatggtcccattaggagctatgttgcggccaccaataggaaagctgacttccttctgggcttcctgctcttgccagacatgctttacctatgaccttgattgggaaatgtctccctgatgccccccccccacctcacccccatccaagagggtctagagattgaatgaatcatgtttgcaaaataagacaaaccaaaactctgcagagcagtgtctcacactcctggccaaggctatatatgcctttgtggctgcctgccactgctcaaggctaagcttggagctgacgctgatcacaaagttgccaaggtcattgcaaacatactgtgtgtgtcaggggtcacaacgctatgtctacaggagccacacaggaaacaggcgcaaagagcactgggcaaggtcttgagaagaaaaatagcaccaagaatccagcatacccgccacataggaatttgggctggtgggccctggtgtcttgttttgatttgttttctgagaaattagaaatttgaactt

SEQ ID NO: 385 - DNA, 2925 bp, Mus musculus
ctacgttttctggtggtctcaggcaacgcctgcggaaaaaccctttgatggcaagaaggtcacgacccacaggttgagaaccattgctgtagcagcgtggttgtgtccctatgcagagagtgcaagggaaatgatggtcccactctctccctctctccaatggcctttggaagactgtagtcatcttatcttgtatacacagccagcactggaggggagagaagattgagagacaccagggaggaggagcgtggggtccctctactccagactgctcacctgggtgcagactagtctctggagttcagtaagagctgtggtcaccgcaggccttccactgcagcctctacaccggcagctgtctgtcctcacctccatcacattccagatgcggcacagctggcttcctcttttggaggtaagatgatgatgtgagttgagatctggtctggttttgtttctgtttttgatacaggatatcatgtatcccaaacagtcctcaaactcactatatagctgaagatgaccttgaactttggatcctcctgcctttatttctcaagctctgaaattacaagtgtgaaccaccacacctgctttaagtggtgcttgagatccaaactaaggccaagtacatgttagataggtattctaccaactgagccacatgcccagatgtcttagttaggcttttactgctgtgaacagacaccataatcaaggcaactcttataaggataaaatttaattggggctgacttacaggttcagaggttcagtccatcattatcaaggtgggaacatggcagcatccaggcaggcatggcacaggaggaactgagagctctacatcttcatctgaagactgctagcagaatactcacttacagacagcagggatgagggacttaagtccaggaccttggtgacacacctactccaacaaggccacacctcctaattgtgccactccctaggccaagcatatacaaaccctcacactagcccctggtatttcattcagtgtaagttgtaaatggatgggccagcccagggtcttagagatggtgagagaagaaggaagtgtcagcccttgcaagaatctgctctgccatgagtctcatttaatgagaaaagctttctctctgggaagccactgggcttctggtctcaaattactaataattgaaaacaagaaacaaaaactaaaccaaaccaaaccaaaacaaaacaaaacaaaaaactgactatagctcatgactgttcctttaaatatatttgcaatgattcagctgggtttttgttgttgttgctatgttgggggtggaatctagatcatgacagatgctaagccatgaaaacacctctttaaaataatttcagtagggaacctaatgatttagttcatgaacagtgggcaccgtgctcactatatctgaagcatacgcttctcaggctctacaaagagacattaagaggcgtccttggctggcaacagagctcctcggtaaccatgcagaacattatgcctttccccagggatgtagcctccagaccccaacgattccccaccagcactccaggctgaaggatgcagctatcttcccaggattagggcaggcaagatcaagccttgccaactgcagcactataaaaggatgttcagggataatgagcaaaatgatgtagtacgtacgaagctgtttttctggactcagagtttgacttctctctatgtcctgtctcttcatatgagtactttaagttttatctcctacaggtaccagtgtaggagtcacctacatgggtctccctggtctcatctcatctcctcccatccttagagtacatggccagtgacactactgcctatcagctatgtgagagctctgcattggttcttcgtggtagagataggaactttcccagcccagaaccccaggagtccacccatggtctggtagaggacacaaactgtgacagatcatgacagtcctgtgttgtaacagagctgagctgatgctgcttcagcagcctcaatgaaccaaactgtgacaccaagctgatctctgacagtaggctattgcctgacagtcaggcaggaaagggacgtagacaagcagttgcccagagaatacagcctgctgtgccttctgtcttcaggatatggatagagcagactttatgctggatgggaaatgccctggacatttgactgagctggctgaggcattttttttctaaactccaaatccaatcactttacccctcctgccccccctcaatgaagagcctgaacttcagaggagagaaagcatattctatgttgtgtgactcatttctttccctcccttatctagagacatcctttccttctacatccacctgcagaactctgggccatgctttaacaatagcctttgaagtgtttcctggttccatgtcctgatcccagcatctgaaatgcctttaacagtacttgccttccaagccctgtggttgtgtctggtttgctgcatgcatgtgtctggtttcacctgtgcgaagcctagcactcagtgatagccgaagttttcctaaactgggttagttatcggtgtttgtttctagttgaattgtgtccctaagaaaagggccatgctctttcaagaattaacttctcagtatgcttatttacttattgacatccaaccataatttgaaatagcacctttgaatccagcactgactaaggctctaggtatcccctcatatcactgctgtggaagaacacagaacacacagccagtccggaaggcagtctggatgagcagttctaatctgtcatggaatagagttaggcgcctcgtgattgcctctgtgaggatctaatcctgcagaagggaaattcacttgtgaccttgaagtcaactgtcctgaagagaa

SEQ ID NO: 386 - DNA, 2850 bp, Mus musculus
ccttcccccattttacctcactatatagccctggatggccgggagtttgctatgttgatgacctggctttgctcacggtgattctcctgcctctgctgctgacgttggggttgcaggcaggtgcgccacaatgagcttcttggctctgagagtctggctgagatgctccaaaacttcccatccttcagtgccagcctccagagtgctggaattactgggatatgtcaccacaggaggttttccaacatttacattttccattactattattattattattattaattttgatttttaggactagctgatggatcaagtggttaagagtgcttgctgctcttccagaggactcagggttggttctcaacacacaaccatccttaacgccagctcagaggatctatcgccctcttctggcctccagcgttacttccacacataggacaagcacacataaataaaaacatggtggcttgtcttccatgttaataatagaaaggatacagtaacgaaggtattttggagggttcagcagttaatagcacttactgctcagtaagagggctataatttggatcccagaatccatatagggaagcttacaatgtctgtagctcaagctatcagagatcttaatgtctccttctgacccctgtgggcaccaaagtatgtgctgtatcttttaaaaggttcatcttattctttctttctttcttttttggaaagagtgtcactgagccgctcctggccgtgaagtatgtatgtaacccaggctagcctaaaactttgcatccctctgcctcctgggtgccaggattaaatgtgggcatcactcctctgtgaaacagccttagagactgtccctgccctgtgccagagttcaggtccatgttctctcatttgctgctgccgttaagggccagtccagtttctacattccttcaaaagctgggaacctggaaggcaatgcctcaggtcttgcagggcaggaaggtgaaattcacgcatcaacaggcgaagagatgctgtaggttgtcctagaaaccggatcctagttaagtgcctgaaaagtaattataaactccagaatatctttcagctgagcaggtggctggaaaattagaaatctattcctgagactccttctgctttccagaaaggctaaggttacatttcaagacagggtgtacacaggtggcctccgtggagcaagcatgtgcgcatgtccgggcgtccttgcgtgcctgtgagtctacaaaatggtgaggggccctggggacctgaaccgcaagtctaggggtgaagctggcgctcagctcagagcggaggcagcgcaccccccccccccacctccttgccttccttgggttgctaggacaccagagctgaggagacgccaactgatttgctaaacaatttttcttctaattaggaataattagacaaaggaagaatgggtgtatttgggtggtgtcaggattcgacttagagcttggagaccccgaggaggagtcatcctggctttgtgagtaaggagctcccggagccatggcacccgcctgggggaggggtagagaccacatttatcaagtgtctgtcaccactcaggcattgcatctgttgcccggtgtgcatgaccaagtcacaaggcagggagggatgctggctggcttgtcttcccatgatcccgccattgttggaaccccatagggctctctgggttgcaccaactttttccatttgcggttgttgtacctccttgtgttgccggcttcttgccagcctagaagacaattctcattcaagataagtcttcgtccccttctccaccccccccccccccgcacgatgctgctgctgtgtggtccttaaggatttttgtctatccctgcattctctcctttgtctgcctagccagaatgccagatttctcaggacagtggtgcacatatagggactccgaatgcacatttgtcagatgagtgctggagaggtaagccatttggtaaagtgttatagaccaccagtttgatttccaatatctacatagatgggtgtggtggcgcaggcttgtaactccgaccctggggagtcagagtcaggtgggtccctggggcttagctcacttactgagttccaggccagtgagacaccctgtctttagattaggaagagagagtcagcaagatgtgcccaatgggtccttcacttgctgttgatgcggacaacctgagttccatgtctggaattcacatggtggaaaaagagagctagctcctacaagtcgtcctccaacttgtgacgggtgtgtgtcccttcccccacaaaataaatgaatgtaaaaaaggtaacagcagcaacaatgtggatggctcatgaggaatatcacctgaggtggtcctctggcctccacacacatgcatatgtgtaatacacacacacacacacacacacacacacacacacacacacagagtctgaggggaccagggtctgactaacacctttttctaacaaggtcttggcccagtggggatattattcccaaactgcccctcccccaaaaccctgctgcctctgagtagtcacggcctagcccaggcactcttttcaaagaggctggtatgaaagccaaggtcataggtctcctaccatccttagatacgggggagtccaaggggatggtgatgtgacagggtagcctactggtccccagagtcaaactgcttggaccaaattccaggtctgctagtgaccatctttgtgatcttggctggcccccaggatatgaaggggtgatatgctggcaaagtgggagatactttctaccatacaaacttcagaaatcac

SEQ ID NO: 387 - DNA, 5425 bp, Mus musculus
ttttttttataactctataaatatatactgttgtgtgtactcccaccaccaccaccaagtattgtccccattcataatgccagtagcaaaatctattagcctaagattgctaggtatgtgggcttcttgtcgagaagtgtggcccctctccctccccctccccctctcccctttccctcctcctacctctctctccctctccctctccctctcccactccctctccctctccctctccctctccctctccctctccctctccctctccctctccctctccctctccctctccctctccttctccctctccctttccctgtcttcaactgccttcacctttacagagagaacaacctaatggctctctttccataggtgacatatgagatagcttgtcacctttaacatcttcattacatctccatatttatgtggcctctttaaatgtgagaatctaataagtgtatattgaatatacccttagaacatacatcagttgattacagggaacttcccaagatcctggtaaaagctgtgaacccaaggctgaggggctttaccccacaaacctctccgtggaagacagaccccattatgtgaagttgtccctgtgagtcagattttttttccaacaacaggtcttagtgtggctagcacactttggtttgtgtcactgtgagtctcatgtgcagctgatatggccacagatgctgaccagtctgcaatggccaacagactgggaatcatcagttagaagactggacctgagaatgtaggtcaaaattggggccacgttggaaagggggacatctgtgtagaagtagtaagttctcagaggacccataggacaagtgtaagcctttgcataagagtgtgtcccaggaacacatgcataggattgcaagtgtgtgtatgaaatcatgcacacataagcacacacctgtccattgatgctcacacatgcacatgtaagcaggcatctgttcacaaaatcatgtacctataagcatccacacataagcacacatctgtacatatgtgcatgcatgcacatgcatatccatgcacatctatgcacacacctgcacacacatacacacatgttcttttgcgttgaacttgggtgcttgggtctgcagtgttttttagaatggttgtaggtcatgtgagtgaaggacagtgggatccagtgacaataaagtctggcgagagccttggaatcccttttagagaagcagatctgaaagggatgtcaggggtgctgggatttacatcttggtcactagataagagctgtcctggatccagccctggatcctcaggtgcaagtctaagaggctcagattctcctttccagtaggaaggtgctcattccattggacagaagctccatagggccttcacacacacacacacacacacacacacacacacacacacacacacacaccctttaccagtttatttcactatttttttgtgttttgctgttttgagttgtagagttgttttacatctccatgtagacaaactcctcaatatttgtggtttctttccaaagctgacaaagttgtcattctgtcatgaatctgagagacggtttgttctatttttagctatttgtcggtgatttgatttctaaactgtaatttgttaatccatctggagtttatctagatgaatgtataatatcgtccaaactcttaggcagtcttccaacataagttttaagtaattctcctccctcgtgatctggggcaaatagattgttttatcacgctctgaatcttcaaatgtagttaagtctccttcccagagtcgccctttgttctcctgtgctgcgtctgtctcggccctggtattgaataattttaattgttgttttataatatgttctaatatctagcacagctaaaaatgactccttcctcccttaattattttctctttcagaatagtcattgttattcccaactgtttgttgttcaagattaattttagaatcattttgtcagggtaaaaataaaagcctactgggattttgtgtgtgcactcctgttaaactataaattaactcgaagaaaatagacgctctcctaatacaccagcttcgcacctagacactggcgtgtctcttttgcttcctctacttgcactggactaaatataacagttctgtcatgcgctacatagaggccacagccataactccttagctgtctttttactggcaggtgctttttacatgaccttgcccacctctgtaacatgcaccatgctcaggtgacgtttgccctcctttgttcccaactaactatagctggcacctggtattccctgtaaagacatgatcccaaattttccaatttcaaacattctctcctttggctctgaaaatatctcaatagctagagcccttggaaattgcctttttcaaaagctcagtgccagggttgggatgggccaagatctgaaaccattagcctctgcatggagagcaacactcctgaagacctttgcgctggggcaagagctgcctgtgagctgtgtgagcatgcttgaggaaatgtcctcattcctccaggcttctatcaaggtctcaactacctcagagcacctgaagagataaacaggaaacatgggagttccagggtacccctccctctatcctctagtcctcaaacactgggctactgagaacctgtgccctgaccttgctggcgatgtgcaaagtggggaaatggccttttcttcaggtggtccactggagagcctgtggcaaggacaggaggtgggatttatttgtcacagaactgaaaatgtcatggtggccatggctgtgaagcatcatagtgccttagggtcaacctgggcaaggcaagacggagatgagaaagttcagggctaagggaattgcctctgggtaaggagttggctcacacatcagcagcagcattgtcagcatgtacaaggaaagagtcaagaccgtcagaccaggctaggctgggtcccataatcactttgtgttggagtaggcatggggaaaggagacttctgggtgatagagtctacctgtgaaacgtggatccatctgccaggcaggggccacagtgacagaggtcatcaagagggacagtgggaagggcctatgggcaagctctgctctctgtgtctccaagcacaccagatgctgacactgggaccatcccacaccttcagccactggcttgcgggaacggaatagtctcatcaatgtgtcgtctggcctagctaagcttggcttagaatctggctataaaaatgacatctgtggaatataggcatgaactgctggggctggctagaagcaaagaaggcaaaaaggctcatggtggatgctccctgcgtgcgttttattacaatgtccaaggaggtagcatcacgccagtatgaatgctccatatcacatgcaacactcactgctttctttgttcaaatactttgtgggctaaggtggtgtcttaggtgtctcttctcagtccaaaacagacccagctcatgattcatgtcacacatggacatactagcatacaaaattcctggcctcattctcagtagtttccagtttactgggcccaggaatcataagttctagaatgttcctgggtgatctaaacatgaaggcagatttctgaaccactcacatggaatacctactgtgtgtcagtagcttacctactgtgtgtcagtggcttagggatgtctgagatgtttggtcccactgtgagatggcagcacatgagctgtggcaccatgtcacatgaagtgatctgttatggtcagacattggggatggccaggtgtcagctgccatggtggtcgtgatttcctggagcctatggaacattagcctccatagctggtatcctagcaaggacaggatgcatggactcatgcttggacctcacatcttgtagtgattttcagctttccttttgtttaagcaggacggtttcgggaaggtctctacacactgagagttgtgcttttggtggggaagtagagggtatggttcttttatggtcctccaggagctcttggttgacagaatggtctccaagtagtagaatgatatatgtggtcacaagctgctacaaggagctgttccagttagcagcttccccaaagtcttcttggaagattatagcacagtgaaaaccttcagtccattccaaactaaatttctatccagaactaagttgaaaatgtggctgaacccaaatcctggtctcgtctagactcacctgagtacagcagggactggggaaccaactatgctgtgtgtgtctagccatgcactgcccctgcactggttgggaatgggagaccattgtcaccctcacttctgcctccagctgtgacaacaagccagcaggctgccttctctcagtaaaatgcccagagatctgggtatgccttccccttgagctctcccacgtctgactcaaagagccgtggagacagatgctgagctccacagaccagcatctgtgctcctcactgtctgtcggaatgggaccggagctcgaagctctgctagtcccctctctttgtccgtcatcagcctgggacgtcagtgcagcattcgtgactgtgggtttcctcaggctctgtggagttcaggagggcttcactcacctttgtaggagccttgggtttatagttgaccctccagctcttacaatggtcatcttgtggagcagtcaagggaaggaattttcatagcagggatgctagtcttcaccctctctatgaactccagtgaggctccagcaaggtccccaggggtaaatacaataccatatgataatgctaaatggccattcatcttcctccgtcttctgtagatggcagcttgagacgtgcctggatgtcgctggttctagtccctgtgaaggtgctcaaactgccttaagaaacaagtcagactgagagctcagcatggagacgttgccactccctctgtgggagatgtagccactccctttcttgaagtcctctgagttcaggagataactgacaaatgggtatttttctcctcacctgatcctaggcctgactttccaggataatagaaactaaagccaattttagaaggaccccaaaggccaactggcacctgcctgtgtgacaaagacagacacctctgcgagttacttggagttcttgaagactgggcacaggtagctgtgaacttcatggggttgtgatatacctgtgagcagcattgctgggaacatggggggaaatgagtcatttgggccaccacattttatcctatgtgtctcagttgaatctcactggggactctagactcggaatgcatattcctcccattctggtcatttaaccaacagagcatcctctgcccacagaaaggggcagc

SEQ ID NO: 388 - DNA, 1650 bp, Mus musculus
gtgagcacacatatactcatgcacacactcaacacacacacacacaccaggggtggggggtgagcacacatatacccagagaggaggggtgagcgcactcgcgcatgtacgcacacacacacaacacacacgggatagggggtgagcaagcacacaaacatacagtgaaagctaagcattcagttaaagcaagaactccccaagatcattctccacccaaacagtttaaaaaaaaaaagcaattttcagttcagtaaggtcacagaaccacaaacgtttcattcaccaccagtggagtataaattggcatgattggaaaactgtctagctaaaatctactaaagatgaacacacacccttgcaacctagccattctctcctacacacacccacacgacaaaggaatatctaccaaaaataatctgcccagactctcttgctcaaagcaaccccaaattcagaatccacccagatacctcccaacagttaacagaaagtagatgcagagggcttgtagaatgaaccacatagttctgagaacgcctttgagaggaccatgcatgccacagtcaggtctcctgggaggaccatgcatgccacagtcaggtctcctgagaggaccatgcatgccacagtcaggtctcctgggaagaccatgcatgccacagtcaggtctcctaagaggaccatgcatgccacagtcaggtctcctgagagcacagcattcacagaaacaagtgggcacaaagcaaacatctactgcatgattctgcttactcaaagcccagaaccaaaaaaacaatcatgtatgacgttatctggcaggagagtggttacccctgggaggtggtgactgcggggaacattggtggcctcccggatgctagggctggggatatgatttcttcgtttggatgtgagtttcctgaagtgtccaggctatgcgaattcactggactgacttaggataagcaccctggatgacggaataaggtgaactgcccatagccctggggaccaactgacatgcagagatcacgagaatagagtagtctggtgtttaactacaggttgtgcaaagctgtgggacaatcgcagccattgctggctcctgtcctagaaaatcttcagtgcgtttgcagatgctgaaggtgagtggtgtccaggggcagccaatgaagtgggctgagttctagatgggctactgctacatatataatatacatatatgtatattacatatagaatagaaaactgcacacatgggcaaccagacaacctctgagccagtccccgtacaggttcctgggagtctgcaagaatttagagaaggctttgggcatgagctggccttagagggcagctgctaggagtggcaggtctggtgggtgtgatgatgcagacccataagcccaaccagttaggaaaagaaagtagaaagaccaacataaattcaggaacaacctgcactacaggtgacacacacacactcaaaaacttaaaaaaaataactcagatgggagcgaagttggtggtaaagtatgtgcttagcatgcgcaaggccacgggttcaattccctacacctaaacaaaacaacaaacccagcatcagggccaggtttacaaagccctgccttgccaatcacagac

SEQ ID NO: 389 - DNA, 2050 bp, Mus musculus
cttggggggtcatagggatggctcagcgcacaatgttgctgttacagagaacctgtgtttccttcccagcacccatgtggtggcgtataaaccacctgtaactctagttccaggagatacagttccctctcctgacatccacagacaccaggcatccacatggtacacagacagacaaacactcacatgatgcacaaaaataaaataaagaaatctggaaaagagaaaagaaatgacaatctaccctcgcccccttagtgaatgctgggattccaggccgtgactggttagaaaccgacatccctaaggcactcccaggagaactgcagtctaggtctaaggtccctgctttggctgggcccttgggttgacctcctcctggctgccacccccagcaatccctgcctgtggatgctcagggggccacaccctcctgcagatggtgggtggcggctcctgctggctgggtttgtggataacagggagtccgccctcttagagtcggtgagaggctcgagcacagactcatgttcttttcttctggaaatatgaacttaggacgcagaaactgagaccgtaactaaagaagacagaaagaaggtcttgggggctatggttcagggagactgactcttccacagcatgctgctgagaacaggacagccctctgcctgacccagatgtaggcagctcatggctcttagaagcaggggatgcctggtgcattatgggatttctcggggtcagcagtgccagctctatgattcggcttcccagaagcagcacctgagacctgggaagtatatgtgggagatgattccagatggtataagtgaggaagggggaggggaggcaggcaggcaggcaggcaggcaggctaatgaatgtgggctatgttgatgagacttagttcttaaggctcagagaacctctgagaaatctaatagagatcatttaccaactgacttctcttgccacctaccacagtggccaccagcatggggacatgcctgtctcctgggacacagctggatcaattccctggacctcaggggaagctcttcaagctgccagcttgctccacagcacagatgtgatcactatcaggctaggggcagtggaggctctacagtaactgctgcagcctccctgcctgagacttgaagcatgaactgttcgagaatcagagctgaaggtgatggcaccatgacggtcccagcagcaggaggcttactgcagtatgggccaagaccagggcctgtcattagggtaccatgccacagcttatagagagaatctcttatgtactgtgtggaagcatcacctgtcaataaaaagccgatggcctattagctgaggcaggaaatagaaggtgggacatccagcagagagagagggagaggattctgggaaagagtcaagagcaggaggattcaccacatggactctgagggagttggacgtgtgaaactaggagaggtaaccagccatgcggcagacgtagaataaacgggttatataagttatgagctagttggggaatgagacaaagcttaagggctaggcatttattcataaataattaagtctcacagttgttattttgggaactggatgcaggtagaaaattccaaacctacaacttgagagacggggctgggcaggggagagggcattgtaagtctggtgtctgctgtgtgagcatgtgacttgagtctggatcccaccgtccatgtaaaaagccaggcatggcaggaggtgcctgtgatcccacactagggccacagaaacagaaagtgcttcttgctctcactgagctccaggttcagcgagagaccttgtctcagaaaaattaggtggggcaggagaggcgacgcagcggctaagggttagtgccacttgccagaggatccaagttagggtctcaccatccacaccaggtactgcacaaaactccagctccagggtaattggatgcttctgtaggcacctgggctcatgtgcacacacccattctctgacacatatagctcaaagtagaacaagtctt

SEQ ID NO: 390 - DNA, 2750 bp, Mus musculus
tcctctcggggaatgtttgccttgagcccttcacatgtcttgaaccctcgcccgtgtgtggactagaacaggtaaaggggacattcaggttctagagaccagcattttgtgtcaagtcattccgtgacgggaacaaggtgtgctgtccctcaccttcctttactgccaatgcgacttggccatctaaaaccacttctgggctgtcatttctcccctcagagaggtggccctggttctgcagcctccaatagagggccagggacagacatacagacagattgagctgggacgaggctgttcactgctctacgccatcaggagctgggtagaaggaaggacagcacctcagagcctggcctggacatgagtggatgcagagatggtgatgatgtttttcctgtccccaccccatccctgtggactgcagtgcttgcggcccataggaggcaggcagctcagacccccacagccttgcattcctggggttcaacagcaggtgacacagaggacaagggtacattatctcacatgatctcactgcaaccagaccagcaaggcccagggagggagagaaactcaggaaacactgagattgcaggcttcctgggggaccaagtgacttggggcatccagggtaacttggcctgctagtgatacacaggcttgggtgcagaccccatctgtgaggtgcccacttcttcccagggcattgctacagaaaccttgacggaaatgactgtttactccaggcctaagggttcttggcagaccctcatacctgtggccccgccccacctccggcagaggccactagggtacagcagagcagtaccacagtgagttcaccctatgggagacctagttcaattctggttccgccatttctagcaatgagttctggcaaactctccagcagccctgggcagtgtcatccactgcacaatgggagcaaccccccagccccccccccaacatggtccctggcttgctctgaaagtcagggaaacctgcagaggcaggaacaaggaacacggcagcacccgctctttgctcgatgctatttccaatgacacttgttccaggactgtgtctcctgggccatgcccactctgtggtctcctccccacccctgctggtccctccagcctttctcccagcatctgctgtttccatgacacccttggctggggagctaattttaatgagcaagattgattaacacgcaattactactttccttccctgtcccttttgtcttttagaaatggaaacaaaggacattctggaacttgagtcaaacatttaccaaattaattctcaagaaaatgtttgagattccaggggctggtggctattttttttcttcttcttctttcttaactacactacatcaggaagtaattgcctgattaagggacacagagcttggagagtgacacattttttaaaattagaacgcccctgccaacagacatgtacgctgcgggttgtctcttcctcaagcaactccactctaaaagagaaatggcagagacggaaaggaaaaggaagggagttggggggcaaggacctccttcctgacctccaagaccccaactgctccccaacacatgtaccttcatttgtgcaaaccagggctcatgggaagatgtcaattccagccccgagagtgggaagcacaccccagacagggcagtagggttacagggcttcctatgacctggatgccaccttccaggccagagatgacagcacccaccgggaaataataaagtgactatagagaaatgtattgtgggagaccaaagaaacacagtgagttgcagctgtccctattctacaacatgaacgctgtcagcacccgtcactcatcaggcttcgaactccccagatctcattcagtggcctcttttgcaccaaaaagccccttccaaaaactgaagaggctgcacccctcccttcaggccattgcccaaccaacttctgtgtcagcaccgatggcagtgatgacaagactgttcttcgcggcatgtcagagaaaacctggcatggttttgtccatagtaaacatttgcaggtgaaaggatggatggatggatggatggatggatggatggatggatggatggatggaaaggtgaatggaagaggaagatgggtagatgaatgaatgatgggtagatgggtgtgttgatttgtatatgctcagcccagggaatggcactattaggaggtgtggccctgttggagtaggtgtggccctgttggagtgggtgtggccatgttagagtgggagtggccttgttggagtaggtgtggccctgttggagtaggtgtgtcactgtaggtgtgagctttaagaccttcatcctagcttcctggaagtcagtattctgctatcagccttcagatgaagatgtagaactctcagttcctcctggaccatgccggcctggatgctgccatgttcctgccttgataataatggactgaccctctgaacctgtaagccagcctcaattaaatgttgtccttataagagttgccttggtcatggtgtctgttcacagcagtaaaatcctaagacaatggatgagccaatgggaaggtggatggatgggcagatgggtagctgaataaatgacttaatagggggtgatgggtagatagacaggtgggcgggtgggcagatgggtggctgagtagatggatgggtgggtaaatgggaggatggtgggtacatgagcagg

SEQ ID NO: 391 - DNA, 1875 bp, Mus musculus
gtgtggtgtgtgtgtgggtgtggtgtggtgtgtgtgtgtgttgcaattattaacaggaagtacattagtctcctcctgctgtgtaacaagtcatcccagacatagtgatacaaaacatgggtggtcaggagaggggagcaggcacagtagggcatgtcagagggtggggggtggggtgggcaaggatggagtgtggtgggggcggaggggggtgttcagcaggccactgtggttctaaatcacttgtaggtggcagcagtgtgcctgctgcggctgctgtcagctcaaggttcacctggaaagcacctgtttccagctcactcccacgcagagatttggttcctcctggaggaatcccagaagcccctgctctcagggttgcagcctgtgccccatagagagctctgaaaaagagcaaaagccagtgtgtcctcacgttagcaacggtacccatcaccattttcctatcctattcatggggtgcatcactaggtcccttgtgcccttgggaaagactaaatgttagtgttgatacagcaaaatgggggtcacgggggacattttggaagcttcccaccacaggaagcagagacaccatttctggaaaccaagagcaagtttcacgtctcaggccatatatttcagctgtgcggctttggcctcgctgactgatgcttgtggtggctgctggctggattgaccagaggctgctgggagctgaggtgactgtcaatctctgagctgtgcctggctcagtggaacctcagctcctgcaagggaaggacatttcttaggagaagctaagtaatgagccagagccatcgttcctgagatacagagtccctctgcagctgctgtctcctagggactcctgagggactttgaagccctttggcaagccctgggctgcctctgtggctgaggccacaggtgggggacagtgttgatcctctctccgttccttggcgatcccagcagggctctggggcacaggtgcagcaggaaggattagatgggattttctcccagccctgctcagacctggttctcagtgggtgaaggatttgacccaaactccccttcaccatctgccctgtgagctggaatcttttgtgagtctgtcacagactcaccatgccccgttgacagtctcctcggggtcccagatgccctggccatggtcttgttccttcagtggtccccaaagggtctgtctagaggcagaggctgaggcccatccctgggcaacagagggcattaaagcatttcccaggatgtagctggcctctgtgtccactgttcagttgttttgagacagggtctcattacgttctttttaaaaaatatttttattaccgtgtgtgtgtgtgtgtgtgtgtgtgtgtgtgtgttgtgcctgtggatacatgtgtgaacttgtgaaggtcagagggcagctcgtagaaactatccaactcaggttgctctcaggtgtggtggcaagcaagcgacttcacttgctggtaatccccctgcatctacttcccaagtactggactctcagataggaacaacaacagtctactccgagttccattctttccaaagcagcgcctcacgcccaggctggctttgaacatgttgtattgcccagaacgacattgaaatactcttcttctgcctcagtttctccccgctgagatttcagacaggaaccatcaagtccaactccctcaagttgattgttgtttttgcttttagttttatgtttacatttactagacaagctctccttttgtacctctcactggcttggccctaggtaggccaggctggccttgaactcacggaatccggtgggctcagcctcttaggttctggaattaatggtatgca

SEQ ID NO: 392 - DNA, 1825 bp, Mus musculus
gttcttcaaagattccaaatggacttctttttttctctctctctctagagagactagagttttgaaccaccccctctctatctctctctgtctctgtctctgtctctgtctctctctctctgtacgtgtgttttcatgaatgtgggtgcatgtttgaagaggagggtgtttgttttcatctggcacctagcttgagacggggactctcattcactgctgtgtacaccaggttagctgaccttgagagactctttgtctccacctcccatctcaccatcagaacactgggaccacacatgtgtgctgctgtgtctggcttcttagattctggtgattcaaactcatgctctgcatgcccaacggtttagccacaaaccatgtccccagccctgaaatgagaatcgtgatatactatagtcaggactaccttaattgaccttcagaatggcagggagttccaagactgatgtccccaaactcagcaggtacttggggagcaaagacttcatgggtagctcaagatgaaccctgtgaaccctcagagactctaggctgacttcgctgcggaggaggagctcagagcagtctagaaaggaaggaacagccactattgtcaccagcatcaaatacatttgggggtctgaatcgcaaacaagcatacatatgggacttgcatgggcaaggtactagtactgtgtccagccttggcaaggattgacccagtgacctgactgtgaggaggacttctggctggtgagtggtgactggaaattctatttgaagtgacttagctccagagcctcccctgagtcaggaagtgatcacagactataagacggttcttaacggttgtgagccagcgccactctcctccccatagcaccagggtggatagaacctagtccacactgcattaaacagacccatgggatgaggaaatagatacgtggcgagtccgggagaaagcaaaatggcagacagtgctggggaatccttgtcgagaagctgatttccagctccggctcctcttcctgccttgcgtgctttctacagaactgaaaacggctccatctcccaggtggttgggggtgcacttcacacgcagaggtgtgtgttaacatctgttcctacctcttccgatttgacaagggctgggaagcaggttgctaggatgttatctggccagttactctgcggggcttttctggtgcagctgggaaccccttgcttatcacagagagttttctcctgggaatgtgctgaccccttgaatgcaatgggtctgttgaagaccatttaggaattactccaagaatacaatgttgctgcctcttggaagcagcaagcaggctgtgaacactaccatgtttttccaagaatgaacattattggcctggcacacaacacacacagacatacacagacacacagacataagcagacacacacacacccacacacacccaaatacatttagataaacacacatatacacagacacacacacacatacatttagacatacacacatacacacatatacacacagacacacacatatatttagacatacacacagacacacacatacacagacacacacatacacacacacacacacacacacaccctcattggtgtaagggatcaaatgagattgtgcatgttcaaggtatatagcttcagactaggctgcagcccccatgcaggctaggcaaatccaaggctagccttgaacttactatgcagttgaagatgaccttgaagttttgatcctctagtctctacctcccaaggaattacatgcatgggccaccatgccgtg

SEQ ID NO: 393 - DNA, 1750 bp, Mus musculus
gatagtaatggactaaacttctgaactgaaagccagcttcaattaagtgttttcttttataagagttgccatggtgatggtatctcttcacagccatagaaaccctaaggccggtgagatcatgattgatagtaagtatctttacctgttgagctaacttaccagccagagatccctgtctgaatgattatgagagagagagagagagagagagagagagagctgggctggctctgatgtgaaatcagagccaactgcgtttcatcctgcattgtcacatggcagattctatccagctatttggctcgggatggctggcaaggtgataatattaatggtgttgataacatctcggagtgatctgcttctgcatgtagcgctgagtggtttacaaagccccagacataatgagctcgtttgacttctcaatcataatctacacaaccactgagagtcaaaccaggatacctatttcctatggctgatttgtttaagtgtctcatacgtattaattaatctgatctccacaacccccagagagcagcgtcttcttggtgtctccgtctaatccatttatagataccgaggaaatgaggaaaccaaggctcacatgccaggtgacccagggtcgccagctaggccctacccatgagagccttatgtgagaccggtccagtctctacagtcatgtgtccagcaccatcttcagcctgtgacaggaaacacgctctgaggtacacacagggatgtagtagtagaaaagtcttttgtcttggtggagaggagatggaccttcaggaaaaccaggacaatgtccctgagacacatgaggccaggaccaagaggccatctggagtgagacgaggtcagcgcaggcccccggaataagatcaatatcaaccacaaattcacttataaactcattaatattcaatggactctcctgttcccatagagaggctggaagctttccatccccagagaagtggggacaaatgacagctagcaggaagtcagcaagtaagggagactcagaaatagaaggagccgcaaaggctggctctcttccagtgcctggtgactcccctctccggtccagtccctgagcagcattttccattccattgatgtggtagcatgaggctggttttcatgataaactctgaagctgatgaaaaccctggctgggaaggtcagtggctggcttctgggccaaaccatgaactcaaaagatgaggatctgggtggtggtggtgcccatctttaatgccagccctcaggaggcagagacaggtggatctctgtaaattcaaggttagcttggtctatagaacgagttccaggacagccagagctacacagagaaatgcagttttgaaaaacaacacaaaacaggcccaggataagtgtggtggttaccttgattgtcaacttgacaggctctagaattacctaagagacatatctctgggtatgtctacgagggagtttctaggttggcctaaatgaggtggctaaatgggtggtgtcattcattgcacatggctgtggtccaagacggaatgacaaggagaaatcaagccatatattagcatccatgtccttatgcttcctgagcttgcaataggaccaggtacttcacacgcttgcctccatgtcctccccgtagtggtggactgcaccttcaagctgtgagcccattatcacagcaacaaggaaggtaatctgagagagacagccccagcgctac

SEQ ID NO: 394 - DNA, 2100 bp, Mus musculus
acatacatacacacatgcacaaacatacacatatacatacatgtacacacaatacacatagacacacatacatagacacacaatacacacatacatgcatacatgcatgcatacacatatacatacatgtacacacacatacacatatacacacatacatatacacatacatacacacatacttacacacatacatacatacacacatgcacacacatacacatatacatacatgtacacacatacacatatacacacatacatatacacatacatacacacatacttacacacatacatacatacacacatgcacacacatacatatatacatacatgtacacacatacacatatacacacatacatatacacatacacacacacacacacacacatgcgcgcgcgcctgcttgatactcatacatataagcaggcaaacatacatccgcacaaagtgaaaagcaagaaatcttggaataaatgaatcaaagagacgtgtcaccaagaagaaggttgtaagaattcctttcctgggaagatgtaaataatgtctacacttgcttcatgaggttccaaaggtaaactaaagtaaaattccaccacaatttacccccaagaaaccagtacctttaccaagctgtctcacagagcaagaacaaagggttgcctaaaggagcatggttgacccccgtgacttccccctacagatgtactggcatagagatggcttccctataggcacacagattgactcccctcccccacgtaccctccccagcctacacactcaagcctctttgcgaccttacatgcatacttagagcagacagaactgcatgtcaatggctgagaggagtagctagcaggaaccaatgtgaggggttcttgcaagaaggcacagctgctctgtggagatgtggctgttggcttggggggggggtggcagtatgctagaacagaggaagaccagactcacatgtcatcactcacaggtgctcgatggtcacccccctgggcaccagtaacagttgctgggctagctctctgctagatggggtggagactgctaatgaacagaactcttccaagcaatttgtcttgcgaatttgtcttgcaccccttcccacaagacagagagagagagagagagagagagagagagagagagagagagagagagagagagagagagaggcagtaacaggtaagagcataacagcaggccagcatgcccccctccctacttcattggctgtgtgacagcagggaaatcttcaagcatctgtgtgtgggtgtgtatgtgtgggtgtgtccagtagcatccaccttgttgggtagacagaaagaaatgtgggtacacacactgcacagcacctagtgatcagctgttgaaggccatggtctcattgtctgttgcgccaatcaagtggctgtgactcagtggccctgcagagtccccacaccgcctgctgctttgccttcctttccctcttgctccagctaatcgcattactaagattatctcctggtagtcacagagctgcggccctgggacttgggtttaattccgatttaataacaggttcttaaacacatttgaaaacaaaattgtgatgcccttttatccctccagttaagcaaagtgcccttcctaatacgcactaatgcgctgggtcttgggctgtctgttgtctcctagaagaatgtgtgtgcatttcttgggagatggttgggagctgggaatttggggatttccactctcaaatccccctggcaacacaggaaacagcttcccagggccaggactagaaaactgcgttgtaggtagcagagcccgggctgcaagctcactatgaaaatgagggatctgattcaggaacagatgtggaatgctgttttcgtcttgaatttatggaaaacataaaattttactctccctggcaggagcaagacggtggctgactttctagaagtttactgtgccattagtctccattgattataaagtcagcagcataaaatgttgcctttgagaggaagaccagagaaggaactcccgggacttcaaggtgagcagagaggctaggtggactcattc

SEQ ID NO: 395 - DNA, 2050 bp, Mus musculus
cagaaacatagaacagaaataccttgtctcaaaaacagcaacaaatgttaggcgacaaaccaaagcaaacaaacaaagaaaaacaagccacccaaactcaaaaccgcctgagtttcaatatttatatgtatatatatatttcaattccaacaattccaatcatcgttggctgtcccctggctggcttggagtcagaaagcccaagagggcatctatagctgtatcacctctggggcaaggccgagctaccagtgcgcttgcttcagaagcgcagatactttctctgctatgacttacatccttttcccaacaaatcctccaacatactttctaaaaatagaagtttcaaattgcccccagcaaatagcctcctgtacttctaattagctaaaaatatcaataaacttaacagacatttctcacttctatatatgcgattcccattttaaaatgttttaatacagaagctagatatttggaaaaatgaataagctttttctgccaaaaggggaaaagtactgacctgacaatatcctatggcaccaataaacagaataataccaataaatattagccagaattatgagtgtgtgtgtagggctagccacttagaataatcaatgagagccttcttccctttcctcagctgtagcctacctatcctccctgagaggtagcccctacagacagacagacagacagacacacacacacacacctacatacacacatacacacatacacacacacacacacacacacacacacacacacacacacacttctagaaaactgaggcttagaaaagtggcgtatctgactctgaacactagtttaactttaaagcccaaatccatagtcactgtgggtttccattaagactagctggaatcatcagagagcctctgccctcaattcccagactcatgggaaggcagcagaaggtacccaaggcacggatggtcttccataggaaatgtgtggcttcactggagacttactaaaactcctgaaacacctgtaaatatagaagaccccagcagagctgctggggggcgggaggggggttgagaggaactgtttgtgggtcaaccacttatctagggtgtgtcttatgttttggtttgcttatggtcttgcaaatagccttgactcaagattttcccacctcagccgctgatgtactgggacgaggaagatgagacgccacaactagactcaaccacgattttaatgtgggttcgtctttatagtagaagctcttttttctgttcactgtacttgtcttcagtgaaaataagatgcaactaaactcacagcagaacactctagaaactgtcagccatggcttccccctcccatctggctaattgctggaacatctccacggctgcaaactgctcaacacattcttagaaaagcaaaggcttgagaagtagaaggcaggctcaattcaaacaccccctctctccctatttttcttttaaagttcttaggcaatttttcataatgatttgtatagctatgtgttgaattgtgcatccctgtgagactgtagcagacacactctgtgtctctcattcccactgttggaaagtcgaaatagttgttgcatttacataattgaataaatatatgattctctataaaatgattaatgtaaaatctttcttcttcttcttttcttctttcctcctcctcctcctcctgtatgcgtgctatgaaccaaactcttatatttttggttttgttttgtttttaaagatttatttactttatatatatatatgagtacacggcacctaccttcagacacaccagaaaagggcatcagatctcattacagatggttgtgagccaccatgtggttgctgggaattgaactcaggacctctggaagagcattcagtgctcttaaccactgagtcatctctccagcctccaaatgtaacattttttaaaaaaaaatatttgtgctgggcagggtggtacacacctttaatcctagcactcaggagtcagaggtaggcagatctctatgagctggagg

SEQ ID NO: 396 - DNA, 2550 bp, Mus musculus
aagacacttcctgcaggtgacacagttaaggggaaggcaggttcagggtcttcctggaggtgattcagttaaggggaaggcaggtttggggttggtggccagttaggtgtgctggggtggccttgctgcgggaagcatgtcactgaggtgggttctgaagtttcaaagccactctccattcccaggatgccctctctgctttatgcttgctgctgaagatgtgaacttctcagcttcctgctcagtcaccagacttccactttaacatcatggactctaaatctccggaaccttgcctgagccttccttctgtaagctgccttggtcatggtgttttatcacagcaacaaaacagtaatggatgcacacaggtcctcattgctactgtttctgcctccctctcaccatgaagggctcctggtctgattcctcagatctggtccccagctttcttggccattctcccaaaagcaccctagagagatgctattatagggatagaactcaactccaacacatctcagttatgcatccttgggccccatcttcacctctctgggtcactttctacaccatcaattgaagaagatcaagtaaggtgaccacagtgatggtatcttaaagactaaactctctggggaagggtcatcgtccttcataacaggtgacacccagtgagagaggctctttgctcagctctgcagtctgccccacctcaccgctcacctctgggcctttgcagaggcctcacccctcccctggagctccttccccctccaaccacccctatcactacacaagctcaatgatcagacacactgggctgtcttggtgttgtgaattccatctctagaccccaatttctgtgacacagggaacacacacagcctcttcagcggggctgctgtaagaattaagtaaggtaatgtgcctgaagcattgagcaggctggcggtgtcatttatctgaggaggcagaatggttacttgcctgggtgtctgggagggaaccggttgctcctctacccccacagacggggagtggaggagagagggagaggcatgggaggagaggtgagaaatggagctaattacagaggccagagtggagagcagcagcacctggggctccttggctcctgagagtccctgctacttaggagcctctgccttctgagggtccctgccttggaggacatcaaccctttgacatctatctgtccatttccagggactctgtctaggttgaccttgggactcatcttagtcacgccctttttctatgaggaccgtttagacttttgttctccccatatgaatcctttctcttttcatcagcttcttagacctacgcccctgtgaggcaggactttctctctgtccctggactttttctttgacctcggggctcagcacaggtttggctttttctccaagaatctgtgaatgaaatgagtccttgaacatcttcgtgggagacacagaggttaccagtccctacacctggcaccagaccctccttcccttgctagctgctcctgcctctggcttctgcctcacgtgtatcagccttgctctgtatagaggaaggaactcaggggctggggagggatccgtgactgctctgccatcgcctgcagtaagcactgtcccagaatgctagccctgctgggtacaaaatacctggcactctgccacctgttccctgtgcttcctgcagcccccatgaggagacatagatggtcacacagagaggtagtcaatctcttagacttggtgtagctcccccaccctggccctggcccggacacacatgtcctcttctgctggacaaaccactccatcttctaccaccacccctccctgatatttaaggaaattaaggttaggtctggctgctaaatatttgtctaagcagaacagaaaatggtgccaaagaaggccttcaattttatgagcaaataaatcgtctgaaggagatgagctggggacagggagccaggcagggcctcaattatttagaacagaaagtgcctcccaaagtctggagaggctgttcaagtcccctccacccactttttttttttttttttttttttacacagggctacacagacaggatttctgtatggtagccctgattgtcctggaactctctctctctctgtgtgtagactaggctggccttgaactcagagatccacctgcctctgcctcccaagtgctggggttaaaggcgtgcaccaccacctgacccaagtccccctttctgaaagcacactcttgttcttttgcattgccatatgggctgaggctggggaaggtcacttatagattcttggcttcctctcttggatccctgtcagatcattccaggtccccttcctggatggctgcacctcctgatcctccgggcagctgagtggaggagcttggcctctgcgttctacgggacctgcctctgcctcctggcagcagtcgccacctgcccatgctcagcctttccctatgcatgatgggatgttctttctgtacgatgggatgcagcctt

SEQ ID NO: 397 - DNA, 1875 bp, Mus musculus
tgctcttaactatcaatccatcccagctgttctttttatttttatagtttattattttttttactttaattttatgggtttgggtattttgcctgcatatatgtcagtgtgccatatgcatgcctagtgcccaaggaggtcaaaagaggatgttggatccccctagagtgacagatgactgtgagatgaaatgctcctctggaagagcagccgctactcttagcagctatgctatgtctccagctctcctaaccaactgttcttaatgcacattattcttgcctgcgattatcaaaactgtttctcggtgtagctctgactatcagtgaactcactctgtagaccaagcttagagatctgcctgcctctgcctcctgattgctgaaattaaagacatgtgccaccaccacccagtaaacatcaaaaacaaataacatatcttattttcaatgtacatctgtacgtatggtcctcttaggagggaattaaaaaatagtatctgcaataacgataatgattagtattctttttaatttaaagacacttgctattgatatgcacttcttccgaataaacaggtactgaacactataagtataaacactacttgaaaatttaacaaggaaaagcagatcaaggcaagcttatagattctatactttcgaatacttttgtggtatatacatgtacatacatgtgtgtaggccagaggtctatgttggtcctctctctctctaaaccttgtgttttgagacaggatctcttggtaaacctagatcttgccttttgcactaaactggttggctatcagaccccagaatccacctggctctcctccccccaggttggatgaatgcatgcctcctcgcctggtttcacaagggcactggggaatccaaacccaagttctcaggcttgcacagcaaatattgtactcactatgacatctacttgtcccctgttgtccttttttgtttaaaaaagcagaatgggagctttaagtatagcttagcgacaaagggtttgccctagcatgggcaaggccctaggctcaatcccagcaccacagagaaaatagtggaaggctaatcctctgtgtgtgctttgttatatgaaggtcaaggttctcgggaggtcagctaggcaggccagccaataagcttgttcccaccacttctccagcctaggaagttgccatgcctggttctttctccaggtctttatgcttgtacagcagctaatttaccgactgtgccttctcctgttctcaagacaacatcagtagaagaaaaggcatgtctgtctgacttgagtgggtttttgcttttttcaaccatataaacttagtttcctacaatacaaattatcttacattcttccacataaatgttattttatttcttggctatttttcttttataattgcttagggataaagtgaatatttttgaatctagaaaatggcaagtattctagtcattacctaagtgctagacttgagatatcaaagatatatttaaattctaaaacgaaacaaaaatctatataaatttaaaaactcaaattaaatcaaacggtcataattttcttccttttaaaaactactattgagctgggcgtggtggctcatgcctttaatcccagcacttggaggcagaggcaggcagatatctgagttcgaggccagcctggtctacagagtgagttccaggacagccagggccatacagagaaaccctgtctcgaaaaaccaaaaaaaaaaaaaaccaacaacaaaaccctactattaaactaactctttacagttcaaatttaccaccatatcttgttctgatcatgatacaaacacaagttttaagtccatttcaattaaag

SEQ ID NO: 398 - DNA, 2600 bp, Mus musculus
ggcaagctggtagctggcctcgctgtaggagcatgcgcaaaacaaagcccgatgcttggggccttctcctccatcccagccaccttccattcttggggtgctttctctctttgctgtctattttattcagtgcctaacttgggaagtgtgatctttgccacattcctcctgacaacttcagggatctgtcaccgaccccgctaatttctcttaaatgctagaaaatttatccctgtgctttcttttggtccattcctaaattttttttattaatgggacttgcgaatgccaaaatggagcttcaatttccctggtaacaatactctggaaaaaaaaaatgtgatattcaggcagagagcaggcaccctccagacaataggcggccacacccccaaggggcaggcgaagagcttccggtgggcctggcttctgtccatccctctcatccacacagggaagaattgagaagtggaagggaggctagagttggcgtgtctgagatgggttctaatgtagtctgggtgggccttgaactggctcaggctggaagacgagcttgaggagggaggatggcttctggagcggctgcactgctggggattgaaccgcaagcctctgcgggtcttctctttgagccacacccactgcgtgaactacatctgtcacatctgtctcatctgtctgctgctcagcttggctcggctagttcttcggcctcctcgccctgtctaacttgtaaacagcacgcgtacttcacaaatgcttgccgaacagaaaaataaccaagaatggaaaggaacagaaaacatgattctgtgtttggcgaatttggtcaaacaaaaggagcaaagaggacaggaaacatcagccgcacaatttcagatacaaacagttgcaaaggaaaagaactttctagtcccgaagcatgttgcagcccaggctcagactccccagccccacagggcaacaggaacatcatttcaaatgccacccggagcttgcttcgtgctctaacccagcgcgtctcatctggccaagtccatgcctccacggtggggcctggcgctcccaccgaccctcacctgtcacatcccaccaccgatattttattaataatccaatgtaaatctgggagaaaattaatgtgtcatctcctcgcaggaaggactaaacatctcaatgtgagggtctgttgaagttgtcatttatcattagcacgcaattcaaggcaagcttcccacactctggtgggagctttcgagacaatgaatctcggggaattagcctctggtccaattattcctgcttccccccacctacctaagagataaattctgtctccgtgggaggaaaaaaaaaattaaaaagagaagacgagaaggaggaggagggagcttgcgattctccttcctggttgaaatcaatttttctcaaggagacaaggcaatattcattgtgcgagaagggactaaggaggcccgctaaaggccaataaatggagccgttccgatgaaaacttcctcaaatcaaatgtaggggaacctcttaatgggctttgttcttcttttccataatccataactattaagagaaagatgggcaaggagaggctactgtaaagggattgctgtgtaaacatcacacggaattttcttctagggagagccagggaccactgtaaacactgggcccctttcaccgtaaacactgggcacccaggcaagccaggaccatggagcctgtcttaggccccagggagtttgtactctagggagaaatgaggactatgaacaagcagattcataaaagccagtgaggaagatgggtcacagtgggaattctatgtgttgaggcagaaattgtttttaacttttttttttttttttttttgctttagtgcaaaccataaaaaattcattctggcaaaagagccatattctggttgcaacctgatcaggaagggtggaaggtgggtggtggcttctccaggcagtgagcgtaggaggcccagtcctgtccaggtgaccccacaacgtggcatagcaccacacccatagcttccagtgagccttgctcagttacagcaggcagagctccaatgaaccatgtctgtacctggaggctgactctactggctctttcagtcctgtaggtgaggtaaccaagggcttacagcttggctcctggggcaggaaacacatagactcagagcaggagtccctctggctctgctctcagatgggctcacctccatttgggagctgaaggggacttagcctctacatggcaactggccctgacaagtctgccctgccaggccgtacgtctccaccaccacgcttggcaaagcaggattgctcccagccctagagttgccatgaagagagagagagatcttcactctgagctcaaagcagccgcttggctctccagaagaagacccaccacagaggttgcgtaccaagtgtctctaggtgacatatggggctgtggtgtgcagctagctggacctgcacgggtctgcatgatgcagaagagaattgtgtctggctgcccagcccatgtcatggcttagaactcatatctgggccgacacctct

SEQ ID NO: 399 - DNA, 2925 bp, Mus musculus
ctacagtgccataggccctgcatctgtgcctgacacctgtgactccacagatgttgcatggaatccaagatggtgacagggacagatttggccccgtgggatgtacagaaccaccctcttgccttagtgtgttagcctgacaaatggaaccttctccatggcatattgtctagattctaaccctagcaaggagacacagtacagccagttcatcacagtggcttcctccattctgtcagaacgatcttaacttctcttcttctgtgtcccacatgtgcaagcttggccctgctttcatctctttggccagggccatgccccaatgtgatcagaattcatgggacttaatgtccagctgctcttagaggactcaggaggggacccatcagtgggggaaggtggtggggttcctggaaggatagattttctattcagattcacatcaaaacctagggactgttctctcagggtggcgtggctgtgtgtttccaagcttaccatatggccctgtcactggccaccgacaacccacagagaaagcatccatcgaatccaggcaacagtgcacccaactttccaagccagacctgcccaagtgcttagccagcaactgaagtgagcagtcctcaagggggttggtgtgagcgtgcctgcaccttgccggccattcctcatttctgtttgagacaggagaccactcctttggcaaagtgcaatccaagagctacttctggccttcccattccaggagagcagtgcacaggctagatccctagcttggctccatggccatgtggtgagctctctagactggcatgtttgttagctgagatctttctagaatgatttagggcagcaacagctgtagcagcagcagcccagtctttattggcttgatggtcaggtgacagaacagagggtgactctctgaagccccttcccaccacctcctgtcatcagggctcataagctgcaaacccagaaatgacaagcacacacggcctaagctttgtgccctggaagcctgggggcatattctacaattctacagggtatccgaagccctctgaagaactcctgctttgtctcagctcagcacgagataagagcccaccatcctcacaggcagcacgggcagtatgcagtatagaaggaagatggcaagagtctgctttcgtttctgtgggctacgctactcacactggaaacaaacaaacagtcaaaagctgtacgacagagcaaatcggcaaactgctccacagtaaacattctaaacagacgtgaatcatgacatgtttttgattagctgcttacttaaaaacagatgctgtgtgggaagggtgggcccaaacatgctgggcattcaggggggtctggggaggaagctgccttctggaaccagcaggaatagagcccgtagccagtggctaagtctctgtcttcagtcccctcctttccctcctcctcctcttcctcctcctcctcctcctcccttttcttatcctcttcttcctcctcctcttcttcctcctcttcttcctcctctttctcctcccctttccttatcctcctcctcctctccctcctcctctccctcctcttcctcctcttcctcctcctctccctcctcctctccctcctcttcctcctcttcctcctcttcctcctcctctccctcctcctctccctcctcctctccctcctcctctccctcctcctctccctcctcctctccctcctcttcctcctcctcctcctcctcttcctcctcctctccctcctcttcctcctcttcctcctcctcctccctcctgggcagaagcagtttgagagtgaagagagaacgttggtagaggtggggctcagagagccgggaagttccctgccatgaggacagttactcccttgactctggctctcttcgtcccttccagctcttcctcactggagtgagcagggtgaggggcaaagagccaggcagagccttttgtaatgatcagagcagctcatacctggcgttgccctgcatttctgaaaggcgagaggctttgctgtatcatccagccctggaccacccctcagtaagcaagagatggctctccaggaggaacgggagggaaggaagccgtgaacacccatggccttcctcctccctcctatcccccttctcctcactccctgtaccatttacctacttgttggttactgtatgtgcgtgtctctgttaaccatcttcacccacagcacaacccagccacgaggacaggactacatccttctgacttccagtcctacaccaacatggtagaagattgacagactgctgacccaatcacaaggagacacgcatgtctgtacgggaggtgcatcttatggagctcacaagttgaaatgagaacagtggcaaacgttgggagtcccagtgtctttctgtctggagcccatggaaggagcatgagggctcatgtgcgtcaggctaacccttataaaagagtgtagtgggcaatggatggagacagaaaaaaatgtggatcttggtgccagtttggaatgaatgacagggaacttccaacctgggtgtggaaatgctgtggtctagcctcagccctgtatccccatcttgtcttccaagaattttagaagatcctagacacctgggagaaggtaaaagatctaaccctacctgtctcttttaatacatttttcatgtctctcttttctgtcagtctgtctctccccctctctccctctctgtaagcctgtgtctctctgtctcccccttcccccttccccttcccccctctctccctgtccttctctccttccctgcttccccagttctggagagccaaaatagagactgtagcagacgtactcactttacgactaagctgatgagctggacatggtctcacaagataccag

SEQ ID NO: 400 - DNA, 2450 bp, Mus musculus
tgtcactacttcattcattttaagggaaaatagtagccagggcgtggctactgccatccctccttgatggacagtcggtggctccctctttgatccaagtgtgacatcatggctccagatcaccagacttgtgcacaagctgacacaaccctggcgtttgccttctgtcagtgaacctgattcaaatgagaatcatgagacaagggatttcccaactgaggaactgttctgattgccctaactgatggaggatgcccacctgaatgtgggtggccttctctggcagcccagattaaaggggcagggttgggaagatgactcagtagtcaaatgtaaaaacatattgtctgtttttcttttcccttcccctgctcccggaatgacaagtctgagactaatcgtttattaataaactcctaggccataagctttgcctcattctctaactagcttgtaacttatttaacccatccaaactattctgtgtctaccacttgtcagttatctctccttcagtcccagctgtgtcttcctcagcatctccctcagggtctctccctgggcttccttttattccctcactatttcccagaatcctctctcttcctgccagtgtcccacctcctacttcctgcctcagttcattggctaccggcttttttattgacaggtgttgcttataagagattctctttaccgttaagagctcccttcactgggagctcttccagaggatctagacgaggttcccagcatcccacggcaggtcacaaccctctgtaactccatttccaggaaatcacaaactcttccaacctctgctgggacgggggtcacgtgtgatacacttgcatacatgcaagcgaatctctcatacacagacaacaaatgaacctttacctattgtctttgagtggcatggtgggaagaggattcaccctcctctccggcctctcctctcaccagagctgattcatcctgctaatgatgacgatgatgactccttccttccccagtgtcaaaaccattgttaccacacttccaccatggactgaggaccagtggttctccgagaaccttccagggtgtggagcagactggggctcagcagcctgaggcatgcaaggcttgtggactgaaattcggccagatttctggcctccacagcaagagagagagagagagagatcgctactgcagaaccagtcccgttgccaaggctcccagactggaagaacaaatagatacagtgttgttagcctcttaggtgtgagacagctgttgttactatttaacatacgctgattaaatgttacacatgcacacactctcgtgcacgcacacacacacccatccattggttcagtttctctagagaatcatgactaatatagaacacacacacacacacacacacacacacacacacacacgcctgcccaaaagctgcgtttaagatcaagcaccaggattgcccacattgctagtggttccttttcgggggttaagggagagaggtgtgtgcaagctcagcactgcctttgtctatgagctaatgactccaagtctttaactttagcccaaacaggagagagctgcaccccaggcacctcttcattgtttccggtggggtcagagagagaagggttggaccaggattcgtctgaggcacagtgacaaacagtgacaagataaaagagaggtcaccacatgcatcctttacggttctggctcaggaagactggctcgtccccactacgtctgcctcctcatccactcgctgatctgaagggtcctctcagattcctgtggcaagagccctctaccactccccttcctcagccggagctgctggactcgggacatagcaatacattcaattcacgagtctataaagcacagcagtacattggagtgtacccctctggcctttcctagtgttaatttcttttccccagtaactcccctattgcccaggagaccagtatagcaggtgaaattggattgaggccggacaaattccttctccacaagtcattggctccctaatcccttcagtaaacagttctttgccagacctggttgcaggaaataaggacacagagtgctaggccacaggacaagctgattgagtcacacagactgactcggggccatgcgagggcacactgagtgcagagagtacagaacagcagccacgggaggcaagtctgttaggaataagagcatgggggactcagtcctgtgagcgatacacttggctcactcggtgattcctgggtcatgaggagaaggctaacccactgatgaaccaggtgggtgcagtgattgggtttgatggaagacagcaggaagccattgggtcggggacttgctttggagagctcctggtgaggccttcgggcccttgggttgaatcttaggccacaccagagcatcctgtgcttctc

SEQ ID NO: 401 - DNA, 2125 bp, Mus musculus
acagagatgcctactgcccatgtttgctgccgcagtattcacaacagctaggtataccgagccagtctagatgccaccgacaggagtgtgagaaataaagcgtggaggcagaaggatcaggaattcgccattctcttgagctacagagtgaatttgaagccatatcagaatacatgagattctttctcaaaacaacaaataagcatgcatacacacacatacatacacacacacacatatatacacatacacagagacacatatatacacaaatacatatacatacaaacatacatacacacatatacacacaaacacacatacacacacatatagacacacagacacacatacatatacagacacacatttacatacatacatacaatacacacacacatacacattcatacacacagacacacacacacacacacacacagacactcagacatacaacacacacagacacacacacacacacacacactggaatattattgagccacagaaagagcaacagcctatcatttacagcaagatgggaagagctggaggacattatgccagggctttttaaattaaatcccagagacctgttacagttacagttacggggaggctggagaaatcttaaaggcatgttaataagcatatcatgcaagcaaaagaaagggaatcagactcttcaaaatgaaagtctgtgccaaaaataaactcacagcccactacctgcctatgtgacgggcaacacttgttcggctgcaaagacgaaagctgtggtctgccagccttagccttttagaggttagctctaaaacctaaggtttagagttaacctgtggtggcccttgaaggttcgattatacgttcagtatggggcgagggtgctagcacagctgaccacagaagcctcgttagacttcctcccatggtgcaaaggggggcagggaatagccttgttcttttgcacactgccagctcctgagagcacccctccgcagccccccccccaatcgctctgcaggtggtgtggcaggatctttaggatgggagctttgaagtctgactgtctcagatccactctaacctctgatgctggaagctttgggagactagacaaaattattctgctcctctctgcctgaatttggtcatttgcatgtcaccagacacgaaggttcggaggattaaatagcacacacaggtaaaagacctcagagcccaaactctgtaaatgtgtgatgtgattagctgctatttttacctttgtaaagaaaaggaaggaaaaggccttcagttagctgcttccagaggctaacagtgcaggatgggccaaccctcagccagaaacgcagagaccctgtgccagcaactgcacctcagccactgtctggaggtggcttttcacaaagctagccccaaggacttcaaccttgtctgtcctccacatagcctgagtccacagggtgctttggaaatctttgctaaaatcacccctgctggtggaaaggagcactcttgctctgccaagccatagggaggggcttcagttaaaccccaggacccctgggagggggcagcaaatcccacctggattcctacacccaccaccggcaagccacactgtacatagcaggtcagaaaattaagtggtagtttgtgcctgacaaaataaacgcaagtctgaggtctcattaattatcctaacgagcaggctggacccagtcagaggaagagaggcagagctagggtggcaatctaaacgcaacgtgctcctgtaattagctcatccataattgaacatcccgctcccgtccggttggctctcgttagtcaaaatcacatctgtcataacgccacaggttgctttcaacaaattgggcatttttgctcaaagccttgtttttattttttattttattttttttaaaaaaatgtgtcccatacaatgtgtcgggaatggggacaattttcacaagatgaatggagtttggttgtggtcttttcttgaacaatgttagagtgttccaggcccagtggcgtttcaaaggggcacaatgtgctgggtgctcactacagaccaagaaactcctcacctcagcagacaagactgggggctccc

SEQ ID NO: 402 - DNA, 3200 bp, Mus musculus
cttcagagccactgaaactggggcaatccacaggtgggacaatgctgagaaaagagccctggaagagaggggtgacagatccactctgtgccccagagacactgacagccagaagagaagactggtcacgagagagaacttcaggtccaaacacagtcgcaagaacagatgagtggagggcaaaccacctcccccgtgtttaactccatgtttaacagctctggatttttctgcttgctatgacctcacttcaccttagctgtctctcaaaggacccatctccagatacggtctcactaggtgacagttacaatgtgtgtggggggtgggaggaaccacaattgaatccacagcaggaagttaccccaaaacagcagcactgagccagagtgtgcaagcagagccagcataaagacagtgggtggcaagaaggtcccagaatgcccacgggaatccaggacactgcagaggagaatcagaactctccagcatggaagacaagccacggcagagccaaaaggaaaggtttgtctgtactgtacactgctctcagttaagggactcaagccaatctccaccagaggcagaatgctgactgacagcaggtccacagcagatgccaggaaacagtgatgagtctccctcacggagtgcacaggacacctagatgccagtgacaccacactcagtgtgagacagcccctctccagtactcagggtagaagtggcaagagagagttcaccctcaggccctccttaccgaagcgctaggaccaatcattagcaactcagagcagaccagggagaggcaggaggcagtgagcagaggagtgggagatgtaagtaggtactgaccatgatgatatgaccaccgtgtaagctcaaggtcaggtgggacaatgctgagaaaagagccctggaagagaggggtgacaggcgggctcaggacatacagtgagaccaggcacacaggaggtacagcaaatggctaatgagattaattcaaacccacttattcacgcaatgaaatactgaatagatgctaaacagccactatgtgtagacaactggaacaagggaccagagtaggagagtctcagttagacaagacaaaaggtggtgtgctgttgctactaatgtgctaacaagagacgcctgctgtgaaggtaacaaaaacctagcccagggaaggtgagacagaaagcagggtggacatgcagagtcccagcctcttacaggtaccagagcccagaaaggatgagcagagcagcataaaatgacagacagacagacaggccaaagacacaccagaaaaggcagccaccttaatctcaaaatagcaacctcagaacagctggacaacatgttgccttgagcagacgtgaaaacacaagaggcaaatctaggaaacagagagaaagcccaaaggagcagaaactagaagtgaaaataaaagcagacaacccctgcagctaagcgcagggcagggcagaggcagctgcagacaacaggggcaagcagatgcccctgcatctgcaggaggaattgcaggatctgtgcacactggggcctggccttctagggcttaccacagccaccccatctggttatgatacaagatatcaaaaatgtgccaaaaatacagcaacaacatctgtcacacagacagtcaggagggaactagtgcccaggacaaaagtaaagaacagagaaagcaagcagcctgagagctgtgctggggagagagagctgtgctggggagagagagctgtgctggggagagagagctgtgctggggagagagagctgtgctggggagagagagctgtgctggggagagagagctgtgctggggagagagagctgtgctggggagagagagctgtgctggggagaatgagctgtgctggtggagagctacagaggcctgggcctccccaggaccaggaatcaaacaaaagcagccaagtgggtacctacctcaggcaggagaatacagaggcacagtgacaccaagtggtggtgaggacaggaagggacttacagtgtactgaacacccagaaaaggctggaagtactccgagggggaccacggacattaactccccccaaagagactggaggtcagagccagggatgtctctcatctggagcacagaggaatgaaggggtcctcagctacacccactttttatatgcttttaattattctgataccaagagtagccatttgggggtacttggaacactttgccttcataaggcaaggtcaaggtagttacagtcaagagagagccacggctgcagaaacaaggtactcccctaccgggttcagcagaagagactgcagcttgcccagctgtgaagccatcctgctggccctgtcctcccacaccacagccctggagctggccctgtcctcccacaccacagccctggagctggccctgtcctcccacaccacagccccggagctggccctgtcctcccacaccacagccccggagctggccctgtcctcccacaccacagccccggagctggctcctctggttcaaacacacagcaacagccccttagtggccaaaatggggccatgaagagccaggccgccacatccacccacacagggaggctagagggcagagggacagctgagcatcaggcacggacagctggtaggacagaagcatctctccagaacctttccataaagcttgtggggtctgtctctgggcctgaaccacacaggtacaacacaccaaacctgagatgcctgagcagggactgggccccaagatgctgtgttagttctgattagtgaacttgaaccgtggtgacatacacttacatatgatccaggttccaggtactgaagaggatccggctctctctgttgccataggggttgatggagtgcttggaaagacagctctccaggtcaaaggggccctggagtgagcaaggacaggcgttggaaaggcaggagtgaggacactactgctctcctcccacccatcaagcttgcaggaactgactggccccacgagtcgtttagttcacgaacagccagtgtcaacacctgtatccccagccctgggaggcaaaggcaggaggagtcacactcaggccagggaggtggctcaggaggaaaaagtgcctgccacataagcctgagaatcaggtatgatccctgcagc

SEQ ID NO: 403 - DNA, 2675 bp, Mus musculus
attccaataaaccagttctaccttaacacataaatacatgcatgcatacatgcatacatatatgtatatgtgtgtatatatgtgtatgtatatatatgctgtgcatatatattatagattatatacatgtgtatatagagggaaagagacagagagaaattatctttctccagactagctctttttctctctgtcctttcctgtttttctttggacagtcacttaaacatttctagaaactaggaatgcaggagcctggcgttctgcctcccgagtagtttgtattctattgagacagtgcctgatatccatgtgtaataagggtgtgtgatgtgtggtactgtgcagtatggaggtaccacatttacattagattaagatgagttgggaatcaaacatggctagaatgtaagaaaacaggggaaagaggattcaaaggttactgagaagttgggtgaggtcagctgatttggattttatattaagaacattgaaacgctttaacccaggattcacatacattcagatttgtatattacaaagatcattttaaatttcttgtggggaaaggttagaggcctgccctctacagcagctgcctcacatcagcaacatcagtagatctttcacagtttgggtggaaggaaaagaccagtaaatgcatggtatgtactggtttttaaagcttcttggcctcttttctttttcgtgtgtatttagcttttaaactctggctctacttcctgaaccagaaaaggtcaaattgcagaagaaagaggcctttcttgctcactgcacagacagggtcagcagaatcctctgacagagatgcagagggactcctaggcgcctgagccccgggtaatctggtgctgcctccacagaggccattagagttgcaggacagggcctcacaagaagccaggacagtctctcgggtctgtcagaacggatttgggggttaagaaaaactgagacttgacaccccagagaagggcgattccagtagaagggtgaactaggggtgggtggatgacaagggggtggggcgcaccctctcagaggcaaaggggaatggggtgcagaactcttggaggggggactgggaagtgggagtggaatgtaaataaatgaaacaataaaaaaatcaattagtaaattcatgtttttaaaataataataataaagagttatattttaaaaaggaaagaaaacctatgtactatgctttgattcttaaagtgttaggttcctaaagccagaggccttgtatatcaagtgcataaaataaagagactgactcagaaaatcagatcaggttgttcttttctgcacagatgtctcactgggaacctaattttagaaagaataagcagctttatgtgtaggttattgttataagtagctgagagcttacctgggacttctggatagtctctgaggcagagaaacagaaatactaccttagagctctgggtcgtatctgcagcccaagtcctgggtaactcctgaacgaagccatcccactcagatgtagcccgttaggctcaaattgtgcatagcgttttcacgtgttactgtaattccaggtcctgttctctgttccctctgctctgttactgaaaaaataactctggcttacgtaattcctggagtcatttataagcgtctcgtgctgttctaaggccaaaaggaaggccaggggttcaagtgcttacgtactgagacttggtgccatgcgcagtctctcggaatacattttctgatcttcctgagagtcgggattctgtttgtgcgctgtccatatgtggcaaatcgaacaggttgtgaatggccttgctaatgtgttttaaataagttgatatccctattgagtttttgaattcagtttcatcaatttagatatgagacttaagtgtggttatatctagagtctaaaccctgaaataccggtgctacaaagtccatatctaaagagtgttaagaggaacggtgaaagcctaacgtttgtcctgtgatctcatacagaagccagcactattgttcagcttcatttcagttcaactgcagggtaaaatacataaacgcatccattcgtagtcatagtaaaccaccatgtttctgttcccagcatgccatcaagtgcagtgctgttacgatttagaatggaaaactgggctggagaagaggctctgccaataaaatccttccttgtaagcatgaggtcttaagttagatcctggaacccatatccacatattcagaaacaaacggtcggttgcaggcagcctcctgggctgccaaccagtctcattgatacagtgagttccagaccgttctcggtttctcatctaaattgatgaaactgaattcaaaaactcaatagggatatcaacatgtttgaaaatagagtggataacacccaaggaacaataccagaggttgtccgccggcctcacacacctgcacgcacacacagaaattaggccataggttggaaaagaagtatttcaacatttcagtgatattaattcatagttttaatttttaaaatttcaggacagcttttcttactctgaaaataagaaaaaaaaacctgtggtctttgacacagtgtttagaaataactactgtttttagaatacacagacgccatttatcagtgtcatatatat

SEQ ID NO: 404 - DNA, 3050 bp, Mus musculus
ctttaaaaacaaatcaacaacaacaacaacaacaaaacccacttaagtcaggcgtggtatcctgtataatccaagcacttgaaaggcacaggcaggaggatcaagagttccaggctatctacagctgtattgtgagtttaaggccagtgttggcttcgggaggcccaaaacaagaatgtcgttagtcccaggactagggagaccagcaggtggatctcaggctaacttatctacataatgaggccctgtctcaacaaaacaaaacaaaacaacaactaagccagatgagataagatggctccccaggaaaaggcacttgcctccaggcctgagacccttggatctgtcttcaggacctaggtaatagaaagacagagccaactcctgcaaattgtcctctgacctctacacacacacacacacacacacagagagagagagagagagagagagagagagagagagagagagagagagagaaactaagttaaaaataaaagcaataaaaaattaaaatcaaaccaaagaagccaaacacctgtctccacatctgctcagtacctgatggggcctccctgtgcgtcaggacaggtagagggcagcaagacagtaggagtgctccagtgagtgcggcctttataccagggcttcccgatccagccccattaatccgttaatccgtgggtggattaaaccactcatgaacacagagccctctcaacccaatgatctccaaaggtctggcctccaaatgtcatcttaacacaagatgggagggacaaacaccacaagtggcaatatgattattttaaccatgatttagctttggggcataagtggagtgtgtgacccacagtcctaacaagacagagcctttcagcagccttgaaagcccatcagtttctccaggtcagtccctgtctcagcagatgggtttcaactgctcaagaaggtcacatgagtggaagcacaggtaccctgtcctcggccaccacgcagccactttcgaggctcgtccctgtccattagtcagtactttctttccctgctcagtggcgttcgctgtgtgaacagcctcagcttgcttattcattcttctgttgacagacacttggactgcttccagtttggagttattaggaacaaaactgttaagaatatccttgtagcaggcttttgtgggcttatgttttcatttatcttggataaatacccaggagtgtataaggacaatgtaagtttaacttttttaaaaaaaaaaaaaacaaactgtcagatggtcagattgaactatacttttgagatgtgagcatttcaattttatacccccaattttttaaagggagaaatgcaggaatatatccaacagaaaacagagtatacacaaagatatgaacaagaatatttatagcaacattgctcataacacccacactggaaacaattcaagtgtcaatcaacaataaattggataaacagtgataaattcacatgcgattcagcagtgtgaacgagtcacacaacacagtacaaatgagaagggaaagcaggccgtgaaaatacatgtgatacaatccacgtggtctgaagttcaaaaccaggccattgtaagccaagggttagctcactctggagaacagtgtaagatacaaaggtgacttcaggatgctccccatatttcctaggggctgctggtcacacatctggtgtgtagaaacctacatgactgtacagttactctgagatgttcacagactgagttcagggggataggaagtcggtgcttggcgagcatgctcaaggccatggctttgaaccctggcatggaattgatcagctgtggtggtacatctgtaatctcggcactcacaagttggaggcaagagggttagaagttcaaaatcatatttttagcaatatagcacattagaatccagccttagctacaagaaattctctctctctctctctctctctctctctctctctctctctctctctctctctctctctgtctctctttctctcgtactgagtacagacatcccacccagctgacctatagtttgtatttagaggctgtgttttgtgtcatttttaatttgtttccattagtaccaaaacgtgaaacagccttctgggtgaccacttgagtaatccccctggagaggacactgccatcaggccctaaagcactatctgctccctaagtagctaaggtgctgggctgctcatgtctagggatcacatagacaagcatgagctgccttccatctgccactcaaggagggcttgcccaccccaccaagttctgactgactctgtgtgtgtgtgtgtgtgtgtgtgtgtgtgtgtgtgtgtgtgtgtgtgtgtgttacactagctatggaggtcagaggacctttgtagagttggttctctctttccacttttacacagctcagggttgaaactcgagtccccaccctcttattgaaagcacctctacctgctgtgccctctcctcagccaccacccattcgttttgttttgtttgagatagggtctcactgtgtagtcactgtgtagaccaggctagcctcaaattcacacagttcttcccgctgcgattagaagcatatcacactacacctgacataagcccttcatgcagctacctcaccacctgaatgagccacacaacgatgagtggcttgtgagtgcggatgctggagagctactcacagactatccagtgcccttctgtcacagggaagtcatacaccaccatgcagtaagtatcggactaggatgcagccaacctaaagaatgaggtcgagggcctagagagatgtcttagcagtgagactgctcttgcagcagactctagtttgatcctcggcacctatgtggaggctcacaaccatccgtaactccacctccaggggatctgacaccctcttcttgcctccatggttaccaggcatgcacgagatgcacagacatacatgcaggcaaagcattcatatgcacaaaataaatacagctcaaaaaaaaaaaaagagaaggat

SEQ ID NO: 405 - DNA, 2525 bp, Mus musculus
caaaaaagccaaaaaaaaaaaaaacaaaaaaaactttgtaagaaaaaaagatactggagttctgatgggcatgtttcatactggaagacacctaaccctgcaagctagtacaaactgaaatatggacaaaggtcataaaacatataattttcaaaaaggcaagtccaaaggccagtcatgagaagacagcttcaccagcagtcagtgtcagaggctggagagatggctctgtggttaaactgcttctttctgttccaggggaactgagttcagtcagcttacaaagcatacagcagcttacaaagcctttgactcagctccagggacccaatgctctcttttggcctctgtggacatgcattttcacacagggtgcatattcacatgcagacataaatataaacgagaatatattctttgagaaagatctcagtgtcagagtatacctacgaagctgacaactgtaaaaaggtgagaacacctcctacacaagagaaaaccagaatagagtcccagacttcaggaggaagccagcaattacggccttttgggaaaatatgttattaaaagaaaaagtaaatatagttttagatagaagctttactttttcgattatgctccataaaactacaactatcaggatggatacaagactattcctatgggacactgatggcacggcatctgctgtgagaccgccaatggccgtgcaacgatgggattgcacttcatcactgtgaagcatcacacaacgtactgagaatgtgatgggagactcaggtaatgcgagctctgtgttcctgggggaaagtgagcatagataatatgattctattttcataaatgtgtccatgcatgtgtccctaagatataaaaactaccaccattaccacaatcactgaagacaggaatggtgagaggacatgacagaaagccgaaactctcaaagaccactcaggagtgtcagtgaagacaatgctcactgcaaaagcctggcagcctgagggcaaacacgcatggcaaggagaacactgcctcctggaactgtcctccacctacgcatgtgcatgtgtatgtatgtacagtaacaacaattaaaaaatggctcagtggttaagaacactgactgttcttccaaaggtcccgagttcaaatcccagcaaccacatggaggctcacaaccatccataatgagatctgatgtcctcttctggtgtgtctgaaaacagcaacagtgtacttacacataataataaataaatctttgggccggagtgagcggggccggagcgagcagaggtcttgagttcaattcctagcaaccacatggtatagctcacaaccatcagtacagctacagtgtactcatatacataaaataaataactctttaaaaataatgattgaggttaattataagctgaagacatagtcaagatcccactaaaagcattcctcatgagtggaaacaggcacagaatgagcaagctctaatatctaaaaggcaagtgaggagagaagcaactggaagtagcagagacagggccctaacatgtccacagaatctgacagagggtcacctcagagaaaaaggctgtgaaacaagacgaaacaaagtgatcaagagcgaagggcttgtaactggttgttaaaatgtataagaaagatcatccaggtaaagtagaagacatttcagaagagcaaaacaaggaaaccataaagaaggcagctgtccacctaggtcatgacactggctgaactccttcagagctgggtctctggaggtgggcaggctcctggtctgtcaacctcagaacattttttccttccagcccctgctcccaggatgttgactctgagactacctattaataaataccttgcccacaagcttagctcattccccaactagcttgtagcttctttaacccattcaaactattctatgtctaccacatgggtcgttacctctcctcagtcccagcctgcttcttcctcaatgtttcccccagcatctcactccaatctctttgtaatctctccctgcatctccttttattcactcactacttgccagaatcctctgccttcctgccattatcccacctcctatttcctgcctcagctcattggccatcatcatcacaggtgatgctcaacctgaagtcacagtgctgcagactaaaaggattcatcaagagaaaaaatgataaagagagcctgatgccaggcacgtttgcaaactgtctaagaacaagattcttaaagcgaccggttaggaggaaagccattgtactaaacttgtaagaattgtgattgttgatctaatttttactgtacgtacaaactggtttccaggaggggctggaacttggaagaggatggggtgaagtaacagaattttatcgcagggtagatctgaaaatactgaggctgatttagggacggatagacactatttaacaacatgagtgtggggactggagaatctgacaaagtaagagctttacagttccagtctttga

SEQ ID NO: 406 - DNA, 2700 bp, Mus musculus
gataaaatatgggctgggtttatctatacaaaacttcactaataacttagttatggttttaaaccttcagtgagctgagacaggtgatagatgtttacctagataatagctcctagtggctatgcaggtaaacattcactgttgtaaacgtctatttcaatttatgatttgattttttgtgtgtgtgtgaacttgtgatgaactttgtaagagatgagcaagaatcaatagaggagacttttttttttgcctttccccacttagactggaatcttttccctttccccactattaggatctttcgcttttccccttagatagctttcctaggaaactttttacaacttagtaataaactctataatcacttctctaagtatcttctcttcctgtgacttccaactagcaggcttaaagttagagcccagcagttcctgttgagatagaacaaaggctgcattgcttaatcctcacctgttaggctacaggtgttaacctcctaagccatcagtcttttacccttagaaagagcaagaaagtttttaggactttttagaagctatcatcagcatttcagtatagttagagaactagaaagcccccagaccctcagactttaaagccgtcaccagagtgactctgtgactctactgctaccctggcctgagccaggaaggacaggcaagaagaaagtcaaacagctgtcaattaccaagccactccaaggcgattccttcagctgcttcctgtgaactgcatgtgggatagcttctccaacagtgtagacacctctgggtgggtcagtgcagtgtttgcttcccttctgctgcttctgcttctgcccaggcagccaaggctgcctccttctgttctccctctgttatttatagactgtgccctgtggccctttgagggcctagagaacccattccagcaggaggaaggactggggttcactaatgagagattttaaggcttcaacactagtatactaatagtgccattcatgggtgtaccacactttccctatctggccctgtgaagaggaattcaaaatgaggcctagaatccagggagccgagcagtgatgctgaaggaaacacagaaagcatgatgggaaagaacagaaaggagggagcgagcgaacctctgggggcagagggcaagcaggacatttgatcagggctgaagggtgataggagctccttaaaggaactctttgtgtgtggcactggttaggaacccttggtgggaggacttgattcttgggcttcccacgttgaatgctttcatgccttagagtcctgttatttttatgggcttccaagtttaagtagctcatctgagcatcatttatgcctctgtacaaatctccaaagccaaatcagatgtgtctcacaaagtaggacagtcaggattgtgtcaactgctccttccctggaagctatctgcttcttaaatcattttatgctaaaaataaaacatcccccataaattttggggaaatcctcctacacttagaacaaagattcttctcaacacccggagctcttattgcccaggggtcatcagatgagcatcaggcctacaaaggcaaggcatgagcaaggatgcatcctggggcttcttcaggacatcttcctgataagccattgagcccagcacagcagtagagacagctgagccagccctgacatgtgtcccgcaagcagtgtgagggcttgttccacagctggcaccaaaccagagctgactgaacagccccagaaattttagccagagccattaaaaatcataagcaagacatctgtcacactgctgttgccaaggtcacccagcagtgtgaggaacccgaagagaatctcatgacatccagcctgggacaggcttcatgagcatccctgcctggggaccagcaggccctagctatgcacatgtgataggaagtatgagctcatttagtgacagccaggaaagacagaagaaaatgaatggtcttagggctgaaacctgaggattttgaaacaagttttgtaagaattacaccattattatcaggaagatccatccaaagtctgggcatggacataagtatgagctcattataaagtcctcttgaagtgtccttttaggacattggcagttgaccttggattcatgggtagagaggtttttttgctgagagtaattttgagaactcatggcctaaagcatgtggggccagcacaaagagtgagaagttaggtaatagagatggatacacaaggccttctatcactaccggtgagcaccctggtgatctacccattcctgctcattcttagggttcctatgaggttcgaattgggcaggggaaaggatagtaaagtgagagaacccataaagaggcttctagtttcttgtgatgtttctccccgcccccctgccccctcttgcttacatgaaaggaagctgggatttggaggagtgggtctcagagcacacatgtatcagtggtctaaccaggaccatctgccagcacatgagcattagtggtctaacccaagaccctgccttcctccctctttgtgtttccttcttcctgatctcaagagaggttctgctcctggctgaaaagaagccaagggtgtttcttactcacaaagggagcctgcaagactgtgggtgccaaggacagcccacgggcctatgctcttctta

SEQ ID NO: 407 - DNA, 2900 bp, Mus musculus
cccccttctccccctcctcctcctcctcttcctcttcttccttgtatgtgttttgagacaggatttctctgtgtagccctggctgtcctggaacttgctctgtagatcagactggccttgaactcagagatctgcctgcctcccaagtgctggaattaaagaagaaaactcagccttcttattttttttaaattgttccatatctatacattgaagccacagtatgtcttttgtcttggtttgttatacggttgttttaccttttattacatatcatttttggtgggccacgtgcataaaagttagagaacactttattctttatagcgtcagctcccccctcctacctttacctgggtcctggaaatcaaactcaaatcactagggctgtggggcaaatgcctttccctttagttctgctggctctattttttgccttttgagacaagatcttactctgtagcccaggctaaccttctaccctcgcctcccaagtgtctgattacatatgtgagccaccacacccagctgtgttttctgttttgtttttgtttttcaagacagggtttctcatatagccctgactgtcctggaactcactctgtagaccaggctggcctcgaactcagaaatccgcctgcctctgcctcccaagtgctgggattaaaggcatgcgccaccactgctgggcgggctgtgttttctgtttgatagagcagcacagcgccctttgttatgaccaggccacagtctatttaatccacctgctaagatgtttagtgttagcgggcatccactgttggccaggagattgactgccatgttcagctgcgggtaggtcagttggtaaagtgcttacctagcacacacagtgcgggttaggtcagttggtaaagtgcttacctagcacacacagtgctctgggtctgacccccaaccccacacagatcatgtgtgctacacacctctaatcccaacacaggagaagttcaaggccatcctcagcaatgcagtgatttgggtgagaccctgggctacacgagacattgttttggttttttttttcccaaaggaaattatcgatcaagattaaagatttgaggaaaacgtctataatctaaccctgactcacctagcataattatcttcatttttgcctaacacttctcttgcctcagtttctccagggttttcataagctagattgccttcattccctccttccctactattctatttggttgctgttataattctatttaaaactgtagctctcttttttccctaatctgaaatagaaaatttcaaaatatgacattaacccctctaatttctccccctccctctccacacctgcacccactcagctaccaaaaattttgacgagagcaaagctgttggtatgggaatttgacacaaacatcttcccatgtgtttctgtatttgtaaactctattcacgtccaaactactttagagcaagctttcagtgtatttttgtatctgcctccgctttgctgtgggcacttggttctgagaagcaacctgttgtcatttagcaaaagaccagaaggagcagggaggaggaaggccagctagggagagttttacatacatagggagctgtcagaagagaggctttcgggacttcggcattgccctgtgggtatgagcctgcctggtgtgcagaaaccctgattttgatccccagccttgcagaaatgaggcagggtggtccataattgtaaacgctgtgctcccagaacttgataggtagaggcaagaaaatcagaaatttcacaagtcatccttagcactacacagtgagctcaaggccagtctgaactattaaagactgtgtgtatgcatgcacatgtgtggcagagggagaggaagagggagggagaggggggaggggagagagggagagggaggagtctgggaaagaaagaagagctcagctggctctgcccttgcttcagctggtcatcgggaatcacaggcctccactgaaaggcccagcagtctgcttcattttctggccttttaaatttgtttgttttgatcccatgtgaaggacagaggttgacaccagatgtcttccatcatggcttgctctgggtgatcactttttttattttgtttttgtttttgttttttttgacacagggtttctctggctgtcttggaactcactttgtagaccaggctgacctcgaactcagaaattcgcctgcctctgcctcccaagtgctgggattaaaggcgtggccaccaccaccaggctgggtgatcacttttaaagcctttctattctactaccggggtcttcagttggccctttcctctcccacttagtcccagtgtcagcagtgggcccttgtttctcagcccaggtctatatatgcctttcccattttagctttaagtaagaactggatttcctacctttcaccagatgtcttctgtctattctgtttttccaatgtgacctaggctcacaaaagccacaaggccatcaggttgggagtggaggtctccaacattgtgcctggcatccaaggcctctttcatattagcgttctctgggaagccgggaagagggctaccactgtgagatatgtgcacatttgccagactgactccatttatatagcttctctagacagaccacagagggaccagaaggcatcacgcagccctcgagagaaaggttccgatcatggtcgctgcaccaaagccttgaacgaagcctagaattccttccctttaccatcctattctttgttggtttgacacggggtctcctgtttttcaagatgaccttgaacttctcttccttttgcctccctgtcccaagtgctggtagaggcgcgtgcctgccaccccacccacatcatt

SEQ ID NO: 408 - DNA, 3600 bp, Mus musculus
atcattaggtaggttttagaaactccaagaactcaccagtgtttgcattcagttgagacttaaaagtaacttccaagtaaggaggttttcaggaaaacagaaagcacagcttaagtgatccagagtctgccctggtaacccagatttgctcacacgcaccattcatctttcttcctcttttcctttctttccctcccctcttcttttcttcctttttctttggagggggggtctatggcattttaaaaccaaccataagcattgctatttcactttaaatatttccatacaagtctttaaaaagcaaagaatttgtgtgtatgtatagcaaatatgaacctaaagtgagaagatcaagttcaaggccacctgggagacatagaaagttccaaactagcttggaatcaccacccccaacacacacacaaacacacacgcacacacacacatgcacacacacacacacacacacatacacacacacagagagagagagagggagggagagagagagagagagagagagagagagagagagagaccactatcacattttaataagttacctattcttctttagtgccatttaaatactgcccactagattctcccattttgttttatgggtggtttgttcacgctagcatttattctatagcatttgcttgtttcttcccatgggcctcttaataaagaagcatcttattttttccctataaaatttacctaatgaagaaaccaggcctgtgttcttgtagaatgtcccttgttctggaggtttctgtagacttatttatgtctctgtcttctggtatttcttcccgagtggcatagcttgaggggtttttattagcacataatagctgtacatgcagtgggtgtcacggagccattttcatccatgtctgtgatgctttcccaggtcccattgtcctttcttgttcctgctcctgctgccctccttcctcttctcagctcgtctccttcctacctacctgctgtgctcaagcttgtgtcaagctgacaaaaagctaggaacacagtaccttaggacagtggtcctaggccagaaatgtccactatttgattaagaggagagactcttaaacccaaagttgtcatagtagtagcagtagtagacactagagacatgaatcactaccaagctgtgatgtgcccagaatcccttcatagagtctccactacatttctttttatttaattgctctcctgaaagaatttatttctgtcactttctcaatgaaaatttacagcattcctgccgtttatgggtttttcaaacattttgagggattagccccagaatctaacctcatttacaacatttttttttctaagagcaaatgcttttcccaaagtcctctcaaacaggctttctcaggggacctcccctgagggtacattggacactccctgtactaagtgttccaaccttagagagctccactccttgcaggtgtgctggagaaccaaaccagcctgtaaatgcagcagtggatcttctctttggaaaggaagcatctaattagagttgccatggcaactttgttttcctacactataacaggcctgtctctctgaagttcaggctgatggaacctgtctgcatgctaggggcagaggccatcacccggtagcttagagagtggacgtcacttcctcatagctcctttaccaagctgttctcaagatttattaagcacttgttctgtggagagcttatataagtccatgagtatccacagtaataaacaacactaagctctctcatagatggaatattgttcttcctgttctctctgtcagaaggtccttctcctgacatttatatagttgagtccacgttatcaatgaggtgtcagttcgaatgcacttcctcagaggtgccttttctgattgccttaaaagtaattattcctgtgccaggtgtggtagcgcaagcctgtagtcccagcactcgggaggcagaggcaggcggatttctgagttcgaggccagcctggtctacaaagtgagttccaggacagccagggctacacagagaaaccctgtctcgaaaaaacaaaaaacaaacaaacaaaaaagtaactattcccttcttggacatgtgtgggccatacactttgacattatggtaattagttttgttatctcttattagaatataaattatatgagagcaaaaaccatgacttaccaccagatctgttaacatttattgactgactgaatgaatgaacgaataagcagattgattgcattttacggtggtcaagaaaggattcatggccaggccttttcacataggcctgactgagatcttagctacttaggaggctgaagtaggatgatttcaagttcacagtctgcctggactacaaaatgagtctaagaccagccccagcaaatcagtaagaccctgtcacaaaataaaaagtaaaggggactcgagatacagcgtagtggtaatgtttttctccggtgtacacacagccctaggtttacagatccccggtgctgcaaagaagagagagggagggagaagaagatgaaggcttcatgcctgggcacctgtgtgtgtgtgtgtgtgtgtgtgtgtgtgtgtgtgtgtgtgtgtatttccatatatgtaaaatatataaatgtatatcatgctggccagaggcatgttatgtgtgaagaataattgatataataggtgggagtggtcagtatcatcagttgagcaagggcatttttgagcatccacttgactctagggatggtaccagctggaacggagtgtgaagggggctcaaaaggtggatttagaatgtacaggaagcagtacaagttttctatggggttgcttttttgtgtgttttgttttgttttgttttgtttgtgtagcctaagctgaccttgaacctatgattgccctgcctcagccttctgagtattagtattaagcatgatcatatctggctaactggaagctgttctagattttaaaaaataataaatagtaggcccaaaatttcaaaaaaaagaaaaccaaagacccagaaagtcttagcttgttgaaacaatttgctgtttagatgactatacctgaggccatggtcttaggccaggccagggtggagagtatgacggactggatgagggcggggctggcttggttggataccagatggactggaggcccagagactgcagtattttaccatcgctttccctttggccaaccagctttttaagaagttaattggaaatatgtctagtaagtatttggcaataaaatacacttattttaagtttttgttaatttttctttttcttacaagggaaacagaataccacagaagtttaaaccccatgctaataataataaatgacattataaaatagtgtgaggaaattactaaacaccttgcctgattctgccattttattgttgttattcccattttactgatgagccggatgaggtttaagaaactttttaaactacttgttccaagctcagtatagtaagtgacaaaaaattagatttttaaaccaatcagacagttcaacaataaagcaagggctttcact

SEQ ID NO: 409 - DNA, 3575 bp, Mus musculus
ccgaggactgagcagagttttaggaagccttgacagaaatgaagcaagctctatatctgtgcacactggtgcactcagttactcaccagaatgtactggctaccttctgtggtagggattagcaggtaaatcatgggccctgatctctcctgagaccgaagaaccatccagggtaccctagttctttaacacatgtctcccttttctgttgcagagaaagcccacgagagtttggtagtcagcacctgcatttctagtgtcgtttagcctaactaaaggtgttgatgaaactgatctcagaagagaagaaaataatacctcattaaagccccaaaaggtcagatagggatactcaagagacttgaggactgtcctagtgggtgtcaggctctacctcggatgaattgttcccagagagcctctacccatagaaaacaaaacaacaactaaccaaacaaataaacaaatcagcccacaggggagggaccaggcccggctacgcaggagaaaccagcccaggtccttccaagtggctcttctgtccaccctgcactgccatagtcaacagcacacaaggtcctgtcctgacaccccaaggtcctttctagggttcagagcaaattgtttagccaagtgttcccgcctctcactaggagggaaagaggcaaacccatctagaagtcaggctcccaggtagctctgcctccatgaccatttctttgcaacattgctgagtggcttgggttgccatgtggcagagctccacagggcccaagggaccataaaacaaggcagaggccacctggctaagaagcatatgtaccaagcccctctcctgccccatatccctgtctgctcttgatctaggcccacctctctctagaaagcacaaagctgtaagagaggctgctgacccctaagggccccaactccagggcctgcgcagcactctctctatcgtctttgactctccacgtaagagcatccactgatgcactctagtgttctggatttaaatcccaaggacatacactccaggaaaactgctggactaggtgccaggcctcttgggggcagggattgagccagctgcttccagagttcctcctggaccacagtgacttctgacatctttgaggtgtgtgctactgcaggtggcacccggatgagtggtttgtctgacctatgttctgagtcagcgcaaagaacctcagcctgggctgtggcagggccagcgagaggaacctgtttgtgccacacccggctgtgcagccagtctccaggcagagaaccacagctattgtttccaaggaaacttcacccatgattctccaaactccagccctgggtgggctgtttctcatcctctctgaatcccaggaacaacgtgtttccattctgacagcaacagggtatcacagaaagtaggggagggcgtgagtttggaggatgggatggcccttgaccaacagatgggggactctccactgagaaggggctgccctggacacagtgagccattcctcttggccaaggagaggcacaatgcttccggtgctgtctgctatgtggatgtggccatggctgactgagtttgcagatggagctccatcctcatcaaagcgcaatcaaacaggttacatctctgatcccaacttgctttactgtaagggagggcaactctctttcccgtttatgcccgtgtttgtgtcatgtcctccccactcactctctccattgtaataaagccagctcggttctccacttgagtacagcagagggtagaggagacaggaagagacaggaagtaccctagaagccctttatcaataggaacactgatacttcatcactatgtctgcaagcaagaagcagggtcttgccttatggggttgggtagaccatatttactcagcccggggggcctctgccttcctgagctgcaggttggaggggctaccttcttcctcagcagggcctctgggctgaggtagtggatgaactctgcagaggtgagattggcatcctgaacatactggaatggagcttgaggggagagtgctgggaagggctgctgaagtgggggcctagatgtgtgagaactggggctctaggtgcctgctcaggtgtgatcaggactggcttcctgcaggctgggatccaggagagatcagctgctgctccccaatcagggcagcgcttgtcccaaggtcacaagagactgagtcaagagctgtcatcccaggatccgtgctgcagactgagtgtcaacaggtgacctgcaggctcctgagcacaagtccacaggggcctggactccggtgaggagagggctccccaacactcctttgcggcccttgcttctgccaaaagaaacattttgaaagtaagatgtttgtttgtttgtttgttttttttctaaaacctccaaaagtattgttttggggaggaatttggcagcagagcatgtgaacttctggaggggcgtgatgaaagacaggcaggaggcacagttagccaggaggcactgctgaccgggggctgcaagttgccaagtgaagcacagtggagctaagacagacagaactaccaggtgcttgtgtccccagcctgctcagtcacaagtggctatagaggcaggtgggagactctgagaccagctctggctagcaaagcccagcagaggcataaggaatctttaaagatgctctagatgccatgaaactggagacgtaggagaaaacccttgctttttgggccttttcggcttgttatcttagagcccactagagacctcccaccatgggtgggtggggactgacagatgactggcacctctgattccagggtgggctctgcaccccagagatgtgttccccagcctgtgaggtgaggtggagtaaagaactgtggggcatagcgcttcttagagcccctagtgaaggtggccatagcctttgttattttccttcctagagatccattctccaggttggaagcacagccttgctttcctgtcaaccaacgctgtggagtgggtgctctgttgggcactgaagccttctggggcctctggataatcccagacagatccaggggcccttgtatgtgaggagagaaagaggggactcgaggaaagggcagccccagatgtattctctagggcctttgggctacaggccagggcacctgtgcataatcttgagcgttaacttgactggggggggtacctagaaaatgaacaaagccttagtgttctctctgtgaagatacttccgggaatcattgtctgggaattgggggagacctggcctgtctgtgacaccttcttagagactgggagctcgggcaaagttaaaagaaaaagccaactaatgtgaagatccctgtctttgctacctgtccttgcagtgagtagcttcccaacacgtccccattgtcacagcattctgcctcgctgtggacccgacaccaacagatctaaggattgtggatcaaaagctcagaaaccccaagccaaaccaagcctgtctcctcttcagttgtttctgtcaggtgttttgtgacagtgacca

SEQ ID NO: 410 - DNA, 2875 bp, Mus musculus
tcattcattcacagtggatgtggttacatgcagtgggccttgcttataccaaggactcaatgaactgaattcctctgagaagcagggaagtcattatcttcagctgcatacccactgctgaacctaccaggctccagtcactaattccaaagccatggtcacatagatggcactggttaaactcagtgagtcataaaacaaaagagacctagagaaagaatctgtagtggttgggagggggagttgacagatgttggagggagacaaaagccagcagtagtaagagtgctcagaatgaattacatacactaggtaacaaatttaatcaacaaagcattaagaacattaatgaacatatagaactcctaggttgcaatgaaaaatgatttaattccttactgtgtgccacacaacaaaattcataatgtaattgctcagagctttaaaatatcactagaaggcagtctaaggagatggactgggggacactgggatggatacatggtgttttgttgtcctgaacagtgagtaataatgtaatcacagcaaccaagacaggcctgtttcttcatatcctgcccactcaacctttcagcaaggatagcctcaggtctgtggggctaggtgaggagccattacacactataggaacagcagatgcaagggcatagacacagctgggaatttggacttaggcagggatatgggtgtgagtgcagctggggtgaagctgttttttttcctaggaggatctcctacctgctccttcctctattattctgccaagtatatcccaccccatccgtaaggaatgccatctgcttgctgacctactgtcctagtggatgaggccacaacctcaaaagagcaagccttggtgcactttctcaccacctctttctgtatggaagaggtccaaggagcagcctggcctttgcctgaaaccattctacgcattgtatctggaggggtgtggctcagtcgtttctgaactcagagtcaccttgagagtctttgatgactggtgcctgctttcatggctcagagcaacgcaacctagggacaggttctaggaccaccgtctgagagctaccccagggctcctgggcacaggaggatgagtgtttaccccagaactccattcctgtggccatatatgaactcatgcatccctacaattagacctgatttggagaagaaaggcccactccagctggggccacgccaagtcctccagatgtgctactggcaggcaattgccatgaggtactgatacatttataaagaactctctcccatctgctgtgggatccctgaggacccgctcatcacccaggccttcgagaggagtgagatgtgggtggaattgggcaccaaggctgcctcatcaacaactcctcacactcgcaaccactttaaaaatagagccatcgtgtccagctctcttggcaaattcataaatgactgtgggtggctctcgacatcacctacaaacaaattagtgttaaaaatagatacagtgaattcagagcaagggatcataattccgaatagaagaagccttggaagggagagcaggaagtatagacccataagcattcaggaagtaaggggcacttcagctggccaagtggcaggagccaccaggcactggcaccttaatctgagaactggacatgattcctatttcatacattctgcaaacgagactcggtgcattgtctaaagtcctgaggttcagatctgagcctcttgtctgcagttctctactcacagggcaccaggcagcctccctgctgtggctttctccttccttgctgcttccttgaagccagaaggcagagaggatgactgagtgaattaacatcctgttactatagcaaaggccaaggcccttggagaagaaagagaaaaaggttgttattgaggctccggtgcatggtaagtcagtcccgttgctttgtggcaggagggtcatggggggccaaggcactgaaaaaaagcccagttcacaaggaggaagaggcatggtaaaggcagggactagagtcccacagtcctatcaagactctgccctggtaacacaaaggcatctcacctggtcccacctctggtaggtatcttgacctagttgaagacctggacctgagtttggcccctcagcattcacataagaagtcaggcatgaaattcaagaagaacgaagaccaaagtctggacactttaccctttcttagaaatgggaacaaaacacccatagaaggagttacagagacaaaatttggagctgtgacgaaaggatggaccatctagtgactgccatatgcagggatccatcccataatcagcttccaaatgctgacaccattgcatacactagcaagattttgctgaaaggacccagttatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtaccccggagctcttgtctttagctgcatatgtatcaaaagatggcctagtcggccatcactggaaagagaggcccattggacttgcaaactttatatgccccagtacaggggaacgccagggccaaaaagggggagtgggtgggtaggggattgggggggtgggtatgggggacctttgggatagcattgaaaatgtaaatgaggaaaatacctaattaaaaaaaactgaaaaaaaaaaagtcaggcatggagatcaaaggatccctggggctcactggccagctagtctaactgaac

SEQ ID NO: 411 - DNA, 2725 bp, Mus musculus
catattactcatcatcattataactaatagagactatttactaaatttttattacttagtgtgatactgctgagtttttcaaagcctaatgcctcatgattatctcttttttactaaggaggattctgagacccagaataggtttgattgaatccaggacatacaactaattcgatatgaagcaaaggttctcatctgaagttcagtccagtgcttacatatcacaaagatggcaaaaaggaagaaaagatgcatttatcaatgattaatactatttcctcagctcaccatttcatcaaagaatggctctttttctagattgttttaaagaagtggtcttggtaaacaatttgcttcatcgttctattatccctttaatcgcacctgctgacaacagaaagacacctttcagctacagatctggtacttttctgtgtccaagggacatggccatgttccaaggtagtctttggtggagtcccatctttgctgagagagtagaaatttagactatctaatctacaatgaaagtagtgactgctgttaactgacttactggatcactgagagctacaaggaggaatgttgtaaaggtgttctccagagagatcagaccatcttaacagtgaatgtggcattagccacctgaaggaattgaggaggaccaagttcttgttcatttcccccctagaatttgggtgttttcctaatatcctggatataccttcatcttcatcattttcaaggctcttgatttttatgtctcctgggatccatgcgcattcacacctcttgcactatctgaacttttctaagttgccagtagtctctgacatgtgaccttatgctcaaggttaaacaagctggtttgggggaaccagatcttgagttaatcatttatcattaccaaggaagacatatgagagccaggcaaatatgtctaagaggattcaacattttagaaaatcaaaggcattctttgtgtgttgtgaaatagctcatctcaacttgcttccaaaattttgttagaaaaactcagaggttgggtgggagatcagatgttctcccttcaaggccattacctttttagaaaagtaatgcttaccatgttatagctgcaccaagaaaaggaaaatgaggtataataaatgaaaaggctcaatatccatataacatcccactgagactcttgagctctgtagattaaaacaaactcatgctagccctgtgaaatccttgacatatcccttaaggtaagctggagttgagattcaaaaatgttaggtgatttgatgaaggtcaaactgaaagtatcaaagtcagaattgcacacaaattttggcttcaaaaaaatcgatatttttatcctacaattgcatgcttttttcaaaatgcagcttaaaattggcctttcattcctgtgtgcaattgagtcaaaaagatctatcataaccaaaaataaacagcaaaaataaactctgtgtgagttatttgactcacattacaggatgagtcaccccagaagaaaaagcaacgcagaaggaatctggcctgagcctttgatttgctcctgaactgaggccctggtggaagtcccctttggaatccagagttttgcaagttgtcccatcacagggatgacacctgtctctgaagtgtttcttcctgttttgtttttaactcctgttacatgcttcagctatttcaagtttgctgatggctttgggaccaagataggctattcagaatgacacagtgagaacagcagctagctgggactagagctgacacagatctgatgtgctgcggggtctgggtgtcaccttcagcccttttgcttttgggtagaatttgaagtatacatgcttttctttttctgagcctttgtataaagcccctttaataaaaattaaacatacagtcaatataatctgttaatttgattttgggtaaatagttcttctaacatatacaaaatacatgatctggtagagtttattcagaacctctgtgccacaataccctacctgtgcattaacatgatagtaagccaaaaagctgttctaggcattaacaaaccagcatcctgcatagcacatagtcccttgaattttgtattatcatatggatgcctctcagtgatacatagagacaatccttctgcacactttgtattggtaatttttgtaaaaagcaatatagacataaccagtatcacaccctcaatttactgtttttgatgtgtttgccatattcagtggcaattagctatttatcaaccaaagataatgaaaacaaagctttcatttttaattgagtcatagtatttgaaacaaaaaaaatgtcaaaactctgctgtctttgctctagagctgaggttctgcagatgtaatgatagtgctaatcacattcttgctagtgagtatgacaatagataataaaacactggaaaataaacactgttatcaactaattttagaaataatcttgagggttgggcatattgaatatgagagatggtaccttttagtttttccaatagtgtctttggcaagagagataaactctagcaaaacagctgtagatagcacctctttagcatcttaagaagcctggagtcacctgttctcatgaagtaataatgactgtaaccatgacaatatcaacaacactgaaactagctggcatcagtgctatgcttagggcactgagcttctgccttata

SEQ ID NO: 412 - DNA, 1925 bp, Mus musculus
tggctgaaacctcccctcttcctttatcatgtgcagaagttgaaggaaaggcagcatgaagggaagcagaaccacacgagttgagcagtgagccgtacctgatagtatagtttcgcacactgaataacaaatgtttgctctcccctctagaatttccctgaagccattggaagacagacagtagtaactgtgttcttggttgtatttgacacataggtagaagtgtcctctctattgataagtgattctccaaacacatagacaaaaccagttaccaccactgacaaccaacgctagtattttgtgttcttaagctgtggctcctgtttcatatttcaatttaatttcattgctggagtcatgaatctctaaatacttgactgaatctttgggttctttaagtttctaaaaaactggaagagagtgagaccaagtaattttctaaaggctgctattagtaagctggaatagagtgggatggctacacgttcagacctatttcagatctatgttctagatcacttgacagtaaagtatgatttttgggggggggcggtgaggggtgatttaaagtgatagagtagttcagaattcttttcatgtcggatgccttttatggtttatctctagtaacttgtattaagtcagttaggcatattctgatataaatataatgtgctaaatttttaagagcaaggtatcagactcagtggttttcttattatagctcaggtcagtaactgcagacgaagatacagagaaggaaaatagacatttaattccttgctgctcagataccttcctagctgtgtctccccttgggggctgtaaagaaaggtgctccactttagagctgcctcagcacaaggtggaaggctccatggtttcttgtcctgcactggcagcctctgcacaacagctgggagctgtggcctcttttcctcaggtttgtccacggtggctggaatagagttgtagtcctctagagagtacataaatccactgctgccctggcagtttgcatgggcaggtgaaaggtttaccattgagactagctgctgtgagattttacttgaatttggagtaccttggcttggtaagtaaaagaaatattttataagaaaaacctgcacaccagaagaacagttcagaaaggaatagagatggtagcctggctctctttctgctttctcttcattttcccctcccgctgatataatagctgtctccaaccctcctagccattcctattgtgacttgtgctgtagatttgataggctagtgaaatgttgtgtccattttgatcatttttttgggttagagtaaacacagcttcagttcctgagggatgtgtccaaatgagttggtgcaactggccaaacccaagtcgtgtcagcgatgctgtggggtggggcagcctcagctgtcagaaggcagcccagcttcctggtgccagtggaagttagaagggtttgcttccttcccaccttctgacctttcagtgcagcaaggagcagcactttctgtttccaagacttcccacctggctgtactgaaatcaaagtatgccaaaataaatgtctttgatatattttcagttccttaataatgtcaacaaaaactttaactcaagctggctctaagtattgatttaatgaaatatactttattgattgatgaaatatactttagggatcatcaaagaataattatgccaaaactaatgagcaaaaccagagatacctttctctgaatgtcaggaaccctggggccgtgggaagttctgtcgtgttaggagaggtgggcacactgaagctcctgatatcaggaacactgcctttccctggcggttgctgttttctttagtgtttcctccatcctgttcagagactaggcacactgctctgggttggaataaggtcagc

SEQ ID NO: 413 - DNA, 3125 bp, Mus musculus
taattccagttggcactcaaccataaccatcacagatatcgctgaaggtcaccatgtatccaacaggaacatcgatgtaaaccacatattaccatagactagtcacacacacatacacaaacacacccatacgcacacatcctgatatgcaaataagaggcagagagagaaagctaactggggaaatggcatgggctcttgaaatctcaaagcccactaagcagggacacacctcctcaacatagccacacctcctagtccttcccaaacagatccaccaactggagaccaaacgttcaaagatataagcctattggggggggggggggattctcattcaaatcgccagcaagctagaatcagctgcagcccattctgagtagagtgcagaaaaagaccagaggagtaggcctggcagagctgttatttgtttaggctctggtagagactctaagtgagtgcttgtaaattataaggcacagtttataaattaagaacataaaaatggaaatgtagattactttggtttggttccaagatcttcagcagtttgaggggaagaaaaatgtaatagacaatcagagagacacaatctgtttccaggaactagtcagagattgtgaaaatgtaaatgccttcattgcgatggacacttgtccccgcgaggcctggcgatatgaacgcccagtcctgtagtgtaggaaatggtagaactcctgtttctttttctgaattctcgcactgtctgtactttacattactgcacatgcttcagcttcagaactgtgttcattcatgcccctgcactcagccaccagtcagcactgactgggagcttgctaggagctggcagtggtaaagtaaggccaagacagacatactccctacctccattggagctagacattaaataaaagaatgtactaatggataggcaaatacaagcagaggacaggatatgggaagatctagctcggggtgaaggagacaaggagaagcagaggccaaggaagggggagtgcaggcagaaagcacagcacatgcaaaggcccaggactgagaagagctgagtgcctgttcaaaccatatatggcatgttcagagataaaggatggggtgccctgagttctggaaggtaggagcaaacaaatcacacaggactctgcaagccaaagcaagaagctcggctgtccttcctaatgccagagggacctgagtcagagaattggcatgatgtcatatacttccaagtatctgattctgactgacaagtcaggcccagaaaggggtaaaggcagctggactcaatctacagcaggaaagaagaaatgtggtgcagtttcaagaggcatcctcagggaagagtcagcagagttcacgttcatttcaggcgggaagtcaaaggaagcgagcgccaaggttacctctcaaaagctggctagggcctgtgtgtgatggatggtggtgtcacttcccaagatgacaatgtctgaagaagaagagggcttggtgagagagggatgtcaacagtttggtgtcagggacattgagttttaaatgtccaggaggcatccaagtactgtacatgccgaatgggtctttagatgcccgatcatactggtccatactggtcgggaggagttatgggagttagccttcacatcctctggtgaagcttccgttctttcccagttctcagtgtgctgttggtaaattgcataagcgggagggagacatttcagatgtgcattagcgagaagatatctctcagatgtatccagccaggaacaatgcatattacagagaacggtggagctaagaatactgcagttggagacgtatttttagatcacaagtaatcttcacaccctaaaccgactataataaggcttttgagaatcctaaagactttctcatacagttactctcccttcccaacttgcagaccgaagtctgccaacagccccacctaagtgtccccacagaaccgcaagccctggagagctatcccagcacctaaagctcttggctcccaagcttagagagaagttgcccattcaaacctcagaggcatttggtttgaatgattgtactttgatgatcccccaggactgtcctccctcacacacacacacacacacacacacacacacacacactgagtttgccaatcccagttccaccacatccaatctgccactctgtgtttggctgctgatcaagcaaacacagaagctatttctgccccccccccccccccgttcccatcccaccacaaccccacccccactgcttttatcaagaaacccggtgagtccccaggctggaacccactctgagctacccttgatttcaatcaagtcccaaaggactgcctgtgggtgggtgtcttgcccctaggacactgacaataacttttagtgacctttgtcaccttgccctcaccacccgtgaagtggaaccttacgggtcattgttaactttcaccagcagctatgtggtctcatagcaacaggacataattttgcatgataaagagtcacacgtcttcaaccacagggctcacttgagggacaacttcagcttccatttcagacatcatccccacgaagttgttccagaacactccgttggccaagccacacagactgagtaattgattggtgacagtattaaatgccaacttcatacctgggaggcaggtcttggggttcatccaggatggattgtctgggtaagattagtctctaaaaatatctaaaaggaattgttttgatatgttacttgacatgggaagacccacccactgtgtgcaggaccattccctcggcagaggatcctggactatttaagagaaaaagttagggctggaaagattgctccgtagttaggaatgtgaacagcattatagagaagcaagtttggttgtcagtgcccacattgtctggttcataacggcttgtaacatgaggtcaaagggagtccctgtgtctggcctctgtgggtacctgcactggcatgcatagactcaaatacaaaatatagatgtacataatttttaactaaaaaaggggggcaggcatagtggtcaacacctttaatccagcacttgggagagggaggca

SEQ ID NO: 414 - DNA, 1800 bp, Mus musculus
agagggcaggaaataaactcagggctgaaatcaaccaaatagaaacaagaagaactatataaagaatcaacaaaatcaggagctagttttttgagaaaatcaataagatagataaacctttagccagactaacctgagggcacagagacagtatccaaattaataaaatcagaaatgaaaagggagacataacaatgaaatatatcttaaaataattattctgtttgttgaatattaactgttgaaaatattaaaatcatgttcttcaaaccaaaagaacaacaacaacaacaacaaaacaacaaaaaaacccaaaaaacccacaaacttttactggggttctcccttggtttccttgtctcacatccattaaaaatgagtagcgtgttttatataaataactggaaatggccagcaggtaaggtcaaaccctttgcgtggcttttaaagctgaatttaaaatatgtgtaggcgaatggttctcttctgttcttctctcatctgctctgaatttgtcagacaccaagaagaagctgctctttgtgatgcagagggtccagctgggacagccactgatgtcactgtggctgctgacatctgtgtagagtcaaataagcagaaaaagctctgagactgctgctgtgatcctgtgtgatcgggaactggagagtgggggctccagagctgggccatttgccccgggaacaggcaaggtttgggaagggaccgaatccttagccaaaagctttaccgttccctataggatagcttgggtctccatcctgtttttatccgggatgactcgtactaaataagtgctccatataattctgtaagttgattaaacagttggctgtcgttatggctgaaggatgggcctttttgtccacatacgcatggtcttcatgcattaaaaacttggcccccaagatggcaccactcataggtggcaggacctttaaggagtggggcctagggcattgtgtcacttctcaactttgcatgtcaaacaaagctcagcactgtgaaatgataacaggggcaaccagagctaaggtcttgagtgcaagctacctgtgcctaaatttaatcttacattttctaattttaaaatttatccagaagctcacattttgcctgcattgccaatatttagtttaccacccccatgtctttgaactcgtctgtggcagaatggcttctaaatccaaagcaaacctcgaacaacttctcaaagatcgtgagaccctgatctttgtctggtttgtgataccagtttttttgtttttctttttcactgcctcgtgttcttgtcatgctatgctgccttgctacaagttcaaaatgataggggcagtagataaagcacaggaacctctaaaactataagccggaaaaaaacctctttttggtgtaagttcgtggtgtcgggcattttgttttagtgctagctgcctaacacagacactctcagggacggatctggaaaccgctcactcagcttggtagtattttcataaggatttttgaccagatgccatgtgatgttagcaacataattttgtttacgaagttcagcttttcatgtgacttggttgttgcgccctcccctctttctcttgcggaggtcagtgtcagggtcttaaagtctgtgtcttcccccaactcaggttttgaagacaatagtgttaggaggcagggcctttagaaggggagaaggtcatgaagatgtagaattcatgagtagggttagtgtgtgtgtgtgtgtgtgtgagagagagagagagtaaaatgcttatt

SEQ ID NO: 415 - DNA, 1825 bp, Mus musculus
aagatatataatcgatcttcccataacatccactagataaagggatcttagtaagcattgtatctagtattattgataaatataaaatgtcaagaactcaataaatacagcccttctcactgtcatctatagattctatgcagtgtaatttttacttgtatgtgtattaaacccccattgtagaaggaaaacagagacttaaggataatttgtcctaattgacattgagtctttctcatatgttcaattcatgtagaccaaatcaaataatatattaacatatatatgtatatgtgtatatatatatatgtatatatatataatgatcatatgccaatgaaactgaaagtacctttaatattttaagatacttaatcttctaagaaacaacaaatgaaagtttataatttattcatgcctttgaacacagttctatttatatcaaagttatatatttatgtaactgcaggaacattgcatttgatttgaaatgtatttttagagaaaaaatgtaaggatcagcactctttctttacaataagaaacagaaaataaagcaatcatgaaaaactcttcttattgattctgaggcacaggaatctcttttttactttttttttttttgccaaattcttattcttttttaatccattaggttacttttagtataaactaaatatgttcagtgcagaattgtgtgtgacagaaaggtgatttggggattttgccacaaaaggctccctactaggtggatgtgaccaatcagcattttaatgagtgatggtttatttacttactctttattctatcatcagtctcctctcagttctttgtgctggaaagctaaggcagcatccttccggaggcagggtcacctggctgcacagtcagtagagaagatgtcagcagtgggcaaatggaaactgctgctgcttcctctggctgcttagagataagcctggaaggtcaacatgaggttttgtgctcttcagctctgtgtcaacccctttaaatgatgataataggtcaaaacgcaggggctcttctcatttatttcccaattactgtatttgggtgcataggcatgtacatatatactgtctgaggaaaaaaaagacaaagaaaaaggcagtgtgtaatgaatttagagacaaggaatgtgagagaaaacatgatttaatttgacatccatagcaggattaaagtatggttcttttggctatgtcacagacagtttgtcagtttgaataggaacacacaaagaaatccataaaactaatttgtttagagccctaaatgagtctgaaatataagattaatttttatttgcatagaaatctcattactcatataattaatggctatttttaccctctaaaattctgcatgtcctttttagggccacttcggtttgtttgtcggcaaagatttcactaataggacccagtttgtctcacctaatatattttcacgccgttttcatgctgctgttaacattattaaatttataattttgtttttatgcctttgctctatcccgtccccagttctcaaaaatagattctcgattaaaatatggttcagtgaagcataaaaagtgatgcaaagagttccacaaatagtacaacccaaaataacatcagaaacaaggaagggtgggtctccagtgggaaatgcaacttgctgatgccaggaccactgcacttgcatgtgtctttattttatatatgaatgaggggaatgtggaaatagagacaacactcacgaatcactaaaacagtagatcgtttgaagattcatctactgcagttccttagctcttctt

SEQ ID NO: 416 - DNA, 1900 bp, Mus musculus
agcaggtgattagaagaatctgccctagttacagaagtttgtcccaaaagggaccacaaagatagattaatcacattgacaaccaggtacacacgtgcatctgttcagtctgcaggaacaacactatacttcccatgcacttacaagtctatattacagtttccattgtatgcaaccataaaactgtcttttctatatctgagaaactgcagttcagacattcacacatctctctctctctctctctctctctctctctctctctctctctcacacacacacacacacacacacacacacattttattttgtcagtagaaggtgctaaaagagaaggtatttgataataaaatatgttatgcttaattgcgggccaatgaacaatagtatgtaggtacaaagcctgtatattataattaaatatttaagatcaaactttaattcaaaagatgctgaatgtgtaccacagtgaaaaatgagtagtgactattttttttttccttaaacagtttcatccatttttaacctaaaatgctgacagaattaaacattcagcaatagatattctgagtgagtctcattaatataaatagaccagatattcatgaggatctatgtgcaaagaattcttatcccatttaatggggtcaagcttaaataaagctctttacccagaaaataggagcttagcattccaagtacaaaactgtaactctttttctcttttggttgttgttgcttttactgttgttgttgttgttgttgttgttgttgttgttgttgttgttattaagaggtcagctcgggaaccttagaaaattccacgggacccctcccctcttggaagcaaaaggtcataggcacccctcccctctggaagggaggggctaattacattcctcagaccacaggaaggagggaccgaccacctacctcacttcctatagaccaatcagtttaaaagtgacactgttgtgccaatcatgttgtgcctaatggctgctgccccgagaactgtataaaggctcgctggatgggctgtgtgtgctccttctctctctccatgtgcagggcaaccccaacatgtggaaacagtaaattcccttgctttttacattgattcctgtctctgtgttgctcactaagggagtccctggaaagctaaggcttgccagagtcttagagttgttggtgctgctgttgttgctgatgctgctgatcttggtgcttttgttgttgctgattgtcattcgcattctcatcaatgctttcattcaaaatccatcctaacattataaccttctgctaaggtaagtggtagcttttcccattgcgcttgctcttcggaggctatatcaaataccaaacgatgccccaaaatagtagatgatagtaagaactgtccttcctagtaactcggggaagtctacttaagggtgtaggagcacatattaaatttagaagatggaagtgtagtctttatttagaaagatatgcctttctgtgatttctttttcttttctttttcgagaggaataggaagtgaaacatgaacatgtgtgggcagaggatgggaatcctatgtcatacttgcatatcaagaattacaaattcactgcctacttactggacagaactaccacttattctatgatctattgaaattcaaaagtgaaataaatagattaggcgttagtctcagggcatgaaaaatgatcctatgtttgcttagatggaacctggattaactaaaaacactgccgtgatacacaataattttaggtaatgtaaaagaaagtagcaatgctgacaaaaagcatatgcttagataaactgactagattctggtgtttgtgtgctatgaacaatctgaaaaacactagaacccaggagtacacat

SEQ ID NO: 417 - DNA, 1725 bp, Mus musculus
aggatgctgaggcgggaaagattatgcagagtgcaagtccagcctgggctacatacagtacagaatgaactccaggtcaacctgggctaccctacctcaaaaaagaaaagagaaaggaaaaccatgtaataaatggtctgcttatttaatggatatcaaggagcagtaaataattactgacattggatgccttcgcatggaaacttctaggcgatcccaaggagataaaattcaagacagaacaaactgctaaccttgtgcaccttgatgtttgtgcacagaaccggacagactcgcagcctctgtggcgcctcctttattctcaaggtattttttacgtgtttcatttctggttggaaatacccaggcttacagaaaagtggcggatttgtctctactttagctttcccagatgcttgtactctagctcaagacagtttctctctctctctctcccagtatgcgttccctggactgctgaagtgtaccttatagatagagtgtgttcaccctgcgcatgccattgcatggtgctcaaaagccaggactttactctcgtaaaccaagggagaattatcaaaatcaaggatcaagcatgaacagactggcatgttcacctacagctctccctcagcgtttggcccttgtcccactaaggtcctgcattctggggcaggcaggtcagggctccaaaccccagatgtgcagccattggctgggagagcatggtgtgctggctgtggcgggttacacagctggggctgtcaatcatgtagcaagagatgtaactgatgcatttccatggttgtcatacgttttcaggggctggagagatgttcagtggttaagagcacatgcccttcttgcagaggacccagaacccacaggggagcccacaaccgcctgtatctccagcattaaagaatccaatgccctcatctggcctccataggctctgcatgtaaacagcacacatggattatggaaaagtggcaaaaggccatccagcagtcccctcccctctccggaagttaggaaacacaaactttgattcagctaagcctctggaaggtgggtttcctgttaactggctaggaacttttctggcctaaccctctaagcacagaaatgctgtgtgcaggtgtgcccacgcagacaccagaacaaaaacaaaaaggaagaaaacatgacttttccttctctccttagcaatgcattatatttttatcacttatttatttgggtggtttttaatagacatgacacctctctttaacaattctcacaggatcatagaattgtagagctgcaagaaatctgagcgatgatctcatctaacctccctacacacatgtaatttaaagaactgtgttcacacataacagaagaagctatgaaaaggaggagagtggcctgggggaaagtaggcaaataccctacagttatcccccacctgttcactgtgtgaacagtctaaatgggtgtccatcagtgtacccagtaaaggatgcttcctacagtaccttcagcagtcagtcatcaaactgtgtctgtgagagagagagagaaagagtgtgtgtgtgtgcatgaaaggagtgtgtatatatgtatgtcatatgagtgtgcctgtgaatgtgtgtgtgagagtgtgcatgtgagtgtgtatgtatgtgtgagagagtgtgtgtgtgagtgtgagtgggtatgtgaatgtgtatgtgagtg

SEQ ID NO: 418 - DNA, 3575 bp, Mus musculus
acttattaagagtgtgttctctgtgatcccagtcattctttaaacactttttttttgttcagaaggagaggatacacaagaagaaagccctatgccccacagtcaaccagtggaattccttggaaagctactttcgaaacaattagggttttttttgtttgtttgttttttttaccaaaccaatggcacttcctatactccccagggttattactactgtttattataaagaagtgaagacaggttacacaaaagcctactcatgactgtccacagcagctttacccacaattcccacaagtgaaaaataaataggccgcttttttcaaaaatcttgttaatttttcccgaacatatgtctgagtagtatacgcacacggagcctttggaggtgaggtgttagatcccctgacactgcagtcacagacagttgtgagttgccatgtgggtgctgggaatcgaacctgagtcctctggaggagcccttggtgctcttaaccactgccaggcccacccgtttcctttatgtctcagaagtctgccaaaccacgtccaaaggctcatcctccaaccgctgagaccagagtgatggattcatcgatagcagcctctgctgtagctcatcagtcagaggacagactggcggaaagggaaggatataccacgggaggacaaagcagctgcttcttcacatctctgcagatcaggaagtagagaagacacaggaagctgggctcgcctgtaacaccccccacaaggcccgccccctaaaatccacttcctccagtgaggctcctcctcctcctcctcctcctcctcctcctcctcctcctcctcctcctcctcctcctcctcctcctccgtgttcccaaccttccacaacagcgccccctgctgggaactaggtgcccagacaggagcctgtggggatacttgaaactgtcacagcctctgtaccagctcatggccttctggctgttgtacgctccccgaagaagttaggcccgcttatgtactggctgagagtcagcgatagacatgatagataatcgccagccccttgtccaagggcagataacatagctccgtttttcaggttggctaatggtgtttgatggggaaaagccacagatcagctggggaaagtgtcaccaagacattctacctgcccctgcagctgtttcctggttcactggccctagccatcactgtcctgcgaactgacccaggtatggagcaagtgcttcaatgctctgtgctctgatccctccctctaaaccccaggaatccatttccctaacactagcccactatggcaggactcttagttctggcccaagaccatcaacagaacacttgtgttatttctgcctagtacacacacacaccacaaagtatcattttggagactgaatgaaggcctaaggtagtgtaagcccctctcctgtttgcctttcaataaatgtatacatgcacactcgtgtgcaaacacacacacacatacatgcaatgcccaatgggtcttttttccatcttaaagtcatacatgtatgcacatgtgtgtggttgtatgtgtgtaagcacatgctggcatatttcctggtcattttttttttcttaaccacatctccacagtgagctgaattcatcgacgatcagaaaataaataacaccaagtctgcatttattaaaagcagagttgctgtcagggtgccctggtttctcagaaactgtaatttgcctccttatgttctagggtgcttgtaactttgttttttttttttttttcaaatcctatttttaatgatggttcttaaatgctttaaccttccttgtaacccaccacccaccagaggtagtggaaaagaaaggatacgggggaagagggcttgtttagaaaggttctttggatcaactccagtctgtgttgtctggaaattggcagtttacttcacaggttagcagcagcggctcaatccatttgcaaacgttccacggataccctagcagtccagtttggtggagttgggatagcaacagctgtgacatgacctagaagagacagagacaacaggaacactagaagttcccagctatgcctctctcaaggaagcaaagatcagcaaaggcgcaagacccacaagcattgcacagctagctgtaaccagcaagccacattctctttccagcactctgagtcctatttatactctcaaagcatcacctctcctccatgtgctttgcctcagcatgtgcatccgatcagcctgagtctgcagagtcccaacaaacacagctcaactacacaaggtaaggcagaccaatacatgcatgttgttagcagtgaatctttcatcacgtgtcctttccatgtgcttgctttagcagaacaatctctctcctgtttcattgaaatgtttcttcacaagtctgccttagcccttcatacctgtgtccactttgtcgaaacattccttcccgtgcttgcaccagcaaaacaccatccaaccaactttccaaagaaccctcaagtttctgcttcaggtgctccacctcctgtgcacctccttccacagacattgtttttctgaagatctttccatcctgagatacaagaaaggttgccatgctggctcaaagccactgggctgagggaatttccattctgccaagaagcttacaaagaaattgggtgtggcagcacacacatctcaggaggagggttgccacaggttcgaggctgacctcagctctatagcgatacactgtctccaaaacaaataagcaaagagagaagctcacaaaagccaggaattcttaagaacattgtgacacagggctgttggtgctcattggtctatgagtacaagggtgggcaagtcaccagcacccaggacccagccaggacccctgcagtagaaaaggtcactgatgctggagacaacatgttttcccacactgttaatatggtatgacttcgtattatccacttggtaaagatttatctgtctttgtgggaatgcttagagccaggcatggacagagagcatccgaagaatcaagagggtacctgggcaccaactctgaagtccttaacttccagggctggttcttcccgatttttcttctgtgaagagacactaaaacagagagcagtaaggcccatgcactggcttgttttgggcatcaacttgacacaagctggggttatcacacacaaaggggcttcaatcgaggaaatgcctccatgagatccagctgtggggcattttctcaattagtgatcaagggtgtgtgtggggggcattgtgggtgggaccatctctgggctggtggtcttgtgttctataaaaaagcaagctgagcaaacaatatagaacaagccagtaagcagcattcctccatggcctctgtatcagctcctgcttccaggttcctgccctgtgtgagttcctgtcctgacttcctttggtgacaaacagcagtgcggaagtgtaagcggaataaaccctttcctccccaacttgcttcttggtcacgatgtttgtgcaggaatagaaaccctgactaagaca

SEQ ID NO: 419 - DNA, 2125 bp, Mus musculus
ttatgactctctctgattctctctctgtctctgtttctctctgtctccctgcgtgactatctctatgtctgtctttctatctctctgtgtgtctgtctctgtctctctctctctctctctctctactctctctctgtctctctctctgtctctctctgtctctctctctctctgcctctctctctctctgggttgcaaagatatacctgccgagattgacgtccaggtcctctcggtcttggagagatgtgatagaaataagtaagcctgtgggataaagtgtcctggatgccgtgcatggctgagggcttggggaagaagccagaacccaaggtaaggcaagggctacctgggaaggttttctagagcagtttgtggctgcatcttgtaggatcacccacatgtaattccagcacccactcacaccacaggagaggggcagggcaggtatgaaccacgggtagcatgcaccctgagctggtgggtatgaaatcatggccatggaggaatggagatcaagagcggtggagccgatcccctcttagggagtccagactcacatgggaaaaagcagaggagctcagattaaccttagatgcccttggtttgagagccatgtgatggggttcccgttgctgagatatgtgagagtctgaggtgcacagtatgacagaacaggccggttcaaatacccagggtccactccctctgcagtagaggctactggtccttgactccattgagactgtgaactcggcactaaatgccgaggtggaaggactgttcatctgcagatgccagaagcttccttccccccacccctgacaaccaagcttgtctccagatgatgacaaacgccctgtgggaggaggcggcaacatcgccctcctttgaaaatcattgctccgtggggatttctgtaaaagccacagccaacatccacaaagaccagcgctgacagtgaggagagaaatcttacatccccatggcgccttcttgggagacaaccgcgcttgcagcccttagatcatgggagaaatactgtctatctcttcctgctgtcagcatcccacaggggcggcggggtacgggaggggatggaggaggggaagggagacggggagggggttgagaaagagaggtggggaaaagagaaggagacagggaggagggggatccatgtgcataggatctggaaagcagggcggaagtgtaaatccactggtaccaagttgaaagcgggcgagaactgaagccaagcagcttcctgcagccacactgccccttgccgaccgcggcgggctgctttgccctcagccttgcggttaggttctgtcctgggaggaagtcggagggacgatgagatgagccatagtattttctccacacttgcagaaggtccacacttcctgcataaccctctgtcaagggccagatggagatggcgctccctggtgcttggtcctaggaactgcatgctctgtgtggcttccaggactcatatgacactttgtaacaattttttccttaacagtttcagtaagaaatgtcccctatagactcctgggttcaacaattcctcaactgatagaaggtgctatttgggaagctgtggaaactgagcggtgagatctaggtggaggaagtagcttactggaggtggatccttggtgtatattaccctcggccattgcctatcactctctctgcttcttgattgaccatgaagtgtgcccctgtcttcagggatcacacagcctctgcctcgaggccctggtcaagtacatacagccaagtgaactgaactctttataaaccaagatgcacccttctttttcatttcttctctggggggtggggacggggagagcattatcagagtggccagaaagctaataagtacataattcctttagtaaaccattcccaaactatcccactttaggatctaaagtgtatttcaggagaacatatgccttgcatgcacacggcacaggatcctcaatgcagccatgaaacccatcattcctgtgtaggcatgccttatggctgtcccactgcaccctgatcaaaacacaaacatggcccaccaaagccctgcaggtgaaatggatcagagaaagtt

SEQ ID NO: 420 - DNA, 2950 bp, Mus musculus
gtacagtgaagcacagggagttcagccacacggactgagcgctgctggggcaagcgctgtggtgtgcggaaggcttcacttgctccatctccctcaggtttagaatgtttccgtcatggaaaggtagcacggaactgttagacaagttctctctggcgcctgccgctcctggccatccctgtctaagggtctaccttgaaagaaacagaactggagcagttatcttactaggtactgactgtagcggatccataagtctggaaccaggcagttctccaccagggcacgctcaaagatcaactgaatacgggcaggatccccgattttcatctcgaagtcgatgtaagcttggtattccgccagccgaggggcctctgcctgcagctgcagcacaggaagtcacacttgttaaatttaagtgtttgacagtttcagacagcacaaaacatcttcaaacaagtgagcctgggcaagagcagctaacccatgagagccaccagggcttcttgctcagaactgcccaccacaggatagatctgtgacctgggagcactgggagactcagtcaccagcatccagtccttgttctacaacctcccgagcacacagggatgactgaactgtggcctgcccacacccactgctccccatctagacagggctgtggggaaggcctcgctcaggcatcagtgctagaacacagctgcaggctaaggagggccggccgggctgacacaccatatagcccattaacctcttcagccccactctgctgacagccagagtggcacagacgactttgtgcacataagtgcacacacaccatttacagagagagaagagcgcatggctcctgcacacagcagcaggctactttagtgccgtgtttcccatatgacaatgagttggtcatctagacgctgtgccactgaaggacaagagctgttccagtaacaccagggtggtggagtgggttcaaaacaggcccatcctgactctcctcgctgtgctcagaaagatactgaaagcagagtcaagatgcccaggaaggaccacagggctgcccgcacacctacaggatgagattgcaggatattacatcaaaccaatgggagattcaaagcagacactactgattccttccaagaagcaagtccatgacagacagctgagctatctatgacaatacacaagagacacgtgtactgtggtcaaaaacatcaccccagtgcaacctacagcctgaaaacagctgtcaacaggaaaagcagagacagggcctgccggatacaaaacaaggaagatttgctgccagagaatcccgggtgctgagacagtacacattaacttcaagccagattccagatagagagctgagattcaacaggaagaggcagaacaaagaaagcagcgctcacagaaaggctgccaacgtggaccaaccacgactgtctgaggtggtgctgacagccatgctggaggggcaaaccaaaatgcaagataattcaagaaaataagagcacaatgaggtgtgcggtaaatcctgcccacaaacatcactgttccacaaaacactgaagactaacactcctgatgtgagcaagcctgtggatgaaaaactcatgatgtgaaatgccacctacactctgtacctcagcaagcacaatagaaaataagtctttacagaaacagcttacatgttcaccaaaagccactgtctacttaaagcttccacgacagtgtgcgctcccgcggttagcacagcctcccaggtgagacagatctcccttacactgagcacagatctatgcaacagcaattgaacgtttaacagaactgcgtgtaggcctgacagaaacaaactgaaggcagcaaggtccctcagaaagactcagggaggagcggtcaactgactaccacagcacaagcagggaagcgggcaaagagccacgacacacactcatcaccatgtggttccacagagagccacggcacacactcatcactgtgtggttccacagagggccacggcacacactcagtcactgtgtggctggccctacactgcaacgagggacacacttgttataatcaggaccacactggctctccacacaggttcgtattgttactgcctgcctgttcccgctagatggagacccagacaaggaatctaaactaagatttcaagtcaatgaaccatcgccaacatagacagtagttcaaaagcaaaaagaaaccatcagaagccaggactcccaaaaagtacccagaaaaggaaaaggggggcagggggctttacaacttctaacgctgaaaaagcttcacagacaaaaagccccaagggccaacgcacatgagcagaggctgtcattagtaatcaaggaaaacacaaaactccaactcaacttggagcacaagctgaactcactgacgtcaacacgggactggcagctgagggcccagcactgctggcagggtgcaggcagcatggccctgtgaccagcgagttccttcttctaacacaggctagagaaacccctctgtgtgtacagacgacactgtgcccctgtgcacacactgctgcacatacagccacacagggtgacacacgggctgaacacttatgacacataagctaaatacgcacacatacaagcacacgaaaagaacgcagcctggatcaccatgccgaggtctacaagcaggaccaagcacgatgctaagggtccgtccacaggagcacagccatccaaggggcaagagggactgtcatgaagccatcaagtggccacctcgagaccagagaggagcagaagagactcccagggcactgcgtgctctctcctaacctgagggctggggacacggatgttcacgttgctctatgtactacatgttacacggcagagcaaaccttagagactgttctctgcggctacggctgcga

SEQ ID NO: 421 - DNA, 1675 bp, Mus musculus
ggagtaaaatagccatctaactcaaataagcagttccagttggcttgggtggggaatggtctttgctggttctcacctcagcaaggtagtgtcagtgttgtgcttgcttagagcgtggacccagggcactgtctgagcatcgtgagtcctctcttgccaggagttccaaacaaatctaactctatagcatggctgtgatatatattggaacaaagagctttggagctaggcagaaccgtgttcaaatcccacccccagcacttctgtactgtgtgacctccatcaagtagcatagcctctctgacatcttgtttgctcacctagagacgagtccccatcttgaaaatgaagaggatttgatgttttcatatacataattctctgcacaaaagcaggggctggaagccatgctatttgcttttcccagtcctccctcccgcccccatcatcttccttccagtttctggtattagtaagttgatgctctgctccattctctgacccccaagtgaagccaaggaggagtgtgaagaagcctggtcctttctctagggagagcatcatttgttgggctgacggaagcctggccttgtctcaccagccccagggagacggtgagcagagacctctgaaccaatctatcttagaaatggtcttttttttttttcttcagacagagggaggaaagggggaacatagcagaaagcatctagccagatgcctagcgaaatctgccccaaatcagccatcctttctaataacgaaggttgtcatgagtctcagctcaatcggaaatgacaggctgtgtaaatatttgctctgtaactgatttatagggtagggaacaacaaaaaataagattagtcactaatcatggggctgcaggaagagcaggaagcctggatgccaggccccagtgcctgcaaggcccaggccctaacccaggtctgcacgtactcagagagatggggatggaggtgtgggtgggtgctgtgtagggcatccacgttagggtacggacttgtggatctttctatagggtaaggtccaggcagcactgtttgtatccgagatcagcctctagctagacgcccagagaagactgtaagctggaatgttttttgtatttgacagctgactaatttccttttgggatgggtgcttttgagaaataggagcaagtgtgtgtgtgtgtgtgtgtgtgtgtgtgtggtcatctcttacaccgctgtaaggctgacagactgaggtagaaccaacatccaggtcaacacacccagctcttactgagttgctttctgagtgcatgaactgttgggagggcaaataatgggcattatcattccttctgcaagtgaattgtgtctgtagctcactgctcagcctctggcattccttggtgtggcagttcccactcccttgttctgaacttcctgcaggttcagctccacacactgccactcagagccaacacctcctgtcaaagctctaccctcagggtggatactggctttcacctccctgtagcatctaagtatgtgcacatgtgcatgcacacacacacacacacacacacacacacatgcacagcctccatgaacatgacacacagaaaacacaccctctccagtctcttctcatatctaggcattagctcggaggttcataaagaact

SEQ ID NO: 422 - DNA, 2200 bp, Mus musculus
ttgatctcttaggagatcaaagcaatgggaattacaagttcaaagtcagcttgggcagctcagtgaggtgctgtcccaaatccaaatatctaaaaggggctgaagatgtactttggttgtgaggctccagattcaatcctgagtctggagggagagggtggagaagaagggggagggggagggcaaaagaaagaaagagacatgaggaaggaaatacagttttcacctgggatcaataaaccctagcccatcagataaatcccatctgtcatttgtttgtataaataaagttttattgagacactgccacgctcattacaggccctcgacgggctgccttctcagtacatcaggagggttgaggggtggtaaggaaacatatggctcacagaagtgaaaactactgactctctagccccttgccgaaagcctaccagcctctgttattcatacccctataaaatgaacaaaagttaatttgggaaaatttagaatagtctgtgaaaaaggaagggaaacttgccgcttggaggcccaccctgctagaatgttctagtgagctctcttgtcctggtcatatatttgttaccacttgtacaatcctgttttatctttaacaaggtgacactgattctcccgtgtcattctgggctctttgtaggcaaggtcttaatggctatagagtgtcatattgatgtgaaattcagatctccctgctgtaaacatcatggtcacagatgccctggtgtgtgcatgccccagatgaccctctgctcagacagccagagaagataccctcctttccttttgtgcgtgtgcccaaagtctggggcatgctgggatgtgatgagattcgcaactctcatctccacccgcttgttctttcttcttgcctccctaatggctccatcccacttgacctgcattaggactttgcaaagagccggcgtggtgcatgtctgaaatcaaaggagcggtgtcttgccagcgggtactttgctgacctagatctctgggtcttttctctgccgctcacaaaccagctccatgagctgcacaagatgaactccaagttattaatggcagtcagagttactgcagtggtgcagggagctgtctgtgatctgcttaagtgtacaagcggggtaatgggcaggaaaactgcgaagggagctcactgaatagccccagcagctggagtcccgccttgcaacagaagtgggtgggctgcccttgggtggttaggcgaggagagggactcctgtatcccccacagacttctatcccacctcctaaggctatgccataaataactgatgaacatgtgtcacccatgacaactctgcccctcctgttttatctcttgcacagaggtaaattaactcagtcttcaggaccctcagctccctgtgatctgaggagaaacttgccccacaataggatggataggtggaatggctagatttccatcagagaaatatgaaggggacagggttttctaggctttgtcctacctgttctcagttttgtatgcagtcagtaatcgagctgctctgtgcccagggcactccattaaacagcatccttaagtgtagaaagcttctttaaacactgagtgcatcccatctccccatcatgagactatgcatttgaatggtacctaaacattcttaacacacaggtgattataccgtcaacacacagtgtggccctaataccctttgtgtgttcacacaactcaagacaaaccctacgcacaatgtgctgccacacatggacacgttcctctccagcacccgtgcttagaatacaactgtggctttcaagctttgcacatgtgatgcccacgcccacccgtgtctccccacccagggaagctcttccttcccgttgacacgtcttgattccatgggattggccaattaaactcccaacactcattgtctgagttgctattttattgttgtgaagagatgctgtgaccaaggcaactcttataaaggaaagcatttagttggcgctgccttacaggttcagaggtttagtccattatcatcatgggagcaggcatggtgctggagaagtgtctgagaatggcaggcagagggggagggggagggagggagggagagagggagaggaagagagagaaagagggagagagagagagagagagagagagagagagagagagagagag

SEQ ID NO: 423 - DNA, 6175 bp, Mus musculus
gctaacaattcattgcacttcttagatcaaaaaaaaaaaaaaaaaaaaaaaaagttcaaggtagccttggggccactgccagaagccaggctgggagaggtaggtggcttgcagagaaggcaaaaccctagcagtctttgtgcctcttttaggagaaatgatttagttacccaagagggatatgtggatatacatgtgtgcatgtatatgtaccaagaggtggcatggatacacacatgcatgtgtgtgcatatatatatatatatacacatactgtctcagaaactaaaggaggactggttaaagccctgagccactgaagcaccttctcctgacctccagactaaccgctcccaagcacgcagactccattcatcttcattgtcctagcggatggtggcagagatgtcatagctgtacttactgaagatctatgtgccccagggtctcagaagaagatgctgtgaagcaagcagtaggctcctgagcacaagtgccatgcaagggccctggttcccattgccagctctggatgaaggagagacatctgcacagccatggtcttagcagcactgggcacactggccaatatgtgtgctggttagctttaactgtctcaacttgatgcaacctaaagtcacatgggaaaagtctcagtgagggactgtcagtacaggttagcctgtgaacatgcctatggggagttgtcttgatggttatatgacatgggaaaatctaccctgaatgtgaaccatacccagtctgggacctggactcctctctccactcctgatggtagatatagcataatctgcttcctccttgaccatcctcagtgatgagctatgacctagaattgtaagcaggataaaccctccctcccctgcgttgctttttgtcagggagccacggccacagaaacaaaactagaacaacacagaaccagcctgagtcttctggtgaacgcacagggcattcttcagccatttaaagagagactcttgcattcacaatccaccagtgagcctgcagacactatgcccaaggaaggagacagacatggaagatgaatatgtttttacaggaaaaccttcaaaagtcccactcaaccaagcatggtgattcacatctgtaatcacagcacttgggagactgaggcaggaggatctggagtcccagcctagcctggattacacagagagacactctcaaaatgcacagtctggggtgtaactcagtggtacagcttacctagcatgcataaattggatctctgcactgaggcaaagaaggaaaaaattcacactcttagacaagtgatgtgagctggccagagaccagggatgggtgaggggtctggagagatgctggtctaacaagataaaatttcttagaactaaggtcaaggtatccattgttgtcatggtaactggctgatacatatttatgtgtgtgtgtgtgtgtgagagagagagagagaggggggagggggagatcatcactaagaacagtgtttattattagcccaagattagtatttaaagtactgcatatgctaataatcttgaattagtcactccagaatgtttatattcatcaaaatctattgtatacaataaataaatgcaagtttaaacctgcttattgaaaagaatcatctcagccggaccaggtggccaagggctataatcccagctatttaaggggctgaagcaggaaggttcctcggttatagaaggatttgaggggtagcctgggcaacttaggggtaccctacctccgagaactgggattgtacctcagttgtaggatgcttgcctgacctgcccaaggcccctcctcagtgatgatgacaacaaatcccttttgacacttggcttcctttgtggagtagagctgagatcacactgtggtgacaggagataccctccatgggcacaggcactgtttgtttatgtgctaccaagaaagacagacaacacccatggtatgctgcacggtgacttactgcaaggcacacatgccctgctctctgagatgctaaatatgagtgtgcatcttggagtctttgaaatggcatgaaaatgttgtcccgcctcctggcataggtgctggcttcatataaagccctcagcatgtgtgaaccctatctcacagatgaggatactgtggctcccctcaggtcatgacgtcatgaagctggctgtaaacaactggagagatgtgaggttattttgtatcttttgctctctagcagcatcttctttcagagaaaagctgggagaagttttgtgtgtgtgtgtgtgtgtgtgtgtgtgtgtgtgtgtgtgtgtgtgtgttgacatgtggctgtgtaagtgggtaggtttgtccttcccaccctgcatctcagtatctggtcctgtaaaatgggaagaggacccagacagacctcgcaggattcatggaggtcacactgatcccaagtgtgcagactcacatcttctctcgcccatcctcacatccccactgtcccagaagtgtttgtaagggccccagggtcagcctcattccaggctctgagccagccggttccatagacatttgagctgactgggttttctcccctaggccatcagagagctcaacattggtgggagctctccatcttgttcgttgtttgttttgttttgttttgttttgagacaagggctctcatagccaacaagctcagaagcctgcctgtctctgtctccactatgctgggattacacagtgtaggttctggggatcaaacttgagcccaggtttttacagggcaagcattttacccccttgccatctccccaggtcttctcacatactttttaagttttttttttttttaatcaaatgaagacccacaggcaaaagtgtccatctcatcagggcagaatagggtagctctgttctcagctctcagatacaaacatgcagcttttccttccaaagcagctcttctgatacacagacaggtatatgcagagagacagacagatacaaagacacacagacagacagacacactcagaggcacacataaatacacagagacactggcaccgctcttccggcttccagcacacaggccaagagtggtctcttccaacagtctcaggaaactccttccacacggtgagcttcgccccgctgtctgctgtcatgtgttctattcattttatacagccatatgaccatgtgttgtcgggtggctccttcatcgagtccctagtttctgttgatgaacacagactgtgtcttagcttccgctgctgtaataaagtgtaatggaccaagcagcttataaagaaaagaaactttgtcatctgttggaagggtgacgtctgagacccagaggccagctcgctccagctttggcaaggactcagagtgttgcaggcagccaccttcacactgtgtcctcccatggtgtcaggtcactggttgaattctctggagcaactttcctaaggctccccctcaccatctctgtaggttcacacccctcccggccatcacactgggagtcaaagatatcggcgcaggaactgaagtctacagttatttaaggctcttacagattacttccaggctgggacaatggctaccctgtaggttcttctttcttccatccatttaaacccctaacactagataagagagatagaggggaaagggggtgccattatcattacttcctgctgattcggagcatcgagttccttggggcaagtttgatttttgccatcaggatatctaatttttttgtttgtttgtttcttctttgtgcatgactatttaacaaacgacaacaaaccgccaccaaccagttgggaccctagcatttatataacatctgaaaagtccccaggattccaaatgtcacacaattgtaggaactatctggagctggcaaaatcacgctccttctagaacaagaggcatatcagtcagctgctatggacagtctgaagcagccccatatcccacacatgggatgaaaagaaaaacatatttccgtaatatttctgtgtgtttgtttgtttgttttttaaagaaacggagattctcatgacatgaaagctattagaatttttattatgttgtagtttgtatctgagggtaaatgtgggtgtacctgtctgctaggcatgtttccaggggaggaactgttggccatgggctatctgcatatttggcattcatagatgagtcaaatcatggctgtaccagtgtccactctgacgagcatccccagataacttagcatagtgagacaggaagcagccactgtcagtggtggccgagaaggggacttcacgcggtcatcctgaaccatagattctgggagtcttggagcctggtgcaattattctctcatctgtgtgcaggagggagggctctataatgagtgtaggtggccgctcgagaacgaggtatccaggggagggaatccacccacggtcggtcttccatctctgatacttaaatgtcaacagagccaaattggctgctcagccagcccttcctccacctctgctgctaaggctcagcaaacttgccgctgtgcccgccaagaggggacacagccttgagtcatctcagaccacttcctgctcatgcactgggtgaccttgaacaggtgattcagccagcctgtgagtcagctgctcttggaacctcaccctgggggcaggtgaagagacaagtcctcgaccaagatcatggatatggagtggatgggtggatggatggacagacaagacagatggacagggtagagagacagggcagaagggatacacaggtaaacatgtcatttctccttttgcacctgtgtgatcactattttatcgatcataaagaccttgaggacctactgtgtgttgtgcagggaacagtgcctacattttgacacacctactcctggtggtgcaggaagtcagtctctctctctctctctctctctctttctctctctctctctctctctctctctctctctctctctcacacacacacacacacacacacacacacacacacacacaactttatgatgcaaaagccaacttatttgtcaggagtacccagggttatgcagcactcatgtgacagatcagaagcctaatcccatagagtctgaattttgtcccctaaccagtgagctggactttccatcagatggcagacagcaggcaggactctatctcatccagtccttctagtaatctacaaagcaggtttgttctgacagataaggaagctacagcccagaggcactggctaacccatgccaaggctttacagaaagcaagatccaggactggggtttgaactgggattctctctgatagctaacactctcacttctacctgaataacacaaataatcccaggcaggtccagtgtgcagcaaaggctgaactgacaccaacggagcccagagcactttagcaataaagctgtaaatgaaaagaaatgcattcaagctgttaaccttatagagatggaaaattaattatcataataatggcttccacacttctatccaatgctggcttctggaggctctactggagacagaattcactcttgtgtttatttattcactcatccctttggtggctccctgcagcacctggtctgtgtatgtcaggagtcaggctcactgggaaggatgagaaggagaagcagacaagatgcagagtgaaaaggtgttgctaccacacaatgtcctttcccagcctgtcattcattctaaactaccagtccctgaaacaaactcaatgaggctctagacgggcttgtataccctccgtctagacgggtgtccaattgagcgccattatccctacagacacgcccttccccaccccatgaaaggactgtgccatttgccaatgacactcagcacacagcagccacagctttgctgcttctgtccctacattgggactcccagctgggacacatggcagacagtgcaatctgagtggtgtgagggacctaaagttattggtgtatgacagctttcccttgagatgggaaacacacaggcctgtaatcccagcagctgagaggctgaagcaggaggaccatgagtttgaggccaacccgagctgtatagtgacagtctgtctccaaaagggctaag

SEQ ID NO: 424 - DNA, 2125 bp, Mus musculus
cttgataactgttatggtctgacagtctaaagtggcttgctgcagtgctaggctctggctgtggtcgttggagaaggcctctccgtttctatttacccatccattccttgtcatgctggaaagcacgaggcttgcgtgaggtagcaggtagtgcttaggctgccttgagttgttctctggtctctgtgctgaaagtagggagactaacatggtttgtggatcactatgctgaggttagtaatagagaaatgcttatagcacagtttccacttgattttgttttatgcctctctagttggaaatgaggacttaatctacttggctatgagtagaattagcagctaaggtttctacaactggtctcaagtatgggaaccataagggacacacagatacgcaggacacatcgacaagctcccgtagtgcaatctctggcactcactgtagactcttttctgactgagctgatgccccaatgctacctgaagagattgccttggatccactacagctgtcagtgttcagtgatttgctttagactttcccacaagttctgggccacataccctcttacaaactcagtgttggcgaatgcatcgtctgtgtgattgggtcttgttttgaccctggcagtgagttcaaccaacgcacattacccttgaggcccatctagggctgagctaaaggccttctgtgctgcccacatgacgatgcagctgtctgagctgttaaggtagtgggactgagtgggaaggctgctagggcctgtggtgacagagcaccttccagtctagagttgatcacacagcacaactgacttgactgaaaaaggaatacaagggattaagacaagtattcttgtgtgcgtgctgtagaaaaggcaaagattagagccccagctgccggccagtagcctctttcttgtacatgcagaatatctcatttttggaagttacttttacttctcaattttctgggcttggggaggaggcaagatgcctttctgagttaaatatgaaaggcttttgtttgcctggcaggcttcctgacatagcagtgtcctggagggactaatctacaagtgcctgtctgagaattgaggcgtgaacctcggaaaggggccgtcttaacactaagatgactttctttttcacagttgatcttgaacttgtttaaatgcgagctattttggtgtttgctattcataaggaagtatgctattcacatggagatatatttagcctaaagcagacaaattcagatattctgtgctgagtttcaggtactgtatttttagcttgttttagaaagtagcctggtagatgtttataatgaaaagcaggcctgcagtggcatccttggacagcagcatgtctgtgtgagaagggcaaaggtgtttgatggtgcctatgtgtcagaagccgactctactgcattgaatatccttgtctgtcacatgttacagatgctaatgagtaccgcaggtgactgtctaaggtggctgttctcttccctgctttctcctggaaagccttgaactcactcagtttccacctttcaagtgctaagattgcagatgtgtaccacagctctgccactataaggaatcacatggaggttcagtgttgagaaaggtggtctcacagctttggctgtgtgagatgaggtcctgaacattttgtgtggacccgctgttttaaacagtgtgtgtctgggaagccacagcttgtcctgatcaggagctggtcgaactccttacaggcatggtgcttgtagaactaataaggctgtttgatcagcagggattatggctccacattcatgctgtgtgccataacgaatgctgctttttcacatagtttattggtaggatcatttttatttgtacttgctgtacctaattttacagtagctgtaaactaggaatagataatggccctgacaccagacagtgatgagatatttacagttagtgtcttaggtgccaggtatttgatcaatcttgagtagaaagtagttttaccttgactttttttccgtcttactttgaatggcttataggaaatagtcgaggttctgctgctttgcctgtacctctggttttgatagatttagtacatacaga

SEQ ID NO: 425 - DNA, 2750 bp, Mus musculus
tgtcttaatgatctgatgttgatggggcaaggctacatctttatcaatattctaactgctaacttcctttaccagggtaggcaacatctcacactctggatattaaccacagtggtacatggagatcacaaaacaggtactttcacatacctttggatgcttatgcttagattattggatgtggtaaattcattatatagccagaatcaaacccctcccaccccattaatccattctataagcgcgtgtctacatactggctcctgtgaattttgcatgttgtatgtatttctaagcatggccctgtgtgtcatacacatctatagcccttgcctcctgccaaagcctctctcagaacccctccagccagatggctctgctgggctgttgcagtgggggagctttaaataaagaaatccaaccagacaccatgggaaagggtcctagaggttggccaataatgaagaggtggatttccctcacgaaaagacaaaggtgccatctccttaaaacacttaattcaatttgaagggagaagtaattacctcctccagccatcatgttgaaatgaccatagggaggaaaatgggcttcaccctcgttaacttcatgggtcatagccaagagttacattagcctgagagctttctccaggggcacagttcctctagatcaaagtatggactgagggctctgagtatggcactcctatggctgactctgtgagagttagatgagactcttctgctcttgcgatggtgtggtagtaagcaaaggtgtgtagctggaagcaaggcagtgcaggactgtggcatccagaaatgattttctaaggtctcccagatacaaggtcatgcagtgcctgatggcacttctgccattggcctggtcttacaacatcaaacaactatatatatgctctgtctaggagaccccaatatgggcagctattcctttgaggccacagacaatagataatccaactacaaatgcagacctccacagtaggaaagagccatgccaaatgctccaccatgctgatgaaaggctattatactgttgggataccattgtgtctctctccagagaatgctgtgttctgctggcatatgggaaatatcattttatatttctagatactgggaagcaagcattcctttccaaaggtagggaggatctgggaggaattgaaagaagggaaactatgaagggaatatattgtctgaaaaaaatttttttgaaagaaaacagaaagtttgagagtgatcaacagtcatttggctccagggaaagcagccaacaaaaccccccaagaaatctaaacaaatcttgtattggtttgaaggaagctattttgcggcagctggtgtgctctgttttacacctaccaaatctgaaaataatgaagaagttgatgtaaataaatgctcaaagcagtgcagcgacgacagctgggtgcttgatgaaagccgtaggcatgcagccttcttcacctgtgcgttcctggtgcacagcacagacgccgtgcctcctcagagtcttctgaacaaaggataggcagacagcgagatgtgtaaagaaatcatggcgtacatggtgggactgttaaaggcagcctgtttaaccccagagatccagcagataactctgcaagggacactaggaagtttgtcacatgttcccagacagtaggctcctgacatgaggccccagctccatagttctgtgaccatcagtcatgtagggcaatgctccaagttcctggtattctgtctggactctaccccacagttacctggcaatagccaagtaggcccggcccactataaaaggggctgtttgccccctcctctctctcttactctcttgctcctactctcttactcttgcctttttcttttgccctcttgctccccatctctccacattcccttccaccctctctccacataatgtgggttgagaaaccctctgtgtgtgggggagggggggctcgaacctttgttttacatttaatccatgccttcccacagtatcaggtaacccttcagagtttcagttgagtccaccataaggcttcagagacatcttggatggggtctgcccattagtgttcaacattttgagctggtgtcatccagtacttttctgtccttgtttttctcattatccaaagtcctataggtggtatgtatgtagtctcagggtttttattgtgaggatgaaacaccatgaccaaaagcaacttgagtaggaaagggtttatttgggttacatatttcactaaggaaagtcagggcaggaactcaaagtgggcaggaacctagaggcaggagctgatgcagaggccatggaggggtgctacttactgttttgctcctcctgacttgctcatcctgctttcttatagtagtcgggaccaccagcccagggagggccacactcacaatgggttgggccctcccacactaatctctagttaacagactgcgctacaggctgtttttacccagcctgttcttgtgtgggcaacttctaaattgacatttcctcctctccaaagaccttaacttgtgtcaagttgacataaaaacaagttggcacacatgccttatgatcaaagtaagagagcatcacttaagaaccaattctatacatttgacccatagacatttagctaagtgtctaagggggactgtaccaaatgctttccactggggtaaataccaaagactaggattcacagagag

SEQ ID NO: 426 - DNA, 2125 bp, Mus musculus
tagttttccatgttttgcaagcattactacttagaaatcttttatgatggcaacaattgttgtgtgccagggaatcccaatatagagcttcctccacttccccacagcttgtaacaggtctttccttaaggtcacacacatctcttatagtaatctgcttaaatagactagctaaattgaggccctatctcagtgagagatctacctccatgaacacagtggagacaatacagttgagggagaccctgagaaaccacatgcatacaccacgcacacacatgcacctgcacacctccaaacataaacacacgcactcacgcatgcacgcacaccacatacaaaaatcacaaaggaaataagaagactatgtttgcaaacacagagttgacctctggaaagctacataagaaagatttgagaagatgaatatctagagcgggagggaggcttaattctcaccctcttgttttgtgtggtatttgcaggttttctttgttaccatttgagtgtgctacatttaaaactgtctgaaatgtcaaaagaaatgctaaataattaccatacccaaatatatctgctagagccacgcacagtaaatgtatgctatatgcttacatgtgatttatggtatatatttatataaatatagtttttataagtacacaatacatattaggaagatatatttagcagaatatatttagcaatctgtgacctactttgcagagaccaggatttttttgttctgttacggttagaaatgactattagctacgggagagatgggctttggcccttgtacttttccaccgttacataagcaaatcaaacctccaaactgctgcgtgtgtctaaagactcctgagtgatgcgcaaggtttgtcttccccgtctactctacttccctccccactctctttttcttttaagaaaacccatcatgccttttgtcaaaagaaactgaggccaatatcgaccgggcaaccaagctgacagtggagtcatgtctctcctaaaagccacaggaaatcacatcactaactggaaaggaaatatcctgcagcccatgctctgtgtcttcgtctttggttctgcctctagtcttctcggttcaaagtatctggagctaaacccagttaatgtcctccgggccctcctgcatccctggggctcccacttgctaatgaaagggattcccccttccagatttggatgtgacttctccctttacctcttctagggagttgctgttccgctgagatgccaaagctatcatgagtggggaggaagtggacccaagggcctagggaccacaggttgagatcgactctctctcataccctggacttggtgtatacacactgaggaaacggaatggtgtcattcggtgcagtttctccatcatgggaatggaatgcttatgatagggagttatggaagagaaaggttggggctggagagatgactcagcggttaagagcactgactgttcttccaaaggtcatgagttcaattcccagcaactatataatggctcacaaccatctgtaaagggatctgacgccctcttctggggtgtctggaaacagctatggtgtactcatatacataaaatcttaaaagaagtggaggaggaggaggaagagaaagaagaggaggaagaagaggagggagaggcagaagaggaggaggaggaggaagaagaggaggaggaagaaggaggaggaagaaggagggaggagaaggaggaagaggaagaagaggaagaggaggagggagaggagggagaaggaggaggaaaaggaggaggaagaagaggaggagggaaaagaaaggttattttgttttggttcttggtcagctggctctgttcctctgggtttgagatgaagaaggatcttgagacggcaggtcatgtggtatagaaagtggatagctttctggttgccaggaagcagaaagacataggaatccacccttcaaggatggattagctgcagacaagattcacccttcaaggatacacccccattcgtgacttcctccctcttggccctgtctccacaagtttccactgccactcagaaacgccttaaaattatccttggctccactccgtgacttg

SEQ ID NO: 427 - DNA, 1625 bp, Mus musculus
aatacatgtataaagcaaagcgcagtagcaaatgactgtgatcccagcattgagttgacagagacagttggagctttgaggctcagtagccaggtgacagaaaacacttggcaacttccaagctaatgagaaaacctgattctagatagatagatgaatggatagatagatagatagatagatagatagatagattgattgatagattgatagattgacagaaacgatgtgtgttacatacacacatatatatacacgtttgtaaatgtctgaagacatccttaagtgcctgccattcctctgatactcacaaccttgggttttgttttgtttaaacaagagcctatttttgccaacatgaatctttactctttacataaaaatctttgacagtcactgtctgaggaactgggggacagcattagttaaccccactgctgctgggactacaaaaaggaagtcttaggagtggctcctctgtgattgccacttcgtgatggggctttgtcttgctgaactccaggttctttgtagacaccagaacgtagcgcttacagctctctcccagggcagtgctcgatggcccccacggcaggccacttagcagaacccttgctggaatgctgcgatttgccagctgccagccgttctacagcccacacatttaagtaaagatttcacagccattaccagtctcagtaatgacacctgctgaaagctaagtgctctgccagctgtaaaccacaaagaaaacgcgggcaggggaaagatggacgctgtgataaacaaggagggacagcctcgattttaattgattgagccaagtctccacccaaatgcagccatctcctctcctaagtccctttgaggttctgtaggcagggccagtcttatcctcaggtgttgatgccaggcaggtgacatggttctctaggataaatgagtataaaagaaagcccggtagaccagcttcagggtttcccctgtaattcttccttctgtgtttagagtcccagggcaaagtttaaggccaccacaccatgcagaaaagaccccacttcagagtgcaggggcaggccagtgttctgtgtggcgaccatggctgtggttcccagtgagatccagggccagccacatgaaatagttagggccagtcttcaaaggactcaaggatttgtgattgccctacgtccttcagcacttactggccaaggtgtgagcattagcagggattaatccacctttggtattgtattaacaaatggtccaaaggatttcacatgtcttaatcacgctagttattttctgttactgtggtacacatcatgaccaaaaaaaaaaaaaaaaaaaaaaacaacttggggaggaaagaatttatttcaacatatagcttgtactcgtcaaggcaggaactcgagacagaaacctggaggtaggaactaaagctggcttgctcagtttgttttcttatacaacccactaccatcttcctagggtgtggcacctcccacagtggactgggcccacccacatccactcttcatcaagaaaatgccccatggggttacctacatgccaatctgatggaagcaagatctcagttaaagttccttcttcccagatga

SEQ ID NO: 428 - DNA, 3125 bp, Mus musculus
ttccttaggacacaatagattcctcctcctttatgtttttagagccatgagtgagtaatgtcctgtctagaaagtaccaccctgagctctgaagtagcctgtgtctgcaactctgaagaggcccctcccatcaagggctttaaagcctggattcaggaccaaggacagttcctaactaggcgaaggttccttctgccctctatggcactgttataaaagtcagctttatgggaccggaatgtcctgatgtattcagaattttcaagtatatgagaacctcccctattcacctctcactgagccagaagccagagagatcctaacaaagcagaaatttttttcctatgttcataagtacaaacgatgagtagaacagccactaaaatatcgactgcaaagtatccctattaataaattgtttttctgtggctgcagataggtgagccaccatgtagtagcagaaattgaacctgagttctcttggggagcagccagtccttaatcactgagctgtctctccagcccctgggcctctgggtcttaattctttacttgcgaaaaaaaatagccatcttccttgttgggttgatggttgaccaaaccagaattagattcccagttcctactgggagcggggaggggggggagtgtacagattccggcattgagctgagttggaagaatgggtctcgcctataaaccacctgatggtacttgccttacactgatggctgatgtattccgtttggaattctattgagtcaaaacgtctgtatttggagtctgggaaaaatgaaggcagggaatggcccaggtgctatcaacaagaatatcacactataggaatggagggcctgcaggggctctggggtggggtgatgttcttgctctattagctgtgcctgaggggcacatccatcatgcccctcagaggcctcagcaaggtggggaccaaccactgtgagatcagcaactccagattccaggctgcccacaccacagcagcttcctgtgctggaagccaaggctggcagctgagggactcccaggtgaaactaccttggcccttgggcacaatgttgcaggggaaagaaaatccagctagaaatgtcagcatgactctccaaggaagcagctcactgcaggcacatgcagagtcagatgttataaaggccttattccttaacatatttgtattgccaatttttaaattagcttgtgaaaaatcctttttactttccattgcgttctctctctctctctctctctctctctctctctctctctctctctctctctctgtgtgtgtgtgtgtgtgtgtgtgtgtgtgtgtgtgtgtgtgtgtgtgttatgtctttctcataagagcggcctatgaaagaatagtagaatcatctgtggtcctcagggatgagcccagctctcctctgcaggtgcttggccaccctgcccagagcaaatacctctctctcctctggttcagttttctagctctcttttccttaaagccatatatgtaactgaacgtcatataagcacacagcctcattgccaatgtgagtgaggaccatatagagatccaaagccagagggttgcaggggtgaggttcagtgactgagagctgacctagcatgcagaagtttctggatcccatcaccaggacaacattgctcttctcccgctaaaccatcagcctctgatcctagcacttgcaaagtaaaaacagaaaaacagcctggaacacatagcaagaatctgtccttttagaaaaataattaattaattaaaattagaaactgcctgcgtggatttcatgtggtctccagctcttcttgataaaccatacatggccgcccactctctaccagaattatttctgttcccatcagtacaccaggagctcctacaatcttcagccttcgtatttaaatccagatccttaataccacagggccttagatggtagaaccagtgggaaccagcaggaaccagagagaaccaaggaaacctttccttaagacacaataggtcgtcatcgtcatccctgtcccccaccccccaccccccaccccacccgggttcctttcaaaccccaggtatccctcttcccagacaccacctccaggctgagggtgggatattagctccgtgtctgccacacccataacatgaactgcctcagccccagggtccatgcccaccctattggaccttaggaactctgcttcctccaactcaatcaagatcattccaggagaccctgaccatcagcctgaggacccagcaagtgttcttaaccagccccctacaaatgcattttaacagcttccccagtaaccggagtatccacatttgtaaaattctaagttttgggccaattagatggctcagtgggtaaaggtgcctgataccccgagtttgatccctggaaaccacagagtgggaaaaaagagaactgacttttctcagttgttctctgatttccacactatgcaggcatgcataaataaataaataaataaataaataaataaaatttagaaaactgagcttcttttcaatgaaaggagattttttcaggctagtgattgtcattggaagccagaagcactacagtatttaatatttcatctctgacatctgtggtcctgggacacctccatttcttctctattgaagatggaagtgtaatataaatcacctacatttcttttaatttcaatagcctgcataatactgttcaccaagacacaatcgaattaggagtgtcgtgcttggcggaggcaggatggaccagagggcccggatcagcctggctcggctcatcagaatcacaaagcttatattttaatatgagttgctggcagaaccgagatctgaaaacagattgatcagaaataaaaagaggctatgagtcctggaaagagacctcgggtcttcagggggacttttaatgtatatctgcccaggacagcctatacagtgatgggatctgctttatctcctcgaagattaaacattgattccagaaccaagtggcagagagaaagaaatcatttattctgagtcactgacaaggaggaggggtggcgcattttcaatgacttaaaaactgtcactgcct

SEQ ID NO: 429 - DNA, 2900 bp, Mus musculus
tcctgccagtgccctaccatcatggtcttttgtagctgccccatctctgactccgatttcttttcttcttcttcttcttcttcttcttcttcttcttcttcttcttcttcttcttcttcttcttcttcttcttcttcttcttctttttaatttcatcctcagagcccaactggggtttcaaaggaattaaggaggcttgttgactgtccagagatgcaatttatttggatgtgtctttctggtctctgctcccatagagcatctgtggaccctggggcatttcttgtgcttgagtgagaactgaggcagggccctgcttcctcccaaagactggtcatgatcaagccccacacaacctgaatctgaggatgcttactctcctttgctcccgcagtgctctcacggtcctgagacaaagtttcatcaacccacagaacaagacttaaaaggatgctgtactggacgaagtgttcgcatcccagacgtagcagcacagtccttgggacaggaggaaagagccctagctggacaccaaggccagtggacctgggtgggacgatctgtagcacaagtgatgcatgtttccatagaaacgacaccaaatctagccaagtgcagaatgtaaaatatttgcttaattttaatgtgagtagattccaagctgtttattcccagtgctgcttaaatgcgtgcagtagcgactgtctctttctgaagcctctcttttaatcttgcctgttttaattggcttttccagtggactgattctttgtgaacaaaggggggaaaaacagaaaacaatacaaaacagagccaaaaacacaaacagctcaagggcaaatggaggggaatagatgtctggacccaatatccccgctcttaggcaccagcaagctctaggctctgccacagcacactctctgctggctggactggccacaggagatcagccctttagcctgggtgtctgggacagagtagccataggagggagggacaggaggggccaagtgatgtttgtattatcggatagcaactaaagggtaaaaatcagatagttccctgagatgtcagatagctcttgggtcctgatatagtgaggaacttctgtcatcaggtgcaccttgatgctactagaccagtgtctctgtgacctgcaatgggaccctctttcccttcctggttagcagaagctggtatctgtttcattgcgatacaggacatgtcctattggggaagaatatgaagagagaagagacactagcaaaatgctggttaagaaagacctgggtcaagaatgatctgtcctgtgtggctgggaggaggagcctagatggggagggtggggggaagggctcccggaatagagcctggagaaagagctaaatgctgaacgaggaaatgggctactgaggcatcctggactaattagggatatattgacaagcagagcaagggtctaacctgtccccaccatcttcaaggtcaggctgacctctgaattttgtgggctggacacatgcggctatctttggcagtaccttaatttgttttttcccctcaaatcaactcagcttttacttaataaaggaataaacagccacggctactcaggactcactgcccaaggtccggagcccctcctgctgtccacaatgtaagatgactgggagacagggtcaaagagagagcagaagaggctggccttgcccccttccacgcccaaataaggcagagctgagattatgggagtccacaaagagaaacaagaactccctccccagcctgtgtcccatgcccccttagccaccccagtggaggtgttttcctcctcctgcttcacacaactccccagccacctgcagtgacctaaaatctagaccagtgtcccccctcctccccaaacagggcaatttgtaaacagcataggatgcctcaatcctggaagtgtgaacatcttgtaacagcggcatgtttgtgggctggaagagatctcaagagagggtgctagctgttccaagcccacctggagatagagccatcaggttaagcagcagatccctgggaaccactggctcaagggaccccaggacggaacacgcgcgcgcgtgcgtgcgtgcgtgcatgtgtatgtgtgtctcccactgccgcacatgagcctacatgcttacaagcatgcgtgagtgggagggccctgtgcacactgtaaagtcctgtcctgtccactgtttctctagaactctctgtagactcctagaaaccaggtcttctgtcccagcaccccatgggtacttaggctgctccagaattcaggtctgcagtgtctgcacccacagcctcctcccccaccaccgctccaccttccattaaaaaaaagtagagcaactgcatatttcattttagaaatgaatattcattaaaatcttgtaatacggatttatagccgcatttcaggggaattaaaggaataaataacctgtatgtctttgagtgttgtcctgaggcgcaaatgtcaccagcttggattcggggctgcctcctgcattatttaaatttgtctgactcacttgcttaggaaatacccttaatgttaacggttccggcatttattattattattatttcatgataaaaatctttgcgtaagatgcatgcacttaatgctctcctaaatattcgagaaccacatggcaatcacagtgtctgatgactcggcaatactgtatggaacacaggtcacgtctcttgagggactgatagccaaccagcatttcttccttgagaatggtggtggcagggctgagcccccatgagatcatacccagatgttgggcacagaggtatgggacgtggggactccctgaaaagccagaaagaggtccaggtgcaatggcccctcc

SEQ ID NO: 430 - DNA, 2325 bp, Mus musculus
tgccaattcataatagcattttaactaatttaaaaaattacccattattggtcacattcagcataaaccaattgtttctaggccatactaacgctaaaatggcctggtacattccctcctgtgtacacataattgtatacttagtgtgacagctactctaggttgtccttaactacatatggcattaactacaacctgaaatgactgggcacatctgtgagagatttttcttttcttaattaaatcgtttgatgtgggaagactccacttctagtctggacctatgaggttagaagatacacctgtaatccacatcttttgggacgtgaagctcctcctttcacctgggccacaccttctgcgtgcagcctatatacagggcacagaagaaggtggttctctgttctcctgcttgctcttgctctccatagctttccttcactggctttagagcctacttcaggattttgatgtcactgaagatcagctgagacatccagtcctgtggactgaataactatgggattcttggaccttctgttgatagatagccattgttgaattagatggaccacagcctctatgtcctatcatctatttgtctgtctgtctatctagatacagatatataagatatagatatataaattaatatagatagatacagatagatgatggatagatgacaaataggtagatgaatagacagatagatagatagattctataacttctattctacagaatcctaatacacttagtttcttgaaataattcacttagatccagcgtcttggtctacaggaagctgtgttgttcacctcaacaaggcatttgtgaaagtgtcttcagtggctcagtacaacgctgctctgtgtgtggagacgatcatgcagccttatttattgactcatcttaattggcatttctaaccgagagaaagcctgtggcggggagtttacaatcccgaacatctcagatgtcaaacaaaggcagtttcctatgtaatttttaccatcattaagcagcagaaatctctttctggcccagaaacagaataagatggtgtttgcttcaaaatatttgcagatcgattcagttataataaaccatcgcatactctgcctgcaaacttaaggtaggaatataaaatttttcttagaaaaaaacaaaagaccatattagtaacaaaggtgccaggaaagcaatataaattggctacagcaataaagggagtatttcggtccatgcgtaggatgtgtaagggaggctgggtgaggctttctacagaagcaactcaaacaaaacccagagagatttgttgggcttgctcttccaaccagggttggcttcagtcccagagatactacagcgatgcctctctgaactcacagtggcagagtggctgccacagtgccagctgccctgtatcacaacacaccatccccccaaggaaaggcagaaactgccttctagttgcttctacagaagtgttgtatatcacttctcagtcttttggctaagatcaagtgatgaagtgtcgtggtttgaatctgaggtgcccctcgaaggctttcctattgaaggcatgatcatgggggtgtgccttggaaggagatatctcttctctgaaccctccccttcatcctcctcttcctcattcccacctccccatctctctctctctctctctctctctctctctctctctctctctctcttccctccctgtgtgtgtgcctgcatgcatgtctatttgtttgcctctatccatttccccaagtcctcactcctctcctctcccccagttaacctcttttataccagatcagttgcatggcataatttcccaggtacaccttggcatgggccacactcgcttaccctgtgttctaagtattttggcacagcactaagaagctgattaaacaaaaacaaagatgtttcccctttctaccatcatcatgttagcccatattctgttgctgtcctaaaatccctgagactgggtagtttaaaaggaaagaagtttatttgggttctcagttgtggaggctgagaaatgtagaatcaaatagatacatctggggaggacctcaaactatctcaacttctgatggaaagcaggagaaagacacgcacatgtacaagagaaggtaccagatgcaacgttgctttgtgtcatggcaatcacatacccaaacttcaaaattatcaaagttgggctggcaacattgcttagtgggtaaccagtggctaaaggttgtcgtcagatttaacaacctgacttcaatccccaggacctataggaggcccagcttaaag

SEQ ID NO: 431 - DNA, 1925 bp, Mus musculus
gatgacaaatgtgcatcaccatgtgggtttatgcagtgtagatgatgcttcaggccaactgagccttggcccctctcagcatactttggaaacactatttatgcttccgtgcgtcttgggatgacctcagagggtttggaataaattactacaatggaacagactgccatacccaacacacatgggcctgtagtatcatgagaccctgagcctcctgggggaggagctgctcatagaccaagaaccaaaacatcccgtcattaaatcctctccaacctgaacagggccaggtgccaaagatcaggggtaaaatcccggccatggcatgagcacccattacagtggccaagctgaatcctggaatgtctggattccggctcttcaaggctgatggggccattcgaagtcagacagagagcgtaacatcgtgttacactgtagagggcctcgctaataggttagaggtggctaaggcttgctttagaccacgtgctttgtaactcccacctgccatgtgccatactcaaaatgtcctgctaaggcctgggactgctcagttagcagacagctttgcctagcacacagaaaaacctgggttctacccccagcagacaggagcgcgcgcacacacacacacacacacacacacacacacagagtgggggggggggagagatcctacccatggtattaggtattaggaatcatgcatctgccctggggactggaagaaaccccagcggtgcagcctgctgccacggaactggagacaaggatgcctgcaaccctttccccacccgtggtgcagtcactcacagtcttccagtgctctcttaactgcaacctgtctatactgcccctctcacacaaagctgccatggtttagatgtgagtagcgccccactggctcatgtatgacatgctggctccagcagctggcactgctgctttgagggcctttgagagccttaggaggctggagtagctagaggaactaggttactagaggctgggccttgggagcaaaatatccctgactgctttctttctgtctctgctcacatttttgagatctacttgctagagatgaggtcagtacccatagtgggcttccacgtgctacattcaatcctgtcatggaaggcttgctgcctagctcctagcagagctgatgggggaatgagaaggcctgagttccagggaacagcacagggaacatttaaaagccactctggctctgacactcttcatgtgatggctgtctcactgggtctgtagtcttacctcctcctgctccttcattcctcacaggtttggactccaagtttgtttgtttgttttacccagatattctgcttgctagatgcctatataaacattagcattgtgggagaacccaacatgtcccaagacacccaatccatctggggagcctggtaaaatgcagatctggggctcagagggtaaaggacctgctgcctgaatctgaacccgagttggatatcaagcactcacttaatcccgggcataatggtacaagttcatagtcccagtgctggaccggcggaaacaaatacatcctggaggctcattggttacccagcctagctgaattagcatcaaaccctagtgagagaccctgtgttaaaaagcaaggtggggggcctcagagatacggctcaatggttaaagtacttgctacgtaagtgtgagggcccgggatccatgtaaaacaaaatgcttgatgggtgtgtgggtccacttgtaattctcaccaggcagaggcaagggatcccaagagcaagatagccagtgaggctaccttattggtgaactctgggattgattgatcctgccttgatgaaaaaaggtagggcaacagaggatgattcagccttgggtaccaggcgcctgtgtgtacatgt

SEQ ID NO: 432 - DNA, 2150 bp, Mus musculus
ggaacctccattgagagaaaatgcctccatcagttggcctgtaggaaagtctatgaggagtattttctgggttaatgattgagtgagaggacccatcccactattggggatgccacttctgggcaggaggtcctgaggtgcataagaaagccggctgagcaagccagtaagcagcatctctccatgatctctgccactgttcctgccttgggttcttgtcctgatttccttcactgataaactgtaatctgttagtcaagtaaacctttcctccccaggttacttctggtcatggtgtttgatgacagcaatagagactaacttagacatttgatccacatatagacacctacacagagagacacactgtaagtctgcctgtccccgccctctactccacctctcattaccacagcaaaaaattactatccaaagacttcagtaggaaggggaagtgtctctctgatccagcactacagtgtttccagcccctgtccttgcctttctaattgcccatccgccccctgctccatttgaaagtgtgctgattacaggtagtttgtttgcttacaagatttctagaaagacacaggatgtgacaaaagaaaaggacatttgctgggctgtactcatgctgtcaaatagagacatgaataggaagacctgcatggaggctggacaaccagaaagcacacatatcccgagtggtccagagtctagtatcttcagtgtccccttaaggtctatgctgacaaaaactgttggaggtcaccctttgcacaacctgggacatggaaagaggatgccatgtagcccaggcctgctgctgcctgattccccaaagtatcaccgcaggaaagtcttcctctcaatacaccaccaccagtgcacccatctatgaagttgtcacacggtaagtgtgcacacacggagtgtgcactgcagtgtgagatgtgcctctcttacagagaccatgacctgcgctgccaacacagctgagaagacttcatccgattcctgtcgctctaagaaagccacaggcttacccttgtgtttggagattgggtaggtacatcaagtactttaattagtctgtctgggaaaatgaaactgattgaattaaatattaatcacatataaattgtggaactaaatcagctgggggagtcgccaggcgggaagggccatgcttaaatgcagattttttttagtctgtacaaaagacttcacaggcctcttcctcctgctctccgtcttctgccaagtaaattgatttcggagcaaaaacaagccttctattttccaagcacaacaacgacgcttaaccagaagtttccttcgcagaaatactgaatggaagaatccagttcctgcgcagtccttctaaatctttgcctctgattgggctcattaataaacatgctgattttgttacaaggagagacatatggtacaatccgctaacaggaagaagtattttgcattttattgtagaaaacaaacatgcaaacaggctctcacagatggttttcttagcttctaggaggggaaaaaaagcttaataatgcgtaagtctactttttctcaacaacaacaataacaacttgtagttctctggttggaattagactaagttccaaaacagggcctgagacatctcaaattcattttttcttatttaagagcagacagacaggcaggtaggcaggcaggcaggcagacacacatacacactcactcatggtgcttgtccatattcttgccccaatccctttcttttttctctattcagacatacttagtactttctaaggggggcagagataacagcactccacaactggaaagaagctaagttcttttacaaataaattttctggatgattgatgctcaccttttagggttatgaaaactagttttgatgatgggttttctttttattagaggtataacaactactacgactactactactactcttttggagtgtgtgtgtgtgtgtgtgtgtgtgtgtgtgtgtgtgtatgtgtgtgtgtatgtgtgtgtgtgtgtgtgtgtgtgtgtgtgtgtatgtgtgtgtgtgtgtagcacatcagatggaggccagaggaacacactgggtgtcctgctctatggcattctatcttat

SEQ ID NO: 433 - DNA, 2525 bp, Mus musculus
aaaggtttaatccaaaaccaattaaatctgtcactcaattcgggatgaggtagggagagcaccaagtagtaagtggtctcctcctcctcttcctcctcttcctcctcttcttcctcatcctcctcatcctcttcatatcatcccaacgaattttttaaaagatttattttttatctatgtgtatgtgtgtgtatagctgcgtgtgtatgtgcaccatgtgagtgcagtatctctagagaccaaaagaacaggtaacatccactgcagatggagttacaggtgattgtacactgtcccatgtgggtgctaggaacccaacttgggtcctcttcaagaacaataagcttataactgatgagccatctctccagctctgatttttttttttaatgacaagaatcaaccatgactaacagacctcccacacaccctattatagttgtactaacacaataatggcacagatggaaaagctcagaaaattgcattagaaaatctggaaggatccttaggaattatctacttagtgtttacctcaagtattttattatgacaaaaatccaaacacacagaaaaattgacaaacattttatagtgaatacccatatacccaccactaacattacatcataaacatattattgtatttgctttattatttgtctgtggcatcaagacaattaattattcacctcttttctaattgattttttcaaaaaataaaaaaatacaaaccttaagacccaattttgtctctctctctctctctccctccctccctccctccctccctccctccctccctccctccctccctccccctgtgtatgtctctctgtatgtatgtgtgtgttaagtgtgggtctgtatatggagattacaggatcacaggacaatctcaggtgtcagtccttgcttggcattttgagataagagtctcttgcttgtcactgtgtgtggcaggctaggtggcccacagattatgttaattctcctgtctccactggccatgttctagagatgagaataaaaaacccttgtggtcctgtgtccagcttgcatgggggcggtggatcttaactacagcaggtgctttatccattgatccattctgctgacaccccaccccaccccctgcctgtttgagatagtttccttatgtaactctggctgtcctggaacttgctatatagaccaagctggcctcaaactcacaaagatccagctgcttctgcctcctgagcactgggattaaaggcgtatatcgttatggcctctctcaggtctcttagttgaaagtgaagagtaataacccaaaagagaagctagagcagacccttgaccccgaatggctccctgtgtgctgctctgacacttaccagtgcgatcaacacctccatctgtacctcagagggagtgatgcgaggtcacagacgggatgaactggtaagacatcaggaacataaaatgggaatgaagaaaagcagatttcaccactagaatccatgatcaactggcaatgactcagtggagcagaactgagaaggatccccacgtcctcctgctctcaaaggcacaccttcatgatgagagaggacagtaaatacaagcacattcctgaaacaaaacatctgcagtgattctagctccctacggttggaaggaaaggtctgagagcctccgagctctgtggaaacaaggctggttttagcctttacactataagaattgttcaaggtgatgctttcaacccccacaattggccatggttgtctctgaaggaacacatcatatatctacctagcccaccaacattctctgcctcagtttccctctctgtaaaaaggtactccaggtgctcagaccactgtattttcccgtgagaaaacatgtactaataccgtcacagtgtctagcccgtgtgttcatccacacagaaccattggtgaggttctaggggactgtgatggtcaatactgtcaaccggagggaacctggtctttcccaggagacgcatcgctggacatgcctgagaaggggatttctacactagggtaactaaggagggaagaccccattaactgagtggcaccactcaacaggttaaagttctgaaactaaataaacaggagaaagcaagctgggcaccagcatccttctccccctgcttcctgactgtggatgccatgtgaccagctgcctcatgctcctgcagccatgcctccccaccatgacagactgtacccctcagtggtgaattcacaataaacctttccgtatttaaggtattttggttcagtagcaagaaaaataactaatatggcagcttttatgactaaactccaatacctttgcagacttacattggagcccttcctccgctcctgcaccagttccaaggcttgcaactcaggcatgctagagcacgccaccactccatgttccagtgcggagtggatgaatatgggggctggacactgtgatgctgtttgcatgttttctcacaggaaatcacagagctatgg

SEQ ID NO: 434 - DNA, 2200 bp, Mus musculus
cccctctctctgtctgttgccctctctctctgtgcactcccccctcaaaaaccaatcaatcaaacaaacaaacaaacaaaaaacctgatggggctagataaatagctcagtagaggaaccaggttcagttcctagctcccatgtcagactgtcctcacagccacctataactctagctctaagcaatccagtgagctcttctggctctatgggcaatgcactcatttgtacatacacacagaagtacacaggaaaataaataaaaataacaaataagacaacaatataagacaataatataatcttaataatattagctaattcattaccttttcctaagtccagagctggttccatgcccaaatgtccaaccatcatgattgggggtgtgggggttggaaggtgcacaaatgaagaccctaggcatttcattttctcttagatcagtctccatgattgccatcattgtgatggcctttgtttagcttgaggagtctgagtcaactgttcatgtaaatcagagatgctcaatggagacaaatatgtgaatataacctttattcttagatgcattaattgcttgcctgactcactaaattctaattaaaaccattctgccagatgattttattttatccctttcaacttgtaattaaagcatttactggctgaatatcccaatgaaatgaagggattcagcctagtgtttgtagaagataatggaatggagggccctgaggaagctacttgggtgttttggtttacctaattcaactccttgttgagcggagatgatttcagtggacaagttgacactgctttgaaacgcttaagtcagaccttggttcaagcagtctattctagcccaacctggtagcacacatttataatccagcctctaacagctactggagaagctgaggcagaatgatagcaaattcaaataagcaacttactgagaccctgtcacaaaatgaaatgtaaaaagaggaactagggatgtagttcattggcagactgcttgcctagaggcctctagtggggggctgggtgtgactcagcagaatagcgtctgcccagaatttcccagtgagaagctagcagcttggttcagaggtagagcagctggctagaatcccccagtgaggagctgggggcatggctcagtggtagagaacctgcctagaatcccccagggaggggctgggggcgtggctcagtggtaaagcacctgcctagaatcccccagggaggggctgggggcgtggctcagtggtagagctcctgcctagaatcccccagggaggggctgggggcatggctcagtggtagagctcctgcctagaatcccccagtgaggggctgggggtgtggctcagtggtagagaccctgcctggaatcccccagtgaggcgctggaggtgtggctatcacacttgcctactatgaaggaagaccatcttaccaagtctcctccccatccttcctctctcctttcctctactcattcctctctccgaagtctcactgtgtagtccagcctagccctaagcctttgatcttcccccagtctcctgagtgctggtagcttagatgtattctgtggacaccagacttccaggagttctgtggtggtcttggtattctgaggaatagttctggtaaactctggggtagttaccccccacccttgggaagctgagctctactgaaattatgagggatttctgtagggatatcccaatgatagtgtttaaatgcccacctaaatcaaagctaggcccatggctgtgtacactgcaagtgagctaaacccttgggaaatgaagaaactgaaaaggagtagagctagcaccatctacctccatatgcctgtgggcttattcccttaatcattaatattagggagccagattaggtcaagcaaagtatcggacccaggcaagggacttgtcaaaattgtcaatcacagaagtgatctcatttagaaataatttgatactatgctgtggagtttaaatgtcaattagggactcgagactcgagccccgggctaccttgccagcagagtcttgcccaacacccgcaagggtccacacaggactccccacgggaccctaagacctctggtgagtggatcacagtgcctgccccaatccaatcgcgcggaacttgagactgcggtacatagggaagcagg

SEQ ID NO: 435 - DNA, 3950 bp, Mus musculus
cactggatataatgagtgcacacttttaatctcaacagttaggagtcagagggaaacagatcgctatgagttcaagcccagcctagactacatagtaaatttcaggctagtcaggttacataatgagaccctgtctggaaaaacaaaaaaatcaggctagattttatagagtcaaggtacatgcttgtaatcccagtgctgaggaagtagagacaagatgatcccaaggctagctggtcagccagagtagcttaataggcaaggtccaagccaaggagaaatcttgtctccaaaagcaaggtgacacagcactgaaggagtgatatcaacagttgtcctctggcctccacacacacagacccaggcatgaatgtacacacacatgaaggcatacagacatgtgcaaggtgggaagcaataactgtaatattggaaagccccttaggtgtctatctggggaaaattggaatcagcatctcaacattggtctctcatatagactagaaaatatgattatctgttcattttccacccccattgaaaagcatctttcagtgtgatggttcattgggaaaaaagtctgctctactcttttgcatttttttttggtttaattttcaaaaataaaatttatgtgtgggcaattagccctgcaagaacatgctcaggcatgatggatgggccaaatcctagctaagacgtttactggcacatgtggtaacttgtttcagtccagaagactggaaatttgtctgggaaaggaatccctgccttcaaacaaaggcagccagctgcttcctcttctgcacttttaggctttggtaaagggggtggggtaggggtgtggcagtattctgaaagcgctctctccagttaggtctggccctggggtgatcctctctgcacactgagaacctcactcaggtctcctccacttcttgtcgctgggtttcagcacacatcaacaaccctggaacctgggcctacccctttctttgactctgttcattgcgttgtagggcagctgtttacacactgtccgcttgtgaacaggggcatctcgcctgatactgtttctaggtaggagatctaccacgagccacacaccccagtgtggattctaggtgaacaatctagccctgagttctatcaccaaccattttcttttatttttactttatctttttaatctattctagttagttgttgttttgggttgggttgggttttgggtgggttggttggttggtaggttggttggttggttggttggttggttggttggttggttggtttggggtgtgtgtgtatgtgtgtgtgtgcgtgtgcacatgtgcacacgcacacacacacacacacgcccacaactgggcatttgtatagaggtcagatgacaatcctacaggagttggttctgtctttccaccatacgggttccaaagataaaacccagattgtcattcttggatgcaaacaccttgacctgcagagctatgctaccaaggcaatgtgaaacatccaagaactggcagtgtagatatggtccctctctgcatgaactccccaggttcctcatatttccctacctgctacactctgaatcctccaaagtttacatgttggaaacttaatccccaatacaactatacagaaagtaggacatttaagaagtggtttagtcatgaagcctatttctggaaaaaatatgactaatgctgttattataacaatagtcttagttatctcgggaacaaaaacagattctttcttaaaatgcaatctttcttccctttcctttcaaacatgtgctctcttgccatctctgttctgtaataaggataaggctaagaaaaactctcaccagatgttgggacaatatctttggacatcttggtatccataaacccatcatcgtttatataattttccaattttttaattctctcacaatatcacaagttgtactatggcatcatcctaatatacctgagatagtttccttttctctgctgctaaaatgcttgctttgcaagcatgaggacctgaattgagaacacagaatccatttttttaagaagccaggtgtgaatcaccatctttcaaaagacccataattggtcagtgcatagcgaataagactgtagagagctcaactttaaacatctatatcaatctttatcacaccccccccctctacaagactcggggaatcatcaggggaaagggggtgtaaagagtttaagatccgaaagaattggtatctgcagaaaaacagcacttgctgggtgttatgggttttgcctagtgttgtttatatgttgatactaattccactctcctgggaggggctgcggacaaagagtgagtcatactcaggtgacttcttgtgaaccaatcccctaatgaataaaggagccaatcactggatgaataggcgggacttctaagttggaaaggggaagagagaaggaggaaagacagtcttttggacaaggattgcatgaggataagatgtcgctatgagtgtctcccagtttcaatggtggattcgtcaggatttgacacctgaagatttagatttaataaggcttacaagattagaattttagttgctgcgccaagcgatcgagttgctctcgtttctgaactaaatttgtgttgcattttccttcacacagcggctcgtccgggttcaagggagaaaggcacagctgcaaagtatgggtttgcctgaggtgcaccacaaaggccataggggatttgaagcacggggttggtgtggtagttacccgccagagggaacctagtgagctgggtggaaagagtttggagttctgaggcagagtctccacaagataaaaacagattggccattgcccaccattgcatggccggccaggccaccatggcagagaatggctgggacaagcgcaggaacatgccagttctttttttattatttcacacaacagctgggcatgacagtgcatgacacagacctcacagcagctgggactgcatgcacaggctcaagccagccataattccagcctggataggggaatggccccttgctgagaagctattggacactgatacttttcagagggggagatttggttttcttccgggatgcaacccagagagactacttgcattccatgtacatacaggcagcatgaagtggacccaatggttgtggttattttctaaagagcacatgaagttggaatggaatggagggagacagatggaaggacctggaggagaaagaatggagagtgaattggatcaaaacaatgcaaaagagattcctcttcttgaaaacagggtgtagcagtgtacacttatgatcccactgctggggaggcagaaacaaaagtatccctgaggcaaattagggagcctcaagtcaaggagagactatttcaaaagacaagataggcagtatgctgatgaaggatatatgaggtttgcctttggcctcctcatgtgcatcctcacgtgtgcatgcatgtgtatacacgtgtgaacactcacacgtgcatgtgcacacacacataacacaaatatgtacacacaaaacactaaataatagaaaaagtaatgttcctgagtgccgcttttattagcaggcataacaaatgaaaacaagggtggtttgagtaaaaatggcccctacaggtccatagtgaattgcactattaggaagtgtaacactgtggggctaggtgtggctttgttggaggaagtgggtcactaggtctcagaagttcaatccagttcactgcctgccaatcctcatgtagaactctcagctccttctctagcaccatgtctacattggtgccaccgtgcttccagccataatgataatggactaaacctctgaacctgtaagccagccccaatgaaatgttctccttataagagttgccttggttatgatg

SEQ ID NO: 436 - DNA, 1825 bp, Mus musculus
gaaggaaagagaagaaagagacagtaaaagaaagggagggggctaggtgcattggaagcctgggacagaaggaccgtgagtttgaggctagcctgtgcttcacagggagaccctgtctcataaccaaggggactgttggggtggctcagtgagcaaagcactcacccgccataaaaccatgagaactggagtttggaccccccagctcccttgtgaatatcagatgggtgtagcatattctcggtgcagaagaggtggagataggatgcctggggcaaagtggctaactaaactagctaaatctgtgagctttagatccaagtgggaaagcttgccttaatagaccaagtggagtacaattgagaaaaacctaatgtcaacctcgggcacatgtgcacatgtgcacacacacacacacacacacacatacatacatgggtgggagcagtaaggagagagacagagaaagagggaggggagaaagctgggtgtatgagttcaaataaaacactatactctgctaataaatccaatccttacatgctaatcaaagaaaataaagtaacacaaaaatctttccacttacgctctgcctgtctggaagccgactgtctgcatatttttttgatttttctctggatctcctcctcctctccgggctaccactaataaatcacagcattcagtgccgttttgaatagatggaaagatcacagcgcgacggcggcacggcagagctcggcatttgtttgatggaggtagcacccccccccccaacaagatgcatttctgttcctgcggccatgattaaaaacagaaatcgagctgcataatgatggaatcaaatgatagcggatgcatttcgagaattctaaaaacagaaataataagctgatggtatagcttagtagtagagtgcctgcctagaatcccccagtgaggggctggggacacagttcagtggcagagcccctgcctagaatcccccagggaggggatgggaatgtggtactgtgggtagagccctggcctagaatccctcaatgaggggctggaggcatggctcagctatagacctcctatctagaatccccctacaagagactaaaattatggctcagttgaagagcacatgcctagaatcccccagtaaggtgttatgggcatggtaaattggtggagcatttgacctaactcagtctttagaaacttaatccactcccttgagaaagacccattcatgagagcaacacgctcatgatcttactccttctcagtgacctttccttctggttggttgcgttcaggaattaggccttaacatgaagctggggacagacagcttaccctgacctctatctgcagctcaaaacatttgtttaaaaacaaagcccatgaagatgaacattgttgtatacgcctggaatcccggcactcatgtgaaaagagaaagaatcctgaggatcaaaaattgattatgtagcaagtttgaagacgccatggcctgtgcacgcctggagctgcctggtcctcccagaatctacacatgactgagattaaagccatcctacctttctctgtcccagcccagactaagaagcaagtttcattttgataccccacgtaacccaggttagcctctaaatcttcatgaagctgaggatggatttgaaactccagtcttcctgcttatacacacacagtgagatgttggaattacagttgtgtgccgccacatctgttttatgcagtgttgggatggaacccaggcaagcatctacctgttgaaccataccccaagtcaattctgtgcattttttttcca

SEQ ID NO: 437 - DNA, 2500 bp, Mus musculus
atctgtgtgagtactgagccaacttggtccacaaaatggctttcaaaacagccagagttctgttatacaaagaactcctgtttcgaaaagtcaaccaaccaacccctgctccaaatattatatatataaaacacatgtatgtgatatatgtgtaatataaatataaatatgtgtgtaagtatatatgtgtaaatataatacaatatataagataaaaataaaaataagctgggcgtggtggtgcatgcctttaattccaacactcaggaggcagaggcaggcaggtttctgagtttgaggccagcctggtctacagagtgagttccaggacagccaggactacacagagaaaccctgtctcataaaaccaaaaaataaaaaaataaaaataaaaaatatataattttttaaaggggccatttaaaccgcagtatttgttttttctggtcacgtacacttccctgttctacattttgttttgaaagttttacaactttactttttcacacatactttcttgatctggggatggcttttgcttacgtgggaggtgggaatctattttcattcttttcccatatggacacctaattgtccttgcatgatgatttgaagagtccaaaacaaaatataaggtattttagaataaattgatgaaagatcttgaaggctcaaagaccttgatagctaacactgtaaaattaacttagggatttgcattattataattaaaaaatacccacttatccataattccaacagtgttcaggtggctgagaaggatgccacgcgtttgaggccaacctgggttatagagtgagatcctgtctcaaaaaggtagctatgggaaccaggcatgggggtgcactctttaacctcaatgcttaggaggctgagacaggcagatctctgtgagttcaaggccagcttgatctacctagcaagttatagaccagccacagctacatagtgagagtctgcctcaaaattattggaagagcctgtagagatggctcagcagttaagagttcttggggctcttgaagagaactcagatttggatctcagcatacatactcaatggctcactcctgcctgtaagtccagctccaggacatcaggcgccctcttctggactgcatgggcagcagcacacatctgtacacacacacacaatcatgagcatgaataagaataaagtaactctttgaaaacagtgatattagatataataagatcaagaaatgaggaccagccgggcgtggtgacatatgcctttaatcccagcacttgggaggcagaggccggcagatctctgagtgtagtaggaggccagcctatggtctacatgaactgggtattcctggaaggcaagctggggctgaaagagagactagacggtgagaaaaataatgaagccaacgcaaattttttttctctgattaaggcccgcaagtttactaagagactgtgcttaaagggagaaggcccctgccccttgccagtccatccttggtgctttgtcgccattctgtcagcacttggtcgccaggctgttgcttattcaggaatgtctccagaaggcaggttcaacctctgggcaggtagcagaatctcagggcagttgacacttcaaaagaagccagccaagtcagaaagctgcaccgcaggtggccccacctcagtggcgacaaggtctgcatcagccagcctcaggatgagggaggctacaattttccccctggttatataataaaaatagctggaccgagacataaaatttatttatgctccatagtcctgcctgggagttatggtggctggcggccgtggctggctttgggactcagattttcccgagccattcttatctgtcaaggagcatacatgcagcttgtttgtgtttattttacacaaatatggctctgtggtgtattattaacaaaccacggcctcttggcttgtacctctgtcttagattgataaggctccgaaatctggttgcccgtcattgactgactggccctcatagcacaccttattcccaaatcagaccaaagccacaatatatatttaatatgcttcttcatattgatgaatttctgccacctgtgcttgctggaggcgaggctgtacacttgctgaaatcaggctgtaaggagagactgacctgcttgaaaagtggagatagttgaaaagcaacgggataaaagcttctttgtggaagtctaggtactaatttattcagttgcaaattagcaacgatcaagctcagactctgacctcctggtgtgggggaggtgactttgagaattagcagaaaagctgaaaattctctgaaagtggaggctgtgctccaaattaacttttttgcctaaaaaggatttttagccatcaatgaggttagaatcatacttactagaagattcaggatctgtgtccacttgatgaaccagtctttcaggcagccatcagccatcgcactctgtcttctttttgt

SEQ ID NO: 438 - DNA, 1875 bp, Mus musculus
acccgcatagctgacacaggctgctgctgagaggacgtgcaagtggcctccaggaggagtgcagaggggtgcgggcagtcccggtgtaatgcatgctaggactaaagcactagttctctctctgagtgtgcacaggccaagctgggccacctgcccacctgcctgatgtgtcaatcaaagtgtgctgtacgcttataatccagtcctggggcaggggggggggccgggggggggggagagacgaggatggaaagttcaaggtcagcctgggctatataagcctctatccaagaagtaaggccggcgaagtggctcagtgtgcaagcaggaggccctgagttcaaatccccagaatgcttgtaaaagccaggtgtagggccaatgggttggcacagcagctaagggtgctttctgccaagcctgatgccctggtttgaacacagggatttacatgctagcaggagaaaaccaacttccacaagttgtcctatgatcatatatatatatatatatatataagagagagagagaggcatcgtatgggggtgctgtaatcccaatagccccagtactgtggggagcacagcccagtcaggaaaacagtgagctccaggttcagttagagaccctgcgtcaagagaataaggtgaggggtgacagaacaggacatctgatgacttccgctggcctctgcaagcatatgcacaggtgcacaaatcagcacacatgtgtctacatgtgttgcacatgcactgaaataataaaacaagaacagaaaaaaaaaacctgcaaaaagaagacgagcaataatgagaagcagagaggagatctggcatgcgcagtggggagagaaaaaaaaaaaaacaggtcaagcagtcacgtgactcggagtcggcctttgcgtgcttggcttaaggggaagggttagggaaggaaggagagccgggtgtaattagcagttctggtcaaggtggggtctggttggccactgtctggttccgcagagtggtccaaaggaagctcttgtttgagcagaacagactgattatcagacatgagctgctccagctctaagctgcagcctcctcttcgttaataactgttcgtgtgggctcaggcaggggctttgtcccactttttttctgaaatacaaagtgactgtaggtttatggttttgtcttttttttttttaagatttgtatgattttcaactgtgtgtctgtatgtatgactgtgtacgtgtgtgtgtgtgtctaagtatccgtgtctgtttgtgcatgtggatgcaggtgccaacagaggccagaagaggacgccatatctcctgacgctggagttactggaggttatagcatgagttcttagaactgaactctgtcttttacaaggatggcaagcaagtgtccctaaccactgagtcatcgttcgggccctgtgactacaagtccacaatgactggagcctctgcatggtctggaacagaagagtgtagatgctgacagtaaggtgctccatgactctaatctcacccatcactatggatggtgattagctagatcaggtatcaccaagttttagctggatgcccctgagggattaatggacctaggagcagaggtagcagctgagccaaagtaaaggatgaaagcaggatgaaggcagagacaccaggcctgcttccagcctgcttttacttagttgccttggagacctgggtgaggagtctctgctttttagcaaatgaagtccaaagtattcaacttttggtttgtcttgcttttgagatactgagggttggactacagtaagtgctctaccactgagccacgcccccagcccctccctgggggattctaggcaagggctctaccactg

SEQ ID NO: 439 - DNA, 1875 bp, Mus musculus
atcatcactcagttttgcctggcttcatggatgctagacaagcactctactaaccaagctgcaggcttctctcttttttaaaagatgacttatttatttttttattttatgtgcactggtcttttccctgtaagtatgtctgtctgagggtgttagatttcccgaaactggaaccacagacagttgtgaactgccatgtgggttctgggaattgaacctgggtcctttgggaaagtagccagtgctctcaatcaatgagccatctctccagccaccaccacccccatctttctttttctaaaataaaatgttgctatgtggcccaggctagccttgaattggaaattctcctgcctcagctgcccaagtgctgggattatagccttgagccaccgtgccaggcatacctgtaattccccctcccctcccttcccctccttccccctcctttctctgctttccctctcctcccctcccctcccctcctcttgcttctcttattttgaagggggaggggcgtctatttgattttgagtcagggtctcactacgttgctcacactgaccttgcactgactttgcagccccagcaggtctggaacttggaactctcctgcctctgccttctgccttagctgtggttctgggcctgcctgcatcaccatggctccgctctcaagggcacccaccggctgctcttccactgctgagttggtttcccagcacccacatgttggctcacaaacacccataactcctgttccaagggatccaacactctcttctgacctcaaagagcaccagccacatatgtggtgcacacatacacacattcaggcaaataaaataaataaatctttttaaaaatgttctgttcttaaaattctgggaactgaccatgagatctgatatctacccttccttagagctcctgagtgtgtatgtgtgtgagtgtgtgtgtgtgtgtgtgtgtgtgtgtgtgtgtgcgcgagcgcgagtgctgagtggggggcttgagccccacccagtctaggacaaacccctaccctaccctagaagagaagccacagttcagcaatatcctggcccatggtgccctctggtggctggcagtaaagtcccatcaaggtgattacagatagagaaggaggtgtagggtttatttagagctgcagttctcaacctgtgggccacaacccttacacaggaatcacataccagatatttacaatacgattcataatagtagcaaaaatcacagttatgaagtaatcacgaaaataattttgtggttgggggtcaccacaatatgaggagatgtaataaagggtcgcagcattaggaaggttgagagacgttgatttagagcatctacaggactgtcactgttaggaagtatccatcaaaatacataatattaattcattttaattatcatgtcatacaacaattatattgttcctttattaagatggtctcagccccccctccaactggagctccctgttaatgacttccttgtcttccccctcccaagtgctaggattataggcctgcactgtcaaccccagttcacatggggattgaacccagggctttgtgcatgctaggctagcacactgccacctgggatctgtttccattttaaaaatgaatttaaacgctacaaatcaaacccagggcttcacacagctagactagcactttaccactgaattaaatcatcagccccaccaccaccacacacacacacacttttttcagtggaggaaggagtctatgtagcctaagaaatcacgcctcaaacttgtgatgttccatctgccttgacttcctgaggactggggttgcaggtgggcatcacgatgcccacttt

SEQ ID NO: 440 - DNA, 3350 bp, Mus musculus
acagagatgggtcgtcaacggccaggaccacacagtgaacagagctgcctatttatggcacctcttaccctgaatttaaacctaaacctaatttagggctgcaaagatggacttggggggcagaccctagacccccttactgttcctcctcccaatgtatccacattgaataagcttcctccctctgcttgtcaccatggcttatctctttgattagtattccatctcaaaggggctaacagtttactctggaaccaaatgagtgaccacaagaacacagactcgggttatcccaaatttcatgttccaacatgggagcattttatattaacaaaccgaaggtagtcatcagttagggaacttttttgttgttgttttgttttgtttttattacagggtctcactatgtggcctggctgtcctggaattcactcagtagaccaggctggcctcgaactcacaaagctctgactgcctctgcatcactagtcctgggaatgaaggcacacatcactactactggcttgtcaaagcgctttcaaattcattggtaggagcaaaagtgggttacagccaagtatgtgaaaacctgatggaaactgaacttgggtcctctgtaagaagagtacaagctcttaactgctgagccccaaatcagtcttcaggtgtttgcttgtttgtctgtttgtttgtgtatgtgtttgtttgtgtgtgtggtgctggggacggaacacagcgccttgtacatgtgaggcaaggcgtctcccactgttctggactccaggcctttgtataacttctcctttttaactaagaattagcttggaggtaatagcttaaatcacattgatgaaaatcaatagagagtaaattaaacataaagctgaattcatcctgattgtgttctttgttgcctttggctaatttgatgacaaagcaactattttaatcttctaggcttagagttttttgtggctggacacattgagaggaggaggtaattatacagcccatttatcaaaaagattaaggaaacgggaaggtgggaattggtttacaagcagtctaggaaatacagcaacgtgacaccaaggtatctggagagtttctcaaatgacatcgtttctcctcccctcctagtttcttcaaatcaataacactaaagctgattaggaggtggccaggagtctggagaccacttgtcccctgtcctaggatgggagcctccttatcttaataaggaactggccagtttgggggggagaggaacacttgtttttctgcaactgtgttaccatggatacagcatccggtcctcagcatctcaatgaaagagcccagcttcccaggaatttttttttttttttgcatatcataatttagaatgtgtttggttttcatttgcagcccagcctgccagcccatcttcccccaagattctgcaaagttcaaccgtaaccaacatgaataaatcgtcttctcagttccagctgcaccttggaagatgtatttcagggtgttgggaagatcaaaggattccccagttgggggttctcaaaattcaccctcaaagtcagagaagaccaggtgtgatagccagtgatcctctgaaccaaatagccaccatcctcatctatttctcccttgcatgaatgcatcttgcctgtggacttttcacttcccttcagagaaggtggaggtgggcagggtctgcgagacctcacttgagtttccagatgcccatagccattcgtatacaattctgctctgcttgcattaggggtttgtggcctcaggtagagcaagagtatgaacccagggagcttgagtgaagggagctctctgaagccatgggagaagcgtcatggatgctgggtgaagatgttccagtgtggctgctttggagtcacccacactcctgtcagcaaccctctgtggggcagtggaccatgccaggaatggtaggtgtctccctgttccctactaaattcctggcccggaacacgtgactacactccccatgttggccacgcagcccagaacagagttctctatgctaatgtggtatctagaggccctggcagggcggggggtggggtgggagtggggggctgctaaccaataagctttccttcccagacaaatacctgcaaaaggtatttcatctctggtccaccctgaggaggtggtatgcacccattttccatgatgaacaatcaataaacagtcctcggacccatcatctcttgatgaagagaaatgtctctttcatcaaggacccgctaaggggagcatggagagcgccttcgtctacagagccataccatctaagtctcccacagaagtcccctccatgctcccagacaattgcagctaagccaaggacaatcgccgctgatgagctaagtcagagttccccattctccccagtcctgtggcccacgaacccaactcctttcccagctcctcatgacccagcagcatccggatgtccaggagtttgggagaccccagccctgggctcctcatcacaggcccgtggacccccagccctctgttcccaaatcctctgcacggcaatggattcccaggggtcaggaaagcccagcttcagcctcccatatcttaggctgtgttttcccaccccctgagcagtgtatctgcacttccctcaagtacagcatccaacagggggatagggtaaatgcagtctagcatctctgtgtttcatcagcccagtggccgggtgaaatttgggaaccacaaccctccacccaatgctctgtaagccatcccaagggcaaccctggtgaaatcatattttggtttgttcttgagacctcatgcagaggcaggatagaccttgttgtttaagtttccacaaggacagactctaaaataccagggtgaaagaccccaccatcaggcttagcaagctagctgcagtaacgccattttgcaaggcatgaaaaagtaccagagctgagttctcaaaagttacaagaaagttcagttaaagattaacagttaaagattaaggctgaataatactgggacaggggccaaatatcggtggtcaagcacctgggccccggctcagggccaagaacagatggctctcagacgtcagtgttagcagaactagcttcactgatttagaaaaatagaggtgcacagtgctctggccactccttaaacctgtgtgtctgccaatgttctgaccaggtgtgtgcccattgttgaaccttcattagaccctttcctcgtacccctcccatacccatttcttgaaaatagacattgtttagaactaaaaagtcccacctcagtttccccaaatgaccgagaaa

SEQ ID NO: 441 - DNA, 3800 bp, Mus musculus
agagacacagttctgtggggtactggttagttcatattgttgatcttcctatatgcttggtgacccctttagctccttgggtactttctctagctcattctttatgggccctctgttccatcatatagatgactgtgagcatccacttctgtatttgccaggcactggcatagcctcacaagagagagctatatcaggatcctgtcagcaaaatcttgctggcatatgcaatagtgtctgggtgtatatggaatggatcaacaggtggggcagtctctggatggtcctttctaccgtctcagctccaaactttgcctctgtaactccttccatgggtattttgttccccattctaagaagaaacgaagtatccacattttggtcctccttcttcttgattttcatgtgttttataaattgtatcttgggtagtctaagtttctgggctaatatccacttatcagtgagtgcatgtcatgtgtgttctccacctcacaccagtcaaaatggctaagatcaaaaattcaggtgacagcagatattggagaggatgtggagaaagaggagcactcctccactgctggtgggattgcaagctggtacaaccactctggaaatcagtctggcagttcctcagaaaattggacatagaagatccagcaatacatctcctgggcatatactcagaagatgctccaacttgtaataaggacgtaggctccatctcttaagaactctgtcacctcccaatagcaccattctgctgctcaagcctttgacatggagcagagatgacagatgggttcagaagccctgtgagtgcttacagtaagtgaccctggaaccagctgtggggagacagatcacttaacttggggtggttcaaggcttatataattgtatggacaggggtcagaatatccaggatgggcaaaggtcgttggctgaaggcttaaggtaccaaagtgcctcattagaatagagaggcattccaggaatttcaggtgctagctgaaaggttcttatcaagagaaaggaagttgaacctgtcatcttaaccaaggatatgtgatgttctgtaggtaatggtgtgtgtgggtgggtggaggtttgaactccccaaacaagagaagctttgtcagtgaagggcatattgccccaaactcagaaggctatttagaccatggtagacttcaacttaattagcagagcaacacctccgcctattttattttttaacagagaaatgtcactaaggtactcagcctctctattggggacagcttggatggcttggtactgaatcggagcccaattagcagtgattttttgcaatgctactatctgtggttttaaaattggatgaggcagggtataaacatcaaaataaaacatcacattggtgggagccaggaagacaaaggattattgaaccaacttaattaattgctcagcggattgaaatctccagaggaagtctgtacaaagtttcttgagggtataaacattggtctcaaacaacattcaattaatttacatagatgtaactttttttctcaatactatgcaagtcctcttttaggtttagcagtcatttgactctggcaaaagagttcagctgtcactggagggacccaaggttgtcatcggtggatgccatcacatgcttgtctcgaaagtctccagtcaaatggtgtgtctggacaaaggcagcttcatggccccagcaggtaccaggaaaggatatggcggttagtgctgccttcctctccttgtagagattgacaggagtgcagaaccctggcaggggggtctgtgtagagatatacatacattaggtgccatctgttgaaataaataataattaatcccattggtaggttcgctacccacctctatagtttgtgtttccaaaagacacacacacagcctttatattttaatatgccttaaacagcacaatagctggaccagtacctgaccaccatgccattaacctctacttcctgctgataatcccgagttattacctactaattctatgttgtatcttggctgccctagactcaattgggcagacttctagcctgtgctcttcacatggccaccatgcctctgtgtcctgtactcttctcgggcatggtgtctctcctctcctccatactcttccaatatgacagatctccctactccctcctccctcctccccgctccccctccccctcccctctccccctcccccctcctcccagtcccaagcctgggaatcccaaagtcccacctgtctgccctgcccagctattagctgttggcatctttatttaccaattagaaccaactgggggcaggctcccagaagctacgtgcagataccctcttcaggcaagtagtttttttttttgtgggggggggggacataattagcattggtaatacatgcatctacatttaatgtaatccatttggtctgtgggaggtagatccaagatgattctctgaagtttaaaagaatttttaagtttttaaaaagagataaattttagatgtgtgtgtgttaccatcgcttgtaatttgtaagcaattttgggttaaaagcataaacattctcttgggtaatcctgttactagggaaaaacaaatgtttgaacaagatttagacaaagaagcataagctgctgttgttctaagctatgttatctccaactataaaagccgaactccacccatcattcctgtgattcaagtttgccgctctgtgctccagagctgacaggtttaacctcaacctgcccggaggacttggctcggccacataaatccagctatgccaacggtctagcagttccttcctgttccttgtctgggctgttcacatctgcttttatttttagcacccctgccacaggccaggtcttcaccagtaggggatgaactgagtgctcctggcaggttgggaatgcaagcctgtgttttttctctgcaggcccctcccttccctgcttgcacaccctggctgtatgccaacacggcatggcagtaggcaacagttgctcctggaaaaggggtacacctctctgtctgcccagcccccatgaaagagactcgaagtatgttgctatggctagagatggagtcccatgagccagaggacaaggcatttccatctcaaccctagtagggaaactattggctaatattggggtgtcactccacccaccgagaaacatcagatgctccacaaactatttgcagtgttcctgcatataggtgcaagctgatcgtagagcaaagaaaagaaaggagacaaccagccttcaggtcagaacggtcaggcatgatactgctaccctcttttgtttgagagggtactcacaaatctctgttgcattctggaggcctacgttgggcgccaactgtgatcctccctgtgcctggagattgttggcagatattggtctgtgagagcaaagggagcagagatgaaggatgggggagggttgggaagaggggttcagaggccctatgagtaccttacatacaccaagaccaactacagagaagcaggactactttacttggggtaattcaagcttatacagttttgggatactggaggtaggaacatccaggatgggcaaaggtcattggctgtgggcttagggtactgagacgcctcattaacatggggaagtatttcaggaatctcaggtactagctgaacaggctcttacaagggaaaggaagttgaacatgtaatcttaatcaaggctacatgacattctgcgggtaaccgtatgtgg

SEQ ID NO: 442 - DNA, 2325 bp, Mus musculus
tgtttcaaccttgctaagtcttctgtctggtggcacggcaatgttcatgttttccaccggtcttgtttttaacttaaaacaaaatttaatattcaacacatacctcactgaaaggaagtttaaaattaatctgaacagcaatcccagagtacctggcacgaggcaggtagggtttagagactctgcatctgctattacattgtgagcatttctcctgttcttattacattaaaaaaaaaaaaaagatctgaagatggtatgtgtttatagtgtgaaagaacactttaagttctcctagaactctggatgctgggtcgattgtattgcctgacttccctaggaggaaaacaaccagccatagacaaatgtttctgcaaatgaaagggccatgctgcttgaaggcacgcctcaagataaatgcaatcagagtcctccaagacagaccctgattactgggcttgttttaagaaattggtgctcatgattatggagtggcacgtctgacatctgccaggcaggcggctgggaactcagacaagagctgaggtcgcaagtcttgaatctgaaacccacagggcaagaggtgggctggagactcggtcgctattctgtgtcacaattccacatcaaagaccaggaacacagattataatcagacctctgagagatatgttaactcccctgctggtacttttgatccacaggaaaagctgacactcttcccaatatcttctataggcgtccagccaaaactttaggcttctagaagggtgcggggacgtcagtgttgttgctgtaataattagacattcgatcagaccagatgttctgtaaacatcttctaatttgagcagcatctcagaacgaaaacatcagaaaagtctgcacagaaataccctgcatagatttgagctcagggcttgcctactccagtactggcactgagaaagtggaggtgatgtcacgcaagggtgtggtccgtgcagtgggtaggccagggcatagggattgatgtggaatggggatgctgaaacacagactcgggatagcaaaggagaggagggaagtgagaagggtcaaaactagagatcaaggagaaggctcagcatgtggaagcagaggcgattctgacaggtctacggagtccaggggggtgcacacagctggaatacaacctccagagcagggctctttaggacagggtgaggaaatgagattttatgagaaaaagattagaagtgtggaggatcaaagccttcctgtcttcagtgtaaggaggacaatggaggctatgatggtgggttgtcaatagttactgtttctggacatagttattgagcttccgaagtgtgtgctgaataccgtgcagcttgactctcatctagtagagataagagaaagtgagtcgctccttgatgcccagtgtccccaggggagaactgtctacagtgcagggagaaaagagagcgacaaagaaaactcaggactagtcacccttctccctggactctcacatggtttccctttataaggacacttggctacattacatgccatccttcctgaacatctcattttactgaggtcatctctttgcagccttctctctgaatgaagtcatattctcaggtattattacatcataggacttcaatgtgtaagtttggggggtggtggtggtgacataattcagcctatatctcaattttaagcctgggtgggattctaaaaagtcagttgagatttagccaagcctcctcctcgctgtgacagaaacttcacaaaatatcctatgggagcagatccctagagagtgtggctgagtctcctcagcatctgtagccttgggaaaactggatgcatcatcgactcagggaacgcaatcagtgagcgtcttcttgaaacgttgagaccctgtatgcggtggttggaatgagaacggcctccctagacacgtatgtttgaatacttggttccccatttgtcggtccagttaggaaggcttggccttgttgagggaggtgggtgtgccccatgccatttccagttagctctctgcctcctatttgtagataaggatgtaatcgctcagctgctgctccagccatgcctcccggctgccatgctccctgtcatgatggccatgaccgctaaccctctagaactgtgagacccagtaaactcttctataggttgccttggtcataggggctcttcagaacaatagagagcagggacattctatgttgtttgaagtgttgtcacctgatcatagctagcaaaagaggacaccaagaacaaatgaatccttccctggagctcctg

SEQ ID NO: 443 - DNA, 7050 bp, Mus musculus
tttgtgagtattttggtagcggtgaccaggttccttgggaatccatagattcagagtattcacaaaataagagaatagtaaagaacattgaatatcagggaatgagcattcaagtctggagaaaatgaaggtagctaagtcacatgggccggtcttcccatcaaagctgtggcagggtgtgattgatgtccattgaacgtgtcctctgggtcaagagtggtggctggctctcagcaccttaacagtacctgttggctactgcagataggttctgttccaaggacccacatggtcgctcacaatacacaaatccagctccagggcatttgacaccttcttctcaactccctggacctcacacacacacacagatgaaacattcatacacgcaaaataaatgtggaagagtgaataaatgagagaaccacatgagttcctacagtttctatgggttcaaactgcaatgtgtatatagttttcaggagaattccaagtcagatgagctcagcaagaactctccatggtcatctcagagtccccagattgtgctccattttctagatcattgtttctagatcattctgtgccactattaaagagctagcgaagactaactaatatactaatatgggaaaagctgtaagaccagtagttgaatgaatagttatttcagaaaaattcacacatatccttgtttattaaggtagaaacaatagacatacaaatgtaggtgtctgaatcagagtagtcttgagaggatggagcagaagaagagcatctccatcagaagctcaagggactgttgccaatgttacggacaccagaaaaacaaggagtccccccctgggcaaggcaggtaatcaatccacttacattgctcagtgtgaaggaagatgtcttatacttaaaagatcaaattgtgtgcagcctgggggacagatgagagataacaatggcaccagactttgtgcaccataccagtttgttgtgtgggtctccaggcggagcccttcccttatgggcttgcacgcccccacacagctgctcaagcctctcccacagctgttgccgtccatctcagctgctgcttcctgccctagactttccctcaccaccaacctcctgcagctcacaggaaggagaagagccatctactagaaagatgttctcttcatcacctttggaacactgattctttaaatgaccaccgggaccagttttcccacagaagacaaattttaatttcttttgaagattttcccatttagttttatgaatatgctttttatgtctgtgcctgtatgaggtttatatgcatgtagtgcctgcagaagtcaaagggcaaggggtcttctgaaactgaagagacaggttgtttgccagtcacctgatgggggtgctgagaactgaacctgggtcctttgcaagtgcagtaagcactcttaacctctgagtcactcttctttcctcaggagatacagtgtatatgtatatgtatatgtatatgtatatgtatatgtatatgtatatgtatatgtatatgtatatgtttatgtttatgtatatgtctgtgtgtgtgtgtgtgtgtgtttgacctgcatgtatatatgtgtaccatatgtatgcagtgcccaggaagttcagaagagggcatcaaatcccctggaacaggagttatggatggtataagctgccatgtgggtgctgagagtcccaggtcctctggaagagcagtcagtgctcttaacaactgagtcatctctccaacccctcattggctgctcatttgatagatgaagattttgaaatcaacagaggccaagtaatcgtctccactaactgttgaccagtgcctctgctcgggtgtgaacatggcatggtcctccaaaggcccacgtggtaaggactggttccctgggtagtgcatgctagaaggtttggaaactttgggagctgggctctgacagaaagttttaaggtcactgcagttgtatcttgaaaagggattctaggacccaatgagccagtcctttcctgtcttgaccttttctcctagagcctgtctaggtatttctgcccctagttgctactctcatgaggttggaacagccaggccttctgatgttgggctttagaactccaaactgtgagctaaattaagcttttttttttttttttttttttttttttaatcaaatatatgaccttacttgtcacaccgcctttttccaaggaaaatcttcttagggaatgactactatacattattgaaattaaattaacaaataatacagtattttgaaagtatgattaaaaaccaaaaaaaaagtttccattgcaacataaaaatataaagaaaatgtgtttatagtaaacgttttgatcacttgtcatgagtgcataaaggtggcaaaatggaacacacagttgcttgcccctatatgcagggtttggatccaaatataggcaggtttaggttgtatgctgctaaatttaaacactgtggacaagttgtcaccagttcttgacttttctcagatgatcaagaactcatgggaaagattcaaagcaaacaaatttttaaaacttgtgaatttatttggttgttctattcctggaaaaattattacatcttagagcagtgcaaaaattactttgtatttatatttagtgtagttaaattcttagctcagatatttttcgcccacacagatgtctggtggggaaactcaatgtcattgcttggtgtgggggattttattgttgtgtgggacagtcacatcatggccccaaccaatgagtgaatatctgtcagtagcaatccctcccccagttgatgacctagaaacacctagatacatttcctaagaatttctaaggaggtagtactgtcctcatttagcagaagtgttttaataatgacatttattgttttccttgcccttaaacttttgtttgaaaggaagcatcaagtagtatacggcaggagaatcctcaggaaaggtgtggtgtatgccattttaaccaagggacctcacacttaaattagagcatgggatctaatttcttcagagtaaagttcctctgttacacttccctttctcctctctgggtgactccaaaatctagttttacctggaaaattccagaacctagcttcagcttttttgagtctgctcttctccgtatggagacacaataatattttcaaagagctcgccctactccagtaagaatgatcccctcgggtattccaactcatcttctataattcagtatgtgaattcttatagagaggcttaatccatgtgggacacccctttggagggtacatgatgacttggataactgttaagttcagaatgggaacgagataggcagaagctaatgtttttaggctgcctttgatgagtaaggtaacttgattgtgcatattgaagatcgcagatggctggaggcatttcttggagagacaatactattttggatgtgtgcccaaagaccatgtatgggagccctactctgtagtgcattagcactggaagacaggacttttgaaaagtggttaggtcataaaggctcagccttcgtgaacatattactggcgtttctgtaatagtgcacttgctgtaatggtgggctatgcccgtttgtcctctcttgcccatctaccttctgccgtaggatgagagggtaagaaaagctctttcaggtggcagcacccctttcctgcatcctagtctccagcactattagacaaacatttcagtactttgcaaattactttgtctcagaccttctgctacagcagagcaaagggacaatgacaggtggatttttttttttttcttcccagagaggctgatgaaaaggaaagaaatcaaggttcctagacagtaatgagaaaagacagagtcagaatcctggagttacagctagcaggaagctttgaggtttggtcttgggctttgaatgtgatgccgtgaagggggagccttttagggtaccagagatgaaagtggaacctctgagtgttctggaagagagaagcaggattgaagagatgtggttaaaagactggagatttattatatattaaaacacagcaatcctttcttgtttaacccaaggaaagcagtgagataactcactggatacaggtgcttgctgccaaacctaatgacccgagttcaatccctgggacccatgtggtgggaggaaagaactgacaagttgtctctgacttccatccatgtgtcatagtatcctgctatcccatacaggtacagacaaaataaaatttaaaactaacaagaaagttttaaaagtacactggtataggaatgcggtgggagaatttcccttcagaaaaaggaaaaccataaaaccatagagagcattctcagcttgctttctgattcttgttttggatccacaacctgtgtgtgtgtgtgtgtgtgtgtgtgtgtgtgtgtgtgtgtgtggtctgtcttgccagtggttttacagagcttagtgatacacaaagcacagccctttgtttatatacttggagtatttaagacaggggttcacctatcacaggcacatctacagttttctatataggtgaggctgaccttgaacttctgattttcttctttccaccttccctgtgcttggatcataggcgcacactgccatccagattatttcgtgttgcagatagagtttagagcaccatgcaagccatggaagcctgctatcaactgggttatagctgaaaactgcccccgatatgttcctgcatgctcatgaccttgtctcatgttcctattgcagtggtctgaggaagaggcctctctgattagactgagaaagcaacagataccaaactgaagacagatcagaatctgagctccgtgctccttcactccaaaccagctctaagttaagtttattctgagactgtcaagatgagcatttttattttgcacctttctttggaatggtatgctattttcttagactgcttcgaatgtttgcctgcctgggcgtatttattcattgccacctggtggtaaataagaaatattatgaggaacaggagaagagagaaggtgagaaaacagttgttagtgactcagaatggcagtctcagttcagaaaagcaaaatggagttagtcactaaaacatggcaacacgataaagcctgtttgctttggccaggatagacagcagggaatacaggaggccctgtgcttttaggatgctcaattcagggcaaaggtggagttgtagaaccttccctatatttttctaagaacaaagtggaaccacagactctgtatctaataataaagagcaacagtgggaccacatatggcacttttaaatatgattacacaaagaaaagatgattgcaaatgagctaaacacaatgccagccagataggctttcaaaacaggttagtcaatttgagatcacatttcttttctaggcccacttaaataccttgtgattaatttttatttttattttgttctacccttctttttgtttttctggtacaggtgggaggaagtgatctcccctagcagcccacctccctcagcacacaaagcttgtctactgttggctcagacagaacgtacctggtgtctgtgcagccagtggccgtctctctctaagttgtcctgttagccacactggagtctctccttttagctcatgcagatgaacacagagattgggattttctgtaaagattgtcaggggaagctgcacttgggggtctttttcctcccctccactgtgttccagggaacttgtgggagtttccacgttttttgggggaaatagtgggtgcttcataacttgctcttttttcttccagttgctagcactacctcaggctggtatgtaggtcatcatgtttggcctcaccctaagaagacatttcttcacctgctaccaccaacactcccctcagacagacctgtacctgcaggaagagagatgatggctgttcggggtgggagaaggggcaaggcagagcacagagggcagaaaacaaaaatcagaagaaaattacaatggggagatggaaattttggattatgattttcaacgtaagcaagaagagtgagtaatttcagcagatgtgactcatgttgatttctatccctttcttcctccaaatgactaagaaacacacatacttggaagattttaatgaaattatgagagttaggtgagtttgattcttgttcgtggaggacaaagtccaaaagttaattgaaagaagaaaatgaatttttacttttaggaggtgtcaccattggtaagcatcataagaacataatttggcttttgtgtgtgtgtgtgtgtgtgtgtgtatgtatgtgtagccctcactccatttgctgccttttcttattttccccctgagattttgtcaaaactacatttgaatctgttccaaggagtcagatatttgtaccagatctattttgaaaaaacaaaacaaaacaaacaaacaaacaaacaaaaacaaaaagaaaagaaaagaaagaaaaaacaaaacaaaagagtctctgagaaccttgattcttgctctcatcatcttcccctttccccttttaagaggaagccgttttgacgtcttttaacctgtgtgtgcacatacatgcttgtgaacatgcatgtgtgtgtatgtgtgtgtatgtatgtatgtacttgtgtgggtgtgcatttttgtgtatgcaaattatacactcgtgctatttttgatttttcagttatgagcatgctttccactgttgaaaatgaaactctagttttttttctcacctccagtcctggtccactcttcctaaatcccactatttactatagttctaatgtttttaaaatacgtagctctgacagtggaaatgctctttatattgaacgcatggttcaaactaagactgcttctccccttctgtacacagttttccttccagcttaacaattgcttgtttgtatttcacccttaaacctgtgtcactggtgtaaatctttctca

SEQ ID NO: 444 - DNA, 4150 bp, Mus musculus
aaactttattttcagtatctaatttgtgacatatagaaatggaatcctactgatattttgacatacatcctattacactgaaataagcaattcctgttttgtgtgccatataacttttcagtagttcttgactttattttacttccctggagtactgctaaagccattggcatccataaaattgttctagcaactatctgtcaaaacaagtggtcttggcttgacactatcatcaagtcatgagtatcagaaagccaagtcctgagctactgttggttgataaggagtagtgtttgttttcagtgtgtgatttcttgtttctcctctgtctggaagtctgaggtctcatcagaatccccaaagctgtgtgaccacccgtgtgtcctgcttcacagaagaacgcattcaggtaacagttattttaattgttccttttcagaaggcattcatttaaaaacatcttttttttttttttttagttagtttctctccaaaggcaagggcacaaattgaaatgacagaacattcaaggctcaacctcacacagccacttctgcaactttccaactttggtgctttttacattgctgctgccacctagtggcgactcgaaggcattctctcctcttcttccagcgcactaaactcggaggggcttagcaggcagcctgcagtcaaaccggtcctctaggcgctttagctgtgtttgagccagaaacaccatgtaacaagagaaagaaaaatagctgctacagaaatcaatgctaagtccttcctcaaagaggaggagagagtctgataaactctcttcgaggggtgtttaagaaaagtgaaactcagcagctgtcttggccttaaaacatgatgagagagcaggggctgccggggtcccattgctgcctttctcagacttctaatcacattccacagtgagcagagagcattatgcaccaatggtacttactagctaactgagccaacattgttggaaatggttagacaaaaccgagcaaaattctgaaaatttttaaggatagaatttcgattcattaaatttctgaatgagtacatagccatcgccatgaaggaagtgttagaaaatgtaggtcagaatgaatgcaaggtcaaaaaccggacacattttagatgccacagagagcagacggaatattctcagaatttgattgtcccccacctttttggtgtgttttcgattgattgatggttgttactgttgttggttggttggtgctgaaagatgctaaaatatctttgttcgcgtttgttcaaaggctgtcgtcctcaaaggaactggacgaatgcttgacttgtggaaataataaggtcgacactttgtttcttttatttaatttcaattacttgattacgacatacccatgggtctggtgttttgtcacaagacaccttggacaaaactgcaactgcactggaaacattttaaaatttctgacatcttgtagcacattggaggaaaagccaagatgctcataaagcaaagaatctcccaaaattgtaatcgggaacaatgtgagcaccaggaagtagaagtgtcttccagtttcaactcattactaattgacagcctgtggccagaatctactctactaattgaacagattatttcaaaagaatgcctgatgggctgcgatgtatgtagccagtctaatctgctgaagagagggatgatggccacaagtaaggggcactgtagctgctattatatttgtaaaatagaaaaataaaattttctttcctatatcaagttattgttagatctgctaattgttctatggatgggaacttctgcttaaagagtcagaattgctctccatagaaatatttagaacctcagaaccaaaacacagagctggttagaagaggagagagaaagcaatcaggcggctctcttatgctcataaggacgtgtgaagtgtccagggaacatgactcggctcgacatctttttgtgaatggtgatacgttatgtgtggggtcagaggtgtgctatggcaggtagggattgagggatgctgggagaatctggaagctaattctgctttggttgtagaatatgcacctcagtcccttgtcctatgctctgaaaccaaacacgcaccagtgtgggagaaaagggaccttggaggggatgttgtaaggtctccatgggttaacgcattcaggctcgcctgaagccagtcagagaaacacagcctaccctgtgttctccaaacagatgactatgcgcaagaggaagatatgggggttgcaggaagagaggggaagtcatggaagaagatgagataagaagcagaggagagagaacaggaagggaggaacaggaggacaagaaagggagataggaaagggcagaggagaagaaagaggaaggcagggtaagaagggggtttgctcccttggctttctttgtgattaagatgtaattacccaggctccagattctgcggccagaccacacatttttggccttttgaagttcattcctctagaacaaaagccaaagtaaacaacctcttctacaagttgcctttggtcatgatatttcgccagagccactgaaaagtcataaatacagaaagcaatgactctcaaaggtcaatggtgaatttaaatgatacagtgatgctctgctggaagacagagaccgtgatcatcctggtatgtatttggcaatgtgagtagagagactagtccatactcagtacaatagccgcgggtgtgttacagctactaagtacacagtacaattgaatcgaatgtgtcagttatcaattccaactttcttcactcaagaacttaaactcctccttccacatgatacaaaatgaggacacagcagtacagaaaacagagagagtcttgtgagctcgctctctcgctctctctctctctctctctctctctctctctctctctcttgttttggtttttggttttttggtttttcaagacagggtttctcagtatagccctggctgtcctggaactcactttgtagaccaggcaggcctctctgatccctctcagatcaccacctaggaagattgctaatgatgacctaggtgtagtgtgtagcacaaatgtctccaaggttctgtctcacagtgagaaaatgtagagtaactgtctggatgtgtacgggtctcagtaggacagagggtggactgcttgcttggaacatagggagttactgagaagcggtgattcttatggaattaatccatcaccaagcaaatacagccttgctcctaagcagatcaaactgagctggtgcagagtggaaaagcctcagatatgctcatgggctctgcgtacctgtggtccattgcggagcacacctattgtagctattcaatgataattggcagggggtcttgtgatgggaaactgatttatcctatgaacgacagatgtctgaatatcctgcttactttgctttgggttgtttttttgctacaagaatttgatccagtggggggtgggggtgtggaggttgcagggggtgggggtggagaagggaactgaggctctggctttaggtcagacagcgaaggttagaaattaacactcgctccctgttacagaacaattgcaaggggtgtggggccatgttgctttctgcagattttgacattgtttaagcaagtagattttgacatgtttaagcaagcattaaaatactcttgagtacaagttaggaaaaaaaaaaatcaacacgcatgtacagtgttactaagtaatgaaacagcagagctccaaagctgttgttattcaaatgtgtgtctgaagacacaagcaaggtacagagcctgtcagtcagatgtgtgatcacacttcccatgcagctaagcgctgtgaatagataactgattttgttgtgtgtggggttttttttttccacaagtcatatagtaaatagatagaactaaaaaagtcaaatattaataaccaagaagtacagatccttaaatccccctctccccaaccagcaaaacccacagaaatttacactgaccaaagtaaatagaaaataaaagtcaagccacttaagcagttgacatttagggataaagccaagcacttatttttcctgtcttcaaatcaccagtat

SEQ ID NO: 445 - DNA, 2125 bp, Mus musculus
tcactccattattgtggtggtaaattttgctgtatatagtagtctaggttggcatctgtggcctctgtgagtctgtagaacatctgcccagatccttctggcttctcgagtccccagtgggaactcagatgtacttctaacaggtctgccttcatatgctacttgcccttctacccctctagcttttaatattcctcctttgttctgcacttttgctgttttgattagtatgtgccaaggacactttctattctggtcccatctgtttggtgttctataagcttcttatacctcaacaggtttcttctttttttaggttaggggaattttctgctatgattttgttgaaaatatttttgtgccttcagtgtctgcaattttctcttccatcttcgtgttcttttggtgaggcttgcctctgagttccttgttccagttcctacatttttaatttccagacttccctcagtttgagatttctttatggattctattttattaattttctttcactgtttgtttgtgcttgcatacacatacatttctctaaatgttttattcagttcctctttaaatacctctatcatttacataaaggctattttaaggctgctgtctttgcttctgttatgtgcaaatactcagggcctgcctaatgtggttgtcttgctgggcttcagtaaaaacatattgaccaggatgttactgactgtgtttttatgctagtggctgagcatctgggtttgggaaaattgacattctaggtgttgatatctggtcttgtccttgctgggtaggtgttttgtttcttggtttctattgcttcctctgtttctcaggagtactttgtggcctggcagaaaattcttcttgatcctgctaggtgtagccattgtatgaattctggatgcaatgtgttctagatattgggagctgacactcggtaatgaggatgtctagaaggtagaaagggctcaaggagtccataggagaaaggaaagcaggctgcttcaccaggatctgcttagtcccctggaaatgggggcagagagtgaagagaggccatagcaggcagtgtacttaggagctggggataagattgaattgattaaagcagacaggagggagagtggggctctgaatctcacctacctgcttcctttgctgtcctacttactgcaggctttgctagtaggaaagcagaatgagtggggagaaagtttgtggacagcatctagggaaagcagcagatctggagtaggaggctgaaacaggaggcccacagagatgacagtgagacagggggattggatttgaagaaggtgggcttctctagctgcagtagccagaaggtactcagggaatctattgtagttgggagctgggatacaacagtgaatggggcagggaaaattgaaggggaacatctagagatgagggcagcagtgtgagtagggaacttacagtgagtttgctatagagctgaagatgagaccaggggatttgatttggaggagggggaggggggaggtctgcagccagcctacttgttatcctggcctgcattttatatgtgttcttagagaatctaaatatttctagctaaattattcagtgagtgttttgcattcatctcttgttgttgaatagtaatgagagaatgctaacttgtattgtttttctgttaggacaggagagaaagccactggcagagtcactgagaaatgtcttctaaaagttatgaatctatagcttccttcatcaagcacgaggcaaatggtcctgatatgcatagtaattgcttctacacgatgtatatgggaccacagtgacacatggtgattgtgtgaatgacagagctgagcttgggagccaagatcacccagaaccaaatagcaaagtaacctgtcagtgaagaacttacattaaggagaagaaatcacagaaaactaagcaatccaattaaacaaactaatagcttcatagaaatgacatggtattgatattcatagtctctggaatctcatctcaccctatatattggtttgtattggatgtattttcctgaaatcactgccttagacagagcttcccatcaaccccttgttagcccttagctaacacc

SEQ ID NO: 446 - DNA, 1725 bp, Mus musculus
ttgtcttcttttttgatccttatggagtaataataaaaattatatctactcaaaggcatatatgatatgatcttcactgttctttgaccttttctggacaggtttataaactataagctagttgctataattaaactaattagcctgttcaccacttcctagttgtcctgtgtgggtacgtgtgtatgcatgtgtaagagtgtggtgagaatacttaagatgtccttgcatattagtattcaaatatttaatatggtattattaattatggttgtcaggttgaaaataatatatctagaacttttcattctgcataagtgaattttgtacccttaagcaatgtgtcccattcatttctttaaaactattatggtgtatttttacaaatgataaaattaacctcaaagcagttaagtatctttctgggtctgaacaaagaacattgatgtaatcttcttttctttacttcatagctgtagattgatctagagaatatattctgttttctaaagagctacatgtgttttacttattatttaaaaatcctagtagaccaaaagctggtttatggtagaaaaaaattatgtgtactggctggttttgtgtgtcaatttcagacaagctggaggtatcacagagaagggagcctcccttgaggaaatacctccatgagatccagctgtaaggcattttctcaattagtgatcacagggagatggcccagcccactgtggatggtgtcatccctgggctggtagtcttgagttctgtaagaaagcaagctgagcaaaccaggggaagcaagacagtaagtagcatcctctatggcctctgcatcagctcctgcccccaagttcatgccttatgtgagttcctgtcctgatttcctttggggatgaacagcaatgtggaagtggaagctgaataaaccctttcctccccaacttgcttcttggtcatgatgttttatgcaagaatagaaacccagactaagagaacgtggctttagcattctgctttaaacccgactaaaataatgtttgttacataacaagttctcaatatctccattttaatgaattcactaagaaatagaaataacatgctgaaatcattattcctttggaggatgatcacaccctctattctcgtatttgaatctccaccccactctcacctagcaaaaaagtaaaattaattcagcaaccacaaaggatcagaaaacaatccatgcaggggaatactctttcatcagttagccagtcagtttatgcattagggaaagataatggagtcttctacttaggttattacatttctatttatatctagatcccccacaagttatatggcattactagggctccttaatctcaggatctcaacttcatcatctccgtaacaaggacaacagcaatgataacatttaacaagattgttatattcaacaagatacttgaaagagaattctgtattaaatggttaataactgccatttggttgctttacttctgcaactacaacaacagggaaaatagtagaatcttagaacggatgccaaaggacagataataaatgggcgtggtgctgtactactctccctggtaaacataaactttggtatctgccagttgcactgtatgctaagtctaagttcatatacgttctaagtttgaaatccattcctaattctaataccacagaaaatatatataagaacacaga

SEQ ID NO: 447 - DNA, 2950 bp, Mus musculus
ataagctgggcttggtaattcggggtataccccaacttcaggagactgagacaggaagatcattaattaatttaaagccatcttggactatattgtgttcaaggtcagcctgagcaacttaaaaaagttttaaaatggccgggcctataccttaatgataaagttgcttgcctaggttcagttccagatagatagatagatagatagatagatagatagatagatagatagatagatagatagatagatagatagatagatagatgcccttgtagaatagggctaaagtagcaggcatctctgagagggatctcagatctagtgaagaaggcatgttgctgtaactggctcttgctctggaagacctgttgcctcaagctagctctgactctaatgagtgttctcagaatcttcaaggtttagtcctatagaactatctatagtccataactgtgggctgggaaaagcctggaacagccatgtgatggcagagaaaagcccacctcatgcatgtggccctaccctaactgcacacatactttgagaaaatccgatggcttgaccttcctgaccctgatgatactccaaagctgccttggccttcgtttgaggcaccagtgaaagtaggctggctatccctcacaagccagacatcccacccaaacactgggcagctgtcacatgagcttctgctcaggacacatctttagacacaggggtgttcctcttggtcttggtgcctgtgtagggcgagaggcaaaaatggtaagaaccaagtaggaagggctggacaggtgtctcggcaattaaaagcatgtactgttcttgcagaggatctgagttcagttcccagcacccagctaagacagctcacagcatctgtaaactccagccccagggctcctgtactgtcgtggccgtacccacacacagacacacgcacataattttaaagaacagtaaatccatctttgagcttggtgatggtgatacaagcctttaaagcccagcactgtggagggagaggcaggcagatctcttgagttcaagaccagcctggtccacaagtgccaggacagccagggctacacagcgagaccctgtcgtgaaaaaaacaatgctagcacatctttggaaatgagaagcaagggaatggttgggggaagcatggggtcagtccgggaatcctacgggcgcttgctttctctcttgagcccctcagggctgctcggaacaagtaccagtactcctgtctcagagcctctgcagtcaagggaactgcagccccaggactctgcacagctcttggggttgtctgccaaatcctcagagtggtggtgacttaggtgaccctgccgccccccagtaggcagtcatgcttttaccatggctttactttgcttggtccacagagaagagaatggatgcccagctcatttctttaccttctacagtgctcccagtaaggcctcaaggcagggcgctgtgcattcacaatgagcgcaatcggcagaggggcaagatgccaacccactctttgtaaaagggtctgaaatcatctccccatcgtaacagttgccttggttacatctgcacccaaggataagccttccatagttttccagatgaaattacgcctgagccttcccacttgttatttcctttctcttccaaggctagtttagacaaaggtcagggcagtcgccaggtaggcagcctctgctgcaggctccagcctgctgcgcctctctctgccacggctgttgagctgctggggagtccgtgttaagggtacacatgaaggagacactcatgtgcgaatgcactggcgtgttctgtctccgtccatgctggtcctgcatcagtacttgcaggcaagccccagaacgcccagacttctggacttgctctatgggtttggaaccatggattatataccttccctgtgcttttccagttttgcccccagttgttcattcccttcttgcctccctgctaaacagattaatacgcagacagcatttagcatggcattgggtccagcaaagtgtcagggctgttttgaggtcctcggagccttacaacagcccaggaggcagccagtgctgtacacgaaaacccagtcatgtcctggagtttcaagggtcttaagcccctggcttgagtggcttgagaaacttcccagggggagaagagaaagttggtctgacagatgaggaagggtttgctcatctctgactttgtcctgggaattccttgaactctggggtttgatgaccgacagggagatactggtacgtgaagtccctttgcagtgacatcatcttcctctctgctacacacacggccaccagagaaggcaggccgtggaggaaaggcctcaccagctgcctcccttcatttccgggcttgattattcgtacgtcctggggagagttagtcaaaaggaccccttttccttgcattagcccatggtgggaagcatcagggaggggcaagagtgctggagcctcaagagtggttattgatgtcctaattacaagaggatgctaatttaatttgaacctaattacagtgcactaccctgggtggcatgtgttttaataattaacgtccttcagatgcgtgggagtgtaataatatttacactaggttggccagcagcctggggaggcgggctgggggcccgtacaccaccctctacccggcagcttggctgctggcaggtgggggagatggcatagtagtcttggtcccctggtgtcttgtcatccttcccaggggatatgcttgggtcttgtttccagccacttccttgacccagcaggctgcttcacactgcagggtgccatgctggccttctgaaagccaccaggcttcagctccagcagtactcccataccacaccagcaaggctgctgatcctgccatccctgcctacttgagccct

SEQ ID NO: 448 - DNA, 1775 bp, Mus musculus
aactacctgagttctgaaatcatcacacctcagacacacacagattcgaatttcattgttctggctgtgcagcctggatgtgagtggttttcatagcaaacaagttctcaagataaaaaagatcccatgcctggaagactgttcagtatactgattaagaaagtgcttgctgtgtaagcatgaagacctgacttcagatcccaaacacattaagagctggtcatgtgactccagaactgtggagggagaatgggggataggcagatctgatcatgtggcattgctagccagactagctagtctcattttacacacacacacacacacacacaacacacacacacacacacacacacacacacacaaaaacactatttttgtggtgtaaacctgccatggcatatttcaagaaatgactatctgatgacccccacccactgagccctagtattctaatgtaatccttttctctcataagttcattacctggggtagaggtggtcacatctgtaagatacattaaaaagatacatttacctgggaccaggatgtttcaagtcccctgaacaggagtgagaaagagaagggtgtggttgtgactcacacagacacttccctgcacccctcttctttctccagccacagaggtcatcatccccttgcagtctcctgccaaagatacttggagtggttggcagagagcaaagagcaatgaaggaaagaaagggcttgtggctgccaggagctgtcaagaccccttcaggggaaacaacctcttagttgttcatctcctttcttatccatccggaaaaacccctcaatgctgaaagtggttggtcagatacccaagaggtcactgtttagcacattatccactttctctggcagtaagatcaacacccaccaagaaggctttcagacctgtgctggagctcagagagtgaggggggagcccacaggaagacagaagacagctgctgttagcagtgatgggctcttggacgttttgcttaagaccgagtctagacgctctttcttccaatggcatgtgttcaggaacatttacaactgctgctccatgataaccatgagaatgcagggttttaaaaagaaaagactgtgctaatagaaagaggaccaaggctaataaaagaagcaaggtttggtgattaaaatcacacagaaaatagcctggctcttcccacatacagctccagctgtgaaatctggcagcattcagagtgtatttcatagacatattttttttatactcgatccatttctaaaacactatataaatacgtgactgggatccagagaagcacaaaggccagctcaggctctatctgagagtcgccacggtaaagtgactgtgatatacaaagccatttggatggtctcatgagttaggcccctgggcaatatgagaattcagctatctcaggcagtgacaaagggatagaggaccttcatctaaacaaccccttccttttttatcagcaccaccaagtagagttgttaagctgtaaataaaaggtacatgcaattcagaagtgtgtctttgtccaattcactcaaaagcacacaagtggccaacaagggtctcagaatgagtctgtgttgccaagagcacagggccaagcatacctgggtcccaacccccactctgtactgatggagcttgagtagaaagagcagaagatgttgtaaaggaaagggaggtatgcactcaggtaaacaaagaaaatgatcaagtatttagggcttcagccatt

SEQ ID NO: 449 - DNA, 2250 bp, Mus musculus
ttccaatttcaggaaataaaagtaataattacattatatatatatatatatatatatatatatatatatatatatatatatataatgttagaaaacataattaaaacacttggaataattatttccctcctatgtcaaacattactacctcttacataatgtagagcattttaaagatgccttttaaaaaatttaatctggtgttgtaaaagtttgaaacaagcttcaaaattgattgaaggtttatcatggagaacttcctactgccaataagtaattactttaaacatctttaaagtggaattccacatagctattaaaatgcaatatgcggttgcttgtgctatacttatgattcgtgtttattaagatgataatgtgtgaattccatgagtagagaacaacacatgttgtaaagttgcatgcatgtacactccttcatgcacatgtatgtagagtcatccatataatatggggcattttttccttttgaatacttttacaaattctttgcattttaatgaacaatttaaaaaattatcttttatttttattattttatttaactttttaaaaattgtatgtgtatggatgctttttgtctgtgtgccatatgatgcatgtcaagtgtccaccaagacctgcaaagggcatagcatctcctagaaagagttacaggtacctgtgaggtgccatgtgggtgctgagactcaaactcaggtcatctagaagagctgcatgtgcattaaatcggtctctccagcccaaattttactctttattataaaacgtggcttatcaagtaaatggcactggacttgttttttgttttttgttttttgtttttaagaatagcagggttgaaactgttccgaggtcctgtctcagacaaaaacaagggctactcttaaatatctaagagtctctgtggtggttgaggattggattcactgtaagaatcttattatcaaatcactcttgtgttctcaattgcacagctgggaggaaacctgggcatgttatgctgagcagtcgcagctgtagcctcaggaaagctacagctgctctctcagtgttcctgaccacctgcttgaccttcagtagcaagtgctaattaatgtgctaaacaacaccccaggctcaatcaggtataccgtgggctgaagaaagaccaaagaaactcttgtcttctctatggtaagtgtagatgtcattttccccaaaactggaactgaagaaagcaaaggtagattgcccttcattttctcttgagggctctaaaactgccagtgtccagtcagttactgacacctttacatttctagccaaaggcaaggtggcaaaaatgcttcaggttcctatgagagacttacaaaggtggccaccatactaggaccatgtgcttaagcacccatctctatgaccttcactctctacaaaccttgaggtctacagtcaaaaactaggattccccacaagcctgagaaaccttggtcttccctaaacagttacagtaagtaaacatgaatgctatttcttatgtctgttgtcatggatagaaactgttctatttagagtctatgggtggggaatttttatacagtgcaatcatcttccaaaacaacaaaaaatgatcatccaaatgtgaagtaaaacaatcttcttaaagtttgaaaaattaagaaagtagtcctttggtctgtccctgtcaaaatgattcagttacttcaatatttaatttacatgcacacttatgcattttgacaaagctgtcatctataattccattttccattcctcttctcaaagcataacaaaccatgaaatatcttcccacacttccttttgtgtcttaatttgtgtttttatggccaagtgaggtttatttcaatagtgcaaacatttaataagtacatttattttgttacactgatagaaaatggagagaataaaaattatatgaaaatgttaatgggccttagtgacaagcatcttttgtgatactaagctttaaacagggtttgtgtctaataagatacatgggagaaggtatatggactaggaaatcctgggctattttggaattctatttacctgaggtatctataaaataaaacagctttattctaaatactagaagggaaaacatagatgtttacttccacagacttaatttaaaacactaatttatactgaattcagtggtattaaaaatgataaacaagtaaagttacatagatttaatttaaa

SEQ ID NO: 450 - DNA, 2125 bp, Mus musculus
cagacaatatgacaattaccagaagagagcagacacccagaatgtctaccatccagctggctgcccagaactaacacccagacacaattagcaaacaaatgtctgtctgcaagttccatcgatgaagagatgtctaatacagatttttcaaggaagtaagaatttatagcagaaaaggaggaaatgcacagagggcagagtggccacaggaaggtaagcagagctgaaacctgtgtaaatagacaagcaggtattaaaaaagacaagaaactgtagccacatggggtactgagtatcacatctctggagatgtttgtggcctgccttcttcaggagtccagccaactctgctcatccctaggtcttggaacttggggaccaagaacctggggggagagagagagagagagagagagagagagagagagagagagagagagagagagagagagagagagagagagagagagagaacatgaacaaactactgaagagtgagtcccttcatctctctgccagtactgagcatcagtgtctcatttccaaagtgctgtggggagcatatctcttaccaaagaactcccccctacctgccaggaaagataatgctgtcatgtttctttagaagtgttcaatttcagtagtaaaacaaacccagcaattctcctgctgtgcaagcaaaattgaaagtatttatgtgtggtgagtcttgcctgcctgatgaaaagaggagcagaatgaatatatacatgctccttccctgctcctttattacctggagaccagagatagacttgagcctgcctgcctgccttctgcagcctccattgcagcaagatgctacattttgtcagagggaatatccaccaaaaatcaggttggtgtgagtacctcgagctcacctgcttggaagtcagagagggttatagctgggcagtgtgagctgggatgtgtctctctgtaccaagccctgggcaactgttcccattgctgaagcccagccacctgcacccaccctgtctacactcttagactgagtgttgaggttgaggctgcttcagatctgagtccatcatagtggcaagcgacagtctgtgcacaccgaggggcatgcagacagaatgcatgcacagctgggcctggtatcagcatacctaggaagataggcatgctcactctgcctgcacatgcagccagcttcagactctgacactgaattggaattttaaccagggtgtgtatgtgtgcacacatacatcacacttgtgttgttctgtccaggggtaccaaattatcatcatgatcacagacagaactaatcaataactctcagtcatatgatgtccattcagatcaagcacatgctttccgtgtgacaagaaaacaaatactgatggcattctctagaggacaactgacagttgtttgaaataggggaggaacaaagctacttaaacacattcctagggctattttcaaggggttagaggtggtcccacaccccacctgatagccaaagattctcaaattcctgctttctggagtagataggagctagctcacagatagcacacagataacccagggctaggccctgtgtcccatggaatgaagacagtaaggtttctgagctaccctttgagttgctgtaaagatcagacagaaccttgttcctagaaatacacaaagacttgagttaccaatgtgagtgaaggactggtcaaatacaacaatgtgttgttgaagcagagtatgccagccaggcacccagctctatgaatggctacttaatctgcatagcaccatattccctgaaccttaagcaatgggcctttcagtcagcctatagagacctcccttttttcttgacccatttcactgagattttctacagaattctcctatggcttccccaaaagagcatgtatggctggctttggacccaggctcattgggttggggagggctctaaaaggtcctgaagctcttatcaaataagatgtgctcagaaaaaagtgttcttgctctgaagaagccatagagtatactccccagcctagcctctttgtatccccactagcagaaccaaaagagtaaaaagtaggtacacataaccacttgctga

SEQ ID NO: 451 - DNA, 2075 bp, Mus musculus
ggaaagtgcaaggagtatatggaccacactaggaaatctgtatttcataagcagaaattataccgcaggaattacctgaggaaggggagaatgcaagagcaatctcatttcaataaaggctacagcactctggtgtactgaatatttatcttactgaacaactttttttttttttttcctgaacaacttttgaaaggagaaaatatagtgaaagtactgaggtaaggagcctgaactctggaaaaattcccctttgacaatttcgtagtctagaactgtcacgaacagaatagagagttaccatcaaatcaattcaaatctttctgtttagttttcatatcaagaggctaattaataagggtgcctttctcaatatgcttcatttattgagtctatattcattcaataaatattcgttgtttatctctatactggcatcgtttatgctgagactacaaaaacagacaaggcagacaattcttacccttaaaggtttagaaatgcctgggagacaagttctttcttacataaatcaaatattcttattactgaggcctaggcaaacatggttattatataaaattagccttataaaaaagaattattggaaacaatgaattttccaaatattcttcccttatcaaagtattaatgttaaattttgaaaatataccaatttcttcagcacagattacaaactatcacttcaccacattatcaatagtttttttcattctcacagttcagtttaacaagttacttcggctgcattcagtgctgtacttgttagctgtatgtcaacttgacagaagccagtcatctgagaggagggaatcccaactgagaaaatgccttcctaaaatcagattataggcaagcctgtagggcatttccttaatagatatagaagtgcccggtggtggatagcccaggggttgcttgtattttgatgctaattccactctccagggagaatggagtcttgtatactggtgacttcttgtcacctatcccctaatgagtaaaggagaaaatcactgggtaagtaggggagacttccgggctggacggaagaagaggagggggaggtgagagagggcccaggggggatggctggtcagccctacagggcagagttgcaggcacaatctcgggaacgagccagttcttttttaatatttcctgcacaaggcccagcccattgtaggtggtgccaccccctgacttggtactggatgctataaaaagagcaggctgaaaatgaaaattttgttttttcaagggagtttcattgagggaaacaaacttctcttaaggatatgctgcaagcctggcagtagatgagcaacagaaaacaaaagcaaaacaaaaacctcaatagcactgagttttctggaagttccttgtctctatagcaacagtgccctcaccacttaatttttaaaaatttgtatttcattttatttatattttctctctttttaccgtactgatcctttgcatatatatcatggcttcgggtttagtgttcgaataaatgggtctctgaatttttaggtttttttttttctccttttgggggctcttttctttctgtctgtctgttttgttttttttttaaaattttgatgtgttagttcttgttttatattattatattattattccttgagaagcctatatgttttctactgagagacagaaagggagtggcttcagatgagggggaaagtggggaggatctgggaggagtagagggcggggtgactgttatcaggatagattatatgaaaaataaatctatttttaataaaagggggaaaaataaaaggaagcaggctgagcaggccatgaggaacaagccagtaagcagcactccttcatggcgtgtctctgcatcagctcctgcctccacattcttgttcacttgagttcctgccttggcttccctcaacgggctgtgattcaggatacagagggcaaatacactcttacctcttcaagtttcttagtcatggtgtttcatcatagtcatagtaatcctaactgtcaaatatgactgctctctaatatcc

SEQ ID NO: 452 - DNA, 2450 bp, Mus musculus
tgttagtacgtaccatgtactgaccatggtagacatcactgacactctctggttaggtcttctagcttctttgttttccccatggatgctatgccttgtgcccaccccaaccccaaggctgtcacgcatccgactgaagcctctttaaaaggagtgggcatcttctagttcttatttgcatgaaaaaatgctattgtttttacagccttggctgatagtttgattgggatgtgaattctaaattgaaattgtcaattttgaaagcatcaatcagttgttttctagataacggcagacacaatatctcttaacttctttgtggggaacctatccatcttataaatttagcaccatcaagttcagactgtcttttcctgtgttcagtggggttagagatctttctttttgacactccctttccacttgctgaagttggagtttccttttctctcttcagtcagaaccccttctgcctgctctgctccaaaatgtgtcaaaatctttatcttgaagtcctcggtcccacctcttcccaagaaactattgaaaatgatagctgctgggagaggaaatgccagttttcatgaatggagtgacacaggtgtatcaaccacaccccagggcaggtcccatgcttcagtgtaggctcacacaaaacaaactctaattccagttgttgattgttgttggtggtaggcttgtgtgtgtgtgtgtgtgtgtgtgtgtgtatcttttcccttttttcccattttaatctttaagagaaagaatatgaagttgggtggagagggaggaaggaggatcagggaggtattggaggacagaaaatgctaaaaccatagtgtagagaatcctaaaacaaacaaaaactccatctcatctcagagcagctgctgccatcgctctgtccccagcacacgggtgctgtccggctgccctgcttcagttggtgttagagctcttccttggctttaagtttctctcgagtacacattatgcttgtgccatctgccccagtggtcggttctctgtttttctgatgctttagcagggtcaggcagaaatatagaacatatacttaagtactggggagagagacttctagaagagtgcgcatccaggagggcagaactgagatttgccgggctgtcagatggcctggatgttcccactctctttaccttatgactgatgcccaagggacactgccagtcacatagacagttcccagaggactgtgctgctcttggtgaccttcagaagtggatggaggaagcacaggagggcttccttttctgctgtttttttcctgtcagctttgagctcccagagtccattggaaggaagtgcctggcaccctacagaagggtgggcagtggtttgtctagcctcagaccctttcccatattgatgacctcaagagctctggcagcccttgactttggtgggtctcagctctctctgctgcagaagggaaaagctaaagattgcctctggcctttgcactagactgttgtgaagtttagggacagatgtatgtgctaagaccacatactgattttttttttcccttcagaacaaaaaatcaaactctcagcttttaaatgaacttctgcctcaaatggacacagattggtatagctaattgcaagtatcacacactaaaaagcaatgagcatccccccaaaccctgttcaacactgaggggccattgttccctagaccgttgaccttcctaaggggaggactcctggttgttttgttcttagagctgtccacagttgttaaagtgaaagctggttaaatattatttgttttctttctttaacatctagcacgttgccaggaaaataataaatgtttgttgagttgaatgctgagcatatggcattgtaagtattgtgaatgtttgcagttgcaacatcagcaaggtaagaacgtacgcattgtatttattttccctaagggggtgggggggatactatgtgagatgaaaaccttccaaagaagattacaaagccgttttcactactcatcactttcttcgtcctcagaattccaattctggttctccccggtcaccagagaaatacacggaagcttccgggattacagaggctatttgccctctttctctttttctgatttttctatatgagggtttgttggaagttaaccaaggataaaagaaatatcggaagccccctattgggacactaattagttatttcttgtccaagaaatgattaaaaaaaattcttctgagagagcgtttgtgtttgatttgaaagataatccctctcctgtctcaacctcagttttgatagctgacattctcaggtgtctccaattagcttgagaggggttaagacatttaaagcaatactcaaagaaaaattaattttcacttgctccgacttaagcagatattcctacatctcttcaggagg

SEQ ID NO: 453 - DNA, 2375 bp, Mus musculus
tttagacattcttggatgtgacaggagtgatctgccccatcatcactgtcagatgggggaagatagtgtcccatgacccactggctgtccaaaatgacactgcccaacctctgagagaatcctctgatatttgatgcccatgggaggacctccagtctcccatgctttggccatgggagccaaagcatgctttgggtagaccagtacagaagatgtgcaaccctaagcagccattcagcaaggagtcagagtcctctgtggtctatagtactactgggtttgccctatgattgatctgcattgcacattggtgcaaataatcaggccaactctggaggctgagagcgctttgaaagtgatgggatttttaatgaaatttacttaaatctaaattacaaatgatcacaggtagagaggctgagggatactcgaagacaccggactgtagagagagtccttgaaatgtttgcttattacaattatcactgtcctttttttctgaggatcttctgaactttctttggggtctaacctcaggaagaattattgctcattatttctttctatcccattctccccccttcctctctctccatgttcgatcccctaccctctacatttgctctccttccttttctaagtaagatgaatacttggtcaggtttctcctttgttgttgcctgggcacttacagctaaattagttcacattaacacatgagtcgagtccacatgcgtaagtgaatagaaagtctgtgctgcacattttaatgtctgcctctttgcttcccttttgatgcctcttcatctccccttctcccttgtgctctcagtcatttgtagtttgcactaccttgatgagcttttggtattcttttcatcaaccttcagtcctttctgaaatgcagcaggatgcagatggatagctagcagtctacccgtctctgtcctgaaatactgaaacgaggcgatggaacacagtgcgtagccaatgtgttctcttctaaacctcacgagccactggttcagtcttcgattgcacagtgaggagccatttgaggcttttgggggatgtcctcttccttccccgcctgacctgaacaagagtcacacctcctctgtgcactgatacccctttgcaaatgtctggccccaacacacctgtgaatcacttccctgtgccttggctgcctgtcagggaagcctgaatagttggatcatttaaggaatccagctgttccattattatctttgcacgctcttgtgctccacttacttcttcatggtgtttaccttaaagcctctcaagatcgttttcctatggaaaggcaaacagattcagaatcttgcctacttatcgcagtctctgagcgggaaatgatcttcccgagcagcggattcatcttttcttgtttgtttctccctcagacctatctcaaaagtcctttcacatattggcagtttttgagcctgtggcccatctgcccttctgacagattgcccagcctcctgatggaagacggtgtgcctttgggcttgggggccctccctgtactcccagctgtctggtccacgctcttgttctgagtcagctgttggggtgcctgtgtggcctcctttagatgtctcccctttcccttctctaagattatatctgatcattctgctgaaatggtacctttcatcttctttcttgtgcaaatatttacttgtagacatgacattctgtttctgcttctcaccagtaaaggtttttgcttatttttctaagcctaggtgcccactttggacccaacactgtctttattctttgttgcagctttagttttgattgctgacgccttacccagttcttacacagataagtagtttgtctgtaaagaaaagaaaaaagagatttttaaattttaattaattaattaatttatatgagtacactgttactgtcttcagacacacaagaagagagcattggatcccattatagatgattgtggtcttccatgtaggtactgggaattgaactcaggacctctggaagagtggtcagtactcttaatcactgagccatctctccagtccccactgcccccaaagagattttaaattaaagaactaagagctagaaagaatcctctttttcttaccctgcccccaaagcctgttacatttgtcttcatcttttcacatttgcacacacccctggctgcacacacccctggctgcacacacccctggctgcacacacccctggctgcacacacccctggctgcacacactctaggctgcacacatccctggctgcacacatcccttgctgtcctgtttttctgtcatttgttccctacctacttcttctgttgcctttggagctg

SEQ ID NO: 454 - DNA, 3025 bp, Mus musculus
ggctcagtgctctgtgcttaccttcccagatccctactactagatatttcattttattatcactttcttttaaaagatttatttttacttatatgtgtgaatgttttgtttgcaggtgtattggtacaccgatgtccatgtatcgccatggaggtgagaaggagggcacaggattccctggaactggagttacaaacagttatgagctattgtgtgggtgctgggagttgaacctgggtcctctggaagagccactagtgctcttaaccactgagccatctctccagccccactgtattctctttatggcaccattttggttgtatttccattatttcttctcaaatcctcttccctctccgcatgcctccccatggacattcctccttttctccttcacttctgttctcttcaaagaactcagatgccccccatttccactcacactttgtactaatggagcctagatgatattctgggctcacctctgctttattttcactctggagccttcacagtccagcctacagcatactctgccactcttgtgtgacagtttataatctgttttatggaccttaaaactattcagtctctttgcccccttaaggaagattgctgacactaaattgaatccaaagggtttggatggtggctcctctcctttacgggcagttgcttatttatgtccctttattgtgcggtggttgatttgtgttgctgagattctgggccttgttcccagacaggagaccacatggcatcagagggaaggggaaaccacctgacctaagtaagacccagcgggcttgcagtgggggtagctggggaggggggagaagaaaccacttcctactcttctgtgaagcgaagctgtgaactttttttttttttttttacaaagctattccttccctggttcagcaagtactttctgagatcctgttaggaaccagacacaatgctagttcaaacgttctgctcaagtcaggagctctgacttggcagtgtcctggtaattacagaatccatctctagctccaggctggggtgagcacccaacctcacctcatgtggttgaaggaacggactgacagattccagagcggcagtggctttcagcggagaactgtggataggggtcaactgaggggaaggcagaggggacaggatgacaggcagaggacccgtgagcacaaaccccttaagggacaggtagactgggcgtaggtgaggatgtgaagcccactgagacctgactggtgccatgttccctctgggaaggaataggaatgttgaaaagcattttaaaaagaagaaaaagaaaagcctctgaaatactattaagccactcttcagaacgggtatcataccatatttacccattttaagcttttctgaaatatacatatagtaaagtacctgaagtgtatttatctgaagtgtctatctccttggattcctttttttaaatgtaaataaactctatgcttatcaagatagtggttcctttttaacttagcatcccatcaaaacaatcttgcactttaagtactttagaatatggtatttaccaactgaatgctgttctgccatagatacctcttcaagtctttagttgtgcacttcttttgttttgttttaccctgtagtactgttcgtggagtgatattgtgtataaatattggcacgtgcccagttatcttcctagtggtcctagagcacagcgaggctgtagacttgtagtaccagatctttatgatgctggtaaccccactccctgctgtgggtgagaattcctgaatcccctgtctgatctttcctgttaaactcatcaggaggtgttagctgtggagggctaggctgacctgcaggtccaggctccctcctgcaggtgggctagtaccaggaacaaggcctaaacctttgcttactctctccccatttgtcacttaaacagatttacttaaagcagttaacattcctgaggctggagagatggctctggctaacagaaattgttgatctggctgaggagctgaatttggttcccagaatatacttagagcagcttataactccagctttgggggacctaacactcatttcccataaggaacagtgtttagatttgttgttgttgttgttaaattaataaagctgcagtttcataattgatactgcctagaaattttctctaaaattttctgcaccctgtctgtatctgtctctttttcctctgtctgtctgtctgtctgtctgtctgtctgtctctctctctctctctctcaagtgtgtgtatgaaaagaaagagcaaatgagggagggtcaccacagagaaagtaaggttccacccatccctcccgctctgtctttgcctcaaaactgcagcttcatgcaggggttctagctgtttaaaatggccggtctcctgtttacttccttgctcctatgtctgagcaaatggagaattccgaggaaggtgctttgctttctccctgggcaagagcactgagcagagcggcacttctaccaggcgtcactaatggagcttgctctctgcagactggctgtaagcccaggttgacggaaattcgcttcagacaaatacgttctgccaccttctctcctggggacagatatggcacgctcccagggggtcattccatctgtcccctggagtcaggatgacttcctacatcatcttcacaatgattatattttaatatgacttttaaataaaggaagcacacttggcaagtggagacgtcttctatgagttggaaggctaatgtaatcttacagcttggaggaaacaaaactaatactactactagtactagtagtagtagtagtactactactactactactactaaagaaacttcaaattgcagaccaaaagggatacacctctgttttctttgcttttctttcttccaccaggaggccaacttcagttgctccacatgtgagtaagttcacacacaagtctaagggaaggatgctgttgccttaggcatgg

SEQ ID NO: 455 - DNA, 3600 bp, Mus musculus
gagtggcacattggagattagggtttatcctgaaagcaatgaggggccactggaggatcttaaatggtagagtggcaagatgaggtatgccctggacatttactctcaacagatactccaagctggaaggagtctacctactttgttaaaataaaatgtctgacagaaggtccaaggtcacccatcagactatcaaccatcagactaccacacagctcatcagactaccaaccattagactaccatgtaatactgctaagaacgatggctcagtgtctgcaagggaaatggggcactccagatgcccaataagaaaaggtaaaggaaactttccaatgttttattattaataataataataataataataataagtctatagagtgccccagtatgggagatgacatgttgattgttttgctctgtgtccttgggaaaattacttcacttctctgtgctgtttccccttctgtgaaatgagcaccaaagtgggttattgtgagaactgcatgggccagtttgagtaaaatgccactgagtacattttaagtgtaccatatactctgcttccccaggatagttgatacggctgactatttctgtctcctctttggtctttgtaattagcctgtttttgtttttttgttttttgttttccaagaaagagaacagcaagggtcctcccttccacaaacacgagtgcttgtgcagttctgacgaccgaccatctttgtctttttcctgagaagtaatttcatggctcatgcacttgagattccatcaggaaagctgggccctctatcaagcagatgatcggcctgctgggcattcattggcaaatcacagttctgttaattaactcaatgtgggattccagctctcagctcctttcaaagcaccctctctcgcttggggtttgagttgtggcctctcttctccttggctccctggggaaaagtgtgcctcaggctgcccctttgtccttgtcctctctaagctctacagcccagagacccaagccttgtctgctatgttgtcatcctaacatcccctttgcctacttgctgggaagtttcctgctttctccctgttgtgaaaagggacatgtatttctattctgagcattttgctttgacttggcttgcctgctaggttcagctagatggggctatgcatgaatatgtctctgcacactagtgcccagcctggagcagccctgcttggctagtgtacatccaagcaactccatgaccaaccccaggggaccactcacagtcagagatgctcacctccatgtcttatccttccactgcttccctgtgtcgttggattgagacttcctccttccctcccttctccctctttgcttctgtcatgggtgcacatgtataaatgtgcccatatgtgtgcaggtacacaagtgtgttcatatgtgtataggctaagagtattaactcagacatcaatcttagaaagcagtccaccacattgaggcaggatctttcattgtcctggaaagcatcaattaggctaaataggacagcagagaccccacaagggtcctcttgagtattcatctccccaaagtcacacacatacagagagagacagacagacagacagagacagacagacacagacagacagagacagagagaaacacacagacagacagacagacagacacacacacacatatattcattcacacacacactggccatgttcatggttctcaagagacctaaaatatagtaggctcagacaggtgaggtaacttgaaaagttctcaccagaggaaacttgaaatgttctaaccttgactgtctgaacttatttttggtgactgatgccaggccctctgtggttgttgctacaactgtctgacattaaaagtaagccacaatacccatggaattttatacataaaaagatcaatatgatgagttctacatgtgtcttaccacaatgtaaaagaagggggaaggggaggatagtctaacacattccacaacacagacgaaccttgaaaacagtaagtaaaacaagctagaccccagatccctcatgaagcatctaagtatctgagttctcaaatggatggagatagacagtgaaatgtgcactgatagagactggagaatggggattgaactatctgactttaaaagctactcccttctaaattccatttatgtgtaaacactagtctcaaaggaggataagaagaaaccaccatgaaaaaaattaagcaaaagtgaatcaataaaaataaatggagggaaaaatgtaagatctataattttagagctcaggaggatgagacatgaagatggtcatgagtttgagaccagcctagacaatatagcaaattggaggcaagccagggctatctcaaaagactgtctcaaatcaccaatacaataataactattttaaagttctgtttactgattcagccatcctcttagccttagggtatacacatggcctaagtacaacgtaggctattcatgaaatcatcatgtttaatacattgcatttaaaagggtaactcggacagcttgcctgttcgttcagcatgtttatgagctgtttgggagtcagagtgcttggcaatgaacagaataatcagtgtaaatgcactaattgcattgggctttaaaaggtctatactcttcttttaggagagaagcctgtgagcctaggacccagcagttctctattcttataggtttggatgatgtttgacttaggttgtaaagagaaggtggggccatcatatctcaatggcgtactctgatgcaaacatgggtttgcatcatgtaggaatccctgtccttagcaaaactcctccttgggtcacaagttttccaaggctgtcccaatgttacttggatttcagatgagcttgtctgatccaccctcattgtgtgcgcttcttgttcctgtatccccagtggccatctgatgaaatcagcttgtcctttatttataagaaacaatatctccaagctgtctttgaaacacactgttgttacagtgattaaatgatagaaatgtgaagtccttccaaccacagcacatggtcaatactgcttaaatgatgtcattgctttgtagctgggtacaatgttgtgctccgaggatacagaggagacatgcagagccatgttttctatagaagtcctgttcagagataaattgcccataagcctgctctactgtgccctggaataaagacaagtatccaaacagtgtgacagtcctttatagttctgcctgagaatggtgagcccaggacatctacagcagctggaactggtagaccatacaatccatgctgtttattgacacttacggacatcattctgcaaaacgttgggtttttatttgttctgagccatttactaaagagtatgtggatagattcagatggctgaatggaaaaaaaaaactcttttgttttgtttttcccagtgatgtggggtgattggtgtctcagagtcaagcttaccccgggcccagttacctgaatggttctcctttgtagctatctgccacgggccatgttaggatcccccccttttttatgtgtgt

SEQ ID NO: 456 - DNA, 2425 bp, Mus musculus
tacacatgtatgcacacacccatacactcatattacacacgtacatacctgtacctataggcataagcatacaacacaacaaaattttttaagtatagaagaatatttggaaccaaaattccaatgattgaattactggatactctaagtgaagcaattcatcaaacacactgggcaagttctacatattaagtaatttaactttttgtactattccatttcttgcctagatatgtgtttctctgagttataaatatacacacacacacatatatcttataaataatgtataatttataaatataggtatttacaatttatgaaatatatattttagcaggaccaaaatagaggctaaagaattttcttcacaacttcttctctgttcttctataaagatggtctacattgggcatttctgactatttctgagttaaagagagggtacctcacacactgtgcaataaccaccaacaaactgttaaatgggtgttcaaaccagaggaaactattaattaagcagggcagcgttgtctggccaggaagctggaggaggatggagttggtaggtgggatctagttttccagagaagatctagccgagactggcacaacctcatatggatacaagcagccatcgtaatgaatcaccagggatatctgaaggcttggaaacaggataacacatggacagaccatgtggcacaggagcacatgacgacacttctcatttctgactccctccctgaaagtgccctaggcacacggatttacaggaggagttggaatccctagcctatgcttatagcatcaagtgccttcccacagccttccataatttctgcaagtctttgttcctctctaccctgagtcagggtgaaggctctgccatcttttgtctagacttgcactgaagtcccttgctgaccaccctgactctactatggctattccatgaccagttttgaacagagcagttagcacgaatcttgttttttaactgttattacattgtgtgtgtgtgtgtgtgtgtgtgtgtgtgtgtgtgtgtgtgtgtgtgtacacgcgggtgcctgctatgacacagacatagagtccagaggacactccttgagatttggttctctccaacaccatgtggaccccaaggatcagactcaggttgtgagacatggttgcatgtgcctttgcccaccaactcatcttgccatcccagcgtaaatcgtttaaactatgaaccagatgtgtcacccacctcctgtcagtagtaatctaatgattttcagttgaacttaaaactcaagttccttacctttcttttaacggcttttatattctggctgacctcacctctctcagctctctttctgtttcttcctgtacactcatggtgctccacacacactggctgcctttctgttctaacatatagaagggttggctcaggccctggagctgcccaatatccttgaccttagcaacaactcacagatgtctctctccttaggtttcggtccctactccaaggttccccttcagagtctcctcggccagcaactcagtgagtgcgccaggcatactctacagtttaattagtttccatttctatcgtgtgcctcttcttgcctagacatatgttgtttgtgggtttgccactggttatttttagcaactttaaacaataaacatgtattatctcataggtttcctgaagaagaattccaggtgcagcctaacagggttcagctgaggatcttattaaactgtgctccgatttgtgactgggttctctgaggcttatgatcctctccagggtcggtgggatttctctccttgcaggtatagaacccatggaagaaggttgcttgttcaaagccaccaagagaggatctctgacctccagaccccctcttttgcctgttcataaacccgttcagttttaaggaaaattgagagcttgtgagatggctcaacaggtaaaatgcttgctgccaaacctggtgtcctgagtcaaatccctaggacctatggggtggaaacagaaagctaattctcacagattatcctctgatgtccacatgtggggtgtgacgtgtatcacacacacagcatacttttttttttttttttggtgtggatctgaatgtaatttgtcaaatcgagcatcgaactttttatacagaagaaaatagggaagttaggtgacacacctaggttacatttcttacataaaacaaaggaatgaaaacacggaaggactggcaggaaccagctgggataaaattcagtgttaacaactggtatcaaaaacagccccacctaaggtcagcttaaacttagaagccagggtcaagggctttgtgcccttgccatagttcctattctagtctattatatagtccaccttccccctaggccattgtaa

SEQ ID NO: 457 - DNA, 1750 bp, Mus musculus
taaaaacaattagttattctttgtaatattaggcacttaattgctggctcaagataaaaagaattggatgtcaaagacaatggagaactttgaactctaaaaatagccataatggaaattcactgtagaaacaacttactttacaaaagcaaagcaaagcaacagcagtaagcaagagcccatgcgtttatgggactggtagtgtacatgccagataaagtattactgcatacttaccaccgtctggagcctcctttccatttgggatttgtatagttttggatgtctctttaaattgacttcttgattttcattcaaacatgtactgtaaggctaaagaataatttatgctctcataagggagacaaataagaagttaataataaaattatgaatcaaccaccttaatatcttatcttaatatcttaatatcttatacctataagtataaaattaataagatgagatcatctcttttatttgagatgaatgaaactgatagtcatctacctagattgccttaggaaggttaaagagactgaaattaataaattgagaaagcaaaattgggacatggatgtaaattttatagaaaaaagagtagggaactcagaagatggtggatggtacctagtttatgcccagccagagtttccaggggctttgaatatctgaaccatatgttcagtagtagaaggtttaaagagatgggagcaaatcgatgtgcaaaggaaatagcaacctgattagaaggaaatgcccaggaaaccccactcttttcagcactgggcactcaacacttgcccagcagcctcgagatgccactgtgaacagattcttcctgcactggcagcttgatagccaagcccatgtgtgagtcatactctggatgcttacagtaagtgtcctgggactatacactgaaatatggccagcagaatactgctagagtgagcgtattagttacgtttctgttgctgtgataaaataccatgaccaaagataacttttggaagaaggcgtttattttttcttaactgttctagaaggttagagtctataacatttggtggggaacaaaaaggagaatgtcccttttttttcctcacacaatgaggctatagaaccttaaagcctttccccagtgatgcacttcctttagcaaggtttcatctcttaaaggttacataaccttccccaaacagcaccattaaacatgagcctctgggagacatttctcattcaatccacaatattggaaaagtaattttgactcagaactgctcagtactgggggagaataaaagtgagtctctaaaggaactttcacaaggttccaagcagaggaccagagagcaggacgtactatactaagtggtctatctcctgagagatcgtccggaggtgtgcacaataagttaaatgaattactaagtgggaagcctcatgagtagaatggagagaatgagtcatggggaggagagaatatctgggcttgaagacaacgcagaagatctgaaatagtcagtgagagaaacataataatgaaaatgtatgaaatatgtgagatgcatggtacaccatgaaaagaccaaattttatgagctgtgaacatagaagaactgcatgacaaaaacaaagaaaacattttaaataaatctttttgttttatttatatatttattttaaacatatttatttattttatttataaattaaaaaccataggcatttagaacacccaatgggc

SEQ ID NO: 458 - DNA, 3050 bp, Mus musculus
aaaccacctagaagggtgtgccttagttcctttactgttaaggcagacacaggaggatccttggtgcttgctgacaacattggtgagatccagattcagtgatagatcttgagtcaaaaataaagtaggtagtgattgaagaagatatctgacaccaccctgtgtgacctaagagggaaaaaagagagagagaaggggagaaatgtaagtaggctagctacaaaagagtacatttaggcctcccactgttgctttgctctgtcttatgacatgcaacaattgtttctgtttttctaccatacacctagaagtccttgccaaacaccagaaattggaaaccagacttccctggctccagaaacttgagtcaataaaaatctgttttctaattaaccagtctgggagactcttaccaaacacaatggactaagacacctatattatatattttttgcagttattcttgataagacacttggatgaatggtacaattctatacctaaagggtaggatttaatttcttgagtgtgcttaacaatacaacacagccaaggtagcttaaatatacaaatttacttctcatgttctagggttggaaagtctgaaagtttcagcagtttgggtgattggtgaggacctgtttcttggcttacaggtggagtcttcttgtgtccttacaaggatgatggggatatctagctcttccagcatttctttctttctttctttctttttcaatttttattagatattttcttcatttacatttcaaatgctattccaaaagtcccctatacccttcccccaccctgctcccctacccactcactcccacttcttggccctggcattcccctgtactggggcatataaagtttgcaagaccaaagggcctctctttccagtgatggctgactaggccatcttctgctacatatataaaaaggccctaattctagtgagggctctgctctcgtgacctaagaagactttcccttctatcaccataactctggagctgaggatttcaacacaaagctgagaccaaacattaagactttggcaggctcacagatcatatccatcttatggctggctagcactgtagttttcctgtaaagctttggaagcaccagctcatacaggaaggtgatggacaaaggcaattacacagtgctggatgtctatcttatcactgtggggtcctcctttccctccctcccttcctccctccccttcctccctctctcccttccctccctccccttcctcccccctccctccctcccccttccctccctccccttcctcacccctccctccctcccttcctcccccctccctccctccctccctccctccctccctccctccctccctttctccctccctccctccctccctccctccctccctccctccctccctccctccctccctccctttctccttcctttctttatagagttaaatgctttctctggctgtcattcaattgctgatgacaaattctgatgctttgcctggaacttggtgaaccatcagctcattggtactgcctgctgcattctgtgctgaaaattaaaaagactaacagtagtctgagtttgtgcagaactcccttttcaaagcctttatttttggcaagtatgtgggagtactgtagaaaacaacaaaaaaacccagagttgtgtactgtcaactataatcatagaattttaaggttgtagttaatttttaaaataagcaggtagaaatatattgcctgaactatttgttaggtgttggaatattaatttttactgctagactttttggttttattttagtttatttcaaacatatttaaataaagacttgaactgatttatgaaattactataatagaagggatttttaaaaattactgctgaggcaggggtttggataatgaggagaggtaagcagaagccactcaggtgctatatttggttggtgtcatcctttggaacctgacaaattataagaacttagagtctacattctaactaaccattttgctttgaagaagtaattcttgagaacaaatatttgtctttgttacacaactgtttataatggcaaagaactaaaaacaatataaacatgtgccaggaagaaataacaatatattcattttgtcagatagcatgctgttgtttaaagtaatgtcgtagactattactcagttttattaaagaggttcaagccaggcagggttgtgtgtgtctgtgatcccaacatttgcaagacccagacagaaggattggaagttcaaggccagacttagctacataggcaatctgagctacctaggaatataagagagtgtctcaaaaggacaaagaaacaaaactgtagagttacatgcctataaacgcagtgctgagcaggtagggtcaggagggttaggagtttctagtctttggttctgtcaaatttcaaggctaatcttggatacaatgacatcctgtctcaaaaaatccaacaacaataacaaggaccataaacaaacaaacaagcaaattagcttgacctgatgtcttactcctgcagttctaacacttgagaggcaaagacaggaagatcagtaattcaaggtcactcttggatatacataaattctgaaatcaccctgggctatatacactttgcctcaaacagtaaaacaacgacaaaaatgttcaattatgtgattactttcggaaaacagcaaaaatattatgcccagaataagcaactttaaaattacataaatgcattggaaaacgaaaggtttctaagcaggcaatattaagctgtattctgactctcgatgccaggcaattaaggattaaatgcagttgatgaatgacagtttgtgttactgtttttttttcttaaatgaatttaacataatattatatggtaagtatatatttgtgaagagaaaagcaaaattctacattcggtatttttcattaaatctaaaagtttatactttgacagtttcatgtttatataataaattttggtcaaattcacttttatt

SEQ ID NO: 459 - DNA, 2300 bp, Mus musculus
aaaggaggtattatttgtgattgtgtctttcagattcatggtgctgggagcttgatatgggccttggtcaaaacataaattcaggcagttccagagggcaacaaacacacttctgggggttatctgagtagtattgactcattgaaaagtatccaataaaatgctgtgactcttaataaaaaatgacttgtcaacataaatttactaggcgggatattttaggattcaatttacatagaccatacagaaagacgtatcatttggtttgaaggccccgttaatggtatgttacgtgaaacatgccatttaccattagtatagcagcatagcatcctttttttctctttctttcttcttttggtttttcgagacagggtttctctgtgcagtactggatgtcctgaaactcactctgtagaccacgctggcctcaagctcagaaatccacctgcctctgcatcccaagtgctgggattacaggcatgcgtcaccactgcccggcatgcatagcaacttttgaataagatgaaaccgtccattctaaataagacaggtgacaccatattttagcttaagttgaaacctttacagaactgatcaaaggaacagcactgagagagagatggaccgattatatcaaggagagaagggctatcatagaatgagggcggtaaggtcaggggcaggccagtagagatgatgtctgtggtgctgacatcagggcatggctagacggtgtgaagccagaagagtctagcttcagaaatcccgatgagaagaacccgttcagcagatcttgtcacggtgagtggaaattcgttgtttcaggtttttcaccggtgcaggaaaaggggcgacatgtggcttgaaactgccagtagggggcgctgcaggcaaggaaatcagggattaggcaccgtgttctcagatgtgatgacaatcgtctcaggatctctgaaaataagcttgagagtgacaggattttcagatgtcaataagggtcagtaactggctgtggggttttgggagctgtcctgggatgttggaagacaagcgacattctgcaaaagagatggtattgtgatcagcttatgtagggatcagcttatataggagggagccaagagagtttactgctacttagaggccttcttctgtgaatttgtcatttgattttggatcaaggtctccatgcttcagttttcttactgatgacttggactgtaaagttggaaagagatgttggttttcagagaaacaaaaacgtttctggcctgtggtgcgttgtgacagccttttgctgtaagttactgtttgagatggacattttggtctttcctcctgtactgttgttaggaatggtgtttagatgctgttgctgttgtgtcaagattgagggctgtggagatggctcaccagctaagagcactttgcttttccagaggacctgaatttagttcccagtacccatgctggctggcttacaaccacctgaaactccagattcagggcatctgacaccctattctggcctctgaggcatctcacacccaggcaacgtgtcccgtccccccccccccccagcagaaatagattatgcagtaagtatttaaaacataaaaaagaggggaatggaagagacacatgcagaaccgctctctaatcgctctccaaacttccggtgacctttacagcatcttgtctgattagcatccttctaaacctcttaaggctctggaccctggagctgtgctgtgtacaaagtatctctctgaaaagaaggaatgccagtgtctgggtgagcacctaacatctgctgcagcccgccttcctgggatggagagaaaagtctgggttgactttttgaacttagccggaataggactctttctggaaagcagctgggactgtcagcttgcttgtgctgatcatgaggcccgagggtcccagcttgcccatttttagtcctggcttaatcttggctttctgctctctgtgtgggggtttacgtgggtgtcatctgctttgatcggctttgctccataaggcgagctttgcactcgcagaagccctggtctctgcttttagtgccgttcgcctcccctgtgattatttattgtttatgtgttgtagtcgtgcggcctttccttgcctttcttggcacgactggcgaaaagcaagttcatctttgctgacaagtttgagcctagagtttgcagtttgggtgatgattaaggcgtggcccgggagacttttcctgtttgtgtgtgcagagggaaaagctggagcatgtgggttca

SEQ ID NO: 460 - DNA, 3000 bp, Mus musculus
acataattcacaattgtttgttttattttatcttatttatctttggtttgtttctttgaaacagggttttactatgttgttctggctatactgaaactcactgtatagatcaggctagcttcagactcagagaggtggcttggttctgcctcccaagtgctggattaaagggcatgctatactacacctgacctagtatgcttattacaaagttgtgttaatcacacatggtgctattaactgtggaatgaacaatcacggactttaggaattcaataaagtccatagaagccacagagataaactctgccctttccagtagccagcctgtgaaatctcaacatttgcttctgttagagatagtaacaagatctagaaagtgtagatgacagccttaaatgacaatctttagttcaagtctttccctttaaatacactgtagagggaaagagaagattgctcagtgagtgactggcttttcatgtctctccccaaaacacttttttttaaaaagcgaaatttggatgtggtggttaggagcttgtcatcttgtgatgacaacactgagggaggtagaaaagggattcttagccagtcagcctagccttatcttcaagttctagtacaacgagagatctcgcctcaaaatataacagcccaaacaaaccacaagaaaacacaaggtggacagtcctagggaatcataccagaggctgatgtgtggcctttacctgccccaacacaagttcatgtgcgcacatacacaaagcttatgagaaaatgagattcaactaagcaaagcttgtggctcctctaaaacaaccatataaacccatactaacctatcgattttcaaattagcaaactagaaaaagcagtaaactaaatagatcataacttccattcctttgggaattcagaagacagccaacataaaaatagataaaccacaaatgcaaatctgtggctggcagaaagccaagtatccaactgaaagtctgctttaaaaaacagtcaccagtgaactatccactgtgtgtgtgtgtgatgtgtcctggatgccatctgaccagtagctgtgggcccacttcgaatccactgcctccaagctgaaccacacagcaggacaatccagtcccaaatgccaagtgttccacagactccccatgtgacgccaagagccacacttgtttgaggtccaggccttctaaccatcttctctgaaaagaatgctaaaaagcagaaccaatcttttaaaatgtagattgtggttcaataggtgtgtgggccagaactacatatctaccttccaaaaagcacttgggtaatacttctagaagcaagctctgaagtgagcatggcagctcattgtccatctagattgtcagacccagaatgaggtttattttcaacattcaaggtgagcacaaaggatataatatcattaagggcaagttctctggcttagtttctgggatgcttgtgtaacatgaacaacgactcctggttcaaccccctagcatcacataaaacctgcagtgtatgcctataatcttagcacttgggtggtagagactgaagaagttctgggtcatacttggctacatatcaagttccaggccaacctgggctaaaggagagcctgtcccaaacaagaaacacacacatactttttgtgttaattattactatccttccccactgtgaacaaatagtgacattatgacagacactatatgcttgtgcatggcaagatactgatggattgagtttggtattgacattttcaggaacatatatgggactcaaacttccttctgctagagcaactcagagtaaactttaagatacaagcatgcttcactttgggccttactgacatttcagctcagtagtaccagagaggactcagagagtagacacataagtttgttttataaacttttgtgaggtaaatgaccaactgtttccatgaagaaactaattcccacttaccttcatctcttccagcgctcagtccttccaaatggccttttctacttagatactatttcaaatagaaggtgcaagcacaagagagcaatgaatgctgaatcaggcagtgcaggcgccgactgcttcatagcacaaagcttggtttatctctctcaggaaatacgagtccactgatagaaaagactatttactctatcagcatctctgtagcttttaatcaagccaggatcccagcatggaagttcagatctttaaacgctggctagcggaaacacggtcacctataaatccttaattcacaaagcccattttcctcaggaagtgctgagggcagaaattctgctatctgggaacggcccagaaacacatgcatgcctccgttggactccccaggacacatccttaggggctgaatacagagctctgaaagagaaaggcaggaatccaaatggtttcccccttggctcttttccttcactttctgccaagcttgattttgaagttattccctcttcaagctttgtgaaatgcagagaaccaccttggggagggggaaggagataaggaaaacagatcgaactggagggatatgggtagaaagagataaagggctctgaaaaaataatgttcagccttctaaagctatactagcaagaaagttcccaaagcaaaagaaataaacagattttaagtcctgtggtaaggtgtagacaagaaaggcactgattactgcacttttattttgtcagttgttaaaagctcttctcaggaggaaaacaaaccccaactgtccctctttctaaggtcccaataacaagctaaggtatctggagctgagcgacccccaaattatctgtcctggacagccttcaaccaatctgaatgcaagtttccccataactgcacagccaaccatcctactgttactcttcccagaacaaaaccagtggctccttctccagttgctggcagctgcctgtcattagggatgcaatactgcatgca

SEQ ID NO: 461 - DNA, 1900 bp, Mus musculus
ttattctttgtcaatcaactctattccatttctaaccatgtgttcctgatctattttcccccttgtagaataccagatcctggacacctcagcaggtactcctagacttctgacagtgcagctaatacacctggtccctggcacacctaataagtcaggcttcactacctgccttcaatgtgacaataaggactggaatactagaagaggaacaaatgaagacatccagggagccaaccccacaagtgaatgtgtggggagttctgacctgaagtttggcttaaatagaaggcaaagaaggagtcataaccaagaattcctagccaaagtgtggtcctgtccatccttctttcagctccagtccctctgcaagggggtctggaaagttgtctcaacctctctcctgagattcctatatagattcaatagagtttggggccagcttgaagcacatgacaccatggcaggaggaagaagtcagaagaggaggaggggaagaagaaggagaaagggaagtaggaggaggaagtggaggaggaaaaagaaagaaagggaaagagagagaggaagggagggcagacctttattgctattcctctagagattctatttcacctaaaaccattgttttgatagtctggtaggcaaatagagagactggggtggctgttcaagatcaggtgttaggaatgctaactttgagatactgatagaatatcccaggtattaaaattccagacatagttagatataagagcacagaagtctgaattaactactggaatttggcagtgagcaacagaaaaatgctatttactatctcacggggtgagaacactaagggagtaggatggatctaagaaaaggtctgcagactgggctaaggatgtcccacactctgaaagcagcaaggccagcaggacccaaacaagagaaagaatgtggtcaaggaagaaaactatcagtcaacggggctctggaagcccagtggcgcgattctcctggagagaattcccacccgtacacaggaatcacatgaatgcagagaagactggagcacagagcacaggctagaggcctggtccaagatggttggagaggcagcagaggaggaagtcacacaaagctggaaacattcctgttttaaagagttttgctgtggaagagatggaaacatgggaagatggccataaggacactagtcaagttttataggcatacctgtatataaatatgcacatatgaattgaaaacatgtgtgctgctatgactgcctgcatagaatcctgtttaactttcttaacaggcctaacctattttctttaatttctgatttttaatgatgtattcatttttgtagatgtgccaaattaacagttgacaaaaaaaaatcacacttttcatttttagtacaagtgtccttcttacccacaggttcaacatctgtgcctttaaacaagctcagaggtggggaatgggagggatctatactgggcttctgagatggcttctatactgttttgtggggaaagccaccaccaagtaaacctgatgacctgaattcattctctggattgctcatgatagaaggaggatttctgcacgttctgctctcacctccacatgcgtgctagggtacacaggcaagggtatgcacacattgaacacatagatagataaatagatagatagatagatagatagatagatagatagatagatagatagatagatagagataaaattatgtcaggttttaaaatatctctatgtatgtatgtatgtatgtatgtatgtatgtatgtatgtaaaatatctctatgtattagacaaaacaaaacaactagctatgaacactgtagtaggtcttaccagaaagacaacttagaatgccatttta

SEQ ID NO: 462 - DNA, 1825 bp, Mus musculus
gcagttgctgtggaaactgagcagttactgttgagatgatctaattcttaccacacaaggacatttctataattttactgttaaaatattgatacttccctaaacagcttcaaatttatcttgtagccattaaatttgttatttatttttgtacagacttgaaaaatattaaaaatctatgtaccatacatgttagtctatttcacccatgctacagacaattgcagaacatcagactaaatgtaaaatctacaccatggtggtaactgtgtacatattcaaacacatggaaacaagtttgttctttttttcttttgttttcctttttcttttttgtgtgtgcaaaaagctctaaaaactctagtaatcacatgagctgtaatgtcaccataccatcacctctagggagcctggtacattcagatcaattctaatccgagggactgtgccatacacagttagtgttgatcacagtgtccttctgtgccctcaggcagcaatgtcttctttcagcaaagcagcaaatgttttgaagaggaatgtgaagtgagtaggaaagcatttgtctttttaaaacccttaagttgtttagtcatgagcacccatgtcaggaaacccatgctgtctagaaagtccctaaaataattagggaaagattccactcgattcatgattcactgttttgcatttactaactttaaagcaaaacaaaaccagactgctcacaggaagactagaaagaaatgtaaaaccagactaagtataaaatattttccaatcagctctaattaaaggactcagctaagccaagctcgccttctcccgaaactcatcacaggcctgagaagatagctgtgcctgtacagtgcttacagagcaagcggacggacctgagtttcatccccggattccacagaagcaagcaccagtagcagaaacaccacaaaggagatggaggagttcctgggccttgaaccagtcagtctaatggaatacaggagcttgccagtttccctaagacgcgatgtggttaattaacagacaatagacagtgggatgctttggttcctctacttgtattatagatgtatctattgctgtcatcttcctaacaatcttgagcatcggttagtatagatgaaagtgttaaaggtaaaaagagactcaggtcttaagtttttcttggaggagtataaaccatggatgaggaaaaaacatgtggatattttccaataagagaaaaaattccaatctactatgcatgcgagattttaatgaacaaccaggcactgcagctaatatttttgtattttctgtagttagtaaataacatcttgaaatttttaaatcattcttttttttgtcttttttttccttttttttttttttttttttttttcaagacagggtttctctctatagccctggctgtcctggaactcactttgtagaccaggctggcctcgaactcagaaatctgcctgcctctgcctcctgagtgctgggattaaaggagtgtgccaccacgtccggcttaaatcattctttttaaacatctatgcatagcatacaaagtaaataatgttattagtaaagaaatggatggctgttagataattaatatatcatattcaatatatatgcaaatagataaagatacaaagaatctgcttattttataacatgcactttatatatacatatgtatgcacatatctaatatacaatgctttttgtttattttgatcttttaggttactatttcaatatttatattttaacattgggtagactaatgctttaggtttgctggtagtattttctt

SEQ ID NO: 463 - DNA, 3925 bp, Mus musculus
taggcaaaggtcttcatggctccccatggtggattgcaatggaaaaagccagttcatggttttaagacatttattgtcatggtgaaagtggacgtgtaaaaccatacccccttttcagggtgggcctgagattaaataccttttgcagggagggatgtctgggaaggaaagcttattggctaagccctccaggcctgtatgtacctcattagaatggtgatctctgtcttgagcctacgtgaccacaggtcacgtccttttcttatctacaggaggggcttggggcattgcccttatgtgatcaatggccacaaatctatgggggctgtggctagtgacagtgacctggtgcccaggagcaggcgaagttcctaccgtcccttcagggtctctggagctgctaacctcagctcaaccgaggaccaggctacctttcctggtccacttccccacagtgggatgggttaggagagactactgggttctcttaagaagtgaggcttgggattcagcaatcagaaaaagagatgcaggaagtctcttggtggatgtgtacaaagggctccaccactcctgtcaggatgaggacaacggaggtttcagtgtgcctctgtgtacagttaatgtttattgtcacggcataataattaacagttctccttgttacctttttattttttatttttaaatatttctccctagagagatggctcagaggttaaaagcaattcctactcatgaggagggcctgggttcacatggtggttcttagccatttgtaactccagttcttgggcatccagtcccttcttctgagggcaggggacacacgtgaggtacacatacatacatgcagacaagtcacacagctaaagaaaaaaatatttctacatgtgttttgtacacatgtttgctcgttctgaggagtgaccagctgacattcatccaggtgctttgagatcctttgcaggactgaggcgagagaactgggttagatctctacgtggttgatgaaaagcctcctggggtcaccttgatacagagcacaagcccaaggtcaaactgtgtcctgtaggcacaaggaatcacaacaggaagatttcaagtatgtatgactccgggggacaggaactgctcatcactgctgaccactgcgcactgcttcaggaacaccaatctacactttatgttggctatcaccagtgggtctttggttcaatgtcataagtgcccagccaaaacaatcaatacaagactgttttcttcctttctgttttcccatccagttagttccttttcttccctttccctttcctttttaaaaataaggtgcccagctggcaccaaaacaatttcatcataaaagggtgagtccccatttaagactgattagacatctcttagcatcttcctacacatttgtttaaaaatatcttatttgtttgcgcaaaggagagctggccttgttccttgtctgccctgaagtggggacaggaaagatgcccttctctcctcttgcctcctgtggcacacccttcagggtataagagtggaagagctggccttgtcccttaccggctgcagcattgagtgagctatctgggccagtgctggagagctcgtcctggtggcttgggttcagaagagctggcaagctgaccaactcagctaccacctaggcccagattcaggtctttgagttggcccaccccaacatctaccctatctgtgaactgctggagcatgtgatggggctaatcttgcaggtccccagcagcaggatctccataacataaggtaacaatgccatatccaagaggagtcccctgaggatctgctattgatggtgtagcagaagccagagacctcgaattagaccatcgactcattgtaatgaacgtctatctacaagtaaagatgtgtggacaaaaggatataccctgtgacataccatgacacactgcagcttccatgaagagatgtttgtttgtttgtttgtttttctttgggggtcaggggaaggaggaggttgcaaaggcagagggcagatagatacaaaggggatgagtggaattggggtgcatgatgtgaaatccacaaagagtcaataaaaagtttttaaaaatcccttatttaactcagaaaaaacactaagactcacagcaatactggccatctaatgacgcgcacactacattacacatctaatgatgtgtctactacaacaaaacctcaacacggggctagagcaatgtcactggctaagtggactggctgctcatgcagcgcacctgtggtgggtggggtctcagcacccacaggtggttcacagtcagctgcaactccaatcccaaaaatctgatgacctcttctggcctccacagccactgcacacacatggcacacacaccttcaggcaggcaaaaacattcatatgcatggaaataaatcttgaaaataaatactacacaaaacgaacaacaaaagcctctcccaggtttttgaaaagatgctaccgctgccaaagctagagaacatgggtggacggaagcagaagcttactgttctgagtgagatttactggagacatttattctgttgttttggtttgcttttgggtctcactgtgtagccctggctggactggaactcacaatcaatgtagaccaggctggcctcaaactcagagatccacctgcttctacctcccaccactaggatcaagggtgtgcaccaccatgactggcccctggaggtataacttaacctctaagtcatctctccagctcaagatttatttgaatgtttaatcatgtgcctgcccacgtgtctctgtgtctgtaataaaaaagaagggttgttatgtaaccacctcctaccaacaggacactccctcctggagaagcagagacgctcatgttacctgccaggctcaggaagctctggagccagcagactcaggaccctccccagttattcgagcaacaactattgctatgcagagaagatcctcagacagacagagtgggctgttagctgtttagggagcataggccaagcagtatgcttgaggcctttggctgagggcagttttttttttttttttttttttttttgaggagggggcatactctatatagctgaggctgaccttaaacccccagacctcctgcctcagcctcctaagtgctgagattgtagagttgcaacacaatgcttagctcaggtcataggttccacttttaatagctgcttcataaaacaattgagaaataaataaattaacccaaaagtaatgctaacatttggaggttgaggcagtagagtcaagagttcaaggctagctttaggtaatggagtgagtttgaggctattttgtatagattgtctcaaaacaatcaaaactcaaccccgaagtcatgaaagtgtttaaacttgctcagtgtcctgaaaggaggaccattttgaccaaatgaaatgggaagaacttgtggtcagcacaatgcagaacacagctctcacttcaggagtcagaagtggcttattctagagctacatatgagtgactatggacacagatttaggttgtctacaaaccatgttctaatgtgtgacagtttcatgaaaaaaatttttttttcctagacagggtttctctgtgtatcaccaagtgtcctggaattcactctgtagaccaggctggcctcaaactcagatattcactggcctctgcctcctaagtactgggactaaagatgagccccactgccactaccagcgccaccaccaccaccgccaccacccagcttagtttcatgaaaatgttgaggtagcagagctgatagtcatagagcaaggtgcttttcagctataccgtgggaacatcaggtaggctggttgcagcacggctgggaggggctgcaaa

SEQ ID NO: 464 - DNA, 2075 bp, Mus musculus
aactaccattataacactagccttagagaacccaatgcctctggcctctcagagcacctgcacgagcaagctcagagctacacagacacataatttaaaataaaacaaacccttggaaacttactaatttatgcagacttaaatttctaccattattaaagagtctgtttcagaagtacatgctggtgtgtttatgatgaaattgtatgttactgagaaaacagtaactgagtttaaaagaaagattgtgggctggagagatggctcagtggttaagagcactgcctgctcttccggagatcctgagttcaatttccagcaaccacatggtggctcacaaccatctgtaatgagatctgatgccctcttctggtgtgtctaacgatagctacagtgtactcacatatataaaataagtaaaatgagaaagaaagaaagaaagagagagaaagaaaggaagattgatcggccatggtgtgataaacagagcaaagtgagacttctggagagcttcttagttgttatttgttgtttttgcttctgcttgacagaatgcacaatagaaatgtttaaatatatacatggttatttttggtatttccacagcttttgtttatacaaatatattgcttcacctggtaattttaagcagttctgccatcacagtgtgagttatttaaaacaagaaacacaatagtttgacacactgcttaacacgtagaaagtagttcactaagtggatgaaatggatgcttggtggtggcagagacagagccacatgaatcacccagaggtgattccttagtgctccagattttaagactttggtaaaaagcagtaataaaagttaggtgaaagcctaaaacgcagtgtatttgggaatgaccaaatactgcagaaccagccagccatcctcaaggcgcaagaccacagggatcagtctgcgatggggctaaggtcctctgcctgccctgactcgtgcacgtgggaggttcctgggtatttctgccctcccctttccttctccttcacttcttccttccttccttccttccactcctcttcccctttctgtctatcccttcccacgtgcttgctcagctgtccctcaccttctcatctctgctgctgctccatctcttcctagaatgcccttcccattcttttacctccgttagaaaagcaatcccattctttccccttctcccttccatttggaaacatgagggcttgctttgtgctagctaagaaaccaaagagcacaggcctgaaaactcagaattaatgggtcctgaaaacttaaattaattaggagcttagttgtaagggatcaatcatgttctggttcagtgatgcattaacatgacaaagctaagtcaacctggtaacaagaacacctcagacaggcccacaccatcctcctgtgccgcctcagaatcctggaggtcatcatagttgattcttcaaatgtgcttcccaaaccactttagttcttggtttttacttcatctcagccttgttcctgtggaatataaggatttggctgttttcatcctgcagggcaccccctttgaggaattagctttattctcatcaggcagtcattggaatgctggtcagttttggcagtagattggctgtgatgactttggttttcacattgctgtgagaaggatctgttcctggtgcatctcctgctaagccgtcagcactgccactttcccctgtggccattctctttaggacttgtgtctgtacctcctttgctctccgtgttctgtatacatttcagcaatgtgatcacaggctctcttcccttagtgtggtagtttggatatgcttgtccaggaagtggcactatttggaggtgtggccttgttgaaggaagtgtgtcactgtgggcctggctttaagaccctcctcctaaccacgtggtagccaatcttctagcagccttcagatgaagatgtagaactctcagctcttcctataccatgtctgcatggatgccaccatgttcctgccttgatgataatggactgaacctctgaaactgtaagccagccccaattaaa

SEQ ID NO: 465 - DNA, 3525 bp, Mus musculus
cttgatgggacgtcaggtgtttttcctgttacgatctgttactcttgtggtacccacatgaggactcacaaccatcaataactccggtcagaggcttcaacttccaacaccagttttcaggcacatacataatgcatacaattaaaacaaggttattttcatagaaaatttcatggattttttaccaagaatgtgaaactgaatgcagtgagatgggtccaggggagggatactggggttagggttctctattctagggtcatgaatcactgaatggaaggaaatccgaaaggatgggctaatccagagaagccaggaacccatctgtggttttagctaattaagacagataaaatagctgttgggagggttctcactggaggcaacaccccaaatcactctagagcagtagtctcggcccctttgaggaccacacatcagatattctgtatatcaaatatttacactaaaattcataacagtagcaaaattatagttctgaagtagcaatgaaataagtctatggttggggggtcaccacaacacaaagaactgtactaaagggtcgcagccttaggaaggttgagaattgctgctctagactaagtcaaagtcaggaagccatgagtttgtatggcttgggatgcagctaggagctaggaccctagtagatgctggattctgccagtggtagtacctgagcaatcagaacacttcctaggaggactggaaagatggtttaatgggtacagtgcctacggtttaactctggctacctgagtttgatctctgggatccaccagtaaagtcagacagggtaagcacatctgtaacaacagtactcccctaccccagctgggaggtggagcagaagaactaactagccaggagtctgtgggccagctagcacagtatatactgcataacattaacaaaagagaccttgcctcagcaagctggaaggagagaaccaactctagagagatgtcctctaatctctgcatgcacaccatgatacacacacacacacaagcacaataactaactatccatttcatttttagattattttattgtacgtgcatgaggattttgcctgcgtgtatgtatgtgtgtgcaccacatgtgtgtctggtgatgtgaagacaaggaaagagtatcaggtcctttggaactgatgttacaaatggttctgagctgcccacatgggtgctaggaacagaacctggggcctttgcaagagcaacaaatgctcttaaatgctgagccatctctctagccccaattagctttcattttaaaagagccttccctgaacaccatggcaggtgtgcctgcccatgaagcttctctttcttaaccaggatttactggaggcgctacaggatgggacacacaaaacagaggtcagcaacagtgcctgtacaggagtcctgatgctacaggggcttcaaatgctgaaataactgctttactaattagctaaacaaataaatacaaattaccactaaaacctccaaatggccaggactcgggcttttggaagctagaaccttcagttcctttctgcacttgtatagtactgttcttttctcaaagacagtgagaaaaactgagccaaggttattttaaacctagcagggctgggggctgggaaagttaattagaggaatttcagttcctctgtctttttatccatcatctcagttacatatgctggagtctaactgtgcttttgatgtaaattccatatataaaacacaactctgactacatctaagatatgcatacacaaaggtatccaatttccatgagggggcagagagggttgctaagcacagttacgtatgcaagacaaataaactaggaaaaaaataaagccatatgctaacaggagtatgtctggatgatgaaattaaagacggataaattgattctcaatgctttcaaaaactctaaacctttgctttgtaaaatgtctgtatctatatacccagatccagggcctacagcagaggcaccataatgttgttttagaatgcaaagattgatcacccacccatttttttttttttaagttgcaggcttttgagcccagttgagggccccatcctggaaactgttatcatttggtgctttcattgctaactgcaaaaaatcaatcacacctaagctttttcatacacaaacagagagtggggacagggcagagagagagagagagagagagaaagagagagagagagagagagagagagagagagagagagagagagagagagagaacactcagctgagagccatttcccataaaactgttaagtgactgcaagagaaagttaggccgtgcagccttggaggacggcagcttgtgccgaacatataaacccaggaagaagagagttgtggagcgtggcagccatgtgctgaccatccaggtttcctgtccgtatttcaaaatccaatgtcccatggagatgcaaagcctcgcgtgcaaagcttgctctttctctctaacacttaacctacagtgtgcatcttggttggggagtgaaatctgtgctgtctgctgactggtctgtctcctgcaattcttcatataaattctgagtgctaggctccagaatgtaaaactctaagctcccttcactttattgctcagttgttatggaaatgtaaatttctacaaatatattattgcatatgctcagactctacggattttgtaattgtgaactaatttaactttgcacagaaaaatgcttcttgccattattccacttcattcatatcaatttcaaaaggtggaaattatctactgccatggaatagcaagcctcgagcctttcagtgtaggggcttttatgagcaccctccattattcggcatttcctttaccaatgagaaagggtgtttccttcaatgcccaaagcttctagcaggagaagctgggagtgcagagattggggggggggggggagagaaaccgcctctcaccacctgtcctccaggatgacactagaggacttcactgtgattccatcaaagccaaaggagggagggagggaaaataagataggcaggctggcagacagacagacagacagacagacagacagacagacactaattaaaccgacagaggaagaagtttacatgcagccacatatagctgtggtatagattgttaccatcaactatgacttctgaaatgtaacctagtcaaactccagcaaagtacaaatgacagaataggaagagattccattcctcctctgctgctgggaagatggaattcctaaggatttattatctcaggagatttttttttcctttctgctcaatttgatatgcagaggagaattctaaattgtcatcatctatcaccatgatgactacaatttattgcaggactttgctaagtgttcttatacattattcagtcccatcctcagcactctgaaatgggaacgagcgtcttctacttcagaggcaatagacagaaggaagcacagacgggttgag

SEQ ID NO: 466 - DNA, 3450 bp, Mus musculus
aagaaagaccatgtgaggacccagagagaatgtacttccatacagacaagtcaaggagaccggcctcagaagaaggcaaacacactgactccttaatatttaacttctaccctctaggaggaagagaaaataactgttattcaagccactcagcctatagcaacttacagcagccgaagccaaggaaaaccacctactgtcaccctccgagtacagccatttcaagatctttgccatattataaataatttccatttgtgtgagctttcgagattaaagctatctcccagtctatgaagttcatgaggaccaaagctgatacgtttctctaaagcactcagcacagagggaactcttgtggtagtttagcaataaaattctttggtacaccacccactacaaagcaaggtctatgtaaccatttaatgtaggatctactacttgactaccagaccatgagagagatgatacttcaccattccataccgtcctataacagtgattctttccaggtcaaaaagcccaagagccttcaaactacttttggagacttttccttgaacctaaccaacatgggtaaaggaagctataggtaggctatttgtgcatgctctggtagagttccagtggagatcccaagtgatagccagttaccaagagctgccacactggagttaagatctgtcactctcagctgggcgtggtggtgcatgcctttaatcccagcacttgggaggcagaagcaggcagatttctgagttcaaggccggcctggtctacagagtgagttccaagatagccaggcgatacagagaaaccctgtctcgaaaaaaaaaaaaaacaaaccacaccaaaacaaaacaaaacaaaacaaaaaaagatctgtcactctcacagcagtcacacagaggtcaagggcagggaaaaacaccagggcactagaaaccagagagaatgcatttgcatacatccaagtcaaggcgctcagcctcagaagaagttaggacttttcattctgagagcagccacataggtcagtggcagggagaaacaccaaagcactagaaacaccacaattgtttctgtaagccacagagcttcatgacctgtgggttttgttctgtagcaatagatggtctactttataatcaaaccgctgcatgatatgtgtaaggagacatttctagcaattccaccctagatcttttgtcatagccttagcaggtaaacattgcctttattcccttactggaagattctctaactagatatacatcagaaagatatcgttaggaaagtaattttactgctaatcttctgcctgagaggtaagctgatttctcagtgcaatcgggagtggaactaatatggacaaaagctttctctgcttcttctgcttgggagccggtgcctggccattgtcctttgcaacccttgttgtcatagaggaccctggctgcttgagtgatggaatagcatcctatcttctgcttccttttgctgccatgtgaaccttatcaaagcagcagccatcaccatggaaaccaggctgagaagaagctcaacatctttggtcaaaccctacgctgttacctacagagagctctggaaaaagcctggtatttaattgaaaatgggtattgcgggttctaggagacacccactgttttcttcctatccagccacaagagaatttcaaaaaataaaaataaatgaaacactttcatttctaactgctttccaaaataatactgatgatcgacctgtgggagtgactaaagcaagccagacaacctaaacctgaaaagagttttaagcactggacttagtctatcttgtttatctttatatttggtgttactaaatataaagccaacaagatcagagaaacttcaactcaagccccaatgttctactcaatattagggtgatatctcacacagtcactgataacttgtgtggttatcaaatttttgtgcatagctgctactttattcattaaagtgaggcaattgagccaaaaatggtgggacaggcctgtcatcccagctttctgaaagcagaagcaggtagttgaatttgtgctcagcttagcctacagaatgatgaaatcaaagaatgacttaaatttagaggtgggtggtggagggtacttctgcagtcaagggctggactcatgtttcaggtcccggaccagagctgcctcactggatgctatctatggtactgcaatcccctctgaagccacctctgcctaaggaggatctagtgttactgtatagaacgtcagcttactgtattgggaggcggatgggagttggccagagggtgaagcacactgcttaatcctcttgctgttgtgacaaactggcaagaagtaatgtgaggagagatcggtttattttgccttacagaaggaacacagttcagcatggcagcaatgccaaggcagcagcggaaatataaggtagccgatggcattgcagctgcagtgagaaagcaaagtgtgggcagggagcagcaggaagtacttcaaaacctcaaggctcaaactcagtggcctggtgccttcaggaagccccacctcacaaaggtcctgcagcctttcgaaacagcactgccagctaaggactaacagttcgaaccaaacctataggagatagtctacattcaaagcccaacacaggggcaggagcaagaagagtttaaggccagctttagctttataattaatctgagtctagagtgggttacagaagatcctaaaacagacacagcattaaacactaacccaggatccacatcacaccactaagtacattctagtgactaggaaaacaaagacatttaaaacagtttgcagttcagtctcaagacaaagaaagccaaatttaagtaaagacctgacattactgcaaaagctctggtcagtcatgctaataagcaaggcagcatcatttaaactctctaagccttagccttggtttctgtactggaagacaagcataatcgtgccacaaataggtgtaagggttaaaagccattaaaattaacatatctaatacaggtgaacatcatgtgacatgcagttcaatataattcctactgctattattaatatgaccataaagtaccattggcaactcctcttgaaagagacaatcctttgcccagataatagcagcctgtacttacttgtaatgaaccatgtgtcttgagagatgagaaaatgtctcctccaaacaaggcttaccacaaaagtgtaagatacatcaagagttccaggtctgggaagtacgcttaccatgtacaatcccatcttggccctttaaaacatcctcttgatcatcaaagggtgcaggaagcctgcactccccgtggccatgctacttgcggtttctgagtagtatcaattcgtttatctctggctcaagagtcttttgtcttctg

SEQ ID NO: 467 - DNA, 2250 bp, Mus musculus
gactttcatttcaacctttggaaacacttgagcagagaacccagctggaaaacaccatacacttgacccaaggtggctgatgaatttgtgttgttttaagtggctaggtttgtggtaatttgttatgcagaaatagaaaactaatacagcctagaacatgtctagttctccctaaagaatgctacattatatggtggtaatttctatgactgatgtacaagaaaatggacagtgacttggtaacaaatggaaagcaacatagaaatgttgtgattctcatagacaattaaatttagagggtggcatatcgcattatcatcatcccttcttgctccttaaccagtttatttgctctctcccgcttgcattattacattacacgtctgttcactgcagtcacagcccatggtttgctggctcccaatgtgtttagacattgatttaaattcttagttgtatatcttgatatttttttgaattatcctatccacaaacactgcaacatcccaaagaatttcatgtttgcctatgctggagaatttaatttcttcctgtattataagacagatacaaccctaatgagaacaaacccccaccacaatctatatataacggactgtctcggagaccggaattcagcagctcagagtctaaatcaatgcttatgaaatgcacagcagctggaatgaggagcctgtgttaatctcctcagtggcagtcttgttttctttcttaagcatgcttaaagatggtttgaaagcaccgagctccatcacaaatctttctcatctttccttcttgctgccctagatttgtaatgagcttgtgctttagagaaagagaaagggagaaaataattggaactgtctcttctattaccaccaggtcctatttttgaagatttttctattatttaacaccttccatttgttttactttagatgtgcgattcagttatcagaagctgaagaaaatgaaatagaacatggaaggcttcatcacaaacgtctagactcaggaaaacccaatgctcttagggcctgtttcttagggcattttctctacaggaaggttggctgcccagaggctttaagggaccatcctcagagaccaggtgtccttccatggtgctcagcatgaatgcatgcttgttaggtttgctatgatcatggacttttcaagatgcctgcctaggaaagtctgataggcacctggctggaacttgcacccatgtgattgtatcctccggggttacctgactaacagagacgaagtcattttaaatttccaccctgtcaattccatttaccctttggcctagcaagaggaaaggaatcagttctgatgtctgacaagcactgccacaatttctgtgggccaagtactataaatgtcctgcaaggcttttcactatatagcaaactagtcctcctcagtcccactaaggtatagccaccccacaatttctgctacaacggaggcaactagataccctttgtgtgatacttgtaggcaataagagctagtatattgttttttatgttgtcatgtgaaactactccccgaatttagctgttgagcaagacttctctctcacagttttcataaaggccaaaggagttcatattaggataattaacacttggagctcaccattgaaagaaaacattacttctccattctggattgcttcacagataggtagaatcctcccagcatggctgaatattttctcagaccagactatcttaggagccacatgttttatgacttagccctggaaatcacaaactgccatttctgtgattgctcttttggttttgaaagcagctaattctattccttatgggaggagactatgcaatgatcatcttggtcatggtttaccagatagacttggtacatagaaagtatattttgtgcttgctattcctttaaagaatattgattgtgtgagggatgatttgaagtatgcatgtgctctgtgtgtgtgtgtgtgtgtgtgtgtgtgtgtgtgtgtgtgtgtgtgatggtcagaggacagcttgtggaagtggtcctcttcttgacaaatacaaatttttctgttgtggaggatacattgaagggagaagattttgaacatggtgataaatgtctttcctatcatgattcttacatatgaatccatctgaattgaatatatgagaaaaaatactgagcagacacgtaactcgagactaacagtatggtgaagactagatctaaaga

SEQ ID NO: 468 - DNA, 2700 bp, Mus musculus
cacggagtgcggattactgatttgctcctcatggcttgctcagataactttcttttataacccaggatcacctgcctggggatggcaccacccaccccttccacatcaacaatcagtcaacaaaatgtcccacagacatgcctatgggcaaatttgatggagataattcctcaatcaaggttccctcttcccaggtgactctagtttgtgccaagttgacaaaaactaaccacccaaggtcactcttgtttgcagttggattgttccaccagcctgtttgtttcatgtgtatagaattttggaatttgactgcctccattcttcttgtcccctctccttcagtgcaagctggcaggggtttctgctggcatacacacagactcattatatttatccttcaaggcatattgtgcctgttgcctcttgttataaataaagttttattgaaacataagcacaagtgcttgttagtgctttgttgttactgtatcattggcaggccaataggatggaaagggctgcaagagaaacagcctggcttacaagctaaaactcccctctccctctccctctccctctccctctccctctccctctccctctccctctccctctccctctccctctcccagtctctctctgtctctctctccagccctctgtaaagaatgcttgttgggaactggctccgagtcaaacctcaagaagcattggggttttagaaagacaggcttgagtgggttgaaagattggtgctgtgtggccacgattctgaggttgtgggatgtgaaaggagaagagaggggagaggtatgcgagaagagagctgctcaacttcaaacaccaacttaatcttcttggccagttgccttggaagcctggggctgagatcattaagcagcaagacgatgaggaggaaaacagtcaatcaaatgaaaggaagatgagcttcaagatgcccatctgcactctgcacgggagaggccgaggcaagaggattaagagttccaggccagcctgggctttagcgggagctgctgtctcaagacaaacaaacaaatcaatcacagaagggaagaaatccaaagtgggctcgactgaaggaagaggatcatcgtaagagcagcgcagcgggttcctctgtatggcagcttcgtgcttcctggccatcctcccttcaaatagtcccatgggctcacattttggcaagcaattgctgtgtcccacctgccagaaccgggcctgggcggctaacaagcctttctttttgctgttattcagtagaagcggagcacgttcacagtgaggggttgctgggtttgttcctttacacagggagacagcttgattagctacgtcttctaaaatcccttcactgcagaattcctgctcacaccctatctcaggggattgtgcctgacacagactctgcttgcctggttgtcagctccaagtgttatttagccaaaacgaaccaggacaaacaaggcgcgcacacagatcagatccagttggggacctagaggctaacagacactgatgttctcttgaaaaatagctcacttggggagtagcggataggaagagctaactactccacggtgctttggaaatgccttgttagaaggggcttagttaggcttggggttttgggtggagacagcatgtcaaatttgcggtttctctctaaacatccaccagaggctctggtatcagagctgaaatgaaggtcctcccccacaactcaccgcaatctctccctacacagctaaggcatgagtgcaggggcagctctccctctgtgctgatagactatctgaggcaggccctgtattctatttcaggaaatcagaccaaataaagttcattccaattaaaaagcaccgcaggccaggagaacaacaagcacccacctcacacaaaacagcgcagccgcaagcaaagcccctcacggagtcaatgacagcggtccctggctgaggtgaaggtttgttcagtgagatcaaagctgcccggtaaatcgggctgagaggattattctcccacatagccatcaccaggcatcttgatatgtatatcatgtacaaccacccagaggaggagaggcagctacgagggagtttgattccaaacattacagagccaagttatcatatggcttttaaatattgagcctcaacttgcttcatctcgataggacagatttttgagctgagaacacaagcgcgcacacgcacacacacacacacacacacacgcacacgcacacgcacacgtacaaactcacacacatactcagcttctttgtgtgctttggtaatggtctgctgtggtgtcacctaattcatggaatcaggttctgttctggttctgctttgcataggaaccgccctcctccagctccccaacctgccccctgggctctcaggtaagagcctgtggtctccagctggcggcagtgcttaggaaagttgtgtaaactttgggatgtaggggctggctttttactttttactttttgctgcagttctgactatcactaggaactggacccagctgctgtgccttcccgaccagggtggccagaaacctttggaagggtgaggcaaaagaactgctttcctcttcactcatgtctctcaggtattttttgtcctgggaacaaggaaaactactaacaccaagtcaaatgttcccaaa

SEQ ID NO: 469 - DNA, 1975 bp, Mus musculus
ccaaagttaacatcttgcagcaactgtgccacatcagtcaagtctaatattagataaccaaaagttatcattaaactttagattccatttggactttcccactgttattagaaatgactcttctcattcatgaaataaatattacatttggtgttctttattttcaagatgaagacttataaactagaaataaattatttaaagcaaagaagataaggagtaggaacaaaagtagaaagaaaggaagaaaaaggaaaaagaaagaaagaaagcgaaaagaagagagaaaaaagaaaagatagcagcacacaagatgattacctttgtggaatggctttgttccagtaagaacacatattttaaaaaatctattaaaatataacatttacgttaaagctagctgaatgctcatgactgtttattcatttcaaaacagaccacaacgttttgcaccgagtcacagatgcaggggaattatttagaagtaagatatcaacttttagatattaaagaacattccatatacaaacagaacattccagcatagagcacagagactgcttactcaagtacacattcaaaatacaagaaataccatactgtttttcagtaataagtatgcacttgacaaacaaaattctccaaactgctgagagaaagttttctcctgcaaagtttcaaacattgggctgcttgtaaaaacatttcacacctagcagtccaagattttcactgctaaaattagccagccatttatttttataggcaaattatagctctctaaaagagaaatgttgattagccccagatttctatatcctgtgtctctactggaccgttttctttgtaggcacatcatatctctgttcctcaggtcccctctttctctccttccttctgtccctccctcccttgtttccctccctccctctctccctccctccctccttccctccctccctccttccctccctcccttgtttccctccatcatttccctccctccctccctcgtttccctccctcccttctttctttccctccctccctctttccccccctccctctttttctttttctttttctttttctttttctttttctttttctttttctttttctttttcattacaacctttctttctttcttccttccctcatccctttcatggttcctgtaatgtaggagttcacatccagggtgtcacataggctagacaaggtctctaccactgatccccagctcacctcacatgcttatcttcaagctgtagtttggacctggatcttaaaagtatcccaaaggccaatgtagtgattccccacccctggctttaatgggaggtggggcaacagttaggagatgggggttagtgagaggaagttagatcatgagggcataccattgaagatttctcactctcccaccctctctctccccctctcttaaactctttcactctcttttcctccccttctttcctctcccttcctccatttctctctttgttccccacgaggtaaacacttgaaataccatatgctccctactgtaatgtactgccttgccacagacccaatgacagtgggactaagggaggaaatatagaaaccatgagtcaaaacaaaccttcactcccagtaagctaatgtcttgggcattttttttctcaccataataaaaaggtgactaacagaatctataagctgattttgcatggaaatgcagcctctcttttcttagacagttagcagtgggaataatgtttttccatttgcatttgacctggttagcattgacgttaacatgggatgttttagaggtgcatctgtgaaagtattggctatgaaattttcacattagctgcagaataacctgggtctactttggttttcaataattaaaaaatgccactttgggaatttaggaggttttaaatatgaactttcatacatgtgtgtgtgtgtgatcatg

SEQ ID NO: 470 - DNA, 1825 bp, Mus musculus
catgctagaaatctcacagaatctgttctttctaagagccagtcgggtttgtttaataaagtccatgtcatagacaaggagacccaaggttacaaagaggaacaagcagaaactggcatgtgtgatgtgtaaacactcatctttgtgattacaatatctttttataattttttttaacgtttgagctaacttgttcataatctggaacacatcctgggaagagctatagcttcattatccaaaagatagtaaacacggtgtctgcaatatagtaaatttaagtcttcagttgtggtttttttttttttttttttttttttaaatacctagtcaacattctgttaagtaaagctctgcccattctagatccttggcttaaatatctcccagcacccagtggcttagtcactcaaaattcccataacatatgtcagttcttagaatagaatttacttatacacacattcatcctacggctgacaacggtttacagggcatttatcccactctattcagtataccagattcaacataatagtgtgatgagcactgtccctgctctcagaaaatacagaacaaagaacaaggaattaacaaatggggaggtaattcccaagtctgccagaatagcaagtacaaagaccctgaggcagaaagagatctgaaatactctaggaacttacaggagaccagtgtaactaaaggtcatttaagacaaaacataaaccaaggaaaactgtgtgtgtgtgtgtgtgtgtgtgtgtgtatgtgacagatagccagacagattatgtgggaatgagggaagtaaggacatgagaacacatgtatggaggccaggggtaaatctagggtattgttccttgcatgctgaccacattagtttttaaagacgcagtctcttattcacctgcaactcaccagacaggctaaacttgctgaccagtaagtaagtctcaggcattcatctagctctgccttcccactgctgaaattacaaactcatgccacccaacccagcccttttcacacaggctctggaaagggaacccatgtcctcacaattccgcggcaagcatttcaccaacaaagctatctcctcaacctccgttttaaattttttattagcagttttaaaactagtggtggtcttcaagatttccttttgcattgttctcacggaaagagaaatgcctacaaccaatctaatattcataattgttgttctaaccaaagtctgagactgtttttagcaagaaaaaagagtggaagtattaaacatatcgcacatcccaatgatgtttatgcatatgtagacaaacttcctaaaaacagacgaggctgtcaaatgatgtaactatgatttatagtgtgaaaggcaacagaatgacagaaatagtttctcacgagataaacatcacaacattttccttatttgctttgctttcagaattaccatttctgaagatgggaacctcagaatcatcaatgtgactaaatctgatgctggaagttacacctgcatagccacgaaccattttggaactgccagcagtactgggaatgtgattgtgaaaggtaatggctaactcaaagaacccgtgtgcctttacttctaataatagaatcaccagacgtggcagcattcatattaatatgtatagatatcactgttgctagattaattcatcacagcaagcatgatatgattaacaattcttcgagaactgttggtaatgaatatgattgaaaggctatcttatttcagcatcgtccaatacaatttcagaattacagccattgtgtctattatagtattgtaacg

SEQ ID NO: 471 - DNA, 2775 bp, Mus musculus
tctttcttccgttgctgattctgctcctgtttgcagcactggatttctctgtggctatgagctgtgaggttgtcttgcctcttaattctctaactggcaggaaagacaaacccaaaatcaaggttcctaaactgtatcaatgaggtcagtcagaggtggatgctggctgctctagatacagggtattaacagacttgtccaatgggaagaaggagagtaaccctggcccgcaagcagacctagatagtcctcagtcgccccgtgcacaggccttcccttctttctcagcatggtgctggctttgatggctaactcctggtcctggatatgcagtgctcccctgtgactactgaatggagctctgcctgcctcagtggcttcgctgctcagagtgtggtaacctgagaatgcttttgcttctcagatatccttcctgcctcagctgcaattagacccaggacttcatggcatgtggtgccctggtgatagccttttggtcaggaaactccttccccggaagctgggcttccataggactgtgatctcctcaatcttttttttttttctagaagattctctccttctgttcttgctaggatggcctgagaccttggtagtaaccaaggacaggatatggtcagaaatcaggtttccagagttatgccaaagtcctgtgcttaggggtttgcccttattcctagtgtccactggggaccatagaccttctagtttggtcttctgtgagattctctaactggatctgggcttttaatagtagtctccttggccccagattcactggtaagagttaccagctctacagaatttaatggaaatttccagctcctaagatcaaacctaaagcactgcagactcattgcaagacatttcaattctgcattgaacagaatttttaaataaacagccagaggttatgtaaattgccaaccactgcaactctctgacctatagcttcagaggggttgggggcagccacatttccggacataaaccctaaggctccttagagcactgaacctacaccgttctggagggcaaggcatgtctaattacatgtctgcaggctgatggggctggaaaccacctttgctccttcacctgtgaacaaaaagccttgcctctgcattttagcatctcttaattctgctgacgcttcacagcacacagctctccatgtctttgaatgcatgtgttcctgggacttcagattcccaaattccatcctttattctcagttgctctagcctcagcgaattcgttcctttccagcttggtttccagtggctccagcaccacccacacaggtgtcaaagggagaagtggagccttggcataaccagatagaaagaatagagggagaaaatagaataataagatgcttcaaagtaaaaaaagaacacagcgccttctgccacggtccctctctacatgtctcaacctggacgttactcagcttgcctagtgatcagcaggaatgttccagaaaggctggcaacagcccgcagtgtgagctgctaaacaggatgcagatcaaagcaaggaaccttttagcaggtccaggcgttggaatgttccttctccattggttctgttcacattttcacaccgttttcagcatcaaagtgaagcaaaccaagatagatgtcttcatgtgctttctgttgttgagcacatccagagcctaggtatttcacagaggaaagatgggttcttagctcacagatgtggaggctgcgaggctagggtcagtggctgcatctggtggatgaccttgggcttgcccacagcgatgtggaaagggcaagggcaagcaggcacttgaggaagagagaccaggttctgggttgatgtcctgaaaggaagttcctatctctcttactgataaggtcactaagtgataagacactaaggtctctcttagggaccttatcactaggtgattgacttatctcttggctctacccttgagcactgccacgtggcaatcaactgtcaatatggcatttggagaggacagaccgaactcaaatgatggcaacaggaagaaaaggaaaaaaaaactaacaaaacaaaataacaacaaccaaaaacaaaccaaacaaacaaacaaaaaataaaatggtgtatttggtaagtcagaggggagatagatcctgaagtgttgaggaacgccttttggtaggctctcataccgctcatgcagtgtctgttgtgaggagagtcagaatgcactgccagcataagggacaactctggtctttaatgatgaccgttggagaccatcgtcgatgttcagtgtaaggaaagcaggttcaaggacttttgtattttgcagcaagcagaaccagaagcctggaggcaatctaactctaacgtgctggctgaggcagagtctgaaagaataaatccaaaccactgaaagttgaaatgggtggaaaatataatttgtaaaataatgttaaacatttgcttttaaagaatgttaggagggcctggagaaccacccgaaacacttggaatttcgggtttgaacactttatgcccttccagcaaacattgcagtctgtcagcttccgaagcagaaagacctgctgtgtctaatctgaggttcccctctgggtacacgcacagtaaacactgaataaagacattgtacatgaattatgagctaatacattctattttcgtctttgatagatagatgagatctgttcatacttatgacgtgtactgtgatatttttacttctgggta

SEQ ID NO: 472 - DNA, 2400 bp, Mus musculus
atccacttgacgggaatccggccctagaggtagtgaacgaaggcattagtatggctctaagctctgtaaccaaagtagtcagctatggctcgtgagtcctataaccaaagtagccatgccctttagcctagctctggagagactatggctcttgagtcctataaccaaggtagccatgccctttagcctagctctggagagactatggctcttgagtcctataaccaaggtagccatgccctttagcctagctctggagagactatggctcttgagtcctataaccaaggtagccataccctttagcctagctctggagagaacataggatactatgtcccagggacagaccaactgtgcacactcttgaaggggccacagctccagcctgaccctttggttttgtcaaaattctactgggaatcaagaaaactgcccacagccacaaaggacagacaacctctcacacaccacagccctgcaaaaaaaaaaaaaaaaaaaaagcaacccaagaaatccacctgtgggagggttgctagggctctgaggcatcctgggtaaggcagaacagtgcccaccagcacagagccaagaacttgtcctgcaagctaagtgtcttgctagtatcccacttgggaaaccaacaccaagcttccaccctgtaaacttcgccatcagcaaggctcctctgagaaaccttgagggaagaaaacaactgtgcaccaaagctggattctccctctctctgggttctcccagcatctcagactgagcagcgccgcccccccccacccccccacccccggcggcagagctagtctctgtgctaacaaatccttttcaacaacaggaatgaagagctcgatgaagaggtcttaagaatgtatcctttttagaagcacacactcacggtcacttctattgaacatgcttcctcgtgcttatacccttcacgatgtacaactgggctcctgacagcactgtctgtggagcctgcggcttgtgctcttggaggctgtcagagcccctgaaagccatacctgtacaccaccactgtgacagcaagcctccctggaagatatgtatgtgcatgagcgcgcgcgcgtgtgtgtgtgtgtgtgtgtgtgtgtgtgtgtgtgtgtgtgtgtttgtgtgtgtgagagactgtgtaggaggccctctcatatcctctctaccgtgtgacacagcagccccttccacttcctttctgcagttctgagatctgctattaccacagaaaccccaaaacactgtgctcgcagcctgtggtgacacacaaggaggacctacgagcctcaccatgaagccaaagcagataaaagctgggtgtgtgctgccgggaaaccacatcaccaggaccccctagcactcccaggaaactcttcctgcctgtgttgtcacatggaagcttcaggagagcagatgccaggtgacaaggcaaggcggttaccatgggaacaagtcatcgtcagtgaatcggatggccacatgatgcttggacttggagaaattctcaagacccatgacatgcatctcctcgcccagttttacccagagaccccagtgagactcctacataaagctacagcgcatcattgtcccattacttccattttaacttcctaggtgcaaaagagcagttacacagtgaacggaggccttattttatggaaccaagaggaattgtggaaaggcacctagttctgaggaattgggagatcttagaaagtgactaaaagcaccaggtacctcaggaagatcacatacaaaaaaagtttgactggggttctggggacccagaatgggagtagatttctcctcctccagtcattctaagggtgccacccacccaattagcatagctgccgagcccacgccccctcctacaaactcgctaggacactcatggccaggtaccttgcttttcttcacataggaatcttcctcataaacatctcgggacagcccaaagtcggaaatcttcatcttccgtccctcagccaccaagatgttcctggcagctaagtcccgatgtacaagctgtagaaagaaagcagcaagaaccctcagaccagccttggtgggcaggggctgggctgggctgggctgggcaccaggggcacacagcgtctgtggctctcaccttcatttctgccaagtactgcatacccctcgagatctgccaggcgaaggagatgaggtcacccatggtcagtaccctttcatctgggtggtccagcgagctggagttgcggctgcctccaccgctcacataggcaggcccaatcttgcggctgtcacggaggaatccccgcagggagccatacttggcatactccacaatgagaagaagtggccctggggacagagagagtcaag

SEQ ID NO: 473 - DNA, 2025 bp, Mus musculus
atatttcttcattgatttattttttaaggacaataaacagctgctttttaaaaatgcaatgtctgtagggttttgtcttctcttgaatggtttgctctgatttatttacatatattttttttcttaaaagtcattgtaaggccaggcagtgatggtgcatgcctttaatcccagcactcaggaggcagaggcaggtggatttctgagttcgaggccaacttggtctacagagtgagttccaggacagccaaggctacacagagaaaccctgtcttgaaaaaccaaaaaataaataaataaagatttttttaaaaagtcaatgtaagagaaattctttcagtttgtttctctagaggccagaagcaagaagaagaaaaagtattcctcgctctgggtatgaataatgccctatattcatacctttattaagtaatcatagttttcctctttttataaatagacattgtagcaacatgagaaaactgtacatcaatgagctgttacagtattaactcaaagcaaggaaatgtaccgtttttctcagcccaagcagcctacttgtggatgagtgcaaggctcctgttggggttctttgatcctgaggatgactagatctgctctgggggacaccattctcctcttacagataaggaaaccgagacccaataaagcacaagttgtgttcaagattgctcatcccaaaccaggctatctcattcagtcttgttaaaacctctaatgaacaatacaaagattaatgattgtaactctcactcgagttttcttccctttacaagacattttaattaactaattagttaattaataattaattcactttacctttcaatatccatccctgcctcagtctcctttctgacagcaacccccccccaacttcacctccccttatcttctgcaaaggggaggctcacatagctatcaccccaccctggcacatcaagtctctgcaagactaggtgcagactagcctctcccactgaggccagacaagacagctcagttaggggaccaggatccacaaacagacaagagattaggtgacagcccttgctccagttgttaggggactaacatgaaaaccaagctgtacatctgctacatatttacgggggagagggggcaaccaaagtgcaagacatttttgaaatcaccttccctccaaaaagttgtgtcgagatttccctctctcacattattgacgaatatgtcaccaccgacagaaataaaaggctcacgaaagccaaggcagaacatccatcacgccccccatttcctcgtgcctcatcaggttgtcactggaggagagtgtgatatgccacagaagctcagggaaacactctctgtcacactgttatttctgtcacagaagcaggtgtgcacagtccctcctcacctgtcaggctggacatcgacaggtcaaggggcacaactggagtgagatcccgtagaagtaatatgcacaaaaatgctgcctctggtcataatgcttccaaaaccatgtatcaatgacaaagcctgatagagttaccattgagacatggagacataagcacagtgaagacagcgaaggatggcatagcatccaggtggcacagggaggtgtgttcaattggaaggggcatcctgcatccgataccacactctttccggttgtaattctactttcaatatccttttgtcaagaaaggcacagtgaggtgaggaactggctaaaacctctaagggacaacataaagattcatgattctccagccaccactatgagattagtaatttgagaaacttggtctgcacttccaccaagactgaaacacttccaacagaagaccagtgaaagaggatggccatcactgctggcggcgagggactctgagtccagaagatggagtaagactttgtatagtcacactctgtcccccatctccaactcagggatattggaattaagtctcctgagctgtttactatgtgaccctgggtatttggttttaattctttgct

SEQ ID NO: 474 - DNA, 6450 bp, Mus musculus
tacaaatatgtattcctttaaatgtattagtgttcagatagaagactgtattcattgtattttcaaactatcatttaaatatcagacaaatgtggttttgtttttattataacaataactaccagtactcatcaaatgctttcttttacatctatgtgggaaatgtagactcaaagtatcttattcaacagtcagaatcatagagtacaaaaaaaaatcacctaattgtaaaaaccaattttgtaacatcttggacttttaatgagaaaaatcatcttttccaatcatttcctttttttaaaacctcaacatcttgaaccataacaacagggctgcatttcaaaaaggtgacatttaccttcacatctggagagttaaatcaatagctatatttgaaagaacaaaagttggatagcatattccactgggtgaagggaggaagacaccacgaggtaagagtaggtgttaacacactaatgatcatttttaataacagaaggaccttttctgggaaaaaaataccaacattttttttccagttctgccttctctttcggataacctttgaatgagagaaacttctgctggtgtcaaatgaccacgaggatattaacaactggacatgtagcttgtccatcgctgttgggtatatctcctttaccaagctagctttctccactactgccactgaccttgcaaacagctctgacaaaggtcggaatggattcattgatcagctagaccaagcatatgacagtctgtgccttaattgaatcccaaaagggggcagactgggtttttattacagaggccagccgatagcactcattaaaagctccacagactgtgtggtttactaattagtttattatacagacaccttgacgatgggcgaagttgtcattttgccctttatcgcacaggggatgttgttaaaagtttaatcagctaacactgaccaagttagcttggcaggctgtggatggtcattgcggaggtcattcccgctgcagaaattctgacagggtcacagcatgaacgtataataaagagagttacataaggtaggagcacacctgaaagggacccctgaaaagagatgtgctctgcagggagtagagagcagatgggctgttaggacaggtgaatccttttaaagtttatctttgcctacactgctgccttcattctttctgaagggatggggtgtgcgactgtcatcttgatacgttcatcagatatagtgcgattagtatgtggagttgggaaatgttgctttatgttcctccagaaacggagatcgttgactgaaattatgacattcttatattcaagattaacagtggtgcccttatatgtaagatttacctagttgcagagaagtaggtgagctatgctacatcatttagacttgacctatttgaacaaaggtaggttttccataactggttattattattaattattattcagaaaatcaaagcattgaacagtcctgtcagaaaattctctcaatttccaatttagctcaatttactgctaagagttttaacttttctgatagattctcttttaatctattacaaggaatattgttgtacaaggaaatttgtccttgtggtctcctaggaagactattgaaaactatttactgaatttaccaaatctgtttggcaagcactcactatggaactatgttgagtgactatttttcttttgttttgctttgttttgttttcgatacttcacagaggagataatggaaaaattaagtgtgcacacttgaattttgttgttttacttgccctaacaatcccactttgtacacttaacagagtagttcacacagagtgcgacgagatgtcaacccaacaaaacaatttttttttaaaaaagtgtaaatctcaattttgaattgttttaaaaagtccccatgtaagaaagatgaaaagatgtatagcttagccatgcattaaaggggagaaaaatacaagggagggagagagggacgcagggagcaaggcagaagggtgcaaggaaggaggaagtgaaggagagatggtggaaaaagtactggaagaagcagaggaggaaaatcagggagaaggaaagaggaaatgaacatgcttgtacttcagtggttatgatactcctgaataacatgctcaacccaagattttgaagatatgaacagaagccacataggaacacagcattgtactttaaaatatatctattgagtattttttaacagttttttttcctatagatttagtgagatgcacctcactagttcagaaaaagatgcatgtattccctgtatgtgtggtcctggaatattcaaatctctagaccctgtataaagctgaagtttaggtccaggtcattcaatgtgtaaattgtacaattccagacataatcttttgaaattgatgtgtttactctgtaatcttgctttcctcagcctcggttgtcatatctgcaatattatctgaaggctttaagatagtacatctgtatgggttacaaaagataagaatgtgttgaagcaacacatttatttctgataccacaaacctattttgactatgtcttggaaagtaataagtaacactgaaaagcttctaccctggagattaaatgacaatttaatagatcattcagtgttttcctgaagagtgaagaaatatcctgtattgcatttcaactgtagaaagaatgttaggcatcattgtgtattattcaagctggaattgatccagcaaagtaggtctaacattgcagctaactatagactttgtgaaaaggaagcgtcttcaggggttcacacttcttgctagtgctgaggaagtttcccatggagacagattgttccatcaagcccacacaggcaagctctgcgttattaactcactttggaaggaaaaaaaaagtgagctgtttgaacagtacagttaaaagagggtgcctgtggtgtgtttattttttatgccaaccatggagaaagtcatgaaaaattattactggtttatctgaagctttatcttcgcaaagtcgtctcagcagagtcgtgtcgcttcaaacatgccagcgttgtgttataaaagcacctgataatctaactgctaaacaagaaatgtgcatcaaagagcaagtcagatgtaaacaaagtgtgactataggatgcgcaaagatacgtgtgataccttaacccaacagagttccatatcaaggacacgcatgtaacacgtatgaactgttgagatgagtgggcgaacctgatggaatgagacgtaaagtaaagctaaagtacagcctctctaagtggaagactcaaaccacaacgcagacttataactaaaacgtgtgtccattatgaaggaaatagagagggcacttatacctatttcaatggcaaagccattacatctgacaattgcaatgctaaaagacacggtggatatattcagtggaaatacatttaaaagatagctatgatcttttgtgtcttaaaaaaatcaaatattcttctacccagcaatgtcactccctagtagatatgacatagaatggttctgtatctgagaatgtaaaggatgcatggtagagctcaggaactttagatgctcttggtcatttaactataagcaaatctaacaaccaacaggtatgtaaacaaaagtagactatataaataatgatgtagatatgaaagaatcctcttaatttaatttatatacatgtagcataagaaactagagaaaaccaaacattaggaacccaaaactttgtaagctcacgaggagaataagagcattagctgaggctaatgttccctgagtagctatatgaagattgactaacttaagtcactggatcttaagtcatgctgggattctgggtaggacggggtccagatgacgcaggggtttagaatggatgcagccacaaaatctcctgtctttaaagtatactatcctgtgcaaaaggatgaaccaacacttcatgctggaaatctacaacttatgcatgacgaaaataagtttttccctgacaaacataaccactgtctttattctcaagacacttggagttcttacccgttcatctttagaatccccatgctagatagtaacactgtaaaaagacttagctcagcatcccttgtaacagcaaattctgcactttttgtaaaataatatcaatataaactgtaagtatttatccttcttcaaagggaaagatctagcctcataaaggtgaacttagcatgcatcattaaactctgaggcacgtgtgtatattttactatgatccatggacttttatagtttgcatagaaggggaacaaataagagtaaaactgtaacttgatcttgtcatacaataatcttattacttaaaatatataattaagaatataaaataatgaaagacaaaagtccagaaaattattatggagagaagccagctgaagaagtacggcacattaaatacattgttacttaaattacacaacagaaatttgaattaaaatgcaattaaataaaagacccagcagagctaaagagaaaaatgccaatctggaagttatttaatgaaattgcatctcagaactaaataaagatggaaaagatacagaaataggtgtaacagatgcttaactgtggtgtgaagggagggatggagaaaggataatgaggttgtgtttcccatcccactaaagaataaaaattggaggttcaactattattttaaaataattgcctggctaaagtcatcctgaactgcgaagacagaaaaccatttagaatcgcaattaactacctgaatgtgaacgatgcacaaggaaacaaagcaaattgtataagaggagacaagagagataagcatgtttaaacaaacagtcaacactagaaaatattgctcaaaaaaattgttccatgggaagaagaaactggaacacaacacccatgtagctcagatcacgtgaagatcataggcaagaattggaccaaaaataaattaaaaaaaaaaaaaaagatttttaaaaacgtctgttctcggacacacgtgttgagagcttttgctgtttcttctaggaatttggcatctgtcactgggcttggacaagaaagtaggctcagataagaatatcagaaacggtgaccacgggctttgtttaccactttgctgaaaacctaccttatgtgatctctttgcttactactctccttgattgctttcctgtgtctacaccttgtttactacttcccttgatgactttgtttttgatctaagaactgaccatgtgttttggatgcacctacaatgatataaaagcagactgggagtcacgttttgtcaactgtttttctttttcattcctcactccctagcttgagattctgttgactaactgagctggcttggtcacacactgtgcctgttacttacagagtcttcactgagacacagtgccttcagcttcctgcccacttatgggacatgtttgagcattttgacactgcatatagagcaggatacttaagacagaggctaggtacaaagatcaatgggaaacccaacaattcagtcccctgaagtccttggaagcttctaagacatcagtctccaacccttaaggatatgtggattactgtcactaacagtgtctctagaatctagtatcttctgtggtagtgtttacttacctatgactcatggcctacaagaacaaatatttgaaatgagagctgtgtgtttttacccataaatctaaacttacattgtcaaaaattggggacacaacgtgaggagccttttccaagtaattttgtcattttgatttggaatcgttgaggagtctaagagagactatgaagaccactaagatttggttatgcagttcttccttgttaaaaaaaaatttgtaaatataaatctaccctctcatttttctctgactcagaaggtcagcctaagaataagatacactgtttttgcattggattatacatgttagcataagtgaaagtgagaaataaggtatgtttaatctatataatactaaaaccatgtttattcctaagacctttgcagtaacagtgtggtacttttaagtctgaatcatgtctgagtgtttccatagggaagagagcctatggtcatgctctatccatcttaagttcatctccactaccgattctattgctttgtattagaagaggtgcttcaggagagagtgatgtaagcacaaatgtacaatgtttatctttcatatctgtgtttaaatacacggccatcatgctctctgccacccattttaagcacaacaatcggtgccattgtaggtcattgccttttaaatctaatccattagtggttttatgcaataaatagcttaagtgaaactggtcattttggtgtaaaactcagaaagctgttatt

SEQ ID NO: 475 - DNA, 4750 bp, Mus musculus
cattgtgtcctggatttcctgcatgttttgagttaggatccttttgcattttgtattttctttgactgttgtgtcgatgttctgtatggaatcttctgcacctgagattctctcttccatttcttgtattctgttgctgatgctcgcatctatggttccagatctctttcctagggtttctatctccagcgttgccttgctttgggttttctttattgtgtctacttccccttttagttctagtttggttttgttcatttccatcacctgtttggatgtgttttcctgtttttctttaaggacttctacctgtttggttgtgttttcctgcttttctttaagggcctgtaactctttagcagtgctctcctgtaattctttaagtgacttatgaaagtccttcttgatgtcctctatcatcatcatgagaaatgtttttaaatctgggtctagatttttggttgtgttggggtgcccaggactaggtggggtgggagtgctgtgttctgatgatggtgagtggtcttgatttctgttagtaggattcttacgtttgcctttcgccatctggtaatctctgaagctagctgttatagttctcactgttaagagcttgctcttcaggtgactctgttagcctctataagcagacctgggagggtagctctctccttagtttcagtgggcagagtattctctgcaggcaaactctcttcttgcagggaaggtgcccagatatctggtgttcgaaccagactcctggcagaagttgcgttccactcactagtggtcttaggatcccgtgtggaatcctatgtgggcccttgcgggtgtcaggcgactcagctggcaaggtaccctggggctctagtggagcagaaggggcttgtgccccaggtcaggctcgggtagtctgcttccctatgtacagcagtctcaggttcctcgtgattggattggggcaggcgctgtgttccactcatcagaggtcttaggatcccgtggggaatcctgtgtgggcccatgcgggtgtcgggccagtcagtggtgttttctagttcacgtgctcaccgcaccttttcacttaaatctctcacagaggaacacatttccaccagtttagataacttctctaaataagcctcccattctatgatatggttacattcactgtgcaatgctgactttcaccgtcacgaacactgcggacatcgtgtatctatctttcttcctgtttcagaataaggtccttgagaagagagtccttagtggatgtgtatgtatatgtgggagagtatatgtttgcaatgccattgacagaaagcacatatagaacaccaacctgatttttttaaaaaaaaattcttaattcttcaattctcttatttagtgtaaaaatgaatacttttgaccctcttttgcttattctatttaaattacatattgcacccagaaagaacataaaacctattttactggatattttcatagctttttcattctcagatagttgcttctattctttgtttctcaaatatggttttgagtctaagaatattctgaactagtacagaaaagataaaataacttttctctcacattttctaaaatcccttttctaatacaagaccatctgtgccaaaaatttggctcatgaagtcttacttagaattgatgtttaaaaaaaaatagatatgcaagagggagaagattgcttagcaggtaaaggcacttggtgccaaacctgaaaagttgagttatattccagacacgacaagctgtcctctgatctccacatgcatgccatgatgtgcacgtacatacacacgcactcacacacacacacacaaacgcacgcacacacaaaaacacacacacatataaacacacacacacatgcacacatactaaagctaaaataaattttaaagtaaccttgcaaaataattatataaattttacataaccatgaccttgtagtgaagacaaattcctacttcctgtcactatgtgtactaaagttatgtcagaattttatttgcacttaacttagttgtattgttagtatgttgtattgttgttattgtataaaagtaactgtatcttgcagctggagtagctgctcagagtttaagaacacttgctaccgttgcagtggaatgttcaattcccataatctacatggtggttcatcctggatctgacattctcttctggccttcgtgggaacaaaggatacatgcagtgcacagacttccatgtatgtgaaatattcatgcacaaacacttatccacacagagacacacccatatttcacaagtaagtgtattgtggtcataatgccgtttgtaggggaacgttgttttaattattcctgaaaatttgttattattgtacaattcctgatgttctttaccaagttgcttggattattttaaatcatgttcactctattaagggtattttttcttcatttcctgtaccgacaaatgtatagcaaacaaacttctactgtagctagaacccctaagactattaaaaattctaagttgctttctgaacagattgcagcagccagttgatgaaagttgggctaattacactaatgctgacaaatgcaatagaatcaaaacaaatgtctcattttttcaaacaaaacttacacctcttcaaaagccaaaaggggggatagatgctaaatagattcagtgatttgtgggtgtaacgaagctatttgtgcaaaaacagttttgaacattattattaaaattttaaaaagtaccagtgaagtgtggaaacttctatttgatttttaaatgtagttattgacatatctgaaatcttggaacaacaacaaaaataactgatagttatccaagttgtttatttgaattttgtgtcatatacaaaagcacaacctttgcatcttaatttaagatgaggtaatgtgaatatactaactggaaaagcatattcttttagagattttaatcagtatcttctaggaaccatttattgtatactcagccacaaacatccttatattctctattacttgagaatatttctaaatagtcttatatttagcatatgtgctggcttcccagtgctgtctaatatgcagaaaatatttagcaactattttaatctgatcttcctgattctactgtaattctattgtaaggaagactcaattgtctactttctttaaatatatgtatatatcacttcttattcattttcaactgctgattcccctgtctcatctcctctctttctgccactgaaacctttctcccatcaagttctcctactttcaagccttctctttgtagccactgagtttagagactctttctggagcactagtttggtggggtgtcttttttttttaattttttatattggattaaaggtttacttttcagtagccaaatcattgaaggaaaggatgctcccacatctatcaccattatcttgccctagtctccaacccacagagacaagaacgacacggacaccaagtcgggttcgcgcaacagcttctttactttcgcctttttcacttccagctctcttcccccagcagtttcttctcttcttcttcttacagcaagggctattctcctatactcgcaacgctgacctcatctcgctccaccctacctcatccaatcagaatcacacacgctccagaaaggagctcaggtcggtcacagataggctgacagacagatccggatcactaggaaactcacatgcagtttcaccacgcatgctcgggcaaggcagtaaacacgcgggactctggcaatgggtcagggcaccatcttggcccatgtggctgcacccgcttcctgaattaactgtctaaatggtcatctgcaaatgactgagattaaataactcaccccagttagcagggcaggactttagcccaaggtcttcttgactcccaagcttctacacttcatacaaatacatgctgggtctccagtgccaagtattggaggaatatatcgtgagagttatcttatagcgaagagggcaggccagagagatttcttgaacttactgtgatgaatctctcagcaatgtcctttacactggggaaattgtgcagcatttagttttgagttacaacatgccgcccttatgccatatgagaagagatctctgtgggccggatgcagttactccgtattccttctaatggaggcctaggttattatcagtgaattaaggtgcttcttctcaaggctcgtggtgagagtttcacttctaaacccacatggtagaaagagagaacaggatgcccaaatcattctctgacattcacaatcgtgctctgtttggcaagtgccatggtatgtatgcacccacacaaatacacactcaaaatcaattaataaatctacaaaggtgctaagttcaggggcttgaaagacagcagtgagaaaaagaacttgacaccaagcctacctatgtgggtttgatcctgggagcttacatggtagaaagaaagaaccaatacaagcaagtagtcctcttgtttctatatatgagccatggctcattcatacacacacacacatacacacacacacacacacacacacacacacacacacacacacacatgctctttcacacacacaccatatgcagtcctaacactgtaaagcctgaggcaaagagttatgagttctaggccagccatgacaatgcagaattactatatttaataaa

SEQ ID NO: 476 - DNA, 4800 bp, Mus musculus
aaagtatctcctaaaatatccactaatcaaagaaattagcatttcaaatgctttaagtgtaggagaaaatacatacttcaataagttccaagatgaagcagtcgtcatcttgatgacgactattgatgaacacttgtgttggggagaccactacggagaatcatttcctacagcatatgtatacaccataaatagtttaatatagtcataatccatttgatgattcaatggtaaataatgttcctataacaagaatataagtggcagttgctaattttaccagaagctgtgattcaacccaattggaaagatagaagtggacacgtgtgcagacaaggagctataaaactcttctgaaacaaattcaagtgctctctcaccataaacatcaaaatagaatagccacgttgttattcagacataaaacatggaagatataatgggaaatattgtgatgatattgtcttattaaacacctcagtaaactgtttcatcacaaggccaggaatatggcaaagtgttttctgtgcaggtatgaggacctacatccatgtccacagcacaagggtaaaacccatgctgcctgtgacctcagccttgggaggtagatctccccacagtttgctggtgagcctttccagttcaattgattagtttcaggttctgtgagagacaatcttaacaaaacagagaacaatcaagaatgagtctgacatgttgtttctgcaggcccaggtacacaactgtacagttgtacaaacatgtgcattctgcccaacaaaaacaaaccaaagtgaaactatttcctttttaactgtgccttgtacacgtatcacaggtgacaaagtataaaaattattttaatttataattaacaaattaaagtgaaaaaatacagtatactttgcataatattataacagccaaaagcccttcatttagtgacaaagataatttgatacatttaagatcatgctgggtttgtctttattctgagacgaaatcagtaaattattaagatacaagtatcaagtactgatttgtccaatcatttcataaaggaatgtatttcctcaaagatgaattttttctgccatatcttccttaacctgtatttcattatgaatgtttaacatgaattctcagaaatatctacacacaacagtgaaaagagactgccactctgcaacagtcagctctgtcggtctaattaccattgggcactgctctgagttgaagtgttaccaatttggagcacttcatcctatctgccgcacctgcattctatctgctgatgtgcattaccgccatcttagccctggagttaaactgtgggaaacgattgattattaaggaaggtgcgctgagctgcaccgcagcgccatcttttggtcgccttgagaaatgaaccaagtttgtgaggaagactcaatcgttcctgttttgttacatacctttgcaacacaataaaagtaggaaaacagttttaaaataaacgttactcgcgagacggtgggtccaaaagacatatctgaagggaaaatatgtgagctttgttcacacatcaaaccctgcaatataactttagaaaccatttacttctgtgattgctaatttctttgaaaagcactgagtttccatgactctgtaatatcacgatttaaaaatgctataagctctatattattaatacacttttattgttttcttctaatttcaactcttaggtcttggtcatttccatagaattgtttgtaagtacttgaatgataatcaaatatgcactttcaatttttaatagtctatggttttgacccttttagagagttttttttcttattattgacatttgcattttgtttattaattttctctctagactcctgcaattctcttttttttcctgtagatttttggttgtttgtttgttttgttggttttgtttgttatattgtgttttttggtcaacatctttaagacattgttgttagtgcattcaccttaagttctgcttagggacagtgattggctagatactctttgcctttaaagtcccaaacttattttctctgtatcacttgtgatgatgatgatgatgatggtggtggtggtgaggttgaagactggacattcatgtgtaatggagtgatacctgtgagagtcaggttcacctccttttccaggacttgctgttcctgttgctcttctagactcactgggaatggaagatgagcctgacgtgtaaaactctcagctgttttcctgcactgttccctgagcatgcccgtctccttttacagcctacagcatatgcgccctttgagtatagagtgctgcttctgaagaaggaaatgagaggaagcacagcagtacggctaaactttaaaatggcagataaacacttgcaacaaaagatggaggatttaatcagtggctaactcagagtctctgttcgtcagtgtgatgtagaatatgaagtcattattctccggggaaagataacttaatacctgtaaccccaacaaccagggcttaaggtagatgattgctgcaaggttgtagcaaggctgggaatagtgtgagctttgggaaagcctgggctacactttgagacccattctcaaggtaaattaactgttttgttttgttttttattgtttttgttttgttttgttttgttttttcaagacagggtttttctgtgtaactgtcctggctttgtaaaccaggctgccctcacactcacagaaattcacttacctctggttcccaagggctgggattaaaggtatgtgccaccactgtctggcttaaattaagtaattaataaaagaagctcattgttttagaacactttaaagtttatcttgtaaaagagattaaagagagtatgtgattatcaccattttaataagacactttgtatgtttaaaaatgtaatatagaacactccagaagaggaaattggaaaggggaggggtatatgtatatgtatatgtatatatatatatatatatatatatatatatatatacagttagcaagtaaacaaaaacaatgttttcattttgtcttcaaaagcctgccctaattaatgctatgctattctgaaatctatcttattaatatgcagaagcaatcatgtaaaaatagaatcatttcactgttatagttggcagctgaggcttcagtcacacctcctcccacacacaaataaattgtgtctgcaaatttttgaatatttaccaagttcctggaacaaatattttatccagaagcatctcctttcctaagaatgtgcagctataaaagttttctgatgccaccgtacaactttttagtgacatctatagcaaagactactgaaggagtgcctttccccgcttgcatatgggtggtagtatatacagaatatgattttaggtgtagacatatacataatatgtcttcgttaactgagtgacgtatttcacagggataaataagtgatattctcctcaacaaagtgtttttgatacttggtaatttgaccaatgaaaaatcaggcaaaaaataacaatacagaaacgcaaagatcttctaacaaagtaacacagacagagttaataaaaaatgctacgtattttattcttttatttttaattttctgtttgtagatattaattcatcacgttagaagtccagtttactctcttaacacctcctgggttagtcggttttgtgcagctttggcaaaataaaaattaagaacacaacataaaccaggacacatttgctatgtcccatgggttcagacgccatgcccctcttgtttagcctcacatcgtggtggtgggaaccaatggtgcagaagactccaccataggagacagggaagaaataaaggacggaatgtggaagcagacataactcacaacaaacaagcaaacaacacaaaacaacaaaaccagtggcttattcttcccaagtgggcaccacttcctaaagtttgcagaaaacttcctttatagcataacgagatagagacctagtactgaacacaggaccacatttaaactgtgtcatttttatgtgacctgtttgtctctacagccagcaattccatcacatcgctactattcggtataaactgagccaagttgcctattaatattgaaacttaatctaactttaaagtcaaactattacatcatttgtgtgcttttcctgtttatccctgacttctctctcacagatgtctgcttcatttcttttcctcacccaacagtggttccacctacgtatgcacttttaacttgtgactgcttttcttttagtttcttttttatatatatactttttattaggtattttcctcatttacatttccaatgctatcccaaaagtcccccataccctcccacccactcccctacccacccattcccacttttcggccctgccgttcccctgtactggggcatataaagtttgcgagtccaatgggcctctctttccagtgatggccgactaggacatcttttgatacatatgcagctagagtcaagagctcaggggtactggttagttcataatgttgctccacctatagagttgcagatccctttagctccttgggtactttctctagctcctccattgggggccctgtgatccatccaatagctgactgcgagcatccacttctgtgtttgctaggccccggcatattcttttagtttcttaaacagtaaaagtaagtaaataaataaagaatgctgaaaggtaacttccccatacttccccccacatcatctttat

SEQ ID NO: 477 - DNA, 2975 bp, Mus musculus
ggattgtgtgcactttatctctggtttgagtgtcctgttattactgccatacaaagcaggacagagggatgcagggagataaaatcctggctaactttcatactggtgatagagagtccttacctgcagatttccactcaaatgcttgaggggacaatatttaatctttaccatttgggagtttgggaataactcaataattatttgagagttcacttactagcttcaacggatttgctatattcacatcaatgctcacagcccatttatagtcatatgtgggcacatataggacagtgggacctgtcgcttaccccaaggtcaaacaaggtgactctcagccttggctatcccccacatgattaaaaaggatgccgtgcagtctgtttatctcacctgcagctttttaagttcgttctgttggtggttttgctattttaaaacacccatgaggtcagtgctgagtcctgactggtaactccaaagctgataagtcctacacaggagaaggctgcgatgtcctttatggagtaacccacgtgttagacaaacgttgatcgggcaagagctatgactgtttgacctcaacacgaacagatcaaagtataaattaagtcaggcatttacaaacagaaagacacgggtgctggcttgaggttcagtgggtcctaactctctcatctaactgacatggttcacaggtcgatggctcacagttgaaagtgacctttgtagaatacaatgatgatagatgagtagaattctctgcagctaggctgcctgaaaagaacggtgggcattgtagtgaaggggaagaaaaaagtaaggagccaggtctgggaggattcagagttaggccaaacagaagacagatgtgtatttaaatcaaggcccaagagacatggggtggggcgggaggggggtggtggtaggaaagggttagatgccagatttcaggtgtgctgggggacactgtctattataagctgaggagattgaaactgatctcacaaatggatttgaagcaaagatgtcatgctgacctctaagaatgggaagaaaatgttcagggaaatggccctggaatgtggcagcaaggacaattgtctccgtgccacttggctttaacagacaggactaggaaagccgacctaccatcagctaacaattggtgttgaaggctgcagtgtgaggaaggagctggcagaggtggaggtatcacagggaaatgaaggaagcacaaggaggagaggatttaaaagaagagggtgactaagcaaagggcccatcccagagctggtgtaaatctcagagtctgtgggtggtgtggttaccatcctttgtgtgtatgaaaacacggctctgagcagactgagcagtcccaggggtagctatggaaactgttaaaaaaaacaattccaataagtatttcatggtccaccgcttttgggtctccatttaatttaatagccagagaaaactacgtttctaagaccagagagtagctgctctttcactcactccacctctccttacggttatgatataaagtttgtcgttggccatttagattcaaatattcatgtgcatgcacacacatgcatacaggcatgcacacatgaacacatgcacactcttggtgtctcgtgctactcaatgaatcctgacagcatagtccgcagccaggatcgaaaaagagtgactgtctgccttgaaataaccgtgggccacagttgactgattgagggtggcaagctcagatttctggggtgggctgcctggaggtgctattttaatatttatcttgtactacttccattaaaatcaactttcaagaagaagtggagtgaagctacccatgagtcaccccggctttatttgtaataaacctggatatgtggggttttagtttcagaagaattagccatcaagataagttaggatgacgtccatggttttcctacgtggcccaaggcttttcatcttgagaagctcgggcatggcatctcgggctgcacaaggcactggagggtcccctggggacctgagctttgtcctatcaagctacatcctcaaactcagcttcagtttccttaggagggctgttcctttattcctgtttagcgacaatctatggcctcttcgcgtggcgcccgaacttggctgtgtgtcctcatgtagttggcttcagtggtgtttttatctgggtctcgtgttataacttgcttagcatccctaagtgtgagttttaaaattatttatgtgaataggtgttttgcctgcgtgtacgcatgtgtaccatttgtgtgccctgtgtctttggagtccccaaattggaactggagttatgcgtggttgtgagaccccttgtgattgctgggaattaagagcagcctgtgctcttaatggctttgccacctctccagcgccacctagtgtaggactttctcagaggatttcctcagtttaattgtttgggaatatttttttcaaccaccagagaatcatggatgccaaataactcagctggtcattagccacccagggctgcatgtgggggaaggctgagtgcgtcctacttttttatttgttaaagtactttttcttaattttttatatactttgtagaataatatctaatcctttgactaatgggaaattatgtcactggaggcataaaattgctcccctgaaaggcgaagcctgcgtgaagtatcacaattgaggaataatttcagttccaactgtaaaccccaactgtgtgaagggcatggtctcagagattaaagggagatttgcagaccctgaacaaagtccgccaggattgtaagaaaggatgattgggaaagaacaaagagtaaagaagaatattggagggcccctttgcagactagctgaaaggacctcagttctcttaaagctggccacatagcttcacatctacatgaagacagccttaatctactcccccaata

SEQ ID NO: 478 - DNA, 2450 bp, Mus musculus
agcaggccactccggggataaagaactcactgtgcaagcactggatccctagggatcacattacaaagctgtgttatggcatcctcctgtaatccccatgctggggaggtggagacaggcaaaaggattcctaggattcctgtccagccaccataaccaagctattgggttccaggccactgagtgttcctgtctggaaaaacaaggacgatgtttactgaggaagcttctgcagcaagagggcagaggttgacctctgtcctcacagacacacacatccatgcacacacatgcatgcacacacgcatgcatgcacacactcatgctgacctctcccaaataaaaaggaaccatgtcggcaggctgcccgctcgtctgtacaacatcaccaattgtttctgggtctccagcctggtgttcaacatcacagattcagaaattattagttacagagaaacagagagcacctggtttctattgctgacctattttcaatagaattcccagctttaggggtgccacagggggaacggagaggtggctcagtgcttatgtgtacacctgccctcacagcacatggacggcacaattaaaaataaaactgagtctttgatgggaaaggaggccataagaatacagagaggcctctaatatgatggagtctctgtcctggtgggagcattcacagagcgtaagggcaactgcgattcagagacaagggagggctctcttagaagaacactcaactctgtaacttcaagactcacgctgacatcctccacttcagctcaggtcacaggttctgtgactgccactgcaaaagactgcatggccacgcaatgctctgacacactgcacggcaatgcagcctccgctctctgctcctctactgaccaggctgactgactttgtcaaggatcaagaactgtcggtcaagcttcctcactccttagttctctgatcctccaaattccttctgtaatcaaaagaccaagaccaaactactgacctgccactcgccctaagaaaggctctgagtgacatgcaagaacccaggactctgctttgtctcatggtgaaagtctggagagtgccagaagtccttggtttgggtggctccttcaaagacatgcgatggccacaaacactcacaaaaccctggaggaggcctctcaagagcaaggcaggcctttgcgctataacataatctttgatggccctgaagaacgtgtttacttaaattcacaaaagagggctggctttgctctgtttcaccaacagattagggtttcaaagaaatactggcaatgtaggtcattgttttattctcttttaacgagctttgaagcttcgatgaaatcttatcagggtgtcaagattttaaaactcccacctgtacctcgttccttctagaactcttttgagcagttgcggcctcctcctcatgcatgctgggctctagctatgagaaaccctgccagccactgctccgtccttactgcctctctggtaggcagactcaaagcagacatgaattcctagggatcgattataagaaccagcaatgcaattgcaggcagcctctctcagaccctccatttttctagccgtaattctcccagagtttactcactgggctctttttaaaaggcgtgcaaatctcaacactgtggccattgaacaccacaagtgtgactgtaaagagagcccagcagaatgaaaagactgtactctcccgtttgtcaacagggggcttctgtgtaatgctccctctgcatccaggtctgtgtgcttgcttgtctgttctggaaatgaatgcatcaaaccatggcacaccagaaactgcccgaaggtcaaaggcagccaataagtacgttctgcaaacccctagtctcctgacatggcattctgctttcttccgatcaccacaactttgtccctcgtagatggtttctctgtaaaccaactaaccaaccccagttcctatgacaacaaacagcccaagcaacgtggcaaattctcagatagaatatgctctcacagctaacttcacgcactctttggaagtaatggagttattcctaatgtctctgtgtattctacccaaacttcagactgtcttggctgtcagtgtaatactgcactaactcccaaaaaccaatgaagcaaatccaacaggaggcagacaacaggactggtagtcagaactcaaggcaagcctctgatctagctcaacatttaaatataaatattaatatatttaatagtaataacaataaggctcagagaacacatggtatggatttgcatcccagcaatactccccttttaccttcctggaaagttggaggtaaaattttttatcaaataactcaaaaagaacttgccgcagaagtgtgagttttcccagcccaatgtcccaattatctagcatgttgagcgcaatatgt

SEQ ID NO: 479 - DNA, 2750 bp, Mus musculus
aaatatataccggctttccgtctctcattccatttaatgcgcagtaataatactttccactatattaataacaatggctagagtttatttagtaccttccactaaaatgtagcatattttatattctatttgatatatccttcctacatgtattttttttaattgtaatagtatagtaagttgtcatattaagtaattttttggtctgatagtataataaagccatgcactggtccaatacacatttattaaatttatttactaaatttatttattatgcattgggcactattttgttgctagagacaaaacaaaaagagaaagtggacatgttcctgcccacatgagtttgtaacccagcgtgagccatgccactcacttatgaggatcctgtataagtgatggctccctgttacatgagaaagatattttctcttgtgtctaactgattgtaaatttaatttaggttgtgttaccatgacaacctcactcatgggaacccactggtaaatgggtattaagttgttttgctacttcataaattatgatccttttcatgcagtttatggggaaaccagctgcaaataagctctagtttatcatcaataatgatgcagaaagcatttaagatcaaatgtgtggtaaaatgtaccttggtgagatggggaaatactgagctgtggttacgagtcactgtctacttaataacattatagaagaatccagagggctgataggagatagcagaagaatatattccagaagagatataatttaagtgggtggagaaattttaaggtatcaatagcaagatattgatataaaaatgatacctataggagaaagacaataaagatcaagaaagatgacagccctctggtaacagagagagggcggtttctgtaaacgtactaagagtcagtgtgaagaagcactccaaggcccacatgatttcctacttaagtggaaccagccacgcacaggcaggttgggagatctgacggttactgacatgttttccttcaggaacaactggagccaggcccactaactcaggcaaggctctgcccagctcaccatgtttacatatgcagcatacacacacagtgagttttacacagccttccctgtcagcatcatgtctgttaggggatactcctaaacaaggggctagcaaccttgtatagaagcaggatgggggaaaaaaaaaaagccctcagtaaccatggcaactgcactggaatagtcaagctggtgcctacggcttgcgggatacaggcagcatctacagacctctgtggtcccacaaattaagttctaatctttttaatatagtgtggctgggaggtgaagtgaggcagtgaaaggttggttagtgaggaagtctggggaacgttgcagctctattaagacaaagtttgtagtcagggggtccgttcacacctaccctctcgtggatactttcagcccaacagtgtgatgggtggggtgttctcactccatgcacattgtattgataagaagaaatgagatgctgtgaggcagagggatttgccacatattacataagccaggtgctgcagcagtggatgtaaactatttacatgtacagcaagctctacagtacagaacagtgttgggggagggatgaacatgtgtgtttcatgggataatcagatgtcacagcactatggacaacagggagtgtcagaggacacaccgaggctttctgcaggagccaaaagcaaaggatatagaggaagtatgttttagaagaagaatctgcctgtgggggaggagaagatgggagtagtagagggcagaggtaaaattatgaaataaaaactagtatgtatgttagcttcctttctagtggctgggataaatcaccctgccaagagaagcttgggagagacggggctcatttgctcacggttctaggttagaggtaaccatagcaagaaagctgcagaagcaggagtttgagggacttgggcatagaatatccacaatcagtaatgaatcaaataggattgttctcagctagccttctccactcttgtatgcttcagatcccctgcctagggaatggtgccactcacagtgggcagatccttccacctcaatcagcacagtcaagacaatctcccacagccatgtccacctgtgaatcttatccagaccaatcctcgctgagactttttccaggtggttctagattatgttgagttggtaactgacccactgagaaagaccaaggcttacacatagggtggtcagccactgtccctcctagggctacagattcattgtggctacggatgcagaatctggagccagacagcagaggataaatcccagctctgtctctaagtagccatgagagcttagatctgcctgtttctcctttgataatctagggataatacacattatatcataggttgtttgaggagcagccaaactaatgtatgtaagaatagtttccagtactcaagagccaccagccctcatctaatcaagtacatttggcacaagaaataactcacgtagtagggactcactctggttcagaataacagcggctcaactgggaagtgagcactgctcactaaagaccatgaagctcagggctggagagatgactcagtggttaggagcatgcattgctcttacagaggatccgagttcaggtcttagcatccacacggaggctcacagtcccctataagctcatgactgaaaaatgt

SEQ ID NO: 480 - DNA, 2125 bp, Mus musculus
ttccctaatcttgctttctcaggtatactgtcacaacaagaaaagtaattcacccaggttaatatttgtatcccccaaaatagcttttatggaaaaacgaaacaggactgatctgtactttttttttttcaaagagcagttgttttgcccaggacaaagtgtttgttctgtccttctaactttctgtgactgagggaagagactgtggtcaccatgattctgtagttggatttgtgtcattggtaagttctctcagttccttctttctcctttcttccctcctacctctctcctaacttgcattcaggagcaggcatgtaagggctgacctatgaaagctcccctgtactgaagcaaacagaggatttgggatggaaccaagggccaatatgagagccaacttctgtttcgttcacttcatgcatatttctcaagagagacacttctgccttcaatgtcctgagaccacctatgtagcaggctagagagttgtggcctgttcagttaggtctttgctggacacacgtctcttttctctgtaggatggaatgggagttatgttgtgttagttatattagttatgttagttattttagttatattagttatgctagttgtgttagttatgttagttattttagttatgttagttgtgttagctattttagctatgttagttatattagttatgttagttatattagatatgtttgttttgttagttacattagttatgttagttatgttaattatgttgcacagcagcttctaggtattcaaactttaatacagattgaaggagttggggaaggtggcctccagcaattcttctaaaacatgccttcccaaataccatctgctttgcccagactccctcttctcatttattcctgaccccacacacactgagcccctgcagcagggccctgacttgcttcagagtcagtgtgcagacttgagaaccagccctgtccaagtctctgtggtcggcacattcattactcatggaggaaccagggagcccccactccccatggagcctttggtctttatttatttgtttattgattttgccacagcttaccctggaccccagggaggctctgtcgtctcaaccaagtctgtgagccttgctagaaagagccagccagtctagtgtcttaatcagacagtcttgaaatgttttattttctattttcttgaaatgacctcaacaacagcaaaagatgtccatgcagcctttcctggatactcctgcatgtgttgctcttaaacactgttggtaaaggtgcaggaaaaaggcccttgcctgtgtaacagtacttaaaataacaatactgaatgtaaataaaaagggaaggtacttcctgtaagttgctgaaaggttccgaaaatagctcggaacccaagccagagttaacacaagttcacagccagaatccgcatgaaagcttggggaccctggctgtttgttctagtaaagtctcacaaatattccacaccaggttgctttgctcaccagagcctgggagcctttcacagagtgagattcctaggtctgctgcctactctacctcccatttccccatttaaaaggtggcagtcaagcaccttctgatatttcaagggttttaaacctgggctatactttataaaacaacataaaacttgggaatgctactaagtcaacatcctctgagtgtgtatgtgtgtgtgtgtgtgtgtgtgcacatgtgcatgtgtctttatgtgcatatatgtttgtgcatattgatctgtgtgttcatgtctgtgtagagaaaaactagccctcaggataccattctattaggatgacagtaagcagtggaggtcacatgaccctcctttgctttcaaaagtggtttagtcaagcagttcaaacgatgaactccactttaaaaaggacatccagttttctctaagcctcctccaaaaactaaagagtgaaagtctagaattacagactttagatcgaggaagagtggcagaaggacgagggaatgtgagtaatctataaagaggacttgtttgttcttttcattttgtgagagagtgtcttgttatgtatctctctctggttcaagatggcttcaaactcacaaca

SEQ ID NO: 481 - DNA, 2175 bp, Mus musculus
agtaggcatctggcccacatctgtaaccccagcactgaggaggtagagacaagaggatcaagaattcaaactctatttggcagattcaagaccaacctgggttatgtgaaatcctgcctagaaatagaagcatttttagaagtgctaatgagagtaccataaacctattccagcgactgaaacaaaacgaaaaccaggtcagatggcccagccagttaaagaactttctaaataagcttgaggccggatccctagaacaaaaaaaaacaaaaacaaaaaacaaaaaaaaacaacaacaaaaaaaaactgatgcagtgggccttcgcaaggtgggagccagagacaggagaactaccaggaaactcatggccaattaccccagagtacataatcagaaacaaaatgggctggagaaatgactcagagattaagagcactggctgctcttccagaggtcctgagttcaattcccagcaaccacatggtggctcacaaacacctgtaatgggatcctatgccctcttctggtgtgtctgaagacagctacagtgtactcatataaataaaaaaaaaaatatatatatatatatatatatatatacatatatatatatatatatttttttttttttttaaaggcagaaacaaaacaaaccctgcctcaacaaggtggaaggagagatctgacttctaaaagctgacttctgaccacatgggcaaatacacacatatgcatgcatatcacacacacatcaacagcagtgacctcacataggctgagcatctccacctggcaggtgggtgtgcaaaattgaacagccaggctggagaggagccaagcagctcctaaccgaggcaaacacacgtcccgtgactcagcaatgctgtccctagcaatactccaaagaaataaagcttccttctgtccacacacgcctgtgtctgtccacgtgtccgttctgtccacacacgcctgtgtccacgtgtccgtggcagctgtgttctcagaagccagcccggatgccagcccatcccatcggtgaaggaaagcatcactccacacagatgcaaatcatctggccttagaatgtactggagctctgacacacactacagcgtggacagtgcatctggtgggagcggaggggagggagatgtgagtggaagcaggaggatcaggagatcatagtcctcagctacacgagaccctgtttccatataataaatagaatatgaataaaaatactatgttagttcctgctccagagaagacaaatccattaacacggaaagctgattagtgtggagagaaagggagtaatttctcaatgcacaggggtgtgtatgtgtatgtgtgtgtgcatgcgtgtgtgcgttgtgtgtgtgcatgtgagtgtgtgtgcgtgcgtgtgtgcgttgtgtgtgtgcatgtgtgcgcgtgtgtgcgtgtgagtgtgtgtgcgtgtgcgtgtgtgtgtgtgcgcgtgcgtgtgtgcgttgtgtgtgtgcatgtgtgcttgtgtgtgtgtgtgtgtgtgttgtgtgtgtgtgtgtgaatagggattgaatagactttgtgggctaagtaaaggctctaccactgataataccttctaataagtgagcctcagagagtccccaagctgcttactggggtatttcaggcagatgctatacgcccaaccctcttatatataccaagcctttaattttccttctttttatttttagagccacgtctcactaaatatccaggctagccttcaactcactttgtagccctgacctgtgaaccttatgcctcagcccctcgagtgcagagattttaggcctgcactaccaggcttactggctggctttgagatggagtttcactgcgtagcccatgttcagttcccaggacccacacggcagctcacaactacctgcgactccagttgcactagatcagacaccctcgcacagacacacatgcaggcaatacaccatcacatgtgaaataaaaataggtcaaagattttagacgagcagtggtggctcctgccaaattctacattcctgtgcctcagctttcccaaggtcgggatttcaagcttagcccaccccatctgtctcacgggattaatttggggtctcgcaagttcctattgtcaaagccacgtctttctggggact

SEQ ID NO: 482 - DNA, 2950 bp, Mus musculus
cccatctggggcctcgggagggcgtggctgcttagctgtgagctggtgcttgccctgcaaggctggctgtctgctgtgccattgacgggtcaggcttctccagcaaaaactcaagcactcgtggtacagatcagatccacctggccatccccagattgacagatggaagagaggactgagcgccatattcccgggcggctcctaagtgcagatgtcagacagagcaggcacaggaacaggtttttgccttttaattctatgtgagccacaagtggtggctcatacctttttatcctggcactcacccgaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcgcagaggcagaggcagaggcagaggcagaggcagaggcagaggcagaggcagaggcagaggcagaggcagaggcagaggcagaggcagaggcagaggcagaggcagaggcagaggcagaggcagaggcagctgggtctcttgagctctaggccagcctggtctaaagagcaagttcaagaatagccagagctgcacagagaaaccctatcttgaaaaaaacaaacaaaacaaaacccctttatttatttattgtcgactagtgggtaggagcttgctacaacttgtgtgtggccatccaagtacaacatttaggagtcggttttttcttcctactgtgtgggacctgggaatcaagccccagttggcaggcttggtgggaggggcctttccctaataaaccatctgaaaggccctcttcttacctatgtctcggattacaggcatgcaaccccaagtccggatttcatatttggggtgggtagccacttctgctatctcaagtactagcaagtgtgatacacattttgagtctgccaaagcttggtcgcttttacctttgaagccgagaggatccatttcttgttgttgctaatagcaacatccgtcacccagtcctcgtggccctgaacaagaaataatttaacaaagacctcggagaaatgctttataaaagtgagagaaaccaagagccagcaagcctgtgttgcttacctgaagcccacgctcggtcccatcaacacctaaggcagaatgcaagccgcaaggacgggtcacagcatctattatgagggtgctgtgtatgtttttaaaatcgtatgcaaggctcagcagactgggaggaaagaaaagaccatgttcctatctggtcttatgtctttgcttgcacccactgcttggggttgggttgcagagtttagcaaaaggctagagaggagacagagctggtaaagcgctcaccaccacaagcctggagacctgaaacctaggtaaaagtggaaggaggtaaacccacccctcagagacgccctctgacctccacacctgcgctgtgccccgttcgtcgtcactcatgcgacatttgcacagagtgatgaaactaggaatgaaaagatagcttttcaaatagcttttcattctgtataaaggtggcgggggaggagggggaggtgaagggaagagaccagagcaatctgacaggaggcagaggggtgggaagcccagtggggttagcattcagcacgaagctgtttgtttgctctcatgaaatctccgtggtagaactcagcttagaaagactagccttggctgtgtgggggtggggtgggatgaacatgtgccactcaagaagacatagatgacagagggtccctgaggactcggaggcttaagtcatgggtgtagacactcacagccaaaggcaacaaagagactggaccaggcatacagggctccagccctagatgcctgccatgttggctaacacccagctaactacagacagccttgggtgcaggcctcctctgttggtggcagaagccctgaggctgggcaagtcctcacgccagcgtcagactctgctgtttgtggactcctgcctagctctgggcttgcctgcttcacctacacacactagatagtgcctttccctgaggtccttgcttgtccactgagatctcagataagcgcttcctctagggagcccactgctctccccttgtgggtcagtccctaagccacctgtcacacctctctctctctctctgtcatcactgctggtggctaatttactgatgtctttgtccttccccacagaagtgtcagtacccttagaactaggcagtgaggccttggccttggtctcagatgccataacacctggagtggcaggaccacacccaaaaatctcagcactaggggggtgggaggtgctgaaacaggaagatcacaagtttgaggctaacacgggctacataacaagatcctaaccacctcccaccccaagccccatgcacctgcacactccccccacacacacacacacacaccacaccaccaccaccaccaccaccacacaaagttagatttattatgttgtgcagatacttataccttcaatgccaacttccggtagccacctcctacatcccaaatagccacagttttgtcaaatccaccagaaatgagaaaagagcctgaaaaacaaagggggagtggctgcagaatcctcccttcctccaccaagtgctccctcccctctgtggtaaggctgacggtgacatctgtgaggcactgccatggcttgtgccgaagacactaggaaaccttcctggtgtggctcaaggatgccctgtaacttttagtttttcaaagtct

SEQ ID NO: 483 - DNA, 1825 bp, Mus musculus
gtagtgcagtttggggaggttatggaacctttagggggttcatcctcgctggaggaagtgcatcagcagcaggggtgggcttttaaaagccttatctgcttcctgactggactctgttccacattcctggctgaagatgcggtcgttgtgtttcttcctccagccacctcctgacatgccattttggactcttcccctggaaccataagccccgataaactcttccttttataagttgctttggggcatggtattttatcaccgacaaaaagtagcggaggcatgccctgactctcctgagccttcccttccagagggagtgtttcagttcagaggccattgacatacagagcacataggcttgtacatacgcaaacaggaaagaagaggagaaggaaggaaggaagagatggaaggatgcatttggtagaagcacaggtgatacacagctatttcatggcctccttgtgttggccactgatgtcactgcttgctgcttatgtgacagcagtgggccagtaatcccagcacccacaggggcaatgcttacagcactcactggtccctctgtcatgcttatctcccagccttttccctgggcaagccatcttctctgcttaattgtcctcaagtcccctgcagcagagccctggccatctcctgtcagcagcagagggagccatactctaccgaaagagactgagttcttcattacgctacaaagccgagaagacccgtaactgttgctttgtgccacacagtatgtcctcacagacaaagctttaatctccctcatccgtctttgtagctggattctgggtccagaggcatggattcactctgagaaagcctcagccagcttggtgggtgatttggggcttcagcgctatccttgctgcatgctgtgttgtggattctcacctcccatcctcagggttcacgccttcatggttgcttgccagcagtgccttagctatggtgtttccgctgatcagttatgtcatggctggcagcatgaaagtctccaacaaaggcagaatgcaagaggcgggccagctgggcagtctccgaccccagcagctgtagatggacgctagattgcttggttgggacttcttgtagctaggaagcttcctggcagggcagtgtgttaagctcttccctgacctctttacttctggtgtttttgctgtataagctttcaaacagagcaatggactcccgtcccacatcaaactcagtgtgtgagcagttgattagtgatgacagagcctgagatcccaattgacaaacgtttcttcaacaacacggccatcgtttggggacatggcaagtttgcttgtaggccactacagtaaagccaaccacatgctctccacccaacatgtataaaagtggtgcttacaggactagagagatggtttactggttagcagcactccctgctcttgtagcagaccgaacggaggtttggttctcaggatctcaggagtctcacaaccttctaaaactccagttctggggcatccaataccaccctctgtcctctggggggcgcccacatgcacatgtacacactcaagtacatatatgcaaaataatgtaaagacatgcaaaacagtgtaaaaataatattttacatttatgggtagtgctctggttaggttttgtttgtttgttttacaaggttgctacaagccattgtcccctggaaagcaggtctctcgattgagaaaatgctttcatcagattgtcctgtaggcatgtctatgggacactttcttgattgatgattgatgagacagcccagctgactgtgtgtggc

SEQ ID NO: 484 - DNA, 2725 bp, Mus musculus
actgggaattgtacaaagacagattgaagagagagcaagctagatacaggtaaagatagaatgagaaggagccagaagacagacgagaaaagactgctagagttagaggctgagcagaggcaattcagaagctgagagagaagccagattgagtcagtcagctgggagaggagtttgaacagaacagctgagttgaacccgccaggtagagttcagaaaaaagtagagagagtgagcttattcagcagcaagtctcagagatggaaacattctaggcctagattaaattgtacagaggctagaagcttccaggaccaagttagcagacaggcagacagccatgggaatggccattactacaagagaatagaaaactacttttacagctcagagcatttggtcttgcagaggacctgggctcactgtccttttagagcttcccctccctgtgctgggatttcaggtgtgccaccatactggttctcaatgtcttcataacatagcagtggtccccagtttttggtcaggattattatttctctatcccctctttctataaatatataagtatgttcatatataaatatgactaaagtcaggacaaatggaattcctaatattttctgctagggttctttcatacattccttgtgtatggctctaagtcaggaaccacagaggtagatctgtttttggcattcttctcagcctggttcagctcacttaagtcgtttgtgatttttgtagttctgagaacgaactccagcccttatgcacagctgacaagcactcaaccactcagccacacccccagccccaacgggggggggtggggggtggtggtggtggtggtggtggtggtggtggagagattctaggcaggggctctaccacagagccacgcccccagcccctccctgggggattctaggcaggggctctaccacagagccacgcccccaacctctcactggaggattctgggcaggggctctaccacagagccacgcccccaacccctcactggaggattctaggcaggggctctaccatagagccacgccccagcctccaggctaggtggaaggtgggattctaggcagctgctctatcactgagcaatgctctcagctctaatacatatttataaaggaagctgtacatgtttgtgtgctttgttaatgctcacagatcattgcaccgttgcatgggaactaacaatgtctcctttccagcctttaagcatctgctgatatgcccccctttctgtgagggtctgcaaacaaagcattttgaaatattgttaatatttttctcttcctctgtaaactctgtgctatccagatttgaaatggtttaaaaccagtgagtgacagagtggattggcataggcaggcatgccattaggtgagtgcaaccggtcagagttaagttcacagagctttgaagcctcggtattttttttttccccttcacacctgctattcttcatacctcgacttctctgtgctcttttttttttttttttaatctccatggttaccttctacatttcttttcattttcagggctgggatcagtgttgtgtgtttctgaatgagggaggagaataatccagctctccagtgacagcagaggatggtgcttgatcgcattcgctttccaagtgggatgagtcccacttgtgcccgcttctcatggaataatcagtggccttggctgctccttccagcttgcctctctggactgctgtaatgccacttcctgggcaatggagagctccgtcgtggtatctgagacggagaagcaaagcccccctggtgacagatacctaggcaatactgtatggcctcagattattttttgggttctcttataggaataagtagaactttgtgctgaaatggatgtgcttctagaactctcaatccagatattttgtcatcccaatttcgtgctgagctaggttttctctaaggctcctcaagtattctcctagctccatcttgagaaccctggatggagatgagacagtctgagggtggctctcccctcctcttcctcctggactcctccttctccttcattactcttgcttattgtgtgtatgtgtacgcgtggaagtcagaggataacctgtggggtcagttctcaccttccaccacgtggggtcctggcttggtagcaagtgaactaaccactgagccatctccaggccagaggcagagcctctaagttgaatccagagctcgcaggtccagctagcttgccccgtgggtgcagtctcaggcttctgagccctgtgatcgcaggcaggccactgtgcccacctggtatttgtgtggattatgaagatcctaacaacggactttatgcttgctgcttgcagggcaaggccttagctaagagttgcctctcatgctcacctgactgatgacgtgtgctctggccacttgtgcatctttatggagaaatgtctgttggagccctttgcccatttttggaagacaggataatgaaaaagccctttggtgctggtatgccaccatgtgccagcagccatatctcactaccacagctttcccacacatctcgtaaagctacaagagaggctggggggaatcaagtctagctgggtacttacacgctcagctaaaaatcagacccactttggaggctggagagatggctcagtgctccttcttttagaagatgcagaccgggt

SEQ ID NO: 485 - DNA, 1750 bp, Mus musculus
tgctcactgtccctctgggattggttctacatcatttagcaatgtggcctttgactctgagtcactgattcgctcatctggcctctccctgagcaatactggttgtgtgccaagctcgaggatacggcagttaaaaggacttaagagtcacaattagaggaagagaccagtgagtgatacaggaaccgggcagacacagacagtcttgtgcttgggctagctttctttgtggccagttgcgggagacgctggtgcagagcctggagttgacttcctctgcactaggtggggcagggctccttggtcctagtaccagagtgaaaaacccgaggagctgataccattaccatctactgactgtcttgtttgaaaactcactcccacagagcctgcccaggacagggatgggaagtgagagagacaggactagatcttgtgcgctccgagttagggtgtgatatggtacccttcaacctgagggttaaatgaagagtgaagccacggatggtcatggtggggacttggtagggagggatagatgtcttctgcactaaatctaggctaaatctgtactgaatctgggaagacagtgtacaacagagcagcctagtgtgggtacagtctctgaggcatagctgggaaagacacctggcgtcccgttttgcagcgctcctccacgaagcacaggctccctcctctccccatgggcattgtctttctccagctatgctcgctggggccccacctctcgcacgcagctctgctggagatgtctgtccaggccctacattgtctggggagggcgtttgctcacctgggtgggttattattagccagagatgaagtgaaagggcctgaatgggggatgctgagttcctgcctgacacagtggcccaggcaggaaggaaatgattcattatggctacaaggcacgctctaatttcatataacaaaataaatgacagtcgtattttgggcaccaggaggcacagatagctttgttccctgactgcttctcactggggctgcagggaaaattccagcagctggcctttgtgttgggagatgcaagactgagggggccccaggggtggcaggtgctgtgacccggggggatgagtgaaattactccggagacagcccagcatagccagggaaaggctcttagggattccttgccttcaatccagggctatgccttgctgatcccacgtctgctggacacgtcatctattcctcttccttaccccaaaggcttctccaaagccccccagttcagttccagtttggagtcctcctctaataagacctctgctatgcctgccagtgacagcgaaggaggacgtccttcctccaggctctgcccgtctcctgtcccagttggctccgaagccatgtggaaagctttagatgagacgctgttagccgtgaatgtggtcccaagttcaatgcagctcacctttccgttgtccaccactcatcctggtggtgaggaattagctcaggagtcgagccccatagcgctgtagaaatctctgtggatcttttctttggggggaaaggattcctcagtagtttgtggagcctatggagaaaatgaataaacacgagtcttgtcaaataggaatcagtaagggtcggagagatggctcagtggttaagagtacttgttcttcctgaagacccaagttcagttcccagcatttgcattgcatgggtgatagttacctgtgactctagctctttgggg

SEQ ID NO: 486 - DNA, 4600 bp, Mus musculus
aagaagtagggtctatatacatgccaggaagtgcttatcaccttggcacaaaattgcatcccagagacagtctcttggtcaatggtccaccagctctcagctccctgctgaatgaagaaagatgatgattagtgactctgaagaagagggaacagcctctaaaagcccatgggagtgagtgagtgctggaatacacggcagaaggaacagggagagacacaagggaatgagagaagtcagagaaaatactgccagcttgaaccgtcaggactaagaaatgaggagtatgtgtggcagaaaagttactaagcatggagcaggcattcaagggaaagaatggccaaagactggggctggcaggacaacctgctctaagacccatggctcttaagccaccaaggtggaggaagccccaccttcaagtctcacagatggctttattccaagctggaccccagatgccagttttcaaaagtggctaggtctggcgtctgtccatcacttctcctgcaaactgcatggacttttggttggaaataacagattaaagggttttgaggtcaataggatcttagacatgcacatcctggttttttaaatgtgtatagcaatatgcttagagcctttctggccccaggagcattcttctgcttcaatagattagcctcagagctccatggaagccatcttgaagaagttgtcattctcagttgagcttgggctgggaatatatttcttagaatcatgaaaatcagtgagccaccctgatcctctatggttttgattacaattatttgtgtgtgtgtgtgtgtgtgtgtatgtccatgcatgcaagtgtgtacatgcgtatgtatgcacatgtaggtaagccatatttcataccctacatgtggaagtcagaggacaatctgcaggagtcagtcctctgttcctaccacgtggatcctggggatcaaactcagattgtcaggtttggcagcaggtgccttttcttttctggaccatcccatctgtcctactgtagcttactccttgctccttggtctcacctgacctaagcagtcttttcttctgatatagttgtgtacaggacctgggcgcacacacacacacacacacacacacacacacacacacacacaccacacacacacacaccatatataaatgtgtgtatgtgtatgtgtgtgtatatatgtgtatatatatgtgtatatatatgtatagtatatatgtatgtgtgtgtatatatatatacatacatacatacatacatatatatatatatgtatatatatatatatatatatatatggagagagagagagagagagagagagagagagagagagagagagagagagagagagagagagcgccagatgtattctcatttgtcttgtatgtgctacaatgatgatgggaaaataaatgtgtttttaaatctcccatttgtgcgtctccttcactaaccatttacggagccgaatgcttgtagcaagcaaactattctgtagattgtgtcctgattagaaaatacagcattaggaaagctaaggacacagaagcaagagttagcctccacttcacataaagtcatgagtgaaactaaaactcgtagcacggcatgtcgaagcctttttgctttctcagtgatgctggggtcaagttatggcttctgccccagaggtggatttcattcttttctttttcttttcctttgtttttttttccattccaagcaatgacaatggattatttttgtaagcaagtgctctatccattattaaattgattattcaaatctcatttttaaaaaaagaagccagatggcaattttccactatttgttgccactgacaaccagcagccctaaactggaagattttcttctcccccttctgctggctgaagagcctgcctgattcccaggcagactgaaggtagattccatattggcaacaaatagccaattaccaaacaagattgctatgattgattatttcagaatcatcttcacattgacagagctgttgttcttttgacgattccataattaacttatctatattcaggcatggtaactttgttcctccagtcattcggatgtgagcgttattgttgttagttagttgtcatgacagcaagaagcatgtttttacatgtccagcatcctggttattttaaggtcttaataagtatgccttgctaatgaatcagaatcatggtgattgtgcaaaataatgatttttgaaaattgtaaaggagacttaaaaaaatctaaccgcaagataatgattacccttgtggcaactctttccctgtatacatttgtgtgcacggttgcgagtgtgtcctggctgtctccatgtgaatgcggccacccctatattcagtgggattgtcatgctgtgtgacagtgggcttttccaagtttcttgtgacaggcactactgtcccgtgtctcacggctaggactcagcttgtagctttacaaatctgttcttggcatccaccttcaaatccttaaacacattttggaaacttcctcctcttcttagccttctgcatgtgtgcaaatgggatctgctgcctcaaagcacttagaggtgactgctttaattgatcaaattcctgcaattgattgttttcccatttacggctccagtggtagctgctggtttaggttttctgtttgttttgctttgtttcttagagacagaggtcctggctatgtggctcagtctgtctgtgagttcctggtcctctggctttggcctgaggagtgggggtggggtggggttgtgagtacaggtgtgcaccaatacatctggctttaaccagatgttctgacttctgatcttgtcaggagaaaagacatccgagttgtatataacaggggtccccttctcttcctatgaaacacacacacacacacacacacacacacacacacacacacacacacacacatgaaagtcttcagatgtgtcttccaaagttaaaaccgtggcctctactgtgttacaatgttttgattctcttcagtcaagagttagataatgttcttggtttgtcgctgttatttagattctgaccaaaagaatccacccgtgtctgccttgttcaaattaggatgattgctgggactggtggcacacaacactttgcaggcagaggcaggcagatctttgtgaggttgaggctatcctggtccacatagtgaattccagaacaaccaggggtacatagggaaactatgtctcaaaaaacaaacaaagacacaaagacacaaagagtagagacaaaacatttggactgttttaattctttcagatgatcctttgtcatatgaggatggtcaaggtagatgagatgggttgcctaatttgtcctgaaatgttccttagtctcatgactgttaaagacctgaagctgttggagactccaagaagtaggttcttgtgagaggccttctgcttactggggagtgcccttgagggtgacagtgggaccccagtctcctagctctttttccctctttagctacaactgagcagtttttcccaccacatcccccctcaaagctgtttcctcaccacaggcctcaaagcagtgggtacagctgcccataggctggaacataaaacctgtaaatcaaacccaaatattaacatacaaatagcataatggtaaaaaaaaataaaagtgttaacatccatgttaagtttctaatcaaacactgcagaaatgcattaatcagtatttcatagttcattacagtctgactaattttgaaatccctcatgtaaattgattaaacgtcttcctcaggcagataaatgggcttttgttttaagcaacctttactgagcaaaacataattctctgtgactcaactctcacccatttaggttgagcgctcacgtagcgagctctagatgatctagaatgttccgctttgcagctagactcaccggccaatgataacacacgttgtgggcctgggtgtttagcaagcacctattttgtgcccacggctgtgtgatgtgcatgcttctctcccacggggagcgatgattcatgcacgtccgtgaacacttactcacagctggatgatggcgcgcagcccacggggtttaccatactttccaaaagtataaactaactctgagtagttttaacaaaaagtcaaaaaagaaagaggcatggtgcttagccagtggctgggttccggagctgttttcctattgatttgtaaagcaggtcatggagttggggactctgcctttggctcccaccacagctgtacagcgtgtcagaagagggactctgactggcatggctggtcacatggactaatcgttgccctacagaaggaaccatggtggccacaactggattatttgaacaatagaaaaactaaagggcgtttttcaatgtggaccctgggtacttagatcattgggctatataatttcaaggggaagcaagcatagtatatatagcatatatagcatatatagcatatatagtgtatatagtgtatatagtatatatagtgtatatagtatgtatatagtgtatatagtgtatagta

SEQ ID NO: 487 - DNA, 1950 bp, Mus musculus
agaggatttaaatatgaaacaaacaacccgtggaacttttaaaacgaatcggatggcagtcgtgcaacaacagaaacacacagtgactggggagaaaaatgatgaactgaatattatcaaaaatagcagggtgccatatacccctctaacaggatgagaagctgaaggccaagaaaacacacatgtacctgacaacacacacaaatgtatatgagttacaaagcatatatgatatacttgtctgtgtgtgtaaagaactctaaaaacaaatagaaactttaagcatgtttttaaaaaaaatcattttaaatacgtaagagtctaaactacctctaacgtgatactattataattagaaaataggcaaatgacaccgccagatatttcatcacaaggaccttgagaatgatgggcaagcacccaaactaaaacatcaaggctgtaccaccatgctcagaggtgaactgctttgtcagaatagttcaaataaaaagtaaaaggaacagcaaacgtgggtgacggtgagctcagacaagctctggagtcgccagtgttggcgggggatggtgcaggcattttgtatgttttggtgatttcttaagaaaccacacacacacacacacacacacacacacacacacacacacacacacacctgctacaagaatcagaactgcaaggggaaggattcagcttagaaaaaccaagcttctgtctgctgaacacctgttctgagaagctctgcttgtgatcagctaaggctggaaacaggtaaagtgccccacaggccacagcgtctgtctgcccactacctagagtagccagcaatggatgcaagaggttcgtaattggcggaacatcttgtgccattcccagagggcattgttctgggtgtcaaaggtctcccattgtgtgactccactgctacaacattctcagactggcagaatcgtatcaagggccgtggcctccttgcgcagggatttgaagcggtagagcaggggtggatggaataatttagggcaagcatggaggctgagcacctctgctctctgccgagattatggtgatgggtaaacggctcagaaacacatatgcacacacagtgcaacctctatttcctggttttatatgaaactacagttacagaagatgtgagcaatgacagaagcattcaaaaagcactcactatctacatctttctgaggatttcaatataaaaagtgaaaagaaaattagcttgcaaatcctgccccttctaatatcctacacctgccctgttttgtatactccagggcctatatttactctcctctcctctcctctcctctcccctcccctcccctcccctcccctcctcttctctcctcttctctcctctccactatgtctcccctgggtgacatagtgagtcccatgcctgcctgggatacatagatcctgtcctgtcctgtcctgtcctgtcctgtcctgtcctgtcctcccctcccctcccctcccctcctcccctgccctccccccctcccctcctctcccctcccctcctctctctcctctctctctctctctctctctctctctctctctcctcctcctcctcttcttcctcttctctcctctcttaccctctccccttcctcccctcccctcctctccccttccctcccctccccttccctcctctctctctctctctctctctccccccttcctcctccacctctccagtcttttcttaccttcccctgcagccccacctctcatctctggttcttctcaaacccccttccctaggccctaatacctcgtaatcattaagaggtcttattgttgatttggcttctagtgctgagaccaaattaacaaaacccaattaacatctaaataaatgaagccgattaataaagaatatacagaataccagagtccaaggggtgctgggggaaatga

SEQ ID NO: 488 - DNA, 2400 bp, Mus musculus
atctgcggaaggcttcagttcattagtgcgttctatcaacactgccaacacaaagcgcgttcagagttcttaaatgttgtttccattaaaatcaatcactcttcgcaattaagccaatcgtttcaccctttttttttctgttatgagcaggaagcatcctaaatatattgacagctgtcttcaatcggatggcacaaacaagggggaacagggctaagactaaatgtcaccaacgggagcagggaagtatcttttgctaaaatgtacctcattttcataccctagctggcgtggaaaacattttttttttgcaatcgtaacatacagtgatcaatgttttgcatattacaatcaataacacacttaaatgtttaagttttgcattcttttgcaataaatattgatatattacaaactcggtaaaaactgttcattggactttttgtttgcactgtgtactgtatcattcagcaaataagtgagctaaatattgtttgttacaaaacagatgtcaaataaaattatgccatatgtgctattaaacacttttcttattttttttttccagcaaaacccaagacttggtttcagaagtgaatgcatttggcttttcaaggatttgaggcatgaaagcaacatctttggagtatttttaaacctgctggctttgtgtaatccaatttcatgagctaattctgaacgctattatagacctcaaataaaatatagatagagaaatagagatgcaggtatgcacaccagaatctagggttaagattaattcaggactgaaaaataaaaatttttttaaaagtggacaaaatttaaaaacaaatcaatataaatatagattgagataccagagttatttttaggggacttgaggctttaagaaggtggaagagaaaactttacaagaaaactttccatgcagaataagtcaggtgtgtttggagatttgggggtgacttgagtggtgactgggcagtgagggagaggggaggaggctctgagagagactccaaagtaggaaaatcagtcagggcattggctagctctgagagagactcacaaaaccaggaaggagacacaggtgagtgtagctgtcctggcccatgtgagccactcagccccagaaagctatcactgagcccagcaagggtctcctccaccccagccttgtcagaagcgtttgcactagatggatagatctctcagcctaaagaagtgtgaaatacgagacagggtgagcagaatgcaagaggcacgttgctaagagccacgtagaaaagcagaatctggagccccagcatgctggcgctggcgctggcaccggaaacgcccacccacagatggagacaaacggaggcaagcaagacacagcgaggccaaggagcagagcaaggccaaggagcagatccagtcacaggggctgacccagtggctcttggccgcagtacctcgggaccattttcaaaggatgctcaacccagtgtgtgtgcctgaagcccggccagcactcacgaggctgagtcaggaggatttcgagtgctaggccaatctgagctacataatgagtctctgtaaacacacacacacacacacacacacattacatacaccctgcacacatacagtatacacacattcacatatattatgcacttgtattacacatacacatgtagatacacatgctgtgtacacacacactgtgtacatacacatatgccacacacactgagagacacattatatatgtatattttatgtacacaccatatatacactctacacattttttgcacacacacacaatatgtacacacatacacacatctccttcctgccctgactcactggaatggtgtccccaataagctacctgcccttggaccctgcccttcagctgtgcactcctacagagatccagacgaagacattctctgcataaccccagtctcataaccccagtgtttcccttgtccactcaaggtcttgaaggttctgaccctcaaaaatccatgacctcggctccatggctgtgctgtgggaggtcctgtagatactgaaagtactttagtcctctccttcgtttggtcaccgagaatgcagtttctcctcttcatccttgggtgaaatctttcccacatgcccctgcatggactcctgagccaggtgcagcatgacaccctcccccaggcccacaccattggcctctgacaggccacgcataggcaggcagtatatgtgagaggagttcctatccttggggtctctagtgaacaagggagaaagctggtggctaaactttactgggctcaaaggatccttcctacaggactccctagaagatcccacagtatggagtcatgtggcccatgctgatggtaactgcat

SEQ ID NO: 489 - DNA, 2600 bp, Mus musculus
gagtggcctcgaagccaccaccaagagctactgccaagccaggcttctgcctcaggctcctcgctggcctcttttggctggaccactaagtatcctgtcacactgtcacactgtcacactgtcacactgtcacaccgtggtctctgcgctctccttccatacagctcactcgcagcgctgacagactgtcgatttccccagtacccatttccttcatcatttatctcctttgatcagaatatggagggcaggggcaccccaggtaaatcaagcatttcctgtctcccaaaatgagtttgtgagagcctatttcacaccattaccatttttctgctttgaacagtaaatcaaaaaagaaaaaaaaaaaaccctaccgcccattcatccactttaaaagtaatgtctttcttatgcataattactcagacccagcggagatctgtgcacggtaaatccgcttctttaaaaggtccccccacccccaccccccgaagtacatcggtgacattaaactggtgtagagcaaatttatttatttaataggtttattcttttaactggtctgataaccattactgttcagtgtttggtttgaggggcggagggagtctgtattaatttatccgatgtatttccatggcaggtatttatgtaaaatatttccctggaaatgagggtgaatgtaattcactggcttagcatgttgactcttaagtggccttcaggggagccacctggtactcccagagatcgatctgggggagtgtcttgaaacaactgaaggaagggaccggtggaatgggctccctggagaaaatgtgggcagcagcatttgggtaccgtttgggtgaaactttcttccgttgctcttcctctccctttttactataatacaaaaataaaggactgttagtaaaaccctggactacaggaaaaaagaaggaagaggcgggaagagagaggagagagaaggaaggaaagaaaacgtggagggaggcaggacagagggagccgattcaatgtttgggcaagtccagttggaagaaaacctgctggtcggtcgtaggtcgggccttgtagagctgttcgctttatgtcatcttgtttgtaactcctgatggtgttggagtgaaagcagacaggcccagctggtggaggcgagggagagaaatgctgaatttttagcagttggcgtttatttttaggcatttaacggtatctttagcttcccagtaaatgagcccatcagaagaccacatgtgagatcattagaatgtaaaaatacaggacgggacctgaggcaccccaggatcaaactgtgctgataggctcctcctgctggcacagacaggcacaggcaggcacagatgggccagggaagctcccggtaccctgtaggcctggctacctgcacccatcttgagagggacacagggtcctgggcccacgcagccgccaagcaccaggtttgtagtctaggacaagtcctctccctccttcctggctccagggtgggtggggcctgcccccccccccccccccgcctctggggtgaggctgaagtgaatccatgatctgggatttgggatcttagtctgttgaggataggtagaggactgcctgagacaggaggcctaagcagtgaggacttcaccgttttagagggaagaactggtcttggtcactcttggactccatcaagacctctaaggttggcttagcaagtgacatgtggcctgcaccaattttggagcctcccaggagagttcacccatgctgtgctgcagtctcctgtgagtcacagcagatacatgccctcagttcacatgtctgtaatattggcaagccctttagaaacaagatctgcattcagaagattgctgtcagtccttgggttggcttgggaggtgcttttcctcaattctttttcagtcctcctcctttccctcctctcacacttttagaccagggcttcttgtaagctgggcagaggctctactactgagccacgcccccagcccagtccttcactgggaggttctaggcagaggctctaccactgagccacgcccccaggccctcactggagtggagaagccagaggcttgcaggaggtaactggggctcctagggctcttccagactatctgctttgttcaaaactccgtcctggggactgcatcattctggatggtggtgaaggctctgttttgagaagctagtttctgacttccctgctgtccttctgtccatccatcatctgtatgtatgtattagtcagcattctctagagaacagaacgaatagaattatctatcatctatctagagagcaagtgaggggggatttattagagtggcttgcaggctgtggtccaggtagtccaacaccgtctgtctaccaatgaaacgtctaagaaccccatagttgttcagtccatgcggctggatgtccaaatggtcttgcgtatatgctggaatctcaactaggtagtcagtccctaatgccaatgaaggagcagacttgccagtgagagtgagagcaagcaagcaggcaaacagagacccagcttccttcttccatatcctttacagaatccg

SEQ ID NO: 490 - DNA, 1975 bp, Mus musculus
accccacacataaaaagtacagttgagggctggaaagacggctcagtggttaagagcattggccagtcctacagaggaccagggttcagttcccagcacacacgtggcagctcacaaccatctctacctccagtcccagggcatttaaagcccctgtctggcctccaagggcctatgtagcacacaaacatacattcgggcaaagagagagagagagagagagagagagagagagagagagagagagagagagagagagagaaaggagggagggagacagccagctataaaataagtatacctttaaaaataaatttaaaattacagtgaaaaataaaaatatagctttgaccaagcatttcagtatagaactgtccaacttctaatagcaaaacctcgtaaacaacctaaatttccaaaaataaccacataaattgtgacatatccaaacagtaatgagattttttttaatgtcaaataactattttaaaggatagctaatacaagtgaaacaaaaccaatattgttatagatgggaaaatctagattataaaataaccgtctcatgttttcaaaactaccatagaaaagtgtggaaaatatattggaatattttaagcggttctctctggggtggttaaagtacatgcaattctacaatgagcacatattatttttagaacaagaaacttaaaattactttttaaaaataaatccctatcctgcctacctcataaagtaataataaaagccaataaaaggataagcttttgtttataccctaaaatggaatccccaggagaggggaacccagccctgatgatcatgtggtgtctgggttagcctccaggaactggggactctggagccctctattaaaatctctgcccaaagacatgtccaaggaagggcagggctggagccatcctgcctggtatcattctgcccagtgacacacctgactggagtaaagcagcaggtcgcagccaggaaagacatggagggaagcctgagtagccaaaggctgacttgacctccactggtcctcaggccctaggtatcaaaggtcattatgcctgggaaacatgatgtgtggacctctgccacagtctcggggccaggcgtgcatttgtagtgctaaatctgaggatgtgtgaggatcataattggcccattgttttaaagaacaatattcccttccaggacagccaggaccacgcagtgagaccaaaacccaccctgaaagaataatatgcttaggtgggcttgatcttgatgtaagcatatacatatccctacaggcccctaagatcaacacaggttttagccaaccgaggctagaaccccaatgtagccacacgtgaatccaaaggggcccacaggcctcctgtgtgtacctttaccaatgattaagccatcagtatcagaaacaagagaaaataggaaggctacagtgggcagtcatgagtacttgacagtgagcagaaaaggcagggcatcctaagaatgcataaggatgctgggtgacagagaaccaatgttgtataaagactaaagtgcacacttgcaatcctagcacctgggaggctgaggcaagaggatcataaacttgaggttagcttgggctctgcagcataatcctgtcgaggatagaaaggaaagggggggaggggagaggagggaaggaaataagcaggaactgatacaatgtaagagcgtgaataaagtgactgcccatcacaagagagtagggatacttcattgcgatcagatgaggcctgagaaatgcaagaatagtcactaaagtaaaagtgccagcctaaaagcacacacatgtgcacatcactaaagggacacagcaggattagtggatgggtgggtgggtggatggatgggtggatagaaggatggatggatggatggatggatggatggatgagtggaagaatggatggatgggtggaaggaaggatgg

SEQ ID NO: 491 - DNA, 4550 bp, Mus musculus
accctttactgggtgaagtcttgctctcaggatacctttccctttgtcccagtgcagagcatgcagtgttttattttccatgatgttaattaatagcaatactgcttacaccctgccttgacggcaactgtacatttccttttgcaaaccatacacttacatctctcttccatttgacctccttcattgtaaacccagataaattcaatatgtagtaaccatattacagggtagatgctttcctatttgaaagatagtcccaccaaacaatgtagctgattatattttaattcactctcaaggtctcagaacagaggcaggatggtgtgaaactcttttccagaacataacatgaatgcccctagtctccatctctgagcccttatcgtcctctcaaaccttatgagctaattcgccactgtttacattcctcctggcattattttctttagactcccactggaatggcacatttaactctatttaaagcacattagaaattttctagtccaaagttccaaattcttctatattcctcttacagactaactctaaagagctgagaaccacacagtcaggttcatcatagctatggtcccacgtttggtgccagttttctatattagttacttttttccttgttgtggcaaaagcaatttgagaaaggaagcaagggtttacttcaaattgaagtttggggatacagcctctgtggtagggaaggcgtggtgtcaggtggttccatggtagcagaaatgggcatctgggactcctgacatgttggcagattaagacacagagtgtggacaggctatactatcttgatgacttcccgcaggaatctgcttgttgcagtgaggttccactttctaagtagttctgtagctttccagatggtgccatcagctggggaccaagtgtttaacacttgactccatggaggaacatttcccattcaaaccacaacaatgcccaaaggttgctagaaatgtccatgtgatatttttgctgatttttgaattttaaaataatggatgtactattttgaggtaacttctttcacatcatgttgtgcttttgagttatctactggcgttgagtatggttgtcatttcctgacgactgctgttctacatttacgtggtgttgatatgcaagagtttgtgttttcttcatttgatggacaaagatcctcttccattttgtggtcgttattgcttctaggaatatccttatatgttgggtgctcatgattgcatttctagggagtatctttctagggatctaatggaatggctgtaggacctgaatgcatttgcgtttttgcgaacaggacgactaatccattttctgaagtggttgttccaaatttcactttcagctataagtgccagggttgagtttgcttcacatcttgctactaattgctgttgtcagctttaattttatatctggcagatgtgtagtgagatcctgtagcctaaatttgcatttcacagaatactaatgaagttaagtatccttttagaactttcttattgtttttggaaatcttacttgaagttactgtgcaggtacttggctcagtttttctgctggctttttccttctatcaccttgttggagttcatatagtcaatacatttagcatgttatgtgtatgagtgtgtgtgtatgtgtgtgtgtgtgtgtgtgtgtgtgtgtgtgtgtgtttgctatatttcccccaacatatgtgtagatgctttctaccttggtttcaagggtagcttttgatgaagggttatcagcattatattttaagtcaatatggtaaatgtccttgtaaggacgttatacacacttcaaaaacttgaaagcactctgcagttcttttaaaagttaattaataactacgtatgggtaaacacctgcaagtacgcccacatggaggacagacaagggtgtcagatgccctggaactgcagctaaagtcagttgtgagccaccatgttggtgctggcagttaatcccagatcctctggaagaacagccagtgttcctaaccactgagccacctcttcagcccctgtaattaaaatgtttgcagctttgttgttttgactttgagttggtttttttttttttcctgaatgtctggattgaagtatatgccaagatttgctctccttttcatgggtgaccagtggaccgagcataattaatcaatatcttcacggttctgtttgaggtttggcggttttcagagttcgttctcattctctttttgccccacagccatcctaggaagggcgggataccattgctcttggtactgaataccattgctcttggtactgacaacttcaaaccgtgacagccctgttactgcctgcagactcctccaaggcctaatttcctaacctccaaggcccctcccactttctcccttgttattgatgccatgtgccttcctggctgtctggttctcctctgggtcatatgtgccatccagcaccagtctcctgtctgaactacatttgggtcggagaccgatcccccctcccttggcttgatgtcaacaccgtggtgtcatgttttcacaaatgagatcattgacagcattcagccccactggcctatttgtcagaggataaacactgcagcgtcttaattacctcacttttataaagcacttgctgtcctgtgtagttctccagtcgtgttctttaagagtatcttactgcatttgtcctttgcatttccacataaaatttagtttaaatctttcaatttccatgtaaacacttgtttctaaacacgaaccttgcagagacttgatgagatcctttggggtccagctccatctggaagttgacaagagtataacaggaagttttccagtcccttcattgtggttttttcttccttccttccttcctttttccttttccttttccttttccttttccttttctcttttctctttctctttcccttttccttttccttttccttttcctttttctttttctttttcctctctctctctctctctctctctctctctctctctctctctgcttggccttggtggggacagaatgacatggttcctgcccctgtgacaggaccagccttcacgagtgtccatggctgtcatggacataaggcttgtttgtataataacatacatattttcacgttcctccgaggaatgtcctccctgttaactattaatgactccatgataatcacagcatgagtctgggaggcaaaggtgtggctaatgtctcagcaaaatggtaaccactgggaccttcagggcagcccttaaggacgtggaaaagaactctaaacatatgagccccaaaatatataatttctcaactatgcaaaaattaaagatgcaatatgaattctatgaggagcttcacagatctagaggaacagaggcagctacactatgagctacactatgggccaacttgtcagaaagataccaagaaaggaggtaaagaagtgtagggagggtatggttttggctgtggtatcaaggcgtgtgtttgggatctaggcaatgggtgcctcatgatgtgttaagaggtgccgcctcctcctctcctcgatagagtttggtaaatattggcagcttttccttccttttacctaagtcaaggcaggaatttttagtagctgccattcaggagaaatgaatgtatatccacttgttcacttgtgctctgacatacttcaggaccccctctctagggaatggtgccatccactatgggctaattaacttaattaagacaaccccccacatacatgcccatgggctaatccactgaagacagtcactcatgaagactgttttcccaggtgaatctacattgggtcaagttgacagcacttacgatcacagtaatttcttcatctcgtaaaaatgtcacacttactggtattgagttgctcataatgtttattaccatcttatgagagctggccacatttttacgatgactcacatttgtgaattcgcatctcttctcccccgcccccattttcgtctttctttgggggaatttattaatttaatttcccccgaagaatcaatatctggctctgtagagccccccttttaattttttgagaaaggacttgctgtatgtttctagcccagggtggtctttaattttctataatattcccttccccatgcctggggttttccgattttagatattttatccattttattttctgctttttgtgtgtttatttttttttaaaaaaatatttcttctcatccttttgtttttttttggtttttttttttttttttttttttttttttttttttttctcgacatagggtttctctgtatagccctggctgtcctggaactcattctgtagaccaggctgtccttgaactcagaaatccgcttgcctctgcctcccgagtgctgggactaaaggcatgcaccaccatgcccagcctcttccgtttgttttatttggaattaaacacgttgttactttaaaaccacatgagagagagaaaaaaa

SEQ ID NO: 492 - DNA, 3000 bp, Mus musculus
tttctgacccttggaataggctgagcactaggcaagtttgacacaatgcagaagtatgccatccatgtagagtctgccacagacgcagggcaacccacagtatcaaattcctatccttctgccatgagaggcaggacagtccttctgagatcatgacctgaggctcatgagtagtgactactgcccaagagcagtgactggaaataatgactaagacctgagctctgagtggtgacctgtgacctattattgcctatgacctgtggagagagctacgtgaaaaagacccaaggcagaagagcaaggtcacaaaagggtcagaacaggggtatgttgtgtcaacatctgctggaaaattgcctatgtcattaacttctgaaccattaatacccttaaaatgtatctattacattttaagaagaaagaatgtcagcagaaattaagatacaatttgccatcttaatatttacatttgaaaacatttagttcaaagcacaacagtacattgaaaagatccttaataaattatgacttagttatcaataatatagatgttttgggaaagaatacaaatgaaagaaattaattcagctcatttaaatgcactgtagtgttagtgagtcctgtgacctgaatagttttatcccccagaaatccatgttttgacaatgttcctgtcagggccattgcatcaggagatgggctctttcagagagcaggtcaggaggactcggctcctgtgggattagtgcccatgtgagagacttgggaagaggactacccactcctccctcctctccctggtgtgtgatagtagaaacaaggcgtcagccattcatgagcggggaagggagcctttgccagagcctgacttcactgactctctcacactcccagctccatgatggggagggggaaagccaggcaaaggtgtgggtgtcagcaccctcagggctggaaggatcacagagacaggtgaatccccagggctcgctggacaaccagtctaactgaaacagccccagccaggtccagtgggagaccctgtaacaaagcatacactgaacagcgacagaggaagacatttgatgctaacaggtggcctgcacacatgcatgtaccgtatctacagccacatggtctttatagagagaagcaatgctctgctgtttaagccattggatgtaagcagtctgctgcagttgcctgcactgaccaagccagggctgcttgtagttcctatcattaagatcacccccatggccactcttcttctggctgcagggcctgtaccattttgtgcttcctggggtacatgtgcacctaccaataatgagacacagccacctgcacacccgaagcattacagtgaagattcacacctggtattcctgaatgcatcgtagagacattcaaaccatctaccctgcaggcgcctctccctctcctcctcctgctggaaaagtcagcgagatgttggaaacaagctattattttatcagctgttttaatctcgacacaaggaaatcttttattttcattagcaatcccctttcccgtaagggcgaaggtgcttataaaatgtctcagctgttccaagctaattagtcacaggctaaaacaacaacaacaacccacaaggcgttttcgcgtggaatgatttgcaaggaaaatttttgataaaacaaaggtttgcagctgagaacgccacagagcaggccagtgaggacctcacctgtgtatcagagccctctcatcactatgacctcagaaccagtactgaggaggagcacttagccccattctgtcacactaggggacactgtttttttaacttgcactgccttcaattactgtgtgtcatctcccactgccaaacaatacggcagggacacatggaggtacaatgtgtttgctctcaaaacaaccctgaatgtacctgttttgcttaggaattgaaggccaattagatgtgggcatgactgaaacaaaatgtcaatattgaagaactcaattagttagccctctaagcccatggttttgaggctgggatctctccagatttccgcatcaggcaaagcagccaattactgccccttcgttagttattgattccctttgcactgcgaggagcacagatgcattgtgtaattgggcagtgctctattaattcagtgttcatgtgtcccacctctgttaattccaggatgggaactctggacagctccaatggcatgctccaatgtctgatacactcctgcaagtggcctgctcagccactggggatgccccaatatcctctagtgggacaggggagcaaggccccctgaggagagctatgggaagggcagggaaccaggatgaatgcctagaggtagctgcatttgagttggatccacagtcatctggatgatttcatttgaacagagagaggtcaggcaggtggagaagctttgagaaaggcaggactcagatcatagcattccctctcggccagtgacatcacaggggtgtgtgtgtgtgtgtgtgtgtgtgtgtgtgtgtgtgtgtgttggggatagggaacaaagatgcctcacctggagtaagtcagcagaaatggacagagaaaattgcaagtcccactgccaggatactcaacagggacagcaaaggtgagagagagaggtcggagagggttgtaagatcaccaccctttagtcttccatgttgtccttctttattctcgctttagactgtccccgagggggttggtggaaccagagcacttgcgtcatccaccctccaaacccaacctctgttcttacgtcatatgcccccagcaagtataaactctgtgccaactgagaaagactgaccggcacagaggtcagaggaagcagtgtttatttgggaagtgaaggttgtaatctgggaaaactgagatagagaagacctgactagtgtcccataaggcagatgccagagatgtttcttacagggcatttgcacaatagttat

SEQ ID NO: 493 - DNA, 2550 bp, Mus musculus
tatgacccagtcatagcagtcctgggcacaggcccagaagactccatattctttctaccagagagatactcactccgtcaactgactccactgctgctctctccataataactcggagatgaaagcacctagctgtccatcagtttatgaatggatactgaaattggggtacatcttattcgggtatagacaaaaatgaagctcacaggtacttgaagcagaagatatttggaagaagcagcccaggcccagaagagaaatgtcacatcctctctctcagatgcaagtcttagctccaagtccttacagcagtggatttcactgggagtgtacgtagaggccaagaagctattgtaggagaatggggtggggctttgagggaagggatatcagagaggacatgtgacatgagagttgtgatgctgagggtgggaacattaggtgaagagggattgagaggatacagaagagaccagtagaggaaagttcacccaatagccatgatagttaaaaaagacatgtgtaaaccttgaaggtgaatgtcaaaacacacatttttagaaacaatttgaacagaggtgaacagtatgggtgaataacatttcactctgaggccatagcttattaaataaaactccaatactggatttggagtgcctccttacacgttgtttgtcacagaggcctcactagcccccaaagcaatacagaccaggccgtagctcttggttgcctaacgggactagacatgaagaccctgttgctgaaaacacctaatatttgggttgcaggacatagagaaaacggttggaatgtagctggaagctttcatcctgctggctaatttccctagtgctgcaaggtgccccgtaagctgctggggagaaaagtatcagaagtcctacccagctgtgaagtctgggggctacgacactgaaactgattatggtagcatggcgcctgtaatcccaacactcggggaggtggaagcggatgttcattatcatctctggctgtattgtgagttcaaagtcagcctagactataatgagaccctttctcaaaaagaaaaaaatagaggtggtatagaaattataataaccaagcataccaaggcttctcacggcactacatgatgcttggttttcttttgccatccgctcccctgggttgaaaaaaagaatcctttgccaattactcctaggaaatggctgcattctgaactgagaaaccaggcaccatacgtgggaggcacagacagagtctgaggttaagcacatcaggcagaaaggaggaggcagctgacaggtttgcatgcaatcggctgcaaacatgttggatctcctgggctaccgcttttgttctgggagacacaggtgcataccagaaagcctggatagtgactggagagacatccaattactgtgcagattatggtcaaaggagggatagggacaccctggcttcacaactaacaaggacagatcacactattcctgcagatcagtataatttaaacagagccaaaatcactggcatagctgtggttaaacaatagaggtcatgttattatttgctgggggtggggggtcctttccccacttacaggcgtacaaaggaagtgctcctgctttgtagaaagcagaccatggttgcctccacacctctttgttgtgacaactggttttagcttagagtttcatggaaactctgttctatatggaggctgtgtttatgcactcatagcgttgccttgttgtgtaacatctgtgatgccctgggttctatctctcaacattacaaagataaatggatgaatgaatgaatgaatgaatgaataaaattatttaattttaacgtctactctgaccaaaaataaacaagaaataattctttgccatctactgtccagcacgtaacgtcaattccccatctcttaatagtcagcataattctaaaggtcaaatggaaagatttgctaatggttaagggccgaggctagaatcagatgctcacaggtatagccgccagactttagaacaatgcacttaacccctgaggactctgttttgctgccagtaagatggggtgcaacaggaattgtgtgtgttcagagtggcctggagtaattaaatgggcacatgcaagaggctaagacagtggttcccaacctgggggtcaggacctctttgggatcaaatggtcctttcacataggtatctgatatttacattatgattcataacagtagcaaagttgcagttgtaaagtagcaatgagataattgtatggttgagcattagcacatgaggaaatatattagagggccacagtgttagggaggttgagaaccactgggctgagggctgtgccatgcacatagtaaagaaggcagccatcacagccatcgttagtaccatgtatcagacacggttggcaaaaacacattgagcagcacatctgaagactggaactgaatgaaatgagtcaaacctatgcctcaccctttacctgcactcctggtgtctgtgacaatactaaggacaaatg

SEQ ID NO: 494 - DNA, 3625 bp, Mus musculus
tgagccatctcaccagcccccagccaaatttctaagacagccatttgttcgtttgtagcagtttctcttcacatatccgccaattctaagaaacatgtctttacagtttgaagatcttaagggctaggatgaaatggtctctgctcttatgtgaaacatttgaaaaaatattaaatattaaagtaagacattatgttgaatctcatctgagggtattaaaacactttaaagttggaatttaaaaggagccttttgtagaacattagaggtggcttctctttctgttgagcaggaaggtctaattccttccccatgcacgcgggtcagcctttgtggcttgcatgaacaagagaaggtactagagatgatactcaaagaaagagttgagtcatgagaatccacgcagctttggcccaagctcaccccatacgtgttgtatgccacgtagcaaatatgtcgccaggaaacagacacaccctgtagacagatcaaacagccacgtgggaagaccatgcagcaggagaaaggtgactgggcagtgactcccacctttgcagcctccttcctgctataatgtgtgaaaggaacaactgtgtctctgtcacctttcagccacggtgacaaagtatccaaccctaacatatttctataaaccagctcatggtttgagtccaaggttacttggctccatcttctcctgggcttgtggtccagagcgctggatggagaggagctgctcacgtcttgcagtcaggaaggagagagaaggagactacaggaccaactgttcctttcaaggacatataccagtgagctctcttctccaagtagcctttctgtcacctccctgcagcctcttaagctattattccattaagggaggtcatctcctgcatgactcagtcgcattccgacattccacctttgaactctcatacactaggaaaccaaaccttcaacacctgtgtttcatgtaaggtccagtccataacaagaatgttcttggacaaaccaccccaggaggaacaccatggagaaccaagaaagttgaccagtagacagaactgtggccccagttcaaacatcccagctatctttgggaattgatgtcacaagcaaaacgtttctgctgtgcccttcctaaattcctccatcacagaatcgtgaacacaaataaaaatggggacttttaatgttactacatttcagggtggtttacatccacaacagaaaaccaaagctcagcttccctgtcagtgaaatatgttttcatctcgggctttttaacagagttaggtaggtttatccaggggctgcagtgcaattgaaattccattagagatgctttttaacaatcaagtgggattaatatagcttctcgctacaaaggactgcaggatctctgccaaaccacatcttacacagtgctgctgctacccagcacaaaagcatcttgtgctcactctcctaacagctgcccaaggaaggtggcaaggacagggagccagaacacactaccgcaatgctcaaagaccaagcgagactctgctccaaagctggagtcaaacagttaacagaaatgaacttctaggggcatggatgaaatgcagggccctgaattcaaggaggcaacaaagatgctggccaaaaaacaaaaacaaaaacaaacaaacaaacaaacaaacatggctcaagatgctagcaatgtgggctctttgacacaatagggagtgggagttacctgttgcagccagagccagctcttgaactcaagtgttcttgctacagccagtgttcaccctacaaccagagagctgcctcctattgtctctcagttggttcaaaacacactgaaatttgaatgcaaacaaggacggtgatctaactgtactacatgctcaccattgtcttgcatactggaagccttgtttcaagcctgcttcatcctcatttcagcagaacaggaggcagcttctccttgatcacacagttggctcctggtatgtgagtccaaagtagcttgaccagatgtcagctcatgcaagataagggactggatgaaaccaacctgtgcctcaaccctcaccaaagcatgccggtgtcttccatctatgctggatacccacctctactccgtgcactttgcctctagaaggccttgctatgcatctcttcctccaagatcctctgcagaatgctcagaacctccaggtctgaggttgtccgctcccttgtttattgcaaatgaggttttatttcggttatcttgttgttaagggaaaaaaattaatttatgtatagcaaggaaatttaatttgagactatgaatttcttgcagacttcaaagaaaagcattacactgctgttaagacaaaatcacagatccccactgatagacttggatgattatgcaaatactaattgaaagtatagggcttggggggctgtggggagtgtaaatccatttctatttaagatgaagccagaacactgaaaggcctcgggggtggggggggggagcacagtgacctgcgtggctgtgactctcaagacctcactgaagctggaatgggagagctgaattgagctaaaatttttctttctccaacatacctgccctactgcagggctggccacagggagactctgttaagccccatagacatctgctgttctgatctgaacctgaaactttccctccaggcttagagtttgaaagcttggtccctaactggtcattgctggttttgcaggttctggagtctttggggaggtggggcctggctggaggaaacaggtcactggaagtctacagggagtctattattcctggtgccttcttctttcattctttgcttctgggtccccctcagagggaacttctccactgtatactcccacactctctgccactgtgacattccatctgagcaaccatggacagaaccctctgaaaccatgggccaaggtaaaccttacccccttaagttgtttctgtcaggtatttgtcacagtgacaaggaagcagataatacagacagaggcacaaactagcagtcactgttggagcatggggtgaaggggacagtgtgcatatttcctatgactagatgctcagcactgagcttaactccaaagacaataagagtcaacatcgctgaagatttaaccacacactatgcctgagcttcctgcatacagtaagccaatcagcttttataattgcccataaagttctatctcgttctaccaatgataagctaaagaatggagagatagtaattgacctttgaccctaaagtgatcaggcttagggctaggatcttgacccaagcactgcagagcctgagctgtcaaatactacactgtgacatttcatagcagtgttgactctaataaaagcatgaaatgcaacctcggtggaaggcactttccttatctgttcagtgagagctaccataccattttttaaaacaatccttgaggtgggatatgcctgtatatgtgtaggcctgtgtgtgtgtgcagagtcctttacctgtatccataagagactggttccaggatatcccacctgccaaagggaccaaaacacagaaatgttcaagtcccctacaccgaacag

SEQ ID NO: 495 - DNA, 2700 bp, Mus musculus
gtatatcatatatatggaattgtatataggtatattatataacatgttatatatgtttgttattataatataacatatatacccatataatatatgtaaagcatattatatattctgtacacacacacacacacatacacatagttcctgcatagaggagtttctgcaggattaagcatcacctatataaaaatctataacaaggacacacatcactaataccatatcatagctatggccatgttggcatcaaaagcatcagcagagagaaaaaaaaccaagtgccactcttctgtcagatctatagagtaaacaggaaggttgtcatgggatgggacagggcttggagacaaggccaagacaccatgcaggtatgggcaaagtccttggagcagggcagttttcttggacagagcagagggaactgccccagaggcagggaaagcttcacagttatttcttcattttgcttcacaggacctcagtctctccaactacttggctgtctgtgactcagatcgacaatgtcttagttacctctcttctgccatgacaaaacactgtccaaaaccacctaggaagatttattttacttacacttccaggtcatactccatcactgagacagtcaggacagaaactcaaacaggacctggaggcaggagctgatgcagaggccatggagtggtgctgcttactagattgctcctcatggcttgctcagcatgctttgtttgtttgtttgtttgtttgtttgtttgttttccctgaggcagggtttctctgtgtagccctggctgtcctggaactcactctgtagaccaggctggctttgaactcggaaatccacctgcctcttcagcctgctttcttatagaacccaggaccaccagcctagggatggtaccacccacaataggctgtatgctcctccatcaatcaataatagagaaaactacctaaaggcttgcttatagcctgagctcatggaagcaatttctcaattgaggcttccttttctcagatgactccagcttttgtcaagttgacataaagctagccagcacagacactaattcacagtcttgctgatcacctgttacggcctctttcctcaatatctcagctaatggtctgaaaataacagttcaacactcagacagagggactgaagtcaactgtcaactggatttctcttaattaaaaaaaagttacattcttctctttgctgataaagcaagctatttgaagataccatttttccaaataaaacaacagaaggaggcatgaaaaaatgggtctaaatttaggtcttaaaacagatagttgattcccagcaaatggtacattcaattctgtttcagttttcaactgatatatttgggccttggagcctacagcttgctgcccagtcttctccatcgcagggtcagagaacaccgggagtcaatctgttttcctgttgttggcattgcctcaggtttcctgctactctcagaaatgggaacacagttctcttaattgatcggctatggagagttcattccctgaagacacttctatcctggacctgcatttatggtcctgcccagtgacatctggctgcccagccacatagggctttagttgctgctcagtaggctcacccaaccgtgcagctccaatgtcaactggaagggaccggtgagggtaaaagtctggggaccacgccttctcagagagcactgacatgaaggaaaagagaaatccagagggaagaatcggaagaggtttgaagaactagggatgaagagacggaaaaagcaaacagcttttcagggggacagacagtgggatgtaagagcccacaggaggacccatggttttctgggagtgtctttagccttgagatgctcagaactttgacatgatgctacagcaagaaaatccacataggggagcactcagtccttcctctgccaactgtcacaataatatttcaatcattagaactgaactaaatacagatctaatttaccaaataatgttttaatgacaatgccagtggcacccagcagtgctccaatttatgcataactgcaagataaattacatcttttgacttgcagaaaaagatgtctaattagggaggttttcaaatataaagaatcatcacggtgaggcatgcaatcttgttgaatcttgttgctacaaagtcactcgttaagatatgaaatgttactgtttaataaactgctacatgaggcatgatcccagtagcacctgaaaatggcctatgacagcaaggcacttcagaaggacctagctaaggcccagggcttcccatcatcttcaggtgcagccacaaaccgtttttgccacaaaacatatttggtcaaattctagttttctagctagctataaattagggttagtataagggtaagatatttaggacttttaaaaagccctgatgtttaacaaagccaccttaagggctgtttcaaacctactacaagataaaaccacattgaaaaactctgtccaccagatgtatccagagcaaatagccagaattctgcaactttgcaccaaataaaggtgaatctgagatgggtgttggggtggaaggatggatatgagagacccaaggaaaatggcagctgggtcctgccagctgtctcctggttgggcaggaagttagacatgagggatccaagg

SEQ ID NO: 496 - DNA, 1900 bp, Mus musculus
tgatgtgagtgctcactgaaagaaaccaggaaggccttacacagcactcattcctaccttagtcagcatgacactccttcgctgtgtgtctgtctgagctcaggcttaacatcaaaagcatccagtatcaagtggggtagggtgtaagctcttagctgctgcttttattatagtcctagcactcaagaggctgagacaagaagactgccctgagttggtggcaagtggggtgggggtgggggctacatagcaggtaccagactactctgtgagaccttgtctcaaactcatcctcacaccctcccctccaaaattaaatgttattcagaacctcgcatctttttagttaattttttttaatgccactttttgcaactttcaattggagctggctctctatatccacaggttcctcatctgagcattcaactagtagcagaatcagaattataaagaaaaatgccatccatactacacacggaaagactttttttcttggtaccgtttcctaaacaacacagcatgacagcgatttacagagcatgcacactgctacaggcatcccgtgcaactagagaggaggaaaaagacataataagaggtgaatacttctgagagaatgggacttgaacagccacagatttgggtatcctcaaggggttctggacccaacacctgcagttacggaggagcaagtgcttaatttagtaaccctaataggatggctcaccttgctaattaaaggcatcagctgtgcttcttaaacaggagcctctagacacaagccctgtgtgtaaacagaaagaggagggggagtcctaaggctccaaccacttatggacaggggggccttgtggatttaaaacaaagaacccaaggatcctggcattatctaccaagcccttacttagttccctcagttctggtctctgggtcttcacagtgtggagttcaccgccctctgggactcgaggctaagcatgctggacagtgcagggcagctctaggccctgctgtgtggagtgaggccaggtcagatcactctgtaccaaatgctaactgcacacagactgttcctgtggggtcctggcacgggatgctgccactgacctattgaatgttaagtgtgatacttcctgttagtcagagaaatcagccacaggccacaggccacaggccacaggctttgttccaagagagaatcagatgaatgaataatgcagaggctcattttttcaaatgaataataaaatagttcatacgcaagctccgagccctcctccggatgataaatatcccattacatcagcagagacgagaattagactgttcaaccaggtgaagcaatttaatcacgaccggctcttttcgtcctgttttcttggagtcttaagttctttgaaatggctttgagaaaaactaatctgaaaacaactttgaaagtgtaaaagaaacaaataaaacctggatcctgcagaaaatccaggaagactcagctatgagtgtgaccctcaagacccaaggttcccccagcctggggtcaagaaacttcttcaacatagcactttcaaagcatgaaattacccaaaagagaaagacaaagtcttgcagtcgctgcagatcgagctacgcgaggaaggcataatcagtagacttagctcatccctttgttattgtgtggatgtacaatgtgtccccaaaggctcatatgttgaaggcaggctcccagagtggtgctatttggagttagcagggccttaatgaagaccggccttttgagaggtcctcagatcactgtggacaagctctcagggggaatgagcagtccctggtgtgtcttctttcactccttcctgactgatgaggtaatggttggtcccatgatgcacaccagctatca

SEQ ID NO: 497 - DNA, 3275 bp, Mus musculus
ctgatgagccctaggcacaccccaacagaactaagccaggccctcattcaatggaaagagcgaacgtgtaaagaaaacatgcccgcatctcttcacatcaaccctatagacatcaaaggagaatcaagaaccatgaagccattgaagaaaaacgaagtcacaaaagcttcagataaatgaacaaacaaaacttatccctgatgcaaacaagaaatttattacactcaattccaattaagactatcaagaagaaatgaacaaatactgcaaccagaaagtaacaccaatgttaagaaaatgaatataaaatatgaaagaggtcgggcgtggtggcacaggcctttattcccagtacttgggaggcagaggcaggcagatttctgagttcgaggccagcctggtctacaaagtgagttccaggacagccagggctatacagagaaaccctgtctcgaaaacaaacaaacaaacaaacaaaaaatatataaaagagaacaaaagagtccctatgactattgtcctggttgctttctgttgccatgataaaatgtagaccaaaaccaactcgggaaggaaaggggttccagcccatcctccaggggatctgaggcaggacctcgagcagagtccatggacaagcactgcttactggctggctcctcacggcttgctcagctgaccttcttatacaacccagaaccaccacccacaacgggctgggccctcccacatcaatcaatcattaatcaagaaactatcacataaacaagaccacaagcccatctgatggagtcagttcctcaactgaggctgtcacttcccagaggacgctagtttgtgcaagtgacaaacattatacagagcaattaactccctggaagaacagatgactcacctggtctgctgcccccaactgccaccttgtaggagtctcggataacacagtcatcatcttcagctaagccaggagaatgtgccaatcagcaatcattgtcagcctctgctatggaggatctgagacagcccagagggcagcccatagcgactgttagatgtttgcagaaatgtttggcatagtagcttatacctgtttcctattagtctttgcctgaattagtcaagaagcctgggtctcactacatatccagaaaaggtaaaagcgtttccatctctgatgagcctgttgctcctaaaaaggaccctgagcaccttgcatgggtaccctggacactgagacttcctgtgcttctcccccactgccccatgtccctttaataaagttttacacaaccatacactgtccagtctctgtgcctcatgactttcctggaggagatatgaagcaccaaagaaacaatccctcccaaatctatcctggcgaacctgtgagctcactggaatcaggcaggagtgtgggtggaggttgctcacagacgctcaggaactcaaaagcagctgcaccacccaaaagcacatcgctggttgtccctgcacaacaggcaggcaagcccatacaagtctcctcttctccagcaactgtttactgcttatagaacatcacagaggaacctagaaggtctcgtgggctttctaagcatgcggagctccatcatcttcctcaggccagtgagcacctcttcaccctccaggaggaagcgcttcatttggaggaatggcggtgaccaaacactccggaatctttcccatcattcaccccgacatctctgatgcagttatcattaaagatttcaatagatggttcagaagatggatctgaacaaatgtcccagattgaaaagccaaaagagcaaagaaatgaaaactaggggaggaaaaagaagaaaaacccacacggtgaacatgggcagtcagatacatagctggagttcccttcaaaataatagtctgcactgcacgggttagaaagcaagccccggcaccaaagaagagacatttgagtggctatggcctcctgaaaatgtggggaaatagatatatgaggacctagaatgagaggaccccggacaggaaaaacaggttttttaggtcagtggcatgagatgtgcttctgtggtgtcagatatgaagtcagagatgctcaggacaccaatgaggaagaataaagttcgaaaagtctgacctttgagcaaatgagaacaggcaggagctcaggaccgggttttacatttctgcttgtgcctctgaattttaattgccatatactaaagtcagaattgtgatcattatcacgtccttaaatatatccagtagcctccactttgctttctggcccttgtttcccacagtcaatcatggtctgaatttctaaggaaaaaaattccagagatgattggtgaatttcaaactgcatgctgcactaagcggtgcattggcctctcataccatctgccctgtcctgccagagacaggaatcgtcctttcatccagtgtatccacactgccagctctggccatctagtcactaagccatctgtgtttccacgtcagaagttgtggtatgaagcatctgtactgaggtaaccattattttacttagtaacagccccggcacacaagagtagtcatgcagggagctcagatgcagcagcagaaaggaggtgggaagtgcgtccctgtgtaaacaacagaaaactctccatttagtaagaaaaatacatgtgctaaggctgctacagtgtaaagaacagatctcctattcatgaaatcaaaaaggaaacatttaatgccagtttgttgttagatctcaaactgccaaagttatgcctagggtgcaaggtaagtacaaagaagcacacagtctgcaaaaggctggacactagccaaagttttggcatcccctgggagtcttaggagtagccccagtggacaaggcagggctgactacaccacttccagtgccagagagtgcatggtgccaggttctttctccacagcagagcaccgcttggctccctcattccctgagctctgattccatccctgtcattgaaatccatccatcatctgggctactaagaagaaccatgagtgtaactctcaacatcactgggcactaaggatattctgggatttctctatggttgtggttggttgattggctggtgtttgggtactgatgataaacgacacacacacacacacacacacacacacacacacacagtaacaaagtagtagtgtgtgtatattatatatgtacacatgcaggcttatacttacatgtgtgtatgtacatatgtgtatgaatggatata

SEQ ID NO: 498 - DNA, 3100 bp, Mus musculus
caagagagaccaccatgcttctccacggttctaggtgaccgtagtgtggaggtgctatacaaagggctgtaatggcgaccatagtatggaggtacaaatggctgtaatgtctggagaacatgtggggaaacctacaatgctcatctccagacttccctgtatgcacatgtgacaaagacgcaaagatggtgacacacacagtgacaaactgcttgcagtaacacacaggcgtgagagagtgacacatgctttgttgctacatgtccacaggggatttgctaaacacaaagcacagtgaaggtcacatgtatgcatgtatgcatgtaacatgtaacatgatggtttctgagaaattggaaaagccagctgcagagccatgtccctaaaaaggcttaatggtgtgacagaaaatgtctgcagatatgcacacatgtattaccccagcctatgaatgttatatgcatgcatgcacatacggcacacatgcacctacgttcatacacacaagcattcatgttacataaactcttagttacgtctagagaaagaactcactagaaggccaactactcattttgttttaaaatatatagcactacccttgtactaatcaacaaactaatcaacaaagaaaaatattagccgccaaggttttttgtttgtttgccttttgttttctaacattgcttaagatgctactccttgagagaccaaccaactctttagtattcaagcaagctcattcatgaggctaattatgagattaccactaagctcacatcacacttgctgtttccacagcaccggagcctttgtgcagagaaagaatgtcacacagaacccggaaaggcacattaatggcattcagcggcttaggctacagcaggatctctgagcaacctttatcctcccctcacccctcctccgacaagcaaggagagtggacaggatatctcactgggaatcagggagtccaagtcccctcaaagtctcctgctgggatgctctgcctgccatggaagatgtagcggatagagaaggcaacattgttttatgtggcggatagagaaggcaacattcttttaggggctgaaatcatgttggcttacctagatacacctccctccctccctcagcgctggcatctctccacccacggagcagcagtactgatggtcatggggtaacctggcctcggaggagaacgttctaggagagatgaggccagcctactcagatgagcactgaggaagccccacccagctcacagcgctgttagtaggattccctgcagctgtggaaataaagcagcaggcctgccaaggcgacttggtcctagatggtgtcctgtagaaagatgttcaaaagtgctttctttcccctttcaatgaaaccacttcacagttttcctgggagggcagctaacgggagaaaggtgtgttttcttgcccagcaagggaacactgagcagctggccacggagccggccaagtctgaagtttcaccctggtgtttatgaaggctccttaagtgacggatgaggggaataagctcagaatggaggcaacacctgtcacaccccagccaactgctgaaaactgtggaaaccggttggagagaagacagcccgaggtatttatgaactgttatttattcataagttatttatgactccactcgtctgaattttaccgtaaaaacgatcatccaaattatttttggacaaggcaactgaacaaacatgactgactgaatgtacgtaagccaccctgggatttaactgtccatctgcaaacaagtcgtcctttatagataactctttaccccgggtcagccgccctgggagaaggacgcttctgtgggagagcgctggcaagcccatctgtgccctcctttcactcaggggtggccctcaatattccagatgcaattgagaactcaggaggcctttgtcatctgccactgccatgattctctctgccagggagcctttcacgttgtgccttcctcgactggctgccagctcactccgatggctttctcgctatgcagcttgaccttcctatacagcagtttccccaggctgccgctgaccccgctaagcgatgtgcctacatcaccttggtccccagaaagatcccacatatttgagtggaaagcagggcacacataattggcctccagcaaatggctcaagcgactgttcccagcccatgcccctgtcctctgccctgcttcgcactggggagaagatggtgtttgtttctctttgtttccaagtgagatcccctatatctgcactcaacttcccaaggctgaggggccttcatctatagagggaccagcttcgctgaaggatggcttagtgggctacttgcctagcgtgccttgggccttgggtcctatacttgcatccagaaaacaaaacaaaacaaaacaaaacaaaaaggccctattatgaaaattcataaactgcactttcctattagcatgacagtatatatttgcatctgtctactggatgtttggatctatttttccaaactttattttttgttgccattttttttcttatgaggttatcatgaccacacacacacacacacacacacacacacacacaaattagaagcactcttggcatattagggacttgtgtgccaatctgtgccacagtgatttctatgggaagtgattctcagaatgtctgttttaagcctttgtctgtaatgtcttttgcataataaagtttgctagttttttgcaaagccaatatttaggccacctataatctcagcacatgggaggctgaggcaggacaattgacactgagactccagagtgagtttctaggctagcctaggctaaagtgtgagaccatatatacaaataaaataaaatgaaaaatatttcccagtcagcttttaaaggttttttttttccagccccagactacacccatgtcttctaaagtgttatttatttattttttaaatgcaagcctgctgtccacatgggcattgctatcacctgcatcaggcagggtcactagcactgtgatccctcatagctgatcacaccaacactatttgctaaaaca

SEQ ID NO: 499 - DNA, 1775 bp, Mus musculus
gatctgatagtgcatgtccttcggctcctttggaaagttgtctcttcagtgttttggggacacagcaaggtagttgcatatacaagctcacagcaattatggcagcaggcacaagaccttcagaagctcaagccagacaaaagcacagcatagagggaggcaggcaggcagagaattccaccagtggccgatgagctacaggcatttgacagctacagaaaaagggaaaagcatttttcttaatgatctgacccctggtaggctaaccaatgctaggtcaggctccattcccaagactagttgggcaatgcaaactagtctccaaggggggaaaagaaggagaaaactcaagttcaaagttggataggaaggaacagtcatgcaggtggggctgtagtgaatgtgttcaaggtacggtataattctcaaagaattaagatattgtttaaaaaaatagctgtttctttttaccagaccaggcagccaaacatggaaggtaaatgatttatttattttagtttcctatgtagggggtgtctgggctcagtttgtccagtgcagaatgaggacagcatcagaaggacttaaaaccatctaagtgacaggtattatgggaagtgagagttctatgatggtctctgtccatccattgaggacctgggctgctgagtgatagctttacagatggggtacaagttagggttagagacagcatacaaggagactcagagatggtatataaattgcaaacatggcaacttcccgatgcacagtcccagactcctaagaagtgctcagaaaggctcctagctcgtgaaaggaatgggataactgatgaatttccatcaccaggcaataacatgtctttcagctgcttctgtgaagagacaaatgcatggtgtggcttgtcagagactctacactgagtggacatcttgactttatgtattttataagtcagcattataaacagccctaaagatcctgagatcatctagaagagtccagctcccccatcacatgcagattgcgcacgcgcgcacacacacacacacacacacacacacacacacacacacacacacacacacacctgatcattccctagctccaccatagggaagcatgcaggtacatatgatcctagaaacctgctggctatggttaattatacctcattagccctgtccgcctgctgctttccttaccccacggtttcttggatggaaaataagagagctttttattttaggttgcagtggggggaggagggagaagaatcacattgctaatttctctgagatgcatgagggtggaatgacagatagagctggaaaccaggaatcactttccttaagatacagcataaaagccattctttaaatggctcagatctgcactacggaactcaaaagtcctaattaaaaacagaaaactagaaggtggaggatgagggggaacaaaagatcacatggctagtggcccagggttgatatttctcaggggcccacatggattgtagttcctttaaagcactgtagagccctatgacctgagtgtttgtccctccagagtggcagtggtcagtgtgagccagaaagaaaatgtgccccttctgttggtttgcccggtctgtttctcactgacctggtctgagactgcagacaaatgagctccacaattctcatgtttaggtgaagtaagagggtgatgttgctctttcaaagctttagcgtcatctaactagaatgatatggaaatgcacttttataatt

SEQ ID NO: 500 - DNA, 2575 bp, Mus musculus
ttgagaaaccaagagacagagacagacagagactttgtctcaaacaaacaaacaaacaaacaaacaaaacaaaaccaactaaattaagcaaacctgtctttaaaagacaaagggcagtaaggaaacttggctttgccgagctctcctttgtggtcccagggaattgcagcacggccagtgctaggcaagtgtgctctgccctgatctgtctccagcttttactttccactttgagacatggccttttttctcactatgttttccaggctaaccttgaacttactcaacagcccaggaagatgctggagttgcaatcctctgcctcatctactccctggtcctgaacccccaagcctggctggaattgtttttcttactgtaggaaattatatacgctttttgttagtttccattgctggtaagttttgtttgatagtgtggggtggtagggtctagggactcacatgctaggcaagcactccgatgctgagcaatgtttccacccttctctgttactaaagtcagaactctacctgtagttatttttattcgacattgggatatatacatttgtataagtcacaagtaaaatggctttagacacaaaagatattaagtgtataatgcattttggagaattagctgataaaagtggactctgcctttcacgatttattttagctttacttgtttgtgtgtgtttgtgtggggctgtgtacacgagtgtagctgccctcagaagccgagggactggagcctctggagcacacacaactgctggggagtgctccggcttagtcttggttttaaccataattacgggaagccaactccttcgtagcaaggatattctatccttaatgctggaaccagtaagcttctaactgttaagcctctgagtaaaagaaggaagtctatgaaggcctgctggcaggatgagtggcccagaggttctacctgggctacaaggacacgacagggttgcacacttatctgtttctgagaggctcctgtagcaacagactgtgtctgtgtagtgtgtggatggtccagttgtctgacgcaagttcactgtgtgctcactgtggccccagaggcttgacggttttaagggagaaagagaactaagcaatagctccagttaggaaaggctgccgacaagttctacaaagacctcgaggcatgacgcatacgtagaatctgtgtgtttacagctgaggcagaagaaagagcatttgagctagttttaaaatacagaactacgatgattccttacgagacaaatcacaacgctgctggcacagactagagcccacaagcatcgtgagaaatgtgggattttctcttgtaatgtgtttgctgattaaaaataaaaagcatatctttgactcattacagaaattcaagccaaaagaagaataatatttatatgagctgatagaatgaagtcccacgcacataacttgtggaaaagccacctaacagtgtgtcgtatactgttacatttatgctgtggcaattttctcacgagaacatccccgtgcagaaccagaggctgccctagactctgggagcaggaagagttaggtgatgtagttactgtaaattcctagtacggagcacagcacacagtaggtggttgattagtaatttctgaataaggcaaggagaaagaaacagaacacctgctggcagttagttaagacaggcctgcgttcccagctacccaggaggctgaggcagaagaacacagaagaacagcaagttcaaggccagtttgggcaacatatgagtcctggcctcaaaagatgaaatgtaaggagggcaggagtgggtgtagctcagtggcccattacttgcctagcacatgggaggttctaggttccatcctgatactaggggaaaataaaaaccaaacaaatatatatcttttgaagagtatttttcttatgggacctagcataagttaccttgagggtgtcaataggcttctcttagagggaaaaaaaaatcccgaacatccatgcaaataatgtatttctgatatgacttggttttctagaaggaagtgatatgaataaaagaaagggcaaggaggtgtgaaacatctcacaggagagcacaccaggaaagaactatctggaagaggtcattaaaaagtagactgccatctagagggaggagggagtgtggccgtgttctgcacacctaaccaaagggtcctggtcccaaggtgcaaggacctcgaacccacagtgctcatgtagtcactctgcagcacagactaagactccctccaagaatcagagtgtcattccaggactgacagcagcctgaagggagccacctcacggctgcctcccccaggcccttttagtgtgcataggtcaatacatgccagtgtgtgccttctgagatgcacagagcaccaaagtatttcttacaaggaatcagtggcctactcatgttttagcaattaaggttcaatttctaaattgattatcaatttttaaaaataaaattctatcttctttggtaagtcatgacaaaccttttctacaaatatacagttgtt

SEQ ID NO: 501 - DNA, 3400 bp, Mus musculus
accctggatggcactgttacagatgagaatccctggtgctatggtgtcttcttcagccctttgcaagttgccttttctgtgtttctgaaatgcaaccaggttaatatatgtccgtagagacaagtgattgtataagtacctttgctttcttcctcctaatgaatgcttagacggaacccactttcaccatctcgaatggtgcttgaatggacttgagggcgtcttgatagacggcgggcactgcactctgaagagaagggagcgcgtgagagggcacgcggggacagctgagcagagcactagaagctatctaggtgatacggagccgcagctcctgaaccggtgtgctggaggatccacaggtggcactgagtaaccaatcctgacatcacgggggcaaacagaattctgggcagctgagcatggcatagaggggaaactgaggctgtcgaaagctggcgaagtacaatgcgagttgggctgtgtgttgctttaaggcgctccttccacttcaccctgtgctgcttaaccctgctctgcacccaggaggctgatgcaggacagggtcagagttctccgactaacagcctggccacggaaggagagtggagagagggcctcctctggatccgccctgtggttcaccttcctctcccatttcttaaccatctacatggagcattgtcccctcgtcctaagacaaagatgcccttagccttggggcgggacatcagtacatggggccattctattggctagcctgtatacgtgtgccatcccttttcttccttcaatatccacgaaaaattctaacagttgaaatgtccagaggaagttagccacatgcaaaaacatagtaagaagtgtctgtatgtctacacaaatccaaccacccctcattttgcagctcatctatactcccctttaaaactgaagcaagcttgatatttttgcatatgaactcgtagtgttagcacgatagctgacaagtggaaagcacttcaaaattaaagcagcaccgagccaaacgggaagaagttaaactaagttgaaatgaatggaattttactgaataaatgagatgctaatttgatacattttcaacaccctgtgtgttctgcactcctccctccctccctccctccctcccttcctccctccctccctccctccctccctccgtccctccagcacgaggttcgagaaagcgtcttaaacaccaaataataaattagaccagaaactgggtttctgaaatcaacaatccatgtttgcctgtacaggattagcatcttacacaggagagtgcagaggtcgggatggtggtgggataaattcagatcccccaagccagtgtggctctcaacctgtgagctgcgacccttttgggatagcatttcagatagcatgtggggaggcgggggggggggggatgacaaattcaaccttgggaaggaaaaaagcggggtggcaagcaaggtgcaccaggctcctgaggctcctcgaagagtcctgatctgccatacgtgacattagatctaagatggctcccggaacaccagtgagacagcaaaaaggaatagggccagggcagtggttgcttctccaaccttcaaggaagtcctggcaggtgacaatccccccgccgcccccccctctctgtttcttcccagtcatctatctcatcaggtagggctttcactggggcatggtgatggtgtgttgagatatgattggccaaggatctggggtttgggggggggggcgaggattagcttaactgctgggcagtaaactccaacctgcaccctggtgctggtctccagagcctgagtcccagggtttgtcacgtgacaccattgcctgcctctcaccctacatccttggccctgttcccccaatatcacacgtatcagatatctacattatgattcataacggtagcaaaattacagctatgaagtacagtgaaaataattttatgggggtcaccatgagatgaagagctgagctaaagggttgcagcattaggaaggctgagaaccaccgctctaagccttggagagctattttcttgatattgttaagtgggcgttttgttgttttgctactggaaagaaaaagccaaaaaaagcaacttctgatcttttcagaacatgcaattattcatttgaaagtaattgtaataggcagatttattacctttctctctgagttgtgatggcaaatagaaaagaaacagaaaaatctttaaatttgactgtgattcagtcagaatcagcacatgttggtgtgttgaatctgtaaaggaaagccctcctgagcatcctgcagcaggctctgcagctgtggatcaagtgggtagatggccaggggagacacccacagcctgaccctgtgcagtcttctcagggacccttctattctctttttttcatgtagacacggaacactccataacttgactctatccttcggctcttgtagtctgagcaaccagagactctattttgaaatacctattacttcagtaacatttcagatcagagttcaagactgggctctttcatgccaaatttcatgttgtgactactcaggctccccccagctccctcgttcagttctttgtgaagaactccagtagtaagaaaagttgttttaaggccaggcatggtggcgcacgcctttaattccgccacttgggaggcagaggcaggcagatttctgagttcgaggccagcttggtctacaaagtgagttccaagacagccagggctacacaaagaaaccctgtctcgaaacaaacaaacaaacaaacaaacaaacaaacaaacaaacaaacaaaacccccaaaaaacagaaaaacaaaaaaagaaagaaaaaagaaaagttgttttaaatcctcgccttcttgtttaagaattctgggtgttccaacacagcagcaacagccattgccagctgtggtggcctgggtgatcaaatccaagcttttccccaatcgcagaaagccttgtactggcagctcagatttcaacaccaccgcagtactaccctgccttgattgtaacctcagagatcgatcagagcagtgagtcctgctgggcgtggactagaaggccttcctgggatggcatttctttcttttttggctgacagatgaagaacagcatcccagacacggcacaacaaacagcctcagagtcagagcggatctccaccctttgctgtgacacgtctggaccatttggccattgtcgtaacacaaacttgagactacccatttgaaaaagaggaggggtgtgtttgggtcgctaccttgaaggttgaagttcacattgctcagtttatggtggccagaaaaacagaaagaggaagaaccagaagttgcatggtcccc

SEQ ID NO: 502 - DNA, 1825 bp, Mus musculus
gctgtgtgggattaggaaagacaggtccagtgcttagcactgttgccatccctttcttctgtccctgagcttttcctaaagagtcacaggctgagaaccacagaactttgccagtccagccagagcaagatcagcgcagacctttgcggaagagctttgcaactgtgctgacagaagtagcagtagcctaggtagggaagtggattcctaggccctaccctagacagacggcagcccagagttctggctgagctcctgtgtactctctgagtttttacccaaggatgcaatcttctggaaggcctccagcatcaggcccatgacccgcctgaaaattgagggaacctggctacagcggcccctttaggacccttagcaataacaagacaagtaggtttttgtgattagttttgtttttgccttccatacggaggtggaagcagaagctggtaggtttaaaactgtaaaatgtaatttactatgcgagttgatcttgacggtccaggagatgcatggagcaagaattgccactagatggcgctgctgcacttccctgcggactctgcacatcgattctaataaggttttcctggatcccaccggagtcctagttaaaaaaaaaaaaaaaaccaaaacgacgcgccactgtgagttgaggcctatttcactaagatacccaggaaatgatataaagtcacgaggctttggctgggggcaactgtgggattgtagcaggaaagccatgtagaatgttacagatctccctgtccacagtactagcttcagccgggtggaggagcagttagagaagcggagataggctattttcttttacagggagctttctgatctgatcgaatgcctcctctttttgtgccagctttgatgaagttgatattggccagggaccccctagaaggcctctagagaaaaaaagtcctatttgggcttgggcatgggagtgtgtgggggaagtggggtgatagggtcaggctggaactgggcttagattagtttgtgccagagcacagtgtggatgcagagactgagcgtggggctgtagggggctgctgggtgactcagtgacaaacccatgatagtaataagcataaagacacccacccaaactacctcatggaatccagcctctctgcagctaggaggacgagaacacagtgtccggttcacagatgggaaacactggacgctcaggcctgaaccacagggagggagggagggcagggctcaggcttcttcttttttttttttctcagacctccctccctccctccctccctccctccctccctccctccctccctccctccctccctccttttcctttcctttctttctttctttctttctttctttctttctttctttctttctttctttctttctttcctctttctttctttctttctttctttctttctttctttctttctttctttctttctttctttcttccttccttccttccttccttccttccttctctctctctctctctctctctctctctttctttctttctttctttcttcctttcttcttttctttcctattttctttatttacatttcaaatgttattccctttcctagtttcccctccgaaaatcccctatccccctcctgcctccccctgctccacaacccacccactcctgcttcctggccctggcattcccctatactggggcatagaaccttcacaggaccaagggcctctcctcccattgatgaccgactaggccatcctttgcaacaagagcttgctgacaggagcctgataaagctgtctcctgagagagaggctc

SEQ ID NO: 503 - DNA, 2575 bp, Mus musculus
gaactctcagtttcttgcttccagacacaatacctgttactggctgccaggatgtccctgccattatggaactaacagacaaaataaactttttcttctataagtcacctggtcaagatattttgtcatagaaaaaaaagtaagtgataaataaataaataaataaaataagactaaatgactaagggcccagccctagatggagcatctgtgacatcccctgcaaggctcagggaacatcacaaaagagagggtgggaagactgtaagagccggaggatgggggagtgtgctatgaattgttgtcctctgcacctgacgtgacctttgcactcatgagcacacagcaactgtggttatccccataagacctgcagtcagtcatgccagcatggacgaggtgggactcatgatgcctgtgcacctacaaaaaagcttctggaaatgggtgacatctggaggagggagaatcaatttcattcggacagctccatgtctgcccctgctcatgcaggtagcactaactggatctagtgagttataaaagatcagacaatgtgaagaagggtgagcactgttgggtgggtctgaagagactaggagaggagagttggggtggacaatatcaaggcatttataagtatcaaattgtcaagaaacaagttaaaagaagtttttaaactgaaagcagggcatgggggcacttgcaatcccagtgccagggtgggtgggcatatacctggtttgctggacaggtagccagtgagaaatctggtctcaaaaaagaagacaaaggagaagaagaggaggaagaggaggaggaagaggaagaggatgaagaggaaaaggaagaggaggaagaagaagaagagggagagaaagaaagagaagaaaacttggtggcacccgagaagccgcaaccagtgctgcacgcgcacatacacttgtacacacacaaactgaacagctacctcgggcatctgtgacgctttatctgtttgatgcagatgtcaagtacacacatggatggaactacacatgaatgcaaaagacaaactgtgcttcagctggtatattctgtacagcactgccccctccccatgtctgtgtgtctctctgtgtgtgtgtctgtgtgtctatgtccactgttgtgcatgcatgcccaacagattcaccggaggtcccccccagctgacggtgtgtggatgcgtgctctcttccacatgtgtgtcaatttaacaactcgatgctccgtacatgtgcgttttcctgcctaatatctttatttctcaactgcttggtttcagacttggaaaagctgtgcttgatgttgaaagctaagttcacaccatgcagggtattttaaaactcagcatctgatgcctgaagtgtgaaaaaaaaaatcttcctcctttctgtgagcaccaaatgctggaaagtttttttttttccttcactaactggagaacatacaagtctatcaaaggctgatatgcaccgttgttacagagtgtgcttggaaattatccctgctatttcagtgatgaaacaggtcattaaaactctggtttggtagagaagtggtccaaatgtgtaacgtccgggaagagatcttgaggatagatggctcacatgcaaccaataaaatggatgtgcttgaattttaaacaaattacgtacttacacacatttcaaggcttatagaatgaaaggacacaaagaatgcttgaggtgctggagagatggctcagtggttgggagtgtgtgctgctctggtggaggacctgagttcagtaccaagtatctgtatcaggcagctgtaactccaggtgtaacagctccaagtgttccagggccctcttcttgtcacccctacaggagggtgggcacctgtactcacgtgcacatatctctgtccctacataatacatacatacatacatatgtacatacatacatacatacatacatacatacatacatgcatgcatgcatgcatatgtgcatatgctcacacacatagttaaaaataaaacaaaaatttaagacaatatacttcagggaatctgggataaatgaagatgggcaagggaggaatacaggcaggttacctcacagcaatgatcacagttggtggccttctgttcatagtcaagtcttcagcctctgaaaaacaactttcagggggaaagaaaaagaacagctgtattgagaatacacagatgttttcttgacattattccctaagcaatgcagcattacactgtttactgtattgggtatttcaagtcatctagaaatgttcgagtagagggtaggacacatgtagagtctgtgcaaacattgcaactttattttcattacttcctgactttgatcagtgcgagggacagaagcctgggccttccatgtactacaggaaaactgccctcagccaaccatacccttgttcccagctacaggccttttgtgtaatgatatggggtactctggaactgatctgccataggggcatagagacggggtgggggtgacagtccacttgaacctgtgttggactgctcatgactgttgga

SEQ ID NO: 504 - DNA, 3875 bp, Mus musculus
tttgctggattctgcagtaggtattactaacttcaggttacatttttgctagacagctgaggtggtttactttttttttaagtacacaaatatttttgaatgtttcttaggtacactgaagagtttgtcttctgaaggaaaacaaaagaaggagcctctcctcgttcattcgtggagttaaacaatggtagtaattccagcaaaagaccttatgaactacattccaaagccacacaggagaagcgtctgtggggatggcccattcttttctccctgctccttcagcacccaagcctgctattgcaagagaaagaaaaagagggggggggggagctgtgtcctcaccacttcaactctagttcaagaaatactgactggtccagccacagtctcaaaatgcattctctgataccacttctgaaaaatggggtaaataagagttgaatgttttgtgattgttaagatattaaaatatttgggggtttcaggtagagaacggtttgttgccagtagttgttcattgaaatctcttacaggattctttttttttttttttttttttttttagcctagtctgtgatgcagaacccgctgtgctaaattatgaaccaaaggctttagggtgggaacaatcaatcaaaatacctggggtagtgtgtaatgtgcacgctcttgtcagcgtgaacaggctgccccggaacacggtcccccagcaggttaaataaatatgatactatagacaaaccgacaggatcacacgggcatcaatcagctgttgataaaatacaatcttcctttaatacacgctgggaaagttatttaacggttacaaaacctatatccatttcttgtcttttttttttttaagtcttcgtagaaagtgtaactcttttataggggcaaggcggaaaaagttgcaagatcctggtgggggttgggggattggggtgcatttagtggcgccaaagaagtgctgaggctcagctctctgaggaggagggacagactggccaagggttcatgaccagcagcaaaccacacttgaagcaatgccggggatctggaatacagggttagcttgttgaagcaatctctgcctgggaacccctggagcgtttcaatcctatctttatttcctctcctttgggtcctgatgtttgggtacccggagagcaaatgagggaatagcagcagcgctgctttggattgattccgggagcgaagagaaactgggcagaaaacaatttaaagagggagggggtagatggaatggaaacgcgtccccagctaaacgggtggtaaaagggaggtagcaattgactctgcagtcagtggcggtgaaatgggaggactcgcgactcggcggccagcacgctgcgcctctgagccgagagtcctgccttaaaaaccatctttgcaataagaaagagtccctttcgcccctctctacgaggtaaaaatagaaggggaacccttcgctaccgtcctgggctcctttactcccccaaccccaccctccaggcatctcccgatcggcggcagggcccgccgtgtccacgctttgcccctgcggtttgctcaccgccttgcttgtccccaccgtccaggtagcgtgtggcagagctcggagctcgggacaccatcggccttcagaagtgggaaggctcaacggtgacagccgatctcctaacaagtggagattaatgtcccaactagaaactaaggtctcctaagtgctgtcggtacaaaataaatactgcgagcaggcagacccgtcgcctgccactcaattctggatcgttctcagccggtagaaataactcgcagcacaaggtgttgatggctacgtttgcctacgcgcagtcctccccagcaggaaccccagatttccaaaaggccgggtctgcccctccgctgctggaagaactactggatctcccgcagtctacgcagcacattccccagtggtttctggaagattcccgactgagaaaaggctgcgcttgccgctccaaggcctaaactctgataatcgactgcccggatggtttaggctgggggcggagtgaaccggcgcccgtgggtcagtttacgacccccgtactgctccgggcccctgtaggtgatggcagctgtcagcaaaaagagcctaaggcgagttctgagacaggtcctgcggactagagtcgggttgggatagggcttggggaaggtgggccatggatctagaccggagtgggagcctgacttttcaaagtacctctttcaaccccagaacgctacttggagttcgttaacacacgcgcttggaattgtcccctccccaggtccagggagcggtgacttgaggaggcacccgaaccactgctatctttttggaaacctggcgctctcaagagctctgtgcccgaaactgacacccgcaagcactctccaggggcctgttgagcagatggagtggcagggccaggcggggcctgttggcgagacacggggacatttgtcatgggtgacccttgcgcctcggcttctgagcccacgccggcgtggggaggccggcgctaatgtaataaagcgagagcgacaagaggaaaggcctctctcgccccggggccgccacatgctcactccgttttactgtcagggctggtcgaggctgtggcttcatttcatattccattaatatttacagcagctattgaatttcccattacaaagttcaccatacacagtgctaatatgaaattttaatagtattgtgcacattatgaaaagtcccaccattaaaaggggagggggaagatctcagggagaagttatcctgagaagttacttgccactgactgcttgaaacgctccctagtcgagggggtagggggagcaccgtactcatttgcaactattatcataaagatgcgcagcggtgggcttgttatcaattttgaaatcaaaagagagggagggagtggaatgtaaaaagcaggctgactaaattgagttttccaagttgtgtgcgctgggctttgccctcactcagagaaaatgatcctgttctcctgccttgtaggaaatgagtgggaacctagcaagatgctttccagtttgggtcagggtctagccgccctcggtcctccccagtagtccctggggctgtgtgcagctgctaagaaaagccctacccgtcctctacttgccagccagccccaaggtcctcaagttccccaaaactacagtgctccaagggtggttaaagaactgtgaaaataacctatttctctgtgtgatgggcaacttctctgtattggtaccctagagcagttatttttaggtgcttcatttggcctggtgaatggcttcctaatactccaactcagggaaaaaccaatagttaactcggggtgaaagggagtgggacacgtgtggaaatgaggctgcacaagaaagaaagtgctgcagaaagtggggaatccagacactggagctccaagtcaggattctctcttctgtctcacaaagggctgctccctggagcccaagggtcagagcctgttccagcatccagctctaattcaaagctcaccttctggcacccagggccaggtggcagagcatgcccctcggcttgtcctcaaaggcacttacctaagtccccacccctctgttaggatgatgagaccctttttcacagctggtatccggagtcactagctcactgggatgtgtcctgtccgccttcccacgtgaactctaagagtattcaactccctaaggagactcatttccccaaatttcttttttctaccagagtgggcagatgaatagtgaatgaaaatttcttttctctctctctctctctctctctctctctctctctc

SEQ ID NO: 505 - DNA, 2125 bp, Mus musculus
ggagctactttgcatgttgtgaaggttaaggcttgaattgtaacaataaggttttgtcatacttaatggtatttcaatgacaaatactttcattgatgtcaaaatcccctgatgctttctaacagtctcaggaacttgaagataaatatgaatcagaagcaaagctacactgacttttgttattttagtgtcattgtagattatctactatatcccgatatctctcctaaatcttgtcaataaccataatttgagcacttcaacaatgaaagtcggacattacctgcaagtataatgatgcaaagtagaaaacgtgtgcccatttcttaccctatgattgtttgaattctccatatgttcgttttataattgtttaattatgtgattattacctacagtataaaatataaaattattaatgtaccatcttccctgtgtcatattgccgacttactttttctgtcattcctgcacatgctctagttctcctgcattccaaatgccctttgtcctttagcctgaggatatttacaagtacctgtattctcagtgctagggagtgtggcctttatcatatatgcaaatgtatctcttcccttacatacaaggatgctgtggtgtttttcctttcattcaccatccaactttgatttttttgaaccatttcctcattccaaactccttcccaaattcttagttctctgaatagcaattattaattgtcccatctttcttccttaatagactagaaacgtttcctaggaaacaagcaaggactgagttttctctggttaagatggaaaattttgtggataatttgtaaaacaataaatatgagaattttttagtatataattatcttttatctctttttttacagtccagtcatttttcttcctcctgttccaccttctcccattcctcatccaaggggatatcctccactccagccccaccaggcatccccacttcctgcagcctcaaattaggttaggtgcttcttctctcactgaggccagaccaggcagttgtctgatatatatgtgtccgggacctcatattagctagtgtatgctgtcaggttggtggctcagtgtctgagagatcttgaggttagttgagactgctggtcttcctatggggtcaccctcttccataatttcttccagcctttccctaattcaactgcaggggtccctaacttcagtccattgcttgggtataagtatctgtatctgtctcagtcagctgcttgttgggcctctcagagggcagccatgctagactcctgtctgtaagcacaccatagcatcagtaatagtgtcaggccttggatcctccccttccggcccctcccgcccaatacccaatgactgagtttttttttttttttttttttttttttaagtaagagaatgtgagatttaaccttgcctcttccccggaatcctccttgatttccttttaccgcctagtctccctatttcactcttctccactgtgctgatatttgggcttcacatattccatttcattgattttcattaaaccatcttctccatatatttcgtgtgtattcaaagagccacactctctgttaccaccaataaaactgcaaaagttcaatatcaatgttatttgttacattctcatgcttctttaaattcatactacctattttgcctataattagatgggaagaggcatttaaaaaatcattttgctacagcaagctagcagaagccttggataaatatttaatgatggcaatgttgattcactacaatatacagaatgggaataaagcagtttcctctaccacacaatgtaaatctccactgcagagatttattgccactgaaatagctttcatgtagtgtcttttttttttttttttttttttttctgggctttaaagctttaaatgatttcctgaattataactttaatctaagactacaaataagccagtactgccatcagcagccacagagggcagagggagggaaggacctgggtgggagaggggagaggcaggggcaagggggaacatgatcaagtattgggggaaacggcagtgaagtcctgagggccagcagaaagaatggaaataggcattgggtgg

SEQ ID NO: 506 - DNA, 2150 bp, Mus musculus
tgcaaagtttttggcttgtaagatttgtattcttccaaagtcagtgtgtattagtgaacatctcctccattcccggttaataatgaccatcagaaaagggagcatgcttgtaagcagtcttctgcctggcatccttgaattcttacttattctagtctcttatttctctgaaaatagaatgtcaaggattaaaataatcagtcaaataagaaacaaatctctgaaattaatacctaagttctaatgatgaaagacattcttaaacttcagttggttttatgtgctatgctatgaccttatgtttatctccatattctgtgagtcagtggccagtattcttatacccaacactgttttttcagtactatgtaccctgcactatgtagtggatgctcagtacttgttggctgaatgtgaatggctgcagtggtaattgagatttattgctagtggttctttgcttttgttgagaccttgctttttcactggagttttgcctgggatgcaaatatgactgaataataccgtgtatcttcagggggagtaaattggagttcattctttttaacagaagagaggatggaatgataagataagagagcatcctcttggcatcgcttgggaaagtgtgtgtatctgtagcacaaatgtcatgctaccatacttctaaatctatgcagttttcaagtctataatctatgctgactctgtgtcaggcaccactgggggtgctaaacattcaaaggtaaacaagacacattttcctctgagtgattcatagtgtataaatagaaattgtaaaaaaaaaaaaatcatattccctttcctcacttcccacatgccatcaaatgacatatgtagatagtaataagcgttgttctctgtcccttcttcctatcctgtcaatgtcagaggaccactgggagttgtgtgagggtcacgtatgctcgtaagatagctcatgctttcatctaccctcccatcataccttctccctctcctcatgaagggtatagatgtgagtcttacaaaacaataatctagctagaagcatagacatcacttcagcccaaattcttgtcaagccttgcaggccttccagacctgattctgtagcccatgctatcagctgctaagctagtccaggagctaggttccctctctgctcacctcatggccctcagtcgctgctaccttagacactccaagaggtcttcttaaatctgtttaaaacaatttttctctcagtgtgttctcactgtgctgcaatgtttacatgacatcttagtagcttgattttcaaattctactgttaaactataaagcaccctcagagtgggcatcagtgttgaaaaggttgtgcagtacttaacagactactgaaccctaggggtagcctagctagccaaggaaacgcttataccatgaatgtgtgtgatgtttgagagaagtaacatatagcaagagacaggactggagaggtaaataacaatcacactgttcaaagacctgtgtgctcatgaagcttcagacaatatgctgccagattcagtctttattccacagatccctaagaactttgctgccaatacactctagaaagcctttctgtaggttagaaaaagacccttttcagccagggcactaaagcttgagaagaaagggcattgggcacattctcctctgtttgccatgggctctgctgacttgtttgcagcctgctgaccctggttctctcagaactccctgaaagcaacagataagagcttccagcaagttcttattccactttcttctctgatgcagaaatcatggaaactgtgccttttctgtaacttataagcaattataaatgtacattgtgtgactcctgagcaaaatttaatttgcaaatagaccttgacttaaaaatgttaattgctgaacatcttccataggcaaaattgtaaataatcagagactattaaatataggataaaacaatcaggcttaatctcagaaacatgattctgacaataggttagaaaagatatgtgctggttagtttataccgacttgacacaaattagggtcaactgagagggctataggcaagactgtagggcattttcttaattagtgatagattggaggggtacagccattgtggg

SEQ ID NO: 507 - DNA, 3475 bp, Mus musculus
aaagctgacaccattgcatacactagcaagattttgctgaaaggacaaagatatagctctctcttgtgagactatgccggggcctagcaaacacagaagtggatgctcatagtcagctattgaatggatcacagggcccccaatggaggagctagagaaagcacccaaggaactaaagggaactgcaaccctataggtggaataacattatgaactaaccagtaccccggagctctggactctagctgcatatgtatcaaaagatggcctagtcggccatcactggaaagagaggcccattggacttgcccagtacaggggaacgccagggccaaaaggtgggagtgggtgggtaggggagtgggggggggggcgggtatgggggacttttggtatagcattggaaaagtaaatgagctaaatacctaataaaaaaattggaaaaaatgtaaaatgctgggctggtgagatggctcagcaggtaagaacactgactgctcttccaaaggtcctgagttcaaatcccagcaaccacatggtggctcacaaccacctgtaatgagatctgacgccctcttctggtgtgtctgaagtcagctacagtgttcttatgtataataataaataaatctctttaaaaatgaaaaaaaaaatagaaagtacctaaggagctaaagggatctgcaaccctataggtggaacaacattatgaagtaaccagtaccctggagctcttgactgtagctgcatatgtagcagaagatggcctagttggccatcactggaaagagaggcccattggtattgcaaactttatatgccccagtacaggggaacgccagggccaagaagtgggagtgggtgggtaggggtgtaacggtagggtatgggggacttttgggatagcattggaaatgtaaatgaagaaaatacctaattaaaaaaaataactatgcgatgactcagcagctgagggcatgcactgctcttgcagagggtccaagtttgatattcctgtccccagcacccacaatcagtggctcactatcaacctcccctttactccacttccacgaggatctgatgcctctgttctccccaggcacctgcactcatgtgcatatatcttcaacacacatacattagaaataaaatcaaaatgttttctaaaatctaaatattcttattccactggcagatgtttcaaatcattagttcttttctcacctgcttccagagatcatgtgggagtgtggagatagttgctatggacagcaacagtgcataactttaccctttgcaaggatgtctctgcttcgatggttctgcttaatcattcagtgtaactgtaaggcaaataatatgaatgctgtcagtcttcctttagataaggaataaatgtatgcataaaatactcatatggcaagtcagacctggtatggtttttaatatgttcaagtctcattaaactctgtggataagttactgctattatgccctttgtaagtgagagctgcaacacagaaaagctattagtttgcctgagatcacccatctagtaagtggcagagctgagatttgagttcagcccatagcatctcaactcatgtgcccttgcctcaaaaaagatacagtgactaagagttgatacaactcaattcagttagcattctttagggtatgtctatgtgcctggcatgcaatgaatattgtacaaatactgcctagatctcattcatcattcacaagagcagcatgtaacacttccagctactccctgactaaagcaatgaggactccattgtaaagataccatgagaagagaaaatggaggatggattctttctcattatagctatgaccacatgttgtaacctttgttgttgatataactcagtacagctgactatctttgttataaagtatacaggcttatttggctcatgtttctggaagtctgacagcacagggtcgagtggccacatctgttaaaggttttacttatgaggcctctaaaaatcctaagacattctagggcatcctataatagggaaagcacacaaagttccacccctattgtatcctaaaacaagcccacactctcagtagcctattagtccattagtgttttagttcataagtagattaacacatttgtgagagcagaatactcattacacagtcacttcttgaacgctccacctgctctatttatttagcccacacaatgttgattaaatttcaatataagctttggtggggacattagctaacagcactctgtatcatgccagatgcttttaaatatatgatttcaatttaatcttcacaaaagtctcaaagagaaactggaggtccaaggagtaaagtaatttaccagttgatgagtcctggtctctctggtagaaagattgaatagcttcccattctactaagagcactgctctaaggtactttcaagttatagaaatgaaactcagatagcccaagcatcctggcagaaccacactgataacaagggactaaggcaagatttgaacacacatctttcatatacctctgtgagcaattgttggttctcctcagccctatagagcatcaggcttaggccactggttttctctcgtccctgtagcatgatacccaacacacacagcttacaggcaagaggttagccctggctcacagtttaaggcggtagttttcagtacagctgtaataacatgacactggggctctgaggctatggaaacatcaaacaactgcctgtcacatctgggtaaaatgagaaagcagagactggactctggctaggaccagacctatactataagccctgagctctgcccatgcagcccttcatctggagcaaggccccaacttcaagagattccacagccttccaataagtgctccaacatgtaagcctatgtgaggaggtttccattcaaaccattagaggcccacattggggaatgccctcagaaagaagcccatgtgtacagctcacccggtagggcccccagtggtagccagcacataaagcatgtgttgcctcccttttacaaggtgaagaggaaacagaatggtggtccaagtagctttagtgacacttatcatagcatctgaatagccttacatcctgagctctaattcaaccatctatgactccatgctaaaacatccaccttatatgatctcaatcagtgtctgctgtaactctttgcagtttctttactattctcaaatagccaacatgaaaagccaccctaacaggctgaatgtctgtttaaagtcaaagatttagcaagtaggggcaacaggagatctcaagccaagatgtgtgcgacttcacggtatgagctcttagcatagagtctctggttgctgacattgcatggttataagtggccagaacaggagctgacccacattctgtgaatccaaatggccattcattaattattgtctacac

SEQ ID NO: 508 - DNA, 1750 bp, Mus musculus
ctcagcttctcaaggccttttaagaaggccttgacctggtaagaacaactaaatatgttttctttctacagcctcctttaagagtgaatgtaaaagagtggttggctctatccccgcagcctggaattattagagactacagtctttgcttggaattgctgtgctatgtacattgctgttgcagagcacagagggagcgagcaccttctgtcctcgaggtgctctcagcgtggtagtagtgacagaccacagagtgtcccagtacggaaggaaaggctccagtaaagccagccagcccaattacacccatgtaccttgtggtccgtattatttcttggcttaaggaataaatgctgtggaggcagttggtgcattgggtgtcatggttacaaagtctttttatgtgctgatgtgtaagctgtgccattaaaaggagaggctggaagttgtttctgttcttacagttgaccccatttctcctttaacttctcttgctactacagctgtgcgtttggattgatgccattctgtccttctggtactttatttgattttcacagtagctccgtgataagtaatactgttttccttctttgtagatgaggaaggtattctatacaatcatagagtagtgtaaaacaagctgctagattgaagtaaccgcattcctttagatgccgttagggattctgatagcctaaggtgtttagcaggtgagccagaagagagagcacagcattcagaacttgctgacctctgagctcaggtgactggaagtgaaggagtaaaggagggcagaggggaggtaaggatggcaaggaagcaggcatccagggtagcctttcttgctgggtggttatacaaaggatggctggaggaggaactggccctggcctccctgagccctgctgagctctgagagcctgggatgcctagaagcacggcttgcgaagtctcagtcacactggactttgctcagtccagggaacctgcttgtctctgccaccttagtgctttgactggagtatttgtgccttccctgctcgtgtccttcatactcatgtcattgtcaaatgcaacctcctgttcagctgttgtcctagttagggttttatgtctatgaagagacaccatgatcacaattcttataaagggcagcatttaattgcggctagcttacagtttcagagattcagtccattatcatggcagaaagattggcagcatgtatgcaggcatggtactagaggagccaagagttctaccacgtgatccacaggcagcagaagggaactgtactgcaataaggctacgtttcctaatagtgggactccctatggccaaatattcaagcaatctatgggagccactcctgttcaaaccacctcagatgctttctcagtgatgctatataatttttggtggccttctcatagatctagactataagaacttggtttttaatggttcttcggattttaattctttttcctgaagccattattgacctgcatatctatagacaggacactttccctgttcagatatgaagagactaggctgagctggctaatattacattagccccaccccatcatgaatctatatatcatctggttttatagaactatcttacatatagaagtgtgacttagctgttagatagaagtggtgtgtctctgatttgtggatttcatttctatccctgtaactgtctgtatctgtggccttgggcaagttatttacagtc

SEQ ID NO: 509 - DNA, 1950 bp, Mus musculus
attttttgaggcagtgtctctcactgaacctggatcatggattggctagactggttgaccagcaagccccaaagattctcctgtttctaccttctagcaacaagctttcaggcacacctcactgtcattcatgctcagctttttacatgattcccgggatcatgattcccaggatctaaactctgtacctcatgtttgtggagcaagcactttacccactgaaccacctctccccaccccccaccctttctctgtgtgtgcatgcgtgtgtaaacacgcagagactggttctcttgaatgtcacctgagctctaaggaccaacccttatcatcaagcttggcagcaagttcccttgctcactgagacgtcttgatgaaacgactccccacctttttatggattcactggaacttgctatgagataagaccaggttgtttaccccctgcctctgtgctccaacagctgcgataagaggtgcacaccagggctggagagatggctcagtggttaagagcaccgactgctcttctgaaggccctgagttcaaatcccagcaaccacgtggtggctcacaaccatctgtaatgataactgaatctgttctggggtgtctgaagacagctacagtgtacttacatataataaataaataaaccttaaaaaaggaggttcacaccacattttgtatgattcttgtaaattttacacatgattgaaataatttaaaatagaatacaaaatgtatatacacaaagaagcctttatccatggtgaggactttggcgggcagtgagagatccaggcacttctcactggacgtcacaagggggcgctggagaaccggggaaggcgtctttgccgaaaactgagctgctttgctttacagcagacaagatggacaacagagaatcagagcggtcacaaccaggacatcagctctagaaaactctagaaaacatagtggtgtgggtacggagagcagacccagtgatgaagagcatttgctgttcttgcagaggacctgagtttgattcccatcacccacaattagccagctcactcttgcctgtaacatagctccaggggaatctatgccacacacatatcacgtgacacacacatattttaaagatacataattttaaaatttttattagatattttctttatttacatttcaaatactatcccgaaagctccctataccctcccccccaccctgccccacaacccacccactcccacttcttggccctggtgttcccctgtactggggcatataaagtttgcaagacttaggggcctctcttcccagctacatatgcagctggagacacgagctctgggagtactggttagtttatattgttgttccacctatagggttgcagaccccttcagctccttgggtactttctctagctcctccattgggggccctgtgttccatccaatagatgactgtgagcatccacttctgtatttgccaggcactggcatagcctcactaaagatacataatttttaaaggggtgtgtgtgtgtgtgtgtgtgtgtgtgtgtatgtgtgcgcacattgatcaggccaatgtcaccttcatcttgtttcctgttttgtttttaatttgataacatctttaagttgataccttaaagttggcagtgagatctcagatttacatagcgctttgcacctagtagtttttgcttgtttgtttgtatgtttgttaaaacaaacccagtttggtcaaatgtgaattcattttgcttttgtactgataagttaatatttatacagtttaaaaggcataaaaattgcttggcattattttgtttgagagcatggagccaggcgatggtgatagcggtgcacacttttaatcctagcatggattccagtacttgggaggcagaggcaagtggttctctgtgagttcgaaggttagcct

SEQ ID NO: 510 - DNA, 1600 bp, Mus musculus
tatgcattttatagctttctttgtgacagctatcactttgtagctgtatctgtgacctgccccttctaaggatgcaagctgtgtttggagctggcgctgcatctgttttgtctgcagctgcattttcagtggtgtgtagcttctgtcatctactacgcattcaaccaacaaaagaactcccaattcaatctcaggcctgaactcgatggacagatccatttggaagccacccagcagcctcaaaatgcaataggggtaaaagcgaactcttcaacttcaaaggggcctgcttcttaaggggaacaccccacatgtggcccactaagcccctccactctccatcccatccctctttaccatgacatctggtactcagtaaaagctgccacactgtttcgcagcactagattttgctacattaagtagatcgctgacttcaaagatctcaaaggaaatgacaacaaaaagatacaagatacaagaagacaaaaccaacaaaccaagccagagaaggaaaagtgtgaaaaccaccacagggaagggctgggagaggtcagaggatcacagcagaaaggatgtccccagaaagagctcaccaacgtttttggactatgacaatgattcaatgccaagtatttacacatcaagttattcattcaaaatcagtcttttcttgctgttgtgtgtgcctgctctatcagcagtgttccaccctgcttgactgaacaagctcacaaggaaccccagcctcaggagcaaaccaggagggggaggtggtgtcatatcttatcaggcctgagtagcccagagtaagagaggcaagtgctcagcactggaatccaagaagcttccagcagctatgatgtcagggtggacttgggaatggagcgttgagcaaggactgttagagaatagcaggtgtttggaagagaggactatgccaggcctctctcacagccctccactagatggtcaagcagtaccagtgtttctgcatgtgtggtaagtgcccaagtgtttgtacaacatgacagatgtccacaaatctcaacctttgggctaggaagcatttctagcttcaagggaaggggggtgggtgggtattaaaggttatcctgagtacaatcccagcattaccccagagctcccaagtttcccttcatcccttcctgggtttctctgtttctctaccctaagaaaaacagagagccaacaggcctaataatctggctgcaagagtttctgctaggtgaagtggggccaagaagttgcaaagagtgacaagaaaggcaattcaggcagggtcaaaaactgtaaagctgttttaaaatcaggatcttcagagctaaggttcagctgctcaataatacatttctaagaactgaggtatacagtacaaatctcacagggtaaaatcaaaattctataatcatttccaaaacaatttacaatctgacctcagccacctcaggttccgaacagcaagcctcttgggatgggatgggaacttcccgctccagcactttcccacctccttgactctgtttacagttcataaccagacaatgatatatttaacaacagcaaggtgttgggtgta

SEQ ID NO: 511 - DNA, 1950 bp, Mus musculus
cagttaagagtttgaatgtgggcttgactgattgtgaaatccataaggtcaaagaagtctccagtcggggttgtcattttctacaatcaagcaaagaatgggagcctgagaactctcccaattagagcttcggcatgtacagtgattctgaactcctttgcccatcagtgctgatctgtcttcatcagctcacacatggttcccagacatcggaactgactgacccaatgcctcctcccagcacttctctttgcctcgggtacagattctattctgtagagcgcttgaagtcttttctaattccacccctcatcatccttcgttatttcttcttgttgcttaagtcactgactgtagctccctctggagcggacatgccattgcagttcatccctattccggttaatattctgaagatgagttattcaaaatactttgaggaaatcactcagtataacaaaggaattacaagatatcttgaccatatattgtaactgacaatatattttataacatcaacctggcgaatgacccagtgaaaatctttgtcctaaaactgtgtgaaagaaattggaagggatcttctcgtcccaaatttatgcaaatcaagagatgtgataacaggctccaaaacaaacagtacccaaacaaacaaacaaacaaagaagactgcagacttcagataagaaaacaagtcagggttgagcttctagtcaaacaaatgaaagaatagaagaaggcttgacagatgggctagcttagctaaaatgaagtctgcctaaaacccaacagttcccatcttcctaccttcaagaactgcagtctttatccttcaaggtcacagagcacaaagctgtgcctgcctctgtcacctacctcccctcctctatgtgaattgactcatcttttattacatgttcaacacactgcccagccacaggctccagtatatcaaagacatgtttatcatcagagactcttacaactgccactggcaccaagaccctttcttagggaagggttggcttccctaagtgtacctctggtgcaggcagatgtatctccaagtgcacgtgatcctgcagtcaggaagcctattcagctaatttaatatctctgtgagcagatttattttgacagaatgccgccctctcccccacccacccagctttggttgcttgttgttctagcagggaagcttttgcctcctttgggatacagcttgggaaagggtaactaaccttgccttcctgttcgcgcagccagtccttcccatactctctgcgttgtgggaagtttgcctgggaagcccttaccctgctgctccccctgaagaagtttgaaatacactttacgatggtgagagtcaagggtatgggctttcacagtctttgccaagtgcagagttatctcttctttagtggtaccctagaaatgtagcacttaaaaatccccatttataattaaaactctgaaaatattttaggtaagagcaggtggctttttgtttggtgccatgcgtaatagcttctatggaaacctatttataagtgggccattgtttgacatattttatttcagtaggtttgttgtttgggaagttaccttttaaaatatgctttcataagcaaaagttttgtcttttggtactgttgtataatgttcagaataaagagaaaaatatcttctctgaagaaccttgagtgacttctcatgtcaaactatgccagcctatctattgttaaaggctaagggaatctggccatgtctccatccctgagcctattcgggctgtcacttgattcatttactagtctattagttactaaatatttatggggcacctattttgtgctagatttgagatgctgaggataacatggtgagaaagatggaaaaagtgccatggtctcctacatctataccctgatggaaataagtacaaagaga

SEQ ID NO: 512 - DNA, 2550 bp, Mus musculus
atggacaggcgtggtggtacacaccacctataaaagcaataaggaggtagaagttggagggtaagaagttcaggatcaggctggagagatggctcagcggttaagagcaccaactgctcttccagaggtcctgagttcaaatcccagcaaccacatggtggctcacaaccatctgtaacaggatctgatgccctcttctggtgtgtctgaagtcagtgacagtggactcatatgcattaaataagtaaatcaatctttaaataaaggaagttcaggggcgtcctcagccgtgcaataagttctgggccattctaggatacaggaaacattgtcaaagactaggggttgaagagatggctcagcagtcagagatttgctgcttttccagagggcccaggttcaatccccagcagccacaaaaggttcataacaacctgtaactccagttccaggagatctatctccctcttctgaattccatgggcatcaggcatgcacagcaatgcacagacatacactcaggcaaaacattcagaacataaattcaaacttttttttacagtttacggccagtgagatggcttagtacatagagtgcttgccaagcaggcttgataatctgaactaaatccccagaaccaacggtggcaggagagaatggactcccaaaagtgttcttctaaatgctgtatgtgcattgcagcatccatgtgcctgctcaagtgtgtgtgcgctccccccacctctgtctgtctgtctgtctgtctgctctctctctctctctctctctctctaagttcttttttgttgtcgtttgcttttttcagtctaatctgcaaggtagtgtgaccttgtaaagagaataggctctgggattacagaagcctgggttcaaatcctaactctgtctcatcaacttcacatggcaaacttataacaaaaacatcactgtgtgtcagtcattgctctgggatgatgctaactctgagtatatggtcagtggaggcggcagcagcagcagcaatacctgaggctttattcaaagggcaggctcctgaattaagccagtcactgcatgttctcgcttgtacatgggatgcagagaagcaaagagtaaggctggcgatggcagagatgaagcaggagatgttggtcagctgtgcagactttcacgtgagcatgtatcagagccccactgtacacaacatggggaccacagctaataataataacttcagaattctcaaagaacagagtgattattgctaccacattacataaggatatgtgggtgaggtgatgaatattaatgtttcaacagcttcacaatgtatgcatataccaaaatctcccatctgttccatcaatatataactattactttttcaaatgtatgattatgtttgtgtgtgtatgcacatgtgttggagtgggcacacccatgtatgtttgtgtctggaggccagaagaggacatcaagggtcctgctctaacattctctgcccccttcccttgagacagtgtctctccctagcctagaacttcttgtctgactaaggcagctggccagtgagctcccagatccatctgtctgccccctaacactgggattgcctgacatgggtggaactgcacaagaatcactcgtgccaagtgtcatttctctactcccatagttattacttttggttaaaagtaaaagctggagagatgccttagcactggctgctcttacaaaggacctgggttcaattctcagcaccgacatggtggctcacaaccatctgtaactccagttccaggggctctgactctcttttctgacctctgcagacagcaggaacacacacacatggtacacataaaataaaataaaataaatcttttttaaaaatcttagaaatacaggatagagatataattcagttttaacagtctttgtctaatatccacaaagccctgggttcaactcccagtgtggcataaacagaccagaagccagtctgggatcaagaccctatataaaatataatttcaaaatgtaggtctttcagcccaggagatctatgaataataacctctgggcagggtactttcaccctgttaaacagccccagaggttgaaggatgctattccaatcctagtacatcactcatatcgtctgacctcacgtccatctcttctgctctaccctcactcgcctctctgcacaacgtggataataagcccctctgactcaccatcgtgagggacagaaataggtgccatcaaatatggcagcttccctttctcagtttcttttcattcagttgaggtaattttaagatcacttcaacccaaacctgtctagcatgcaggtgtgcctgcttgccactaggtggcagaggttttccattcattttcccaaagcccacgtctaatgtggtagcagctcccaaatcctcagaggtgggtggtggccgaagcagtcagcagatgtgggactgctccgtccatctgtctctacagcctatgcagagtacctgcctaccatgtttagatggtcacag

SEQ ID NO: 513 - DNA, 2375 bp, Mus musculus
aacactaacacactggaaagcacatgcactcgtgaaacacacacacacaattataaaaacaggacccatgctgggtggaatgctaaccttggccagagccatgggccagtcccacagaagccagagagtaatctgtagaggaagtctgctgctttccactgaacaagccagactagacccctgaaggtgactccctcataggctgcttgctccttactatcttgttgctgtgaccaaaccgtgacacgaagcaccaacaccgtaaagaagggaagttttcttcagactcccagtttgaggactcagccctaggtgaggaaagtgtggccgtgagattgcctctagctgtgcagcaggggtgtgaggacactggtctcactgtatccaccacaaacggagagatcaatgcagggacttagttctctttctcctctctccttgtcagtcagcccaggagcccagccctgggatgatacaactcatattccaggaggattttctcttctcagattcacatctttggaaatcccctccctccatgcctggtgatgctcccatgattgtttcaaacacagtcacacttatgagggtgatgagcagtcatcgtggctactctctaagaggttccagtgagggaagcagactgtgaaggcaggacataccctgctcaacacggaaccatcaagggccataggaagatgctgtcacattcatgatcctcaaggcgctcttgctggagctcggttttcctccctgcccagcaattggtatcttgtttacattgatttcacagcacaggttaaaggaatgagctgtgaaagaagcgccatgacatagagtgagttagagtgagtgaaagtccaggtgttgaatctcaggaggaaaacagaaaaacccttttcttcttgcacaatgaacatgatccttattcccacttgaggcgccttcccagaggcctaaatatagcacccagaagtcgtgctttgtgttgggacttgcctactgaaatctccatacaaattagtgcagctcctgatctgctctcagtccctgtgcggagtcctgcagcacatttctcccacgtgacgaagaacgatgggcctttattagtagagcgaccctgggcaggagacgcctcctctctgctcttcatatacaggaaaactgaagagttcagaggctgtgaagatctcgtggcatagcataagtaaggtgactggtggctgtccagaaccataagcaacatctaatttccttctcttctggtggcacctccctcttccctctcagtgcacagaggctttcgttccctatcagcattgctcacaacagctaagagaggaaaaacagtcctcgcaagccatcaagagacacatggataaacagagtgtgatgtatccacacagcagaatattaattagccatataaagaaatgaaattctgacacatcctacaacgcatttgaagctcagaaacattctgctaagtaaaggcggccagacacaaaagagcagataagataggattgcattacagaggcacctcgaataagcaaattcagggacgggaaagagatcggaggtcacctggggctcagaatggggaatgactgctgagcggagaaagagtctgcttaggatgcttaaaacacagtgctgtgagggcagtggtcgtccgcgtgggtggacacacggaggtgcaactgtggtggatgctcagctgtgcttcataaacagaacagggaagatgctgatctctgagacctagaaccagagttcctggatttgaatccaaggtttgtgagctgtatgaccttaggatgctctagaccaatctcatctctagagggaggaggagactgagatttgcctcccgctccttaggtggtcctcagtaattagttgggattaacaaggctacaatcacctgttcttctatccacacatattcttcagacacaacttctcagtacccattctgttgacatcatggaccaaggaataatctactctccaggccattctatacgcaatgcttagatgtctctgggtacggttcacttgagttttcaatttggtgagatctatagtcacctaggagtaaggcctgtgggacattattttgatgaagttaattgagggggaagacttaccctgagggcagcactgttccctgggatgggattcggaattagataaaaaaaaaaaaaaaaaaaaaaaaaaaaaaaaaaaaaaaagagctgaacacaagaacacttcttgactgggtacaatgtggctgtttgcctcaagctccagactctgtgacttccgtgctgtgatgggctgtgacctggaactgtgagctaaaacaaggccctccttccttaagttgc

SEQ ID NO: 514 - DNA, 2800 bp, Mus musculus
atgcttcagataaagccactgcgccagcagtattttgaataactaacgactccataatgtagaagcttagaatacccagcatctgggctggagctggggctgcacagcacttatttcatgcttacgggtcttcagcctgtcatatctggcaaacagtttgctgcagatgtccacacttttggctcttacaatctcctgacccctcttccacgacgatctatggaactttcagggaggggtattatatagctgtcccattccgagctcagcacacgccagtctcttattccttgcacattgacaggttgtgagtctctgcattgattgccatctcttgcaaaggaagcttctctgatgaggttgagggctgcatgaatttatgggtagaagataagtagttagaaggtagtttgatactaaatctagtagaataatagtagcaggttctgccctagggcctgtgacataaccaaccagagattcttagctcagttgataggcatcagttgtatcttgtgaagcaggccttaaatctaatcagactgtggttggttgctctagcaacatctgttctacctatcattgtatcaactggctgtttctttccaggctggttcatataggatttgaacctctatgaggttactctggccatggtatttagcggtggggcctctcagaggtgatttggatcaaagccagtggaattctggtggctttgcaaggagagattgagactgtggaatacatgcatgcacacttcctgtcgttggccacaggctttcctgcagcattgaaggactctgttgtcaagtcagccatcccctaatgcagtcccttgaccaccgagcttccaggatcatgagccaaaagaaacttgttttctgtagaaatcatccagtccctggtattatgttattggcaacagaaaatggactgatactctatctaggccttatttagcatttaacaccctatttcgggttttattgcctctccgctgctattgagaaactgaaagtctacatgtctttccctaggaagcccagctgatggtccagggtactgcaagccacatgtcttcctaagggctaacgttctgcagacatcctccacctgcattgctgacaggtgcactctgccatccaggctgtgttcctgcacagtggacagggatggagtacctgcaaatatgcaggagaggatgtgggttggaattggatgcctggttcccagggctggcactgccgcttgtcctgtttcctcatctgtgaaatggagataataataactgccccagtttctcacatgtgaagacaaaacgagaaaaccatgctgcaaaataggaaacactattcaaatgcagacagttttagatcctttgattgctctctacattaataatagccccatagagttggtgagcctctgtagttcctttcagtttccagagtgcttctacttgcattatctcatttggtttgcaccatggtgctcagtgtttcaggggatcatggggattgaagaggccatagggcttgctcagggccatcctgtaagtaacagtgctgggagagcagccagctttcccagtcttgtttctctacttcatctaccagaatccattgcttcagcgcctctgtcaaaacctcaaggctcccttggtacagcatttgtggggtcaatgctgctggtagaggcacggtagacaaggtgtttgcaacctccttatgggaatgtgagcatagcgctactgaaagtaactccaaaccctctccatgattggaaaagcatctatgggctttgtggtccaagctcctgggtcacctgcaggttctgccccatttcatcctgccagtgtcttcttaggatgttaagaagatgatcatcatgtcagatgtccagtgaggattaactgacttctcaatgatggaaagactctcccagaatacagaactatctaattacttacagtggaaataaacttagaggtatttccagtccagtttgctcattctataggagtaaaacacagggttgcagagggatacaggtgtgttccctgttagtgaccgggtttcaggttattgttgatgcgagggttcattcttagctctgccacttactgtttgaggacccagtgacaggaggattaactgagataaatgtattttcagtattgaaagcttaccaggaaccatagctagaatgaagtctgagcttatccatgtgcttggttgtaaacagtttagttaactcatgttatcaggaaagatctttaagattatagcaggagcttctttctgggagctgagtcaaatgtggaagcaacagaaaaacagtagagtacacactcatgagcagacagctccagcagcatcgtgtcactgctcagggcctctgccagcagcttcttcaaagcacatcaggacatcctcaggagcaaatgtcttctaggtgcatctgttacccagaattcttttcagccaaacccacatttcaggaaggattggaaaggccaaggtcatctggttatgctctagttgcaagggatgctagaaaaactagttccgggcttctctattggaaaggagagacaattataatatgaagcattccagtacataagaagaatgtccagaataaaatggagacttcaaaatattcatcaaagtaccctatgtttcctttatgtttgtcccttttttatgtgtgcatagaatgccaagtcgctttcttatgtaacatgctccccaccaccacagccagcctccacgtggcccagttaattttatgtaat

SEQ ID NO: 515 - DNA, 2675 bp, Mus musculus
gaaaacattcagatctgcagaccggagtgaaagaggcaaggatggctcaaccagataggaacaggccagcgtgaccacagtgctggggtgccccaatggtccaggcccaaactcatgaccaccccaaggccaagagcaatgcttggcatagattaggcacaagttaatacctgtcaacaatctcagttcactgttaatacacagtgagtcactgaaaacacagtggcttaaagccaccgtcacttactttatctagctcatcatttcctaagttttctgggctggctcatggaggtgacaggctgcttccagggaacatcagccaggccagtcctactgtgctccactggcagtcctactgtgctccactggcagtcctactgtactccactggcaggctcaccatcccataggctagcccagccccttctcgtgaacctacaggccttaagagagggacagtcgttgggagcttttgggtacttttccaacctctggtgtcacatcggccccataacccaagctcatcatggaaccaagctgaaacttaaaatgtggagtaccaacaggcttttacttcctcccgggagagttacaccactgcaaagacagacaccctaaaagaaaaaggatttgtgactggaacctagagaccacccagatcttcagttctgtgagttaccaccttctatagtgattagggataaagtcagtgggtaggtgactgggcacaaaagggggagggagcagctgaaaggatgcatccacacggagcccctgaattccacctttcctcagagcctcttctattgttctgtcagtgatgaaggtcagaaagaagagtagagcaacaagggagtgtccgaccagaaaggagttgacagaagtcaggagttagccaggtctgtgtgtacacccttcccatacataaccttccccaaagcaggccattgtgggcagttgtcccctctgtcccagggtctataccctctgccccttgcccatgcagaccctgttcctggtccctctgagccgtgtgagcttcgagatgctgaggagtctaatcgctatggtgattactaacagccattacattaagttttaaaatgttcccttcaaattgaacaatgttttttcaaagtcaacagctggttcacagcttgaatgcaaccgttaggataaattaaataaaaagggtaataaaatcacagtctaaatttaatttctgaagagtgcacaggctcaaaaaaaaaaaacggcatttaaaaaaactgcctttaaaatacagcttgaaaagcagaagttaattcactcgctgattataccagctaatgcacacactggtgcaattaaccacataactgccctggtgtagaccaaacttcaggctcactcttgagcatctataatataaggttctgtaatataagcctcagggtcctcttgggtaggggttctgttcggggtcttgtgagttcagaaatctttgcgcctctattcccagcactgaagagacagaaggatttccaataggttaaatgcaaacctaggctgtgtggcaaaaccttgtctccaggtgggggggggggatatagagtgagttctcattccttaggaaaataacactagtggtagtgatggccagtaggacctcaatcccacagtaccgtcccttgtctgtggttatctgcaactttcctggcaggaggcagaatggcagggtcccctctgcatatgcgcctatgtacttgcaaattcatctacagaaccctgagacctaaggacaattcactgagtgacccacataaagagaccttagcccctcagccaggcaacctcaccctccacactttggagtcagcaggagctcgaatccctcatctgctggacaaatgattgggttggccagctgggcccagtgtcctctgtgaagagggaagtcggtctgaccttcccaacatgctgtgtgggcttacagagcctctgcttggaagacacccggagacatggaagggagcagtgagatgacaagtccctgtgacggggataaacaacgaacaaggtcagagagtaatatacaaagaataggaaaagacaactggtaattttaggaaagccaaggagggactggggtgggtggggagggagaaggctgtgattctaaatgaggtatccaggaggaagcacccgagaaaaggaacttggaacacagacctgaggagcagagggtcagctgtggagatgtctgaagtgatgctggcgaagggatcatgcaaaggtcctgaggcaggagtggtgctaaagagaccaagaaacaccaagggtaatcagaggaagtgggaatgatggcagagagcaagaggactagggtgagcgtccttctcctgatctctctccacggttttagttacctgtagtcagtgctcttaactgctgagcctccatctctccaggccccttagttgcctctagtcacctatgctctgaaaagattacaggagaagtcacacaaagagcacgtaagatttaaatcacacactaggggctggacagttggctccctggttaagagcacttactgctcttacataggacccgggttaggtttccagaccctgtggcagctcacaaccttctgtaactcctttcctggggaatctgttgccctccttaag

SEQ ID NO: 516 - DNA, 2675 bp, Mus musculus
gtatgtattattccacacaacatggtggattgttcagtccatatcatttatagacttaacctgaatcaatacgtgcaattttaatctgatggatacaatctccacaatctgtctttttctcttggatgaagcatgacattgtaagcttgatattttaaaaccccccaagagtacccttcaacttttcccagggcatcttttcctactggtcaaacacagtgggtgttggatttggcgagcctcctcccattcagacctttggtagtttctatgaggctggggtgctctgtgtgtgtgtgtgtgtgtgtgtgtgtgtgtgtgtgtgtgtgtgtgtcccattcagacacaggacaaaggactaaggtaggcagaccatcctcagcatctgtgggaagtagaggacaggaccctgctatggatcacaggaacatctctctacgaggaacaggtggcaaacaggccaccaagtctacctgaaaaaacaaaacagattccttaggaccttggccaatatggctcctctcattttgccgccattctagagtaaggatggagtgagaggctcctggtcatggcccatagggatgatcaattaccgggggatggaaacactgaacgcagcgtgtgatggatgtggacaggttcattcccatgggagcaagagagtattttcggtccagtgtccacagcccaggacagcatcccataaacagagacacatggacacacccagttcaacaacaaatgctgctggccagtggcaaacacaagcctgtccccatggagtgccaaaggaaagccacgctcctggcagcaccagcagatccaggggagctacagagacgaggtagcaatggcttcttccttccctctcagccatctaggtggacagtcctgggaggatggtctcggaaagccctgggaagctacagctgtaacagcagcctatggctgcctagaggagcctattagccaatgactgttagttatcaaactccacagtcagtgaaaaagacataacgtcaagccacagaattctatcaaagttttcctcttatttccttgctgactaggtctatcttcttgacaggcagtgggaggaaacaccgtatacaggacctctctattggctcagctgactgcttgccgtccagctgacctcagagcgcagtgttttaacatgcccagagctgtccttcagcaggcagtgcgagccatagaatcagtcacacaaatgacccaccacatacagaaaagccaccgatctgtcaccaggcctttaaaccaagtagcacttaaaataactactggctcagcagctgggaacacaagaggcagcccgacccagggcccagaggaggagaggctgggctctactggtgatttacacccaaacgtcattctctattcaaggtttgaaacattctgaacagcagatgctaagaaatgcgaaagattgccgttacaagctgagcggcagggcacaggctctccggaggatatttatgtcctgaaatatcattctcatggcaactcatccgtatgttttcagaggcatagaaggcaggggatagagagggaagtggctgctccactacctccacctcctatacacctgtgggagtttgtccttttttaatcagagggcttgttgtcatgagcctggcccctaccatagagggattctccatttgctgagacagagactgagctcaactgtaactcagtgcttagcctctagagaccttggttggagtcttagacatgtcttttaattgtgtgacattaagaaagccactggcctcctgggcctcagtttccacatctgtacagaggtgccaatgatcctcatcatctcatgatgacacaggggcccgctctgaaaactgaaggtgctaacgggaacaatgtgtcagcactgaataaacaagtcttcacacactctgacctttctaagaccctgctggatggagaggggagagtgacagagaccatggggcagcatcaaggatttctgaaccacagaggggagagctactctgctcacgtgcccaggacctatgagcagggctccggaacaaaatccatgtctgcagatgtaactaagttaagctaaagcttgaaatttctgggccgccaagaggagagagtaaacttttttttctcctagtaggtctgtctgtccagcattggacccttggggtacatattgctgaaaataaccatgattatggcttaacacaaagttgtaaacctacttaaacgtgatgcaattttttttaaaaagtaactccattgtgaactccgaagtatgaactttgtaggtgacagtgtcacagcaatgttaaaagattggaaccacttgtgaaccctgagaggaaacatagtcctggtgacaccttggctttaaaattctagcctcaggaaggaatttgctgccttttaaatccatccactctggttctggccagttgttatggcaacactgggatgtcagagtactagctgatctggaacaggaagttctgtgctttagggcttgacaacagatacggttcctagatgagcagagtctgaaaggggacaaggagccaccagagcttgggggacccagcaggcaggaggacgctgagttcacctctattagctgcaggcacacatgctatgattctatt

SEQ ID NO: 517 - DNA, 1900 bp, Mus musculus
ctgcagaacctgggcacctgaggagatgcggttcccacctcctcacagacacagcaaggaagagccatgcctggaggaaagcgttgagatggctgctgcagcaagctgagagctggacagggcaagtcacatggcttagccctaagcccacgattgagaacagtgtctgagaagacaaaggtgtgactccatgcaagtccttcttcagctctcaatgctacggggtagggatgtgggctggcctcagatggactcccttctgttgatcatagctaggaaactgtgttcgaggtcacctggcaggttgcctgaacgttcacattcctgtctggtagttgactggccaccaactggatgactaggatagctggccatgcatttcttacctcccagtagactggcttgagtccctttacatgtgggtggcttggttgcaggggcaacaagacaggcagttgccatgtgtaagtacttctcaagccctcacttgtgggtttgctaacatcccagtactcaaagggaggcccgaggtcagtctggcagggaactatcacagtgggtagatagagggggtcaaataaattatggttgttattgtaatctgccacaagcacctcgcccaaggcgcacaatcaatgcacagcagatcctctgtggtcctcggggctgacaggcctgtggcaaacactgccttacatgcccctaatgtgttccagacacaccgatcactccctgcatggccttggaaaccgcctggtcctcatcagacccccaagttcctctgatccctggagcctcctgtctcagcagctagatagaaataaatgtgcaaatgtatttgtacaacctttagggaaacaatgtaaatgtctcagaagcaaaattggctttcagggggaaaaaataatccatgcatgtacagttcctggatggtcctgtgccagcagtcctgtctggtgaagtcacagctggtagttccctggcctcctggcacagccaagcaacaatttgcagggtgttgcttgacgtgggttcccccaaaggatcgaggagccccttgggtactcagatctcagcaaatgagctttagtcatgtctacacagtcggatcagctcaccagtcttgcatcacatacctggaaaagggcaaaaatctattttccaaatcagagagggcggagaatggggaaaatgtgttctttgttattgcaattagtcacgctctggaatatcctggggaaagtctgctctccggttattattgacacagtgaagtggaggaggttacaaagaaacctgtgggctccgttaattaacctctctgttatttttatttctttatgcattttcctgacagaccgaagatcacaaagtcatgtcctgttagaactgtgggtgtccctacattgacggagcccaagcctcctgcttcccagacacaggagggtggtggacagtcaacctttgggaaagcaatgaaaatgtgaactacgcagagcagggggagggaggtttgtatgtctcaaagtccccttgcttcttaagatggtcattcctctctgctctactagcttcaaaagctgttcatatcctcctcccgaaagccttcctagatggatttctccctctgcagtaatgtgtaacctttcaagtacctttagtaaatctaaggtattctgtccagatctccactgtaagcattttctaattacatgtgtgtgtgtgtgtgtgtgtgtgtgtgtgtgtgtgtgtgtgtgtgtgtgtgttcttacactatgtgaaacctcaggttgtcaggcttagtggcaggtgcaattcccactaagccatctgcccatcaccccttcatcccctccttagaaccaaagcaatcatcatttatacagagccactcacagct

SEQ ID NO: 518 - DNA, 1950 bp, Mus musculus
cccacatggggcagcttacaactacctgtaactctagctcccagggatctgataacctcttctgacctccaaggacctacgcatggtatacatacatatactcaggcacatgtaacataaaactaaattatttctttaaaatccaataatcccttacaaacaggcccagagagccatctacctgattttgctagattccatcaagttgacaacatcaaatatcactataaattctggtggtgtgaatgacaaatgtctcctacagtctctggcatttggatgcttggtccccaggtggtgctgtttggggaggcttaggaggtgtgggcctgggtggaggaattatgtcactgctgacaggctttgagagtttatacactcacatcatgtcaagtccactctctcagcttcctgcttgcagatggtctgagccttcagcttcctgcttccggcttccggctctaaccattatgcctgcctcccattatgctatcctcaccattatgaccccagcctcctgggactgtaagcttcaaataaactttccgtacgttggattggtcatggtgttttatcacagcaatagaaaccctaactaagccccacatcaaacatttactggtaataagtcataatgaatttcattctaaaataatgctttagcatccatcactttccctgttttatagagatgaacgcggatttgcatgctaaggaggctgtgtgcttgtttgttttcacacggggaattcagtccccactgaatattcggttcagaagaggagcttctgcagtgttttatggagctgattgacgtttttatttcataattgctaatgctgagaatgtcactgttttagtcagtgttggtattgctaggatgaaacacagtgacaaagagcaactggagggggcagggttaacttctctcccagttccatatcacagttcatcatcaaagctctgcgagcaggatctcaaacaggacaggaacctggaggcaggagctgacgcagaagtcatggaggggtgccgggcttagtggcttgttcttggcttgctcagcttccctccctccctccctcccttccttccttcctccctccctcccttccttccttccttccttccttccttccttccttcctctctctctctctctctctctctctctctctctctctctctctctctcggatatttcctttatttacatttcaaatgttatcccctttaccagtctacccccccaatcccctatcccatcccctccccctgcttctatgaaggtgttcccccacccacctacacattcctgcctcccccaccctcaaatttccctacactggggcattgagccttcacaggaccaagggcctctcctcccattgatgcctgacaaggccatcctctgctacatatgcagctggagccaaggattcctctgtgtgtactccttggttggtggtttagtctctggcgagccagttttcttatagaaactaggaccaccagcccagggatggcaccacccacaatgggctggaccctccttcatcaatcactaattaagaaaagggtcagaggcttgcctgcagtctgatcctacggaggcattttcttaattgagatttctgcctctcaggtggctttaacttgtatagagttgacataaaacttggcagtacagccctttgcataagggtagaaatgtgtttagagtcattttggaggtattctcttctaatcaaaagttaaaaaagaaaatcatcgaacatttttttcaagtaaaacttctttcagtaatcctgaaagcaacgtttacattcaagcattctaacacaacacgatccaaagatattacatgttgagcagtgaccataggaaaatacttaacgtttttcttttctgtcattggaccattgtgttttcctaacggcagaaaattct

SEQ ID NO: 519 - DNA, 1825 bp, Mus musculus
agcacctagaagccctttctgtgctatcacaggatccccgctttccctctgctacctaactaggaaccgtactccagggcagcccatagggagatgaattttccccaacaggacaccagcaacatggtacaggccgaaggagaacaggaaaaaaaaagagtattgatgatattttgtgttacaaatatgtaaaaataaaatgaagatgttctagattctgggcatgcgctgctatttggtttttggcgccccttgactgaatttttgttttgtttttgtgaaaataattttaatgttatgatcatggttttctttgtcagtttgtaagtgaaattggtttctatgaggtaggaggaaggtgatttcaagtccagaacccaggattctcttgagtgtaggcaggattaatacagcactggatgctgccattgacaaagtcttttctttgagtcttaaaatatctgctttgtaaaactgggttaagttattttagaactataaatggttgcttggtaattaggtgtttggttttatttgttaaatagagtgcttattaaagttcagtgcttcccccccaccccttttcccatggagctgaagcttttactggctgagtggtaagagacagcctgcgtgtttcatctaccggctttgacatgtgtggttgatagatgcgctcctgaacttttacatttgtgcctgctgtagagaaacagagctctcatctctcttgataggccccactccaaaattctgctcccacttatataatcaggcttcctccgtgtcacacaggcactcagaggaacaacgatgcgggcacgctctccctgtcagacgcatatggaatttggcccgtggtgggcttatctcttcccaccagcttctttctttacacatctaaaatgacaccggcatgtaagttcctgcagaaatagccctgcgttgggtcagcagcagaagatgccaggccattcccagagcaccccgaggccagagctctgtgtcctcgacagtgtccagtgggctgaggatgatggctctcggctgagaagattgatgtggccatgggctctcgtgccctcccctgtgggctgggagtgagcactgcagccctccccgtgtgtagttgtcttcagaggagcacagcagtgagtaacttcgcatatttgctgtttcggatctgctttttaatttgccctcaatctttttaaaaattaattaattatttttttatgtattcactttacatcctgctactgcccccctcctgctcaccccctcctgcaatccttcccccatcccccttctccttctcctctgagccaggggtggggggggggcgtccccctgggtatcccctcatcctggcacatcaagtctctgctggtctaggctcatcctctcccactgagaccaaacaaggcaacccagctagaagaacatatctcacgttgccctcattctaaaaattaaacagaatagagtctgagaccaagcaccactacaccctgaaagctacttcaggagcatttaaggaagtcccaacactaggaatgtttttgttataagcccatgtccttgcggtctgcctctccaaagctgattggcctcctgcctccatgccctgcactctctgtttgccttttccataggatccaataaaaataagtacattttaaaatttatgaaagtttaatgaatggccagcaagaggaggactactttcataacaagattaatacctagactccagggacataacattttagtaaaatcagaatttgtgtagctatcctcgcagagcttgcaacctctggcttcc

SEQ ID NO: 520 - DNA, 2500 bp, Mus musculus
cagtagccaatgaatcaggacacacagagaacagagtactgcatctgtgtgccattttgcatcctcaccctggtcataggtgctccctgttagaagtagccatgtgtaaacagctgagccaacaaattttattccagccaccataaaacagtgctgggggccaaaacactgtcagcactttgggaatgtaaggtcagctaacaaggacagtttgaatgttctgatggctcaccataagtcgggaacctcgcagagcatagggacgccatacttagggggccatgccatcgtgtctccactttataagacagagtcagacctcacgatctcagccatgtgccacccggtgaagtttctgaaataaacttgctctactctttgaaatgaaagtgaccttgactaatggaagagaaagttaccattataaaagaaacagatgttagcgcaggtgaaagcattttgcagctagaaatatgaaaacgtttttaatcaccacgtgatttctgttgccaaaaatcatctgtcaacttaaaagcaaaataactatgactcattaatcttccctttaaaaactgtaaagacttaaaaaaaaaccaaaaaacaaaaagcaaaacgcatgttgaattcatttcgcttcttacaaaattgcacctcctgccaatgtgttcatgatatctgtcaagttccagtggtaacagaaagttaacaaacagcatggacagctcctggcataacaccataatggagggcaatatcttttgcccacagccccagagggtttggtccattcacatcagggagggcgtggtaaagtagtttgcatcagcactgacaggaggcagaaggaagactgtacagaactaggccatgccaggcatgggcccctagctcctccaagtagactctgccttccccattcactacttaccagtaatgtggtcccacggtgagcccatccagaaattcatctatgcatctatctgagcttttacgacctaatcacctgtagaaggcctctcagacattccccctccccgcaacaggagatcctttattaccacccacaatagttttcaatctaagcaagttcacaatcagactccacacacacatactggtgctctgtgacagggagatccacagtttacaatgcgtgggagaaaggatgaagctgctgttggcttctcctcctatctcatctcccagccctggatcacagcagagcatctctgtgccaagctgcacacagctatgggactgaaagacggtatgatggatgcaaggcatgaggcatcactggatacaaatagataaatgctgctgggtgcctgctgcttgagaacaccagccaggaaatgtgtggagccgagagaacccggacgccaaccgcacccccatgagatctgcctctcggctgagtttggagtataagcaagcaagggctcaattacctgtgtcaactgataaataatgacaggaacttcctttccccaaaggactttagaaaatcccttagtggagtaaataaatagtaagataagataggtgcagccagaaaaacctgctaagccagcgaagagataagccagcaaagccatcccataaggattacttataaaagtcaatgttttaagcaaaccagtaattaactaggtgcttccttgaaagcaagagcctcatctgtataggctcaacttcagctgctgccacccttgttcttgtgaggcattcgagcataggagacagtttgcatcctgggactcccccccacttggacagctgcactctttttaacaatgcccttagtagcctccttccttcaactgtatgttctgtacatacaacccctctccaaacacagcacctagaaacctcagaacccctccatccctcactcgcaacaggatacatgtgttctcatctttgaacaaaggtgtaagtttccccactcctggtaacagtcaaatttagacagtttctattcaagtgcattcccgatgtatccaggtataaagaagggctaatctggcctgaactggttttgagtgcatatgtagtaaggtgagactttgtcctttagtaaccttgaagagaggcccatttctaccatcttatgcatatgcataattggtatggctatgattattagccatcggctgcattatggaatggggcatgggtagtacatacatgattaaataactcaatccataaatcaaagtagataattccgcttagaaaccagcccatccttccccttagaccaataacacggaccctagactcaagacccagacctcttgagtattctttctcatgtgatccactgccaatcttaacagtgcatctttctatattttaactatcctttttctccacataaattcatcttgctacttttgcaaagctgtgtgagcattattttcagttatttggcaaagaagccaaaacatctggcccagaccctgaccactggtaacactctctgttgctggagttt

SEQ ID NO: 521 - DNA, 2875 bp, Mus musculus
ggtaagttactcaagctccagcacatagctctacactcatgaccatgtaagtggccctggttacgcccagtgggtcataaatgaaacagaagagtagcaagatagtgggggagggggagataaaagatggtggagggctaagtatgaccagaatatattatacaaatatatgaaattgttgaagaataaattaatgttttaaatgtagtactggagacaggaaagagttcagaaagtagaatgcctaccatacaaacgtgaagagctgagttgaatccccatcatccatgtgaaaaagcaggtgtgctggaaaggtagacataagtacatccctgaggttcactgcccagccagcctgacctagtcagaaagcccaggtcccagtgagaaagcctgtctcaggcaaaaagatggacagctcttgggaagcaacacccaaggatgggcttcagcctacacacatatgttgacacacatgcacatgagcttgcagaaatacacatagatacacacacacacgcatgcatgcatgcacacatacacacacatgtgcacaaacacacttgtgaacaataacaaaaaaaaatgtggtactgaatttcccacataccattgttaaattatctatttcatatttccagtgtaaattcaaaatgatctcaagatctttaaatcaatcacatatgcaaacaagacagtggacataggcaccaggcagacaaaactctggggtaggcatatgagctaagtgctcaaaaactagcaatgcaccagccccagaacatgggtaccattgagaagctagctcctggacttattgctgtttctcttggctccacccagcagggcttggaaagacctcagcaagcccaggaggaatccttgctctttgttcttagccagacctctcatctgcaactcggctggggggttgaacacactttagaatgaagtttctttaagaatttttttcttccctttccagctctattgaacctggtataatccatccgagcaaaggacagaatcatcgccaaaggttcaggacgaactcagagccctcaacgtgggaaaagctgcccctactcagagttcagggctcctacctgggggttgatactaggctctctacccattgcccccattttgggctcttcctttctgttcttccatgatcagatgatcatgaaaaatggccagaatttgcctctttttttattctggctgtttccatcctagtttccatagaaaccaccatgtgaatgtggacaaggaagaaagtaaagatcctttaaaataatgatggttggaaaactctaacacgcctattcttccagctacctggtagtttccatggaaattcaagacaacaacagagccaaatagacccaatgctggatttctcaatagccagtattggatggaatggattccccaaatctgttgtttttgtgtggctggctggattgctctgcctcctcctcaacaaagcatatccccaaatttcagagagaagacataagaagaggaaccccaggagacagggaagatgggggcaggcccacagctaattcctgctgatgaagtcagacctcaggcagtctcttctacccagaactcacagtgctggggggacctcagcactgtgtgcttgcaggggtagctccctggtgggctatggggtgcatcctaccatcttccatccttcttttctagacactgccactggtgagcctagtctaggggccaggaacaccaagctggccttgcctaagcagcagcttcagcagaagctgaagcaggaccataagcgacagactcagtgctgctcagaatgggattcaaaagcgcattcactgaggagccatccagcacgtatctgctcaactaggcgtatgcctggggaagagcatcagacagagcactgctctgcagttgcaccacccagggatccctgggactttggagttctgctttctagtcaggattcgagagcttggagggagtccctcagtatccattagaaagaccacgtgttatccagccacagaatgttgacttagcagcctgagcccagcctagtcccaaaggccctgccttggtttgaaaaaacaagcactgggattcagttcctgatgcttgtgttggcaatatatattaaccatattttaagagtatcattctggctttttatgggaaagataaaaatcaaacagtatattccttttgaggttttttttaatacataaatatatataatataatatatgatggattttttctaattttttatattcccttacaatttggtagctattactctaactttagactctggcatatactaagtagctagtctgggctttaagaatatgcatggacatttcagtttgttttagctgaatgaggacactttgaattctcttaaaagtcacctgattattaaataacaatgtttatttttaaaactaacaatttgttgtatcttattacacattacacattcctaaaggtgtggctctgatatctgtgagctgtgggccaagtattctgttttcagttctatagcacaaaacactgattagaaatgtaaagagatacccacatcgacgttctggttttgtttttccaactgattcaagtgttcattgagtgacgtatctcttaaatgttgggggagtggagtgtcagaaccaattacctggcttctgttttgtccgtaacttagatttgttctgttgtcaaaactgccccccccaaaatggtatgacacatactcatgcataaactgctaaaatgagcatctttgtatttgtattgttttcaacattgccaaggtgctatgggaaattaaaattacaaaattagaaaaaaa

SEQ ID NO: 522 - DNA, 1975 bp, Mus musculus
tcctcagtcccttagacagatgatgtgtgacctgcaacaattcaccgagagcctgtcctagatgctggtctgagccgagtaaaatggagctgatgagaggtctccagagctgaacgctggaagatgcataggccctggccgggaagaggaacagcttgtcaagccctgtgtggaataggagtggtgggatgaggactgtgtcaaccctactctgatgtatgaaatgagacaacagacctatgtaggaaagtggcaggatttgtggtgatagacagggactttgctgttcagtatccactgttagaaggcagccacactttcgagagaatctgaattcagcagactgttcagagagtaaagtcattccttcagacatgcacagctctatgtcaccacactgtaattcgggacagtatgaagtccttggaggttaatgggcacagtgcccgttgtgtagatgtaccacattttctttatccactcttcagttgagagatgtcaagtcgtttccaggagatgcccttaggtgaaaggggtgacactggagactgtgatcaacaggcggaggctgagcaaatatcttcaaatggatggcatgtttggagaactctgctttattgccagtgctagccctacttgaatcggattcagcaggaccagctgcagaagctgggtaggagctacagaagcaggtatcaggtaaatacagattggggactgcagtcaacaccactgcacgtgggtggaagtctctatgaaaacttcccctgagattgagacaaagctcagcttagcagtccaggacagacaaacagctgctaaagttcaacgaggaaatctcccaagtcatttgctaggtcgggatgtgataacacgtactcccagggtaccgtccccacagcgtccccatcctgggtgttccatttagctgtgctgaatctgtaactcctattcaggagatcatagagtgcccaggccaatatttctcatttgtgtacctattgaacttacccctccctgaaagaaaaccctaaatttacctcttattttaagcagctttcatcgtcgcgctaggcaacctagaaggtcccaagcccacgggacctggattgcgagtgctctacatcatggagaccgcacataaacatcgccgagttaaaacgcaatgtatcacatggaacttggaaagctaccttgtctttttttatatattgtgtgtgctaactcattcagtctataaagatgaaatctaaaaacccaaagaaacaagcatctctgagcatataagactcattttacatgtaattagagctaacaatttctttcatttataaaacatactctgatgacctttgaggttggtggcgggataggacattagcttataattacggtttgatttgcaaggaaatgttgaaataacttcctgtggaactcaagagcagatttgaagcggtgaagcaccactgccccctgctgttgcacattgtcataatcgtcaagagatttaagagaaaatcactttgcaagctagaagtgaacactttccgttcaggattgtgaaaatctaattttttaaaatctcttcacatacttaaaatttttaattatgttttaatagtttaaaatgcagatataaatcgccaattcagaaactcttgagacagtcgtgatggctgctaacatcttgcactcacagaacattttaaaagaacaattagtgtgacctgtcattcactcaaattatccccaggaagaggggagtcatcacccttcatctgctcagcttcttaggtctgctgctgtcacccctaaatgctttctcagtacaagacatagacatttaatttgcatgcttttacaggccagtgggtgtttctttattccacagcaccagcaagacagttcctaaattgcacaaacaaacgatgggccgttttggagtgaaactggtctccatacagacagagcaaaa

SEQ ID NO: 523 - DNA, 2325 bp, Mus musculus
aaggcttaactcataggaactacatgagaaatgcttattgtatttaatacttcaaatgtgttctttcaaccctgtaaatttctgcactctgttgaagtattttcataaaaaatggagtcaagtggtattttgctctactgagcacatattttgactggtattagtgtttgagaagccactcaacttgatgcttttggtgcacagagtacagatgagaaattttgaccttgctaactttttgctatataatatatattggaaggagtttcatgcaagaactacactgaactctcaagttgtgtttctgaatgggacaacaatgcagattgttgtacaatctggtaaaggtctttatgaaatgtggacaaataaccacattttgggaatttgacttaagtcaaacatcctaattgttaccttaatatgttttggttcttatcaaaatatacatatttatgtgtttaataattatttgtgtccttagaggaatgtatttattctcagatatggctttttctcaaggttattcaatggcctgatggagattttattggcaagcttcttcacccagggcaggtgaacatagaaacagagctctcagacatgggaattattataactcatatctccagtctctgcctctggctcctattcaaacaggtatccgaggccttgagagctgagggagagtgagagacttctgtcattagaatcacagtgccagagtacacgtgcatatgcgcacgcgcgcgcacacacacacacacacacacacacacacacacacacacagagagagagagagagagagagagagagagagagagagagagagagagaaagacaggaagatggacacacagagagggacaaatagacatacacgtgtacatacagagggagagagagacagagagacagagagacagagagacagagagacagagagacagagagacagagagacagagagacagagagacagagacagagacagagatagaaagacacacagtgagagaaacagacagacgcatagagacagaaatacaaacatagagatagaaagacacacacacacacacacacacacacacacacacacacacacgagtacaaaagaactaatttactatggagatacttaaatcattcacagacttcagcccacgttctactgagctgcccatcctccagggtatgggtgcgcaagtcattctgcttcccaaccactcaggacgtacctaccagcttattccttcccgctttgacacgcttctgctctttagctttctgtgatggtgccgggaatgctgatggtctcaagcgctagttctacctctgacctcctatcattcaggttctgtgtgttctatactggtgcttccatttatttattaatttatttattttcaagaaaatccactatcaaccttggtattaaatccccatccggaccttagtgaattcataaccacatgtataggagaggaaacagaaagccatcatgttcatggtccagcccgagtgtctcctgggaggccctggacatagagaatacaaggaccagactgctcagcacagcgctccattctcagtaaccaaccccatcaactttctctacctacaatttgaagcaaataaattatcctctgactaggatcatagttaaacgttcaattgaggccataatttaaaactcgatttataaatttgaaagtgtgtctggcaatttatttgtcatggttttggtctgtttgttgttttacagccagtcccactctttattacaggcaggcctcttaattgagcctctacattgccaaacttgtgacatcttacatgtactccctatcacacgtagatccttttaatttttctaatttttaaaaacaaacaatcatagagctagaaattcataaatgaaatattgtagaagacttatgagttttgatgaacttttatgcacttttaatagacattgttttaaactatgggttttttttagagttaccttttttgttgttgaaaaattaaaattgaaatctgtgtgctgtgtttgagatgacacagtctcaggattttatccatctggtaatataatgctctataaatatttctacagaggaaagtgagaacgttgactataaatacagccaagatgagaaaatttattgagtattttcagttttgcacactgcagttgcaatgcagtctactttagctacacaatacaattttattgttggaagagaggagaaaaataacctattttttcctgaagaaaaggacagaagaaatcacataacaggaaatttcccctta

SEQ ID NO: 524 - DNA, 4775 bp, Mus musculus
gatctaatttatatatttacatgcccatcacaagcatgaatggtgttattcctgctgaatcaccatttggagaatgatgctaagtttcaacaactgctctgtgctttttgatcctcagccagctttgtcttctagcagcttcagtaagctactagtcaacctagtcctctttcagcaaattgagactggtgaatgcagactttcagttgttagctagtataaaccttgagatggttagatttcactttggctgaagtttaaatgtttatgcctgtgccataaacatacacagtaggcaagtggcctgcgtctggaagactgaattagagaccacaagaacttaacttcagtatagcacaaatttagtcatgggacacagtcacttaaaaaataacatattctggttggaaagaatgctctctggataaagtgcttactacacaagcatgagcacctatgtttgcacccacagaagccacctaaggttaagtgcagtagtaatactgtttgaaataacagttatcctatgatgagatggacagagaggacaggagactttctggaagtatatgagacagtgagtctggccagagcagccatcagcacagaatcccatctcaaactagttggaagccaagaaccaatttatagtattacttgctggtttctatacatcagtataacatggtaatccttcacacatacacaatacatgttctctcaccctctctctctctctgtcatacacacagacagacagacacacacacacacacacacacacacacacagagagagagagagagagagagagagagagagagagagactcatctggttataaaatgcttgatcaaatttgacattaaaaactgaaaaggctctaataaaacgtatgtcttactttataaataactgtgtctccaatgcccttaattctttttctttaatgttgacaagtatttgaattgaatgtctttatgcaggatcaagtcatttcatgaacgctatcagttgaaggcatgtttgctaagcacactttcatcactgtgcccagtgtgagtaagacattgttctcttatttgtgtgggctgtctctgaagagacttggtactccaagttttttcacatttaacctgcttgtcttaggttgccaaactcagctcccaaactctcaaattgagatctcttcttcttttattcttttgtgttttaaaaataattctgtcagctgatatgtactccaggccttatctttgcagaagatgttggaacaaaagcacagggaataattttccctgttttcttttctttttcttttttttttctttctgaacgtgtgaaaaaaaaacttgtctttatgaagtagttatttaaaaagaagaaaaaagtatagcagttggcaggaaacatgtcaacaattttttcttgaaaacatttcggggtaaaaataaaaatacaagttctttctaattttcagaaagcaatgcactctgagaggtagacaccttgggttttcagtaaaaattcccctggaggcacaggaggcaatttcaattccctcttcttcattatatcatctgagcttgcctccaagtattaaaattgtaatcatgatcttcacaaagaatgtcagttgtggggcgtccgaggaaaaggaaggtgagtcctggagtttgtcttggagtggtctactacttaccttacgagagtgagaatagcaaccaccctggggagagatcctattgtggtgcaggagaactaattaggcaagtataatttctcaagtcttgtattgggaaagaacagagcactgacagtcaggagacagaagatagggaagcaagaagagagcgaaggtttggagggcacaaggtcaggttggagcagcctgagagctgtgtctgtcagtgaaagggacagacatgtcaaagctataagcagcaatcttcatggaggaaggctgagagaggtgtacatctgataagcacaatttatatcacaccgaacataagagagaacaaagactagggacacaggggaggagaagaggagaggaaaactcaggccagacggacaagacaggagaacagacataaaaaacaaacaaacaaacaaaaaaacaagattaaacacgtctctgaaaacaaaagagatttatgcatcatatcgagaaagtggacatttggggaatttaaccagttaactatctacaaaatcatgagatgtgttttgtaaaaaatatttgtgacctgtccctactatatctcatacattgatcctttgtactacagtgagtaatacaaatccctttgtcttaacagcaaataaccatggatgaagaatttgaggatgcaatgcctgtgagataattacagcttgaaacctagggtgagggtctttattttactctttttatcgttttattttttgacattttcctatatgcataaaataaattacgatattttgtctctcatctatataaacccctctctcctcctgaaaagtccaatttcatattcatagctgtctgacttggaagacaggaagtgtgaggtgtgcatatcctttaactaatgaatggaaaataggaacatagaacaaatatgcacaataaaattttattctaagttttaatgaaacaggacttggcttgggctgtagtgttgagaaatcaaagtgaccgtttcagttgctcatgctttatcattttgtgtttgggtgttattttatttttgaaaagtaaattgaggcatatttagatgtaagtacttggaatggaaaaaacaaataaaagtcaatgatttaaaaaaaacagttctcaataatgtttcagcagcataagcaaaatcagatctattggaaagaggactttctaatattagggataggtaatactcatgactcatgactataaaagttgtaaaatattctttcacgaagcttttgtttatgtttttccttttttttctctctcttgaaattgttctatcacaattcactggggcatgggactttgatatcttttgcaattctttttttttccaattatttcagtgagctcattgttccaggacaggaagatagaatctacggaggtgtctgtgtgggagggtgagcacatctgagaatatatttccacattattgtgagaaacagaacctactttcaagttaaacattgatgtgaaacttattgaattgtatttgcaatttaaaataagttgacattagataactccagtatactccataagaaataaaaagcatcccggttataaatcacgataactttatagcaatccctgttcatctcatctgcctgcacaaagctttataagaacttttctgagaaccttgctgtttttgtccttgagatgaggaagcttagctattctactttttaaatatcattctatttttccccatggtagaggtcagtccttttgccttgcacatgctaggcaaagactctccaatttatccatgtccccagctgtaacttcctatttttattgatgttacgattgtggatgaaaaggatttgcaaaggaataatcgcttttttctcctctgtaaaactggagtgtttcatggaatgttttccatctcagtgacttctttagaaaaataaattactctatgtcatacagatatcttaaaggtcagctttctctttgtctgtcagaatagcatttggggttcagccacatatgagctgtagatccaaaggaaagggaaggcacccattaagagactctgtcccaagggaggtaaggggagaagagaagaaaaatcaatcagtataatgtaaaagtgtgtgcacctgcttgcaggagataagcatggccttatgtgattaacaaaaaggataaattgacacttgggaggtcataaaattgtgcacgctgtgagtttaaggccagcttagctatattagtaaaatatagggcactctggactaccctgtgaaactaactgccaccacacccatgcatgtgtctgtgtgtgtgtgtgtgtgtgtgtgtgtgtgtgtgtgtgtgtgtaagagagagagagagagagagagagagagagagagagatacacactgataaatggctattactttaaaatatttgttgtgtataaaagaatcataaatacacctccaattgtttcttacacttttggatttgaaatgaatgtaaatcaaaccaaccattaaccccaattcctagacaatctctattctatagtttccaaagcatatgaatccttggggatttatagaaactgggtaacatcaggttttaagtcccttgcctgctctaatcatctcttgtacttcttctagttcagaattggaagcttgactgcttttcaacattgctaagcaacagaataaaagagaaaaatccttataatttaatttgaagctcaatactctcttcattataaacttttctacatgcaacatctgtatggatcatggctagatgtattagaattagctgccattaaatgctcattgcactgggtaggcctccttgggtattttcagttttacagagtgggttacagtcttttaccatagtccttatccatgttcctaattctctgcttgacaatagtttgtttaaaatggctattttatgtagtcatccttaagtttttaatttcgtagtcatacttttcaaattctaagtggtaggcaattcctttccctaagcaaagaaagccctttcccagaaaccactagagtacagaatacgaatatacaggtctgaggag

SEQ ID NO: 525 - DNA, 3125 bp, Mus musculus
ccattctcctgccttcttttcctgggtgctaggattttaggtatgtaccattgcacttgaatatgactttaaaatctataattgcccttcttagtgggaatagacagtggtctaattgtatcattaattttccactttctaatttgttgtactaaatcacattttcttagtgactggatgtctgaaatgagctgctgctttagcttgcactggtatcacatgtatttgtgtaccttctcagtagaagaagagatcatagataaaatgtaaatggccaagaggctgagtttcacatatttcaaaatgccagaggaagattggctagctggtggtcatttttttgtaacttgagaaaagttggagttatgaaaactgacatgcattagggccatgaggaaatcacagctgcataagcattggccccactttaacaaggtcattttacagatgcctacgctttctgtccagatagagctgcctactccgtggctcgttggggtgctcactcacatttctggtttcatatattcacatataaacacggtcgaatgttgggcatgaaaattacaaaatgacatagcttttattgatgcagctaggatgaattctaacccactaagtgatgggaatttcccctttgtccatctgcacatcccctcccccccccagtcatacagctttctggttcacaggagccctgaaggcaggagtctgctaggggatgcggtgacccacatttctgcctccatcagtactcaggtgctgttttctgtctgagtctttttacctagaggtggcagagaaggagaaggagcctcagccagcagatcctgcctccaggacacaggcctcactcccctgccaggtatccccttgtgttctcatgctttgggaaacacaaggcaaacccatcaatgtgtttagtcttccccagtagctggagaggctgggcactgatacccccccccccccccaaagcctggagaggggctgaagagctcagttcctaagagaattacaaatccagatacttgctgggaacaacaagagaaagagccaattggaaaaaccacacttaactatttaaatcctgtgtcttggccccgatggaaaaatatttaagcctgtgaaacttaaatccggtaaaaatgctcaaggcaagaatgagtcagggacttgtctagtttaaaagtacattttaagtgatgcagggcacccatgtcaagaacaagcctgtgtttggaagccaagaaggccaacgagcagagatgcagccagcctaagctaaacagtgtccttcatcagcgtttcttctgggaaagaaggtgctgactgccaagtcctattcaagagtctatagtaggttacggaagactctgcactcaagaaaggaggctgcaggtaacaggtgactgtgttcacacagtccctgtgaatttgtttctctgaaaacacagcattgatgcgggaatggctcaaattcatcaagcaatgcttaaaatattcccagttcccttcagaatttgggtacctagaaagcaggtgcagccgctatcatcttctaaatcaaggtaattttcaaaaagagcactagtgtttatccttgtgttgtccccacggtgtctcctatcacctgtggtctgtaagcacatttttttttttaatgtttaaaatacgtggaaggagcaagcagagtttacacaaatattattctgaagatagttaccaagactgtctggggaagctttacactggggagaaggaaaagtggaacattggctgagactgtaggaagggtttgctcttttagttctgagggatttttcttcagttattttgtctcttgcactctcaatcaggaacattacaaacaggtatatggtatgatttgaaaagaggaagatggggaagaagaaggaggaggaggatggggaggaggcagggggaggaggaggacagggaggaggagtagggaggggaagaggaggagggagaaggaaggggaggagaggggaggggaaagaaggaagactaagaggaggaggggaagggggagggggaggaagaagtaggaactgcaggcagtttgggcacttgaacagggacctgggcaggaaacctcacaggcaagagggctggaggcaggtcagggaaggctagctgctcctctttcacatcaggggtaagcaagtgtgagcagaagggaggcagggatggaaggagggagggagagaggacagagagagctcccagtaggtcccctgtggatccttcactctctacctgcttcttctcctctttatcttctgcctccccgtcatggtctcctccactttcccataatgcccgctgtgtgacattttctgaatagagtccattccctgcagctagggcaacaatggcatatcaaagaaacacctatggttgggattaatcaacaagattattgaggctacttgcaggggtaattcaatcatcacaagagggtacacattggcatgcaaccacacagcaatgacctcatttttgtttatctcacctaaacaaaaacaacaagatctgttctgattttctccaatttagctcatgttatcccacagagtctcacttaagacctgtgctgaccttaagaacaaagaccacagggtctctaccttaccctcacggtctggtgactactttccctataccctccattgctaagcatctgggagtcctgtagttttctatcttcagttcctcattcctcatctgtctttagctcactgcattttgtttcctgccctcactccatcactgaggccaatgatctcttgacagacataccaatccttggagaccttgtcagctcatactgagcgctgtgttcaggctgagccacctctggatcttcacacctctctgccagactactgtgtgacattatgacttgctacttggttcttcccatgataacacagcaaagggggtggggtgcccatgcaatgaatgtgtgtcatcatgcaagtctccatgttaacctagatcagaagcactaggaaagaaacaaggaactttgggggtcttgagaaccttagtcaactgcaaacaaaaagtggggttcttcaatcatgtgcacaaagaca

SEQ ID NO: 526 - DNA, 2875 bp, Mus musculus
aggaagaaagctggatgcagagttcatggaggggtattgcttgctggcttactcatcatgacttgcttagcctattttcttatagaacctacaatcaccagcccagggtgtacaactcacaatgggctgggccctctttcctcaatcactaagaaaatgccctacaggcttgcctacagcctgatcatatggaggcattttctcagttgaggttcccttctctcaggtgaatctagcttgtgtcaaattgacataaaactagccaacacagaaggattacaagactctgaaggtactgaagtactgaactgtagcaaggtgaggtttatgggatatgagttacttcagaaagatgtcatgtaaagatggtgtatctgcatgtagtcttcaacatgctttggtactaaaaccttagtattttcagatgaatgttattattcattatttggagaacacactcagtatatacatatacatatgcacatgtgcgtgcacatacacatatacatataaacatgcacacacacacacacacaggcgttgtatcacttgtgcatattaggaaacacttgcccggaggcccaagctctgcaagcccctctactctgagattgatgaatttgtttacttttcgaggatggtcaaagttcaactttagcaaacagagaaatagcaagaggatggccactcatcagcacagaacataaattttcacacataactcagaggaacccagtgtatatgcttggctcagggaatggcattattagaaggcgtggccctgatggagtaggtgtgtcactgtgggtgtgggctttaagaccctcatcctagctgcctggaagccagtattctgctagcagctttcagatgaagatgtagaactcccagtccctccagcaccatgcctgcttggatgctgccattttcccaccttgatgataatgaactgaacctctgaacctgtaagtcagcgccaattaaatgttgttcttataagagttgccttggtcatggtgtctgttcacagcagtaaaaccctgactaagtcacccataactagagcaaaggaacagcagcatgtgggggaggggtcctcagcgtaggctaagagcagcatttaaactaagtaagtctcacaaaccttggttctaagaaggaagttgtatattttggggtttacactaatttaggaaactgccagtgtcttttctgtcttaagaattcagctaaagttagctcctgtctttacagaacctgaatgtattataaagtaatataattgtcgatcatttgatatgccaaatttacatttcttctcatgcactgatcttttaagaacctatcggataaagaaatatgagctaacttccacatccaggatcacaaaacccgaatagtgtagatggtgctaaaaatcccccattttctctgaagctcaaagagtgtcaagctaaaacacagctcacacaagacagcaggtgtggctgatgcaagaagagccatttatgtcttaaagggagccgattttatttcagtagctagcgcttaatgtgtgaatgtttatatatatatatattttaagacgttgtttaaatgcaagtgaacaaggaactgagaatatcttacagtaggaacatacttatatctaaactgcctctttttaaggaaaaactgttagaaatgtttgatttgttaagcttaagggaattttacagattgtaaaataatggatttcaaataatttataggtaagttatggttactgatagcactgaaactccctgtgttactcaggtctctggagaggctgcagtggctgttgcccttggtcttgctgatgtctgtccttcaacagctgactgaacttgccagttgctgaactcaaggcacctagatccccagacccttcagtaagcagattccagggacagcatatgaatccatgtaaattttattttaagatacctcaaagaaaaatatccaagtgatattttagcagaagtttatagattagagcagtagtaggagtgagcaggggtaatgaaaacatcatatatatagtcaaaagtggaggtctcacaatgacatcgttgtcaggcataccatgtagtttgactgtattcttgcctcactgacctccttatctgttgtacccatgtagctccttcctctccccaaacaacccctcttctatttttacattgtatttatatattatattaatatattatattattatattatatcagacactccacatatgacagacagaatgacttatttgcgttctagggtttggtttattttacctaacttggtgatttctaaattcattcatttcctacaaagggtctaatttctttcctattttggctgagtaaaatccaactgtttatataaactgtatcttccttacccatcatctgccggctgagtctgtatgttggctgtagtgaatagttctgcagtaaacatgggtgacaaggtggctctgcaggtggctgacttcgattcctttgggtatattccaaggggtcccaggtaggatctactcttgggtttttgagaaacccctgcatatttccatattttacatatcagtttacacttccagcagcagcatacatggtccctatctgctcatactcacccttcatccttgccaacatttgtgttttaatgatagccaatcccacagggctgagacttgagtgtttggtatctggtaaaatttaacagcagttctagccacactggccttttctcagagcaccggtgagtgatagcttactacctgatcaacatgatggcttgacacaggcatatctaggcgttcacacattggtccaattttgattggtcatatgtgtct

SEQ ID NO: 527 - DNA, 4300 bp, Mus musculus
tgagctgtatttaattacaccctgggctgggtgaatgcatgagtcttaacctatattttgtctagatccatgaatctcaagaaaatgctgccctaccctagcaccatgagagctctgctgagatgccccgaagtggtcacaggcaagacacaggacatacttatgtacaaatgcaagagtttattttctttataaagttaactctggattattatgaaaattatcactatttaaaaatatattaaatactgaaatagacacctcctactattaaaaatagccttaaaaaacctttcacatataatgaaaagataaaagacttttaaacacactgaagagataaatataaattatttttaaggtcaaggaatagagttagtctttaggtattgcacataatttgtatagatgaaaatgataaattagagtttttcagatttatttgtgtgtgtgtgtgtgtgtgtgtgtgtgtgtgtacagtgccattagaagccagacgagggcattggattctcccaaaactaaaactgtagagagttgtgagccgcccaatgtggctactgggaaccaaactctgatcttctagaagagcagaaagagcttttaattgctgagtcatctctctaaccctggaattaacatctttttttgaaataataaaggtcactttgtggatgtctataggaaacagcagaaaattaaactcttgtgatagcaaacttttcacaacttacttagcaacaattactgacttctgtaacctaagtacacacagagaggaagtagtttgctatttgaagtgtgtgtggtgcaatgatacattacagaggttgttgtgtgttcagaagcataacacaatagaactggttgaggatgtgtggcctccgatgcccctttaaaagcccatgttacttgtgtcccctcctgccccccaccaggcccatggtaatacgtcattttaaaattaatggtctgggatgctggagatggctcttgcagagagcacacactcatctacacacacacacacacacacacacacacacacacttaaaaataataaagcaaatattcaaagtagaggatttcccagaagatgaaaagggagaatttaaagcaacagtacttgcctttgtggaggactgggctcctgcacctcttgagaggagcctcctctgaggaggatcgtttccatggctacagaagttagtcttgcaatcacaagggttcctttcctgttttgttcaaaacaatgaactaaaaacaacaaaccaaacaaggattgatttccagtaagctaaaaacaacaacaagaaagtctcttatgggcagaatggctctacactgcatctgtttacaagggcttctttaggcagaattcggtggcagttagccgacaggaaagaagagggacaggaagcatctgcatagtgtactcatacacgtgaaataaataaacaggtctttaaagagaaagagagagagagagggagagggagggagggagggagggaggaacaaccccattcctcctctccaaatcaccatataccaaagattctgcttttggttgaaaatgtattaagatgagtcaagtcttgcatctcctgtacaatcacagatcaggtggatactggccctataaggtctgtctctaccttttttggtatttcagaaagtacaaaggaccaggactcctcctgaaggtctatgctcaggttctctccactctagctttgggatgctacaggctctgtatgaaccaggccaaatatcagagagaggctgccctctgcctctcagctgcatcctagagagtgagagtgggtgaggtggtacaactccttggccttgtggaccctggcccatgactaaattgtctgcgatgtgccttctgtcttatccctgagaccttgccgcactgattcatttgtgacagctaagactggttgtcacctgatagatccagaagagagaaccctcgcccaccacactggtctgtgggcacatcgatggggtgttttcttgatttttaattgatacagaagagcctagccccctatggatagtaccatccctagacagtcagtcagcctgggctgtataagaaaggtagacaaatgtggaccagaagcaagccagcaagcagcattggcctctgttttagtttctgcttccatgtccctgtgccttgtcttccctggatgatagcttcattctgggagctgaaatacactttttgcactggcttccctggatgattctatatcctgggagctgaacacacttttgctccttcaggttgattttgatcagggttttatcacaacagcataaatggagctggggcaggagcagtgggcagttggggtgtcagccaccacctcctgcaagccagccttcctcttaggcaaattcttcaacagtctccggcctccaccatactccacaattgtgaccttctaccggttgccatggaaataatttctggattataaataatgacaatgtgagtttcctagttaccaagtatgtttgtaaaacgaattccaaaggtacatgacatttaattccagcctatttttagaaaccgaagggcaataaaggaaaatatttttaaagaataaaaaagctgaaatgtttcccaaatctcatcagagagaagtagatctataacagctattggaggggaaaataagagttttagtaacacagcgtccttgaggttccgaggaaagctctgagagaaatacagagctctgagctaaactgcaatgatcacttatcaaaatgagccattatagaactaaccaccatggaaatgaggaccagagcatccctccacgatcgtgtgccctctgtgttgcaaaatgtttctatttaagaaaatcactgctactcttgaaaataaaggtttagcctacttcgttcacagagaaatgaaagggagggttcattccaagggaatgtattacaaatgaaaatctatcacaaagattctcaagtcaatgtctaattgatttttataaagacatcaaagtctggctcaaggaagacagaggcatggaaacagcaattttctgtccagtttgttatcttgtcctttgtgaacacagttgcaggagatcaaagacattgatacataattatcccttcaactttgctacaatgtctcaaaactgggaaatgcttctcttttttttgtttagaaacttaggtggaatgggatggtatacaggagggtgtgtgcattcctggggagggggtcacatatgtgcacgtgagtgtagaggccagagaagccactgggtgttttccactatacccctccaccttgtttttatttagaggtgcggtctctcactgagtgtcacacttacattcagaaagattacctgcccaaagagctccgtgccatcttgttctgagcaccgggatctcaggcttacaccaccacaccacctgtcttctttaatgtgagttccaggaatccaagtccatattgccaagcctgtgtactcttacagagccatctccctgcccctcagaacctctgtaggtagggcaggggtactattcattgagcatgactagcataggctaagaacctactataatataccttccaaacttaaaccaccttctttacttctgagacgaggtcttgctcagccgggccttgaatttgctccagagctcaggcaggatttgaacttcaaccctcctgtctcagcctcctgagtagctgtttttatacacaggaggtataccaggtttttataccaggtcaggtttgttttctgaatcttaaatcaagccccagctccctttggccttcgaaacatgaaattaaagaactcggtaacagaagtccaaggtccattagggtttttctttatgaatatttagtgggccacatattatgaatttgccatttctgttggtttgattccaacaactctgcttacagtaaatatgttttctatgctgctatagccagtgaccaccaacttggtggtgtgagacaatgcaaatatactccataaatctgaggtctgactggccacttagctatggccatggtgcagcctggactgcattcactctgagggctctgagggagatccctgcttctttctacttcacctcatccttggcttctcatcccctcctcggtcttcaaagacagcaacagataaacaagtctttccctcaggattctgacctcacccaccccacttttccttccgtctctcttcgctgcctccccttcccttttaaaccagcctgtgtgattaca

SEQ ID NO: 528 - DNA, 3150 bp, Mus musculus
gtgtcgtcttgttaggtcacagcaataagaaggtcactaacactccataaactgtgatgttttgttaactagattacagcacaatcccaaagtgtgcacaaagaaaaggcaagcaaatccacatgaaacatggagagaaatgttctttagggccatggcaggcttcagtgccagtcacagagagatgggaaactcacttccacgatgctgctgacagtatagcgagaaatgccttttatccctagcaaactacagcactctgtgggggagaacaccggctgagaacaaacgttaagtaaagtaagatgtcatcgtgtgtgcgtacccagatggaggctcatgggaactggccaaaagcttgtcaagactttaacatggcttggaaaaacaaaaaactcacccaccaaatctcttaactacacagttttaaaataaactccgacacttctcttaaactagagctgtgcctacaacagatctgactttctgtgtatcttacgcactcagctgcctgcaataaacttcacccttcaccaaatgccgtatttttttcctaggtgagttatccctacattcttccaagagcctgcccatgctctgtgatttgagaaatcctgatattttcctagagactttttcatctgaaattactcggtagaggcaaatgttctcacagaggggaaacaagcaagaacctggacttcatttgcttctgccaccccacatatttcaaggattcataaccattaaaaaagaagaagaagaagaagaagaagcaaccactttctatttgtgtattgacaacaactcaggacaaacaaatatttgtcagagttcttcagccatcctcggtagactcccagaaggaagcagactgctccaaacacaatcaaatgtcgaattagcccagagctcctctgaaggaagaataaattgttctcacttcctcaacagctacagtgacctgtgactaacggaatctctgtggaaagaggctggagttccctccacagggactgtgcgcatctctgctgccagaggggctttgtgttaaggcttcccttgctgccgtgagtgttcacagacacccagcaatgtgcaaagacagggaacttccacctcgagtcccctgttggaggggtgtttttagtcagaataatgaaggaactctctactcaacaaatagctaatgccttccatgacacattcacacctctctccctccttccctcccttctcctagttgcttgtagcaactatttctggcatgatgaagcattcacactaaaaatttgtttgaaaagatcccaggaagggaaagagggaggtaggaagaaaggagggagggagagagggagggagggagggggggagggagggagggagggagggagggagggagggagggagggagaaaaaagagggaaaagatggcagcaacttctacctttgggttttaagattgaatccagagatcgagcacttctactcctttgtcatatatatatatacatatacatatgaacttattgaaggtgaaaaagagcaattcaagcaattagttagcttcagagtaagatcagtcaggagcaaaagcaaacaagccccaggtcaccactgtcgcaaccccagagcacagtgctcaccctggccctttcattttctctgctgtgtcttgtggcctctgtgctccttatggtatctccaagttctagggatggctagaacatctcagaaactctgcatctgaatctagtacctcttcctgccctttgaaccttcctataagaccctcccccaacaagccctttccagaagagccctgcaaacactaagtcttctccatgagtaggttcagaatcattcttgagttacagttttgagtgcgagatgtctccacgggctctcgtgtttgaacctgtgatccccaccaggaggtttggggaggttgtgggacctttacagggtgaaccacttgtaatgggtttaggctataactgaccctatttctggcccaagctttcagctttctggtctaccaagatatgatcaagcaccttcatattcctattgccacagcagagagccactcccaacaccatgaataacaccacaaacaccaccacaacaacttctcagccgctgagaaccaaaatgaaaccttcctcccctaagtagtctcttacagctgactcatcacagataagaagctagcgcagagaccttctccagccttgtctccctccttccctccctgggctcagcaaggggaatggctctccaagtcaagctgtctgtcttctagaaagaggtaagcatctgcctgcatggcctccccaggcaccaggcaaacacagccacatcctcacagctctgtgctgaacagctgggacgaagccaggaaaacgatcaaacattaataatgaatttgctttgacagcagcttcttttttctcttttctgctattcacagtccgtcaccttaagtaccagcaaatagctcacagcattgccgagagaactccacacggaagaggatctagtggaggagaaaggcaaagggctttccaggcagatgaagtggtgggtggcacggttgacggacataccccaccatgaagagattatcttgcaaggcctccccagtggttgtctgatgcctaatatgcataggcagctgagctgtccctctgcaagacagccatgtcccaaggtgaccgagaagaagaaatggcagattgcaggacaggttctggtggataaagagcagtgggcagagagtggagcaagccattgcagacaccagagacgtggggaatggtcagggaatctgcaacttcttggttcttgacagatacaccaagtgtcagatgacaggttgatgtgaggccatgctatctcagtgttgggcatccatctcaatggggtcactgtcacacaccttccttgcttctgtggatctgccaaattcttagctggagcttggttccctgatgtaattttaaggtactcatgtaccccaatttgaaatcatccccatactcttatgagtggctccctttctgttcctgggaataaattacttacgtctgcgttgcagggtggtgcctgacagattgtgtgtggttttatgaacccaccagcctgttt

SEQ ID NO: 529 - DNA, 2600 bp, Mus musculus
cagccatgcagtgggctccagggtcacatggtacttctgcgtctttgtcacaccacaggtatatgacgacagcaacctcttgtcctggtaactcatgaaatcttccagcctctaaaaccccatgttgcaagccttcccttattctgcccctgcccgtgtctcctcccattgcacaccctggtgactcaggccccattctgctaccttccccacgtcactgagcacatgtagtcacacgaggaccttcacacactttccacggcttccatcagaacctgatctctcacgagttgggtgcggcacactgttgcctcccctaagacggggacttggatttgaggtttgggcagtttctgtcgccttcaggtcagtggctaaaagtctgtaactctgaggatcttaacatgcaaagtgaaaacaaacaaacaaaaaaaaaagaatcgcaaatcatagtagacccttgctgatgtgcagtcacaaaggctgctttccccaggcttgtcagcttagatgcttgttaatgtgttaaagataggttgcacaaacacagctctggctggtgctgcaggaaggggacgcctaagaggagaatgcagattttctgttgcttcctggtcccacagacctccccatgctgcagggactctaccctgcccccgcctgcgcatggacctccagagactggcactggcagcagagttcatagaaactgcctcttctactttcattcttcctccttagggtccattagtctgagcaccatccttctcaggagggtccgctctgggcatcactcatcagcttggcccccaagctcctcagagtgaacaattccactcctcttcagacaggaaaaaggcccatggcaacaggttttagcttggagttaaagaaaagggctactgcttaaaacatgctctccttaaccgagtcaccctgcgcactgctgccatacgggaggtatccatggggatgagaccccaggagccgtgaggcgcatcttcatccacagaacctgcacctcccctctccaacattcaatactcgatgggggtattgacacagcgctttgagtccttgttctatttttaaacgcttgatttgtgccttttcagttggatcttattcagctaaaactgtactgtgtgctcagctgaggaagggtaaacatcccagggctggggcaatgtgtttgcacagacctcaattacaaaattaacagggcagattgcactgtctgttgagccgaagagatgacaataaaaacctctaatgaagggagacacgagaaataagacctaaggacaaatactcaaaagaatggcttgtttatttatcaaattcgatttactagccagctgtgtgactccagttcagaacccactagagagaagggcctcactccactgcagcaaagtcccagccttggtcaaagcaggagggaaagggaagggagagcgaggcagtgaccggatgagggctgagtcatactggcccagtgcagagcttcacatatgatctaacattactggacaggtctgcctgtattcttggggtcacaggattgaagggagcaggaatgaggcttattttctctgatgcactgaggttaggaagccccatccagaacgcctctcagactggaccctatgaagtaatggaggaaagcaggtcaggcaggattggaaggtacccaggagcctgactccctacaaaggggaggattgcaggttcagtcccactgcagagccagtggcatgatgggagccagtgcctttgtcctgggcccctagcttcaggctgctccatcctggcatctcaggaggacccaactgaaataagtggatgctctatagcccttcagaccaggcatccccatggtcctctatgcttgcccttcctgaagcatccgatcagagatcctggggaacctggtcagattctccaactctcccagactcaacagcctttgagagggaggctgagtgcattgtctgtagacataacgaatatggtctccgagcctcaagaccacagcctatggagccatagagcaacagacaaggcataagcttggcaagggaggagctttgctacttgggtagctgtgctacttggggcttatccagtcctttcccaacctctagctcttcctccagtctgactccacaaatacagtaacacagggtggactgaagcccaaaaagattctcctgtgcacaaaggaaaagaaatgaataccaggtccgccacctcctgtgactgtttagccctgctcagacggagtggacacatgcacatgtatggggccagggacatggggcaaaacgagcaacatcataccaggtacctttggaaaatgggcattgagacagtgtggaggggagctgattggagaggtggcaatcttgtatgtgggcactctcctgctgcacctggtgacaaggaatgccaccatgcgtgacttcaaagtctgaccgtttaggctctcattctcagtgcttaagccaggatgatgagccgctgaagtctggtgtcacagatgagaagaaaacaaggtctgaggtgacaatgtgttcctggatgctttgtgaagtgca

SEQ ID NO: 530 - DNA, 4425 bp, Mus musculus
cagggctacacagagaaaccctgcctcaaaaataaaaggggagggggggaacatagctaaacaaaaaattctcaactgaggaatgccaaattgctgagaagcatccaaagaaatatttaacatccttagtcaacagggaaatgcaaatccaaacaaccctgagattccacctcacaccagtcagaatggctaagatcaaaaactcaagagacagcagatgctggtgaggatgtagaaaatgaggaacactcctctattgttggtgggattacaaactggtacaaccactctggaaatcagtttggcagtttggcagaacattgagcatagtactaccagaggacccagctataccactcctgggcatatacccagaagatgctccaacttgtaataaggacacatgtttcactatgctcatagtaaccttatttataatagcgagaagctggaaagaacccagatgtccctcaacaaaagaatggatacagaaaatgaggtacatttacacaatggagtactactcagctattaaaaacaatgaattcatgaaattcttaggcaaatagatagaactagggaaaaaaaaaacaaaaacatcctgaatgaggtaacccaatcacaaaagaacacacatggtttacactcattaactagtggatattatcccagaagctcagaatactcaagataaaattaatagaccaaatgaagtcaagagaatggaaggtcaaagtgtgaatacttcggtccttcttagaagtgggaacaaaatacccatgggaagagatacagagacaaagtgtggagcagagactgaagggaagatcatccagagactcccccacctaatgatccataccatatatagtcactaaacccagacactattgtggatgccaacaagtgcttgctgacaggagcttgatataactgtctcctgagaggatctggcagtgcctgacaaatacaaaggtagatgctctctgccaaccattggagtgaacacaaggtccctaatggaggagctagagaaagaattgaaagacctgaagaagctagcagccccataggaggagtaacaaaataaatagaccagtacccccacagctcccagggactaaaccaccaaccagagagtacacatggagggactcatggctccagctgcatatgtagcagaggatagccttgttggatatcaatgggaggagaggcccttggtcctgagaaggctctatgccccagtgtaggggaatgctaggacctggaagctggagtgagtggtttggcgagcagggggagggaggaagggatagagggttttcagagtggaaaccaggaaagagcaaaatatttgaaatgtaaataaaaaaatatttattaaaaaaagattaaatcttagcatcttttgagcactttcacttgctattttcagaatgtagttgactttgtgggacccacataaccgaatgtaagtcctctgttttatatggtatacaacattaggaaaattggtttctggaaggggagggttatgcatctctgggtcctttgacaacaagatgtcaacagtttctcacaatatcttcaaatagttactttggctaaaatttctgtgtttttattgtttctctgagactaacatctttattcttccattgctgatacctgagatgttccaggaagacagtaacaggacatctacaatcatttctttccaagatggcctggtcagccctccaccccacccaattctgccattctgtgaggtcctctgtgagcatgctccataaactatcatattcattgtctatgctttcaatggaagcagctcaaaataaataaataaatagaataaaatcaagatgttctttaggaagtctgtggaaataacaccgatctgtaggacatttaaaaatccctaggcatctgctcagttttcatttctgcatagaaaactacctgcttcctagtcataaatacactgcaccttcctgcagacctataattgagttactttggtttccctggcaaccaccacgattaattagaacacttgagcatggtaagtttatagatgcagaaaatatttcatgtataaatagtgcaatctgtttatgctcaaaggacttttctccctcagttgagaagtagggttactttttcctttttttgtgtggattattcactcttcccataaactctataaataatattcaaaaattaatgttgacccctttagcagaattttccagtcctgacacctcttggatggttggtgccctgaatcctgagtccctgcttggtaaagaacagctgggtccacactataattcataacaacagtaagacacagggccacaaaaatccctcttccctttgagtagtttgtggcacaaaggacagacacataagaatatttgtatgaaaactgttttctattagtgatatgcattgcactaagccaaaagaagatcatcagtttaaaaaaaatgtaggtaattaatatcggtttctcccagaaagtacaagacatgacacagggctaacatctcttggctatttactcaatatctattaatcattaatcctggtatttccctccaactagtcctcttaagcagtattgttaaatttgattggaactgtaaacctcatttttgagatgtgaacctgagaccttgaaaatttaagcaaaattttcagattcatattgtttggagctggaagctggattgagatcaaaagtctatccatccacgcattgcccagcctgtcaccaattctctgacattgttgtgaaaatgaaaccagaggcttcgtgactgtccatcaagggaggggaaaacagtctcgtggtttacagactccagccacacctgtctgctgatacagattaaatggattgatgttgttaatcccttgccttgaaatatgcttaaccatttgtagctgtattcagttagagcttaaactgatcccggtggtggtagtggtggtgtgttccacctgtcccagtgctctgagttcccgaatgaactacacaaacacacacacacacacacacacacacacacacacacacacacacacacatacacacacacacacacacacacaccacagcttgtatattttgatatgccttaaacagctcaatggctgagccacctcctaactcccatgtggctaacccaactctctccgatatatactcaggttattatttactaaaatctatattctatcttgcctgccccaaatccagacatgcagccctcttagtctgtgttctgcccccccccccccaaggtgctctctgttcagcactttctcaggtctggcatctatcttctccttcccctgacactgcagatctccttcttctccctcctcccttggtcccttgcctgggaatcctaaatgtcctgcctctgtctgccctgtccagctattggctactggcaactttatttaccaatcaaaaccaactgggctcagggttcatgagtatcttacatgtggacactacctaagggaccctgagcagttttggggccccaaattaacataagaatacaagcagctatagacacttgctgactttttctccaaattgtatgctgcttctcgagaaataagtggcagtaatgtaaatgagtcccttatcgccagactggattgtaaagagacagaatggggaaaggatagagccactgcccatctgctaaagctctttggctgtacctagggaagggccaatcgttagtgcttgaacagattttagtacatgtcatcattgagatgagtatagctaacaaggccatgcttagggattacatcacaacaccctttggcaagaagatattctctaccattgtgttatttctttccaagaaccaggcataataataattataggaatttatcttctcccttccttaagttattatagcctttgtaaataatggatactttaactattatgtcaataactcatatattggaacaaggatgaagatactaagaatggttaattagtaggcctgcctatgaccagttcccaatgtcactgttctcatgtacacctgtgatggtaaatgataccctcatggagaatatcgatctagttaaatctaggtttttgattctatatcccaatatccattttctgagaagtgacactaagaatattaatgatcttagctgaagattagcagaatttctttttatgcatcctagtctctgcctatatatctatatctaagcctttacatattaaactaggaagtgctctcataatattttagatgcttattccagtgcataaacattcattgtgtttcttgacttcagaatactttttaaaatttaaaacagatatttggcttgaaggttatcatctacagtggcttgttagaa

SEQ ID NO: 531 - DNA, 2125 bp, Mus musculus
ttccaagtttagtaccttcattgttacttttatctatgtgcgggctaaattttccatctcttttatctcattttgtttgaagaatttcttttagttgcaaatttatatttaatgccagtctactggcaactgagactctcatgttttgtttttttctcaaaatagtctttgtgtgtgtgatatatgtgtgtacatgtacatatgtacgtgtgtttagaggacaggttcacttccaatgtcttcctcagtccctcttcatcttattctttgagacagggtttctctgaacctggagctgagcgctgtgcctgctacttcatctttccctcaggactgtacaaggaaggattccattacgggtttcattttcaccataggtgaagtgtgtttctctgggactcagtggaagtattttctcaacatttcccttgctcctgcttcatccaatgactgctttctatctggggcatctttacatggtcatatttttcagctttcaatggttgtaagacactgcttgatcattacgggattctgagccagataggtttctcctgcttcgagaggctttcttaggacagtggtagagaactttaactttggtttctcaggagcagcaagagtctgcctagactggagtgtgggaggcaggaatgcctttgtttcctggcaactgtagatggttacttcatctcaaggagtctgctaagtgggtgagatttctcctttgtaccagtgcagcaagtgttcacaagagtaccagtgccacccaagggcatctcctgcccagggatggccccacccatcatcctttacggtcagatcttatgtaggcatcttcccaattgaggttccctcctttcagatatatcttgcttgtgtgtgaagttgacaaaagactagctagcaagagagggttcacaagcattcacccccagccaaggaactattgatagctgatgtttactgagggacagaaagccagttttctttaagtagcccctggtaggttgaccatgtcctgtggatggcctagtacctgtgagtgtgtagatagcagtaattggacttggtgagctacaacaaacaaacagacagacagacagacagacaaacaaacaaacaaaaagacatgaagttgggagggattagagggagaagtgagggttgaatacgatcaaaatgtattgtatgcttgtagaacattcttggatttttttttcaaattattattctttagaccttttttacagcccagtcttcatcccctcccagtccgctccctaactgttccccattccatacctccccccacatctccaagaggatgtttccacaccccaccctattccaccagacctccccactccctggggcctcaagtctctcaagggttaggtgcctcttctctctctgaggccagacccagcagtcctctgctgtcaatgtgtaggaggcctcatatcagctggtgtatgctgcctggttagtggctcagggggtctgagagatctcgggggtccaggttagttgagactgcagatcttcccatggggtcaccctcctcctcagcttcttccagcctatccctaattcaaccacaggggtccctggcttctgtccattggttgggtgtaagtatctgcatctgactctttcagctgcttgttgggcctctcggagggcagccatgctaggctcctgtctgcaagcacatagcatccttagatttaataaagactgtttatacatatttaaaggtttgtttatttttaatttggtgtattttgactgtatgtgtgtctatagaccatgtgtgtgcagtgctcacaaaagccagaaaagtgtgtaggagcctctggagtcatagatagttgtgaggtgccatgtgagtactgtgagccaattcctgatttgattctatgcaagagccacaatgaaagacccacaatgtgaggacttccccacgttctgactcaggagaggcgacaccccaaaatcacccacaagaaacggtcttgctgcaaattgcaagaggatttttattcaagagtgctctcgggcccacggtcatacaccatgcaggggtagaggaccgtgtcgcgccgagtagctgggtaagggg

SEQ ID NO: 532 - DNA, 2350 bp, Mus musculus
caacaaaaaagaacaagccatcaccagtttctctgttgattggaacctactttcaaagaaaaattctattatttctatggataccttgtggctaacataagcttaaaaccaaactttgtagatgtttgtagagacagtgctacagaagtagagtaaaaatctgagcaggtggggctgggaagaaagtattctctgaattctagttgacaaaactgattagttcctgaactcagtggtgtctaagtcagggtttctattgctgtgatgagacaccatgatcaaaagcaactttggcttacacttccacatcttagtcatcattagaggaagtaaggactggaactcaaactggccgataacctggagacaggagctgatgcagaggccatggatgggtactgcctcctgccttgctctccatggcttgttcagcctgttttcctgtagaacccaggactaccaacccaggattgtcctcacccacaatgggctggacccttctgtatcagtcactaatttaagaaaatgccttccaggcttgcttaacacccaatctgacggaggcattttctcagttgaagctccatcctctttaatgactctaccttgtgtcaagttgacataaaaactagccaatacaagtggtgccatcaacttgatctcttgaccttccacaatgtggctaggatgatttccactctagtagatagtatccaaacactggttgtgttcgctattgatgcctgtgaccagagtcaccttgaaagaggaagggtttatttcactcacgctttcacaggttttcctcttcgataaggaggcatggcacagccacataatggtgactaggaaacagagaaagaacagagaggatgccacacaagcgggaacttcctccatcttccctttcattctgtcaacctcctcccatggaattgtgctcagatgcagagggaatctttccccagtgagtcactcatctctggaaacaccctcacagacacagccagagatgcgcttctgtagtctcctaggtgcttcttcatcccctgaagctgagagttcatcttcacaggtgtcagtgaactgaatctaagtattcgtatttatatgttgttccacccatgtgagctctgggctaggcttgcacctcatctaatagggctgacgtgacagtatgctggatgtgggattcaggatgcctggacgcctctcttagcacttttaggcttgagctgtcaggtaagacactagaaggccaggcccctgagctatgagaatagggagagcaaagcagacatcccagcacaccaggcgagtcttcagatgattctagctccagcggcctcctgcctgacagaccacaagaaggagtcaaacgggacagtcacccacccacttgtccatggtatcataaaatagtgtcgtttgtttgggagccttaaggaccgaggctgttgtcacaacgtggtagtcattgacacagcttcccacagaaacacagttagaaatgagaaaacactactccctcagatgccagctttaccagtggggctgtgggagccatcacagtcccttctgtttgcccagtgagcttcctggctccaaacacaaagacaagctaacagatgacctaggaagaaaaacactaaaaaacaaaacaaaacaatatggtttgaagaggcagagggaagaaatagcaagtgggaaattgaatctgtatgtaaatattgagttaacaacaaaaggaggatgaagaaaagaggaaagaggagaagaagggagagaggaaggaggagaagaaggaggaagagaaggaagaagagaaggaagagaaggaggaggagagaagaagaagaagaagaagaagaagaagaagaagaagaagaagaagaagaaccctgacatacaatagcattgacattgtaccccagaatttacatcagccctttccaataccaagaatgtcagttgttggcttgtttactttttttcccagtgcctcattcttcctggatgtgtgggatggctagaatcgattcctagtcatttttgtgcttattacagttttcccaacttccagctctttttaagtatgtgtgggcagcaagatgtataaaggaattttattctgttttttttttttaaaaaaacttttgtaagtaatatgactcattgcttaattttctttggggatagctttaagaaatatatatatatatatatacatatacagcattttattgaagaaacttttaaattaatatagctttgaatacttagtgacttccagtagccttcaactgagctgaaagtatgccttggtgatacattactgccttgttctgta

SEQ ID NO: 533 - DNA, 2225 bp, Mus musculus
atcaacgtatttctccaggatccaagatgttcctgggttttctcttgtccacaagaataaaggtatatactccagccaggtgattcagaactatgaaatgtttatccaaggtcagatgtctgtcttcttggcaggaggtctaagagccctgatgagaaatgaccacctcaaagagtggcttaagatatctctctctctctctctctctctctctctctctctctctctctctctttaaatcacatatcctaaaggtcaggcagacattatgagcattgtcttgggggcttagggaaaagagaaagagtgtgtggtgcttaaatcatttaaatggtcctttaagttttccttagtttcaacataattcctttacaagttgatggcacttccagccttgaaggcttttgaatatatttgatggcctgcagcttcccctgcctttgtgagagcattacttatcttccagtgagccctgacagcatcgcacagtctacaacatccttgggaggaaatggcttccggcataaaatattgtgttaagcatttaaggctggctttgttactctttcattcttaaaaattaggacaccgcagcggtattataggagagcagttgtctataatttgcacggctaaatttggctttggggttgtccaatatgcatgtgtattgtttggaataatagttaataataagttcccaagcaagtcggaaatggagccactatcatttaaaagcaggagccaaaattcaactgcctctccggcaagatagtaagttaatgaggaagaccgctttcaaaccaataaacaccaccatcatgcaccgttagcttggcgcccactacctagaacgtcaagttactcacccatcacagtatgatcgctaagaatagacccattaccacctctccagcaagggcttgagctacacagctggtacttgtgtctgagctcttcagagaatgatgacggcaataggcacaggctctggctttacagagagcttcgggtgaaaatgagagtgagcagacggtggttttaagtctctgaaatttgaggtcacctggaatagcttctttgatgcagtgcccagaaaaagctctcgctgacctctgcggcacaggttttatactgcatattctccatgctgccaggatccccctcaaacctttctctattccctggagcacacagcccatttcctctgacctcctgttggttttggctagcggagtactgggtgtgatggttggtatatactcagcccagggagtggcactattagaaggtgtggccctgttggagtaggtgtgtccctgtgggtgtggactttaattaagaccctcatcctagctgcctggaagccaatattctgctagcagcctgcagatgaagtctcagctcctcctgcaccatgcctgcctggatgctgccatgttccagccttgatgatattggactgaacctctgaacctgtaagccagccccaattcaatattgtccttataagagttgcctgggtcatagtgtctgttcccagcagtaaaaccctaactaagacactgggaaaaggaccagaggatgctagaaaagagagggtggcccatccattgccctgacgcagcaggctctattttcccctacctacatccctggccactgctttcagcagctctgtgtccttgtcctccccacagagcaacacactgatggatgacagcgctggtcctgatggagagtcgtgggttggcccctctcctgtccttcctttgcgatcagctccttcatggatctgttctcctttgttgccctcggtcatcactttcctgtaggcctctgattgatgctacagtcctcctttcttaggaccaaggactttaaataatacacatttaaaaaaaatttaaagattcatttgttttatgtaagtgcactgttactctcttcagacacaccagaagagggcatcggatcccattacagatggttgtgagccaccatgtggttgctgggaattgacctcaggacctctggcagagcagtcagtgctcttaactgctgagccatctctccagccccaattaattgtgttttaactgacatataaaataattggttcactgtgatattttcataatgtatgtatgtgtatatatatatatgaaaatagaatataaatgtatgtatgtgtatatgtgtctatatattgtactgtgctaata

SEQ ID NO: 534 - DNA, 3300 bp, Mus musculus
agctgtgtgtgtgacctaggacgcagaagagttcatttagattattgaacttaagcagctaagaactataaattctataagagagaagagtttctggtacgtagtttgcacttagcattgagcctggagctgggcactgagctgtgtttccaggtacagagttttgggatgtatcctagaagttaacggctttcttaggagcttcctctattgtcctgtggtttcagtagtgcaggcaataatactgttactatagctgagggaaggctgctttccctttctttgattatacatctgcgcgtgtacacgcacacacgcggggaaacacacacacacccaagggcaggcagggctgttggatacaagaatcagtgatgccttgtgagaatatattgcacggaaggcaacttcttgcctgtgctaggggagaggtctgaacttgttaacatatgaagcaacggtgtgggggtgtcagggtgtgggacggcgggggtattgggaacagtatgtgatgtaacctgaaatctcccatacaggctcaggctttgagttcttgttccttggctggctggtgctgttatgagaactgttgaactttgaggagagcagatgtacctaacaagggtcaagtctttgagacttattagcctggcccctagttccggtcattcggtttcctggtccactaccaggtaaatgttcagtgcctcacgctcctattacggtccgtggagctattcctccatgtcttcccttctatgagcaacgaaaatccctaaaagcaggagccaatcagatgctttcttccttctgcaggcgccaaccagatgttttcttccttatgctcttttttttttttttttttttttttttggctgtgtggttacattgctatataagtagctaatacaaaaagcatgatgctgtgtagttgagcagagctagtggtccttgacatcctgtgttggatcagtcctgtgccaaaagatgctgtctgtactatactactttaccaaggaaggaagtggtgtccacacagctgagaggcagtttctctttagctgagttgaaaaagacagaaagaaaagagcctcagcctgtttgattccagagccatattctttatttacattctgtacagttcctctcgaatgtatagcagccgccggtaaacagcccgtccagcaacatcatctttgaattctgttgctcaaatacgttacttaatgttgggggcctctgcttcatctctcccgtgatgcgggcttgttaaaattgcccgggtccttttcattctagagggttttgctctgcgtgttgtattgctgggttctatcagacctggggatttgctattatgctttgatttcttttccttgtatttttatgagttactttatatagatgtataatgcatttttgaagtttgcatgcctatatatacaaacatatacatgtttatgtgaggatacatgaacgcacacacatgcataaacattcagagagtttcccccacccattctaattgcctttgtcttgcctttcacagttctgcatactcttgcctggctatgagatgatcaaatgtccccttgtattctgtaacaaaagcataaatatgttgctttctctttccagaggacaggagaaaagattaatatttctccataaaagctctgctgcctttcaaaataggaacactaattttgtctaagtggtgagtcactggtgcctagattcattttagtgttttcagacgagctccagtattgccctggttatgggagttattgctcatttgcataaagggagcactgattggaggatttccatctcatcttgccccagaatatttgtatgaagacagagttgctatctatcttcagacattatgtcaaggaatctttgaatatgcactctgaagctcagaagaaaccctatctagataaggttctagatggagtcaaaatgtctaaaatgctacaccagcctctcagataactaggtggtgacccacaaagtgtgttgctgctgggttataacctttgtttccaaataaactttcaagccacttctgcatgaagacataaaatatgcaatacaacaggatatggacttgggaggtgccatccttgtcttaaaggattgcagctcacgatatatagaatatatatatatatatatatatatatatatatatacatatacatatacatatatatgtgtgtgtgtgtgtgtgtgtgtgtgtgtgtgtgtgtgtgtatctgtcatctaagcatctaagccctggggaggtagaggcaaaaaaactgtgaattcaaaaccaccctgggatatgtagcaagtatgagaccaggtagggctacatagcaagatctgtgtgtgtgtgtgtgtgtgtgtgtgtgtgcgcatatgcccccatacactcacatgtgccacagtgtactgctctctggagactgcttctctccttctatctcaaggtctgcttcttaaaggtccaccatacctcccaatactgctacccccgcatactaagacattaaaaatatggacaaaccacagtggtgcctgcctgcggaagttggcactgagcctccagggctttccttattaaagattccacatattctaacgcttccagctatgagacacgttggatatctaggcatagctcttactgatctataagctagaatctgctgcagccatatgaattttcctacaactcacatttgccattttaataaaatgtcctggctacagagataatagacacagaacacataggctttagctgcaacgcaagatttcctgagaaggggggaggggtgaaagaaatatgtgttttctgtggacaggcttggttttaaaagtaactctcggttgtcttaaatccctcatgtttgtgtttagaaaaatcagggaaacaccacaagcaggtaatgtggagaggcgactcgcctgctgtcctgcccactcccctcatccaggaaataactgcatgatcaacaccaaaggcatcctgcgctgagaattctcactgcgtggtctggagtctgtctgtatctgcatctgttggagaagatgccaccatgattccgtgggtgtgatttccctcctggacaattttattgggtttagagttgtaaactgctgggcacatgtctgggagggcatttttagggaggcttagctgaggagagatacccaccctggatatggcgccattccatgtgctgaataaaaatgggaaagaagggacagccagctgagtcccagaattcatttctctcagct

SEQ ID NO: 535 - DNA, 4450 bp, Mus musculus
cactatggctttagaaaaggatgctttgagagtggactaatatatgagtttcttcttaaggaagcccacgtcagctgataacacagctggtccacaatggagctgttctagtcttttcccacaatcactcatcttggactggtcctttcttacacccctcaccgaatgattcttcatgctgtggcctcttttgctgccatcagtcataaacccgacgtcctcagtcacttgctggtgtttttcttgactctttatcccgagggcttttgctacctgagttgtctagggtggtgagaaaatgaagagaagactgacagatgggcgcacatacgaaaagctgggatcaagtgatctgagctctgaagatggagagccctcaacacattggaagttcagcagtgtttattatagagagttgaacagggaggcgggggtatcatctacagctggacaaggatgtaggcttattacctaaggaggcagggtttggggtgtacagctgggtcaggaggacaggtttagcttatcgcagtctgtagagaaacagtctttacaatacaaacagcaggggtggaggtaggagaccatatggacattctcttcacaccctcaacacaaactccgtcccctgagggagcctctgctctgggacccttgacatgaccgttgccatatcaacagcacgatgcactgatgtcacaactcagtcttcctctgctccccacaggtctgatgtctcaatttgacgatgcctacatcactgcctggggctcttggaatcatctccctatttcaaatctacaggcattagttttgttccctcccgcccccatccccttctttctctttcccactgtagaaggtaaggggatggtgagacgtggtcagattcagggtacagtgagagtgagaagagtcagaggtgagtgccctttcattccctcccctccctgtccctccccccttctcctctcccttctactccctttccctccccttgcttctcccccctcctctcccctccgctctttcccctcttctctacttccctacggatagtctcatctgtgctctctgtatttacttggcttttcttcgcagcacatataagatatggaatgcggcttatctgtttaaatgttgatcatcttatttaaaaataagctttacagcttggtttcattatacttaggaccaagaacaacagtgtttggcacaggcgctcgatctatatttgtcaataatctggctactcagtccagcaaggtgattcaaaatgactgctaaaaaaaaaaaaaatgtcggtaccagcagtagaggaaatatagctgggttccacagttccctgttctcaatcctgacctccaaaagctctgctaagtcataggttaataactcaccagcttccccacccccgatattttgcttggcaagtaactcttaaattcatctcaatgcagtatgaatacattccaaatttgagtaactttgttttggctaatttatttttttacttaaaataaaaaaaaacagtgtatgaaaattcttggtattcaaagttgtgtgttttgtagatattttctttaaaataggtttaaaaaaatagctcattttccaatgggaaaactgacagttttatttgctgatggtaaaattcaagcttaaaagtgaaacgtaagtttctgcattttctgatgtcatcggtgactgttgtcgagtgtgggtggggtcttgagtctgtttaacagttctgctcatgcatggaagatcaccatagctcagtgagcagcctcatgccaaagatccagtgtgtcatgttaccaaataagtggattcactcttggaatcctgtactcagactgaggcagaaggattgcgagattgggaccagtctgggctggctgccaaattttactgataaattttcagatttgacgttttattgaatctctgggagattattgttccttccaagtgccagcatatatgtatatgtgtgcagtgtggtatatgcagtgtctagagggagtggggaggctaggacagagaaagtacccagggagctgaaggggactgaagccccataggaggaacattaatatgaactaaccagtacccccagagctccttggaactaaacctccaatcaaagaaaacacatggtggaacttgtgtctctagctgcatatgtaacagaggatggcctagtcggtcatcaatgggatgagaggcccttgatcctgtgaaggcttgatgccccagtataggggaatgtcagggccaggaatgggagtgggagggctggggagcagggggagagggggataggggattttcagaggggaaaccaggaaaggggataacatttgaaatgtaaataaagaaaatacctaattaaaaaaaattccctatcaaatttgcttctagaagcagagaatagtagggtcagaatgaattgtaaatatttacatttttctgtgtctctttcttggtgtttgaaattacaaaataataataataataataataataataataataagctcaaaagcatcattttccttataggaaaatgatgtcatttggaccctaatatatttttatattttgggaaatgatttgacgttatctgtaataactaaggggagcatattctttttcggttggtaggctggcttcctgtttgctcctgtgtcgcacagaggcttactatgtggcacatacagaagcgcactgcgttaccttctgactcctctgcttcctagctcctcctcccaaatgctgggattaaagatgtacgccccatacttgctgatgctgatcattggtagtacataggaacattttcccaagtcagactgtgtttgcccattgagtgttggccatattctcagtgtgcaactgcatgtcatacttaccgttgtaccttttcccatgatccatatttcttggttgtgtaatcacagaatctgttttatctttttcttttcttttctcttctcttttcttttcttttcttttcttttctttccttttcttttctcttcttttcttttttatagtgctgattagtgatgagctttggcaccaccaattgccagctccctaatttctcccccgaagtaattatatctcgttttcccacctacgcgcaagcatgaatttgtgactaatttgaaaatcatgagggaaaagactcttaaaagcctgtcttttcctgaaataacgcagtggccttgatttatagcagctgaattgtttccatcccttctgtaaatacatcagttcgacagaaatagctcaggccagctgtacctctgcctgctccagagcaccaagggccttgggtaaccgagactcacacaggtgtgaagcttcagtagaagagtgtaggtcgtgttcaaggacacatttcccatcgttctcaaatacttaggggactctgatgagcacccaacctacattaaaaagtaagtaagtcacacctcttcatcatcaggcacagcagttgacccactcattccacgatggttcagagaacctgtcgtaagccaggttatgctgtagacatcacaaggaactaaaaggatgattgtaacatgatccctcacacaaagaatgttctaacctttaaaaaaaaaataaatgcactccagtccttcattgaataattactattgagtgctactaagtgctaggaatccaatggtggccaagactcagctatggaagtataaaaggagactagagctccactgtagtccagaggggaacgggttcattttatgtataagaaacagggcttcctataagcgacatttgtgctctgacacccctgtgtcttagtgggtaaagatgttgtcttagtcagggtttctattcctgcacaaaacatcatgaccaagaagcaagttggggaggaaagggtttattcgtcttacacttccacattgctgttcatcaccaaaggaagtcaggaatggaactcaagcaggtcaggaagcaggagctgatgcagaggccacggagggatgttctttactggcttgcttcccctggcttgctcagcttgctttcttatagaagtcaggactatcagcccagggatggcaccacccataatgagccctcccacccttgatcagtaattgagaaaatgccttcatgagatccagttgtgagacattttctctgtaataactccagcttgtgtcaagttggcacacaaaatcctccagtacagatgtagaagggtagagtttcaggacaagagaccttaggaatgttgcagtttgccaaccaatctctatgaaaattgtccaaagggtggtggtgtggtttcctcgctgcccatcccaatgttctgggttcttgaatgaaacacacacacacacacacacacacacacacacacacacacacacagccttatattttaataagccttaaa

SEQ ID NO: 536 - DNA, 2250 bp, Mus musculus
aggtgataaaatctttttctttctttatttaatttttttcttttatttttgaaattataattgcataagttccccttcacacccttgttctctttaaacttcatggcacactttgatggttttgagcaaagctcgccgctttctcatttatccactaggtggtagtgtttcctttctaataactcatggcaggcgctccagcgaacacaatgtactgcaaaaatcaccatagttcctgctgcagagttattaaaatttcactatggtgttaagagttattccacaaagagaatgtgtggtgtttttcctgtaaaaacataatttttggtactgagttagttcatactttggcatttgtctgaataaagatgtccctttatgccctgtaacttaatttataatgactgttttagtgataaccaactgctttataaaaacaactttatactatgtaatcagtgactgtgaaatatttcgctttgaagaatagcaagctcaccaaccagcaaactgggtgtaaactgaagacattttaggaaagctatttactttccaatttacaagttttttcttaaattaaaacatttataaaatgcactgactacgattgttttttaaaaaactaatggttctctctctctccctccttcccctcctctctcatttttaatggtaaggaaatgagttaaacctctgtgctgtgaagtgctgaaaaacaaatcagcaatctttataaatagattttactgccggcttagaaattaccttctacgctttttaggtgacagaaaaaaaacgaagtcaggcggtgctttgctctgcgcatgcatcttgtttgctgtgtcatttccgaaaggattatgggacattggaggtcaagattctctaaatggggatttctaagaagtgatgaaatgagaaaacgaaaataaagcaggttcagtttctttggttttaaatttatttgcacctctaagttgaggggactcctgggttggaagccagtagacctatgttctgattttgactaagctatgggtggctgaagcaggcctgacacaaacaccggaggctgcctgtgagctaggctagtaactgcaagaggggaggagggtcctggtcagaaggaatggctacgggtacagtgttcagtgctgactgaggtgtcagggcacattcccagcgcagggttgacaccagagtctgtacctcctgcctgaagccaagacttttttctaaagggtcttcaggtagctgtagaagtccaagccagacagaacccacctaggtgtgctgtgcagggaagcgccccaccccacccccacctcaccccaccctcagcagagagcttctgtctcagggaagggagggaaaccacaagttcaggggttccggtgcttgcgacttttcgagatttctcaacaaaagcaaatgcatgtgtgcttggttttctcacacactgccacggatttattcctcatgactccagaagctaggaagtccaaggtcaaggcccgcctggttgccagagaagacggtcttggagtggttggctggcttctcaccatatcctcgtgtggcagagagatctactgctatgtcattctcttttcaggggcaccagtctcatcttgaggctctgctctcttggaagcctggtcacctcccaatgcctccgccttctagaaacatcctttcatcagagctcgtgtaggatgtgaacttacagccggtagcatcttacttagtgacagtcattggtcacgtggataaaaatttagctggcatttgagttccactctatctgactcctgagacctaagtaccattctcctacactgtttgctaagccccagggatgctaacatttctttagaaaccccacttctttctgagtagtactgtattagggtctcaccaggacatcctgctaggaagatcctgaaatcctcaggatttgtggtgggtgggatggttctggtgctgaccaaccaacagaaacgtagaatccagcacatagctgtgaagggttatcttgatgatgctaattgatatgggaagacacatcttaattgcgggtgggattattccctatgtagatgattctggactgggtgagatgggagaaaggaaaatgagcagccacacacacctgttgctctcttcttccaaatgcagacagaatgcgactggctgcttcgagctcccacttctctgaccgtccagccatgatggatagaacttcatgat

SEQ ID NO: 537 - DNA, 2225 bp, Mus musculus
gggggactttggggatagcattggaaatgtaaatgaaataaatacctaattaaaaaaaaaccatgtgtggagctgtgtgcagaaaccagcagaggataaagccagcgatcaggacgggctgatccaggataggctgagtccacagtgtttattctgagggaatggagacagtgagggtgtgatggacagcgttcagagtccgcagctgctgggtcagttgccatgcccagcctttcctttgatttagcgagagaggaaccatttgtttgcttaatatagagttgggatacttttgtttgtttgtttgtttttgttttttgtttttcgagacagggtttctttgtatagccctggctgtcctggaacttactttgtagaccaggctggcccctcgaactcagaaatccacctgcctctgcctcccaagtgctgggattaaaggtgtgcactaccacgccccgagagttgggatactttaagttagtggttctcaaccttcctaatgccgtgaccctttaatacagtttctcatgctgtggtgacccaccccgcccccacacacaccataaaattattttcacggttacttcataactgtaattttgctactgttatgaatcaatgcaaatatttctggagatacagggctgccaaatgggtcacgccccacaggttgagaaccactgctttaagtctcctgctccacctcatccagccccacccataacagtttccttttccttcctaaggccatttctacagttcaaaaattcttgatatttccacattaggaggtacacagggccataaatgccactgagcaggggtgtgaggtctcagtgctccggaggccagggtggcccctgcagtccctgctctcctagagctttcttgggaaggtcaggtcctggcaggtgcccagggtgctggaagaggcagggcgctgcgggaatccaaagtcgacatcactattctgctcccctcctagagcttcaggagctgccaggagggatgctgggcattttcctgttgctagtggcaacgtctgtatcccagtgctcagaaactccagtagctgagcagcccccaaagaatacttgtaggggcagcagtggagattgtaccgagtaggtgacccatctgacaggagcccggggcaggctgggaaacgggtagtgacagaattgtgcagctttgtgttttaaatctcattgcccccttcttaacctgcaaccccagtggggctccctcagcctctggaaggtaagagctgatgaagcaggaaaggggcagttttgggtgtgcgcaccctgtcatggcttcaggctgcaccaagcttgttccagaacacccttaccttcttgtacccactaacgctgggcacagctattgcctgccctccaggagaggtgctgtgtagagacaccaaggtcagatttaagggaggggagaagagaagtgcgaggggaggggagaagcaacagatcaaaacattcccagaaatcaaaaccaccttcaactttctccacatttgagtgaacattttgtaggcacacactgagctatgaaaggggtggtgcctgaatgactttggccaacaaaactctgaggggtccacgagatgtgtttgtgaagggagcaagtccttgaagactctgggtgatgtaagaggcttttgccttccggacctcttctttctaagccctgaatgtgactgccatcttagcaggaggctcatggcagtcacccctgcttgtggctcagactgcctgcccggtgttaacctaccgtattgatggaattagcttctagatggagtttgcttgtatattttgtaaccttgaggcagtgtctctcacttcttgccaacaccctccccccaatcactttatgtttactccagcatctcatctgtacttcttagatgataaagatatatggtgattatcaatgtaagtttatttcaaataatctattgatctgaactattacatttctaagataactttgttttgattcaaaggaaagctaaccagactatggagttgtgcagccctacaatggtgttattgatattgttttcaatatagtttcaatataatttccaaacactttttgaaaatagctcttctgattcttaggatacagtatagtgtttgaactgggtctctacattgcatttaagatactgcagaaaacatctaattttgctgaagttacccaac

SEQ ID NO: 538 - DNA, 2775 bp, Mus musculus
tagagtattctctgcaggaaagctctcttcttgcagggaaggtacccagatatctggtgttcgaactggactcctggcagaagttgtgttccactcactagaggtcttaggatcccgtggggaatcctgtgtgggcccttgcgggtgccaggcgactccgctggccaggaagccctgggctcgagtggagcggaaggggcttttgtcccgggtcaggccagggcagtctgcttccctatgtaccgcagtctcaggttccgcgcgattggattggggccggcgctgtgttccactcaccagaggtcttaggatcccgtggagaatcctgtgtgggcccttgcgggtgtcaggcaactccactggccaggaagcccggggctcgagtggagcggaaggggcttttgccccgggtcaggcccgggcagtctgcttccctatgtactgcagtctcaggttccgcgtgattggattggggccggcgctgtgttccactcaccaaaggtcttaggatcccgtggggagtcctgtgtgggcccttgcgggtgtcaggcaactccgctggccaggaagcccggggctctagttgctccctcttcttgcaagggcacctagtatcatcacggaggcctcattctcaaggccttatcttatcctaactctctcacaggagaaccccttccaaattgttttagcatatgaattgagggattaaattatcaacatatgaacttttgccacaacagtgaccttacttgaccgagctctcaggagtccaagccaaagagactgaatgcatgtacgacttttgtctgaagtagacacctagtgcctaactcaggaataacccgtgtctctctagcatccctccagtttgtggcaggcactgacaaacagtcccaatcttattgtggagccggaggaaaccatcactgggctggagatactcccttctttcgcattcttgacctttcttagataattcaagtttgtctttaaggtgcaaagggctctctgtgtgtagagattgcttcctatcaaatgactattttggatttggtccttcataaggtcttagctggtggatgttttgtaacccgcaaaattctgctagccagaggttaatactctgagaggcaaagagctgctttaaaatcgctagtgaaaaaggtgggctgggcagtaggaatatagaactgcatctctgtagcagactaggtttccatggaaacagatgcagctgagtcaaacccacgagtaaacttttccacgttcagtattaagcttggaatgtggtaagaaacagctacttactggccagacctagggaagatttcagcaagaccctccacaaaaggctcaaaacaaaacgggtatgactttacatgcacacacacatgtgctcatgctcacacacacacacaatctctctctctttctctctctctctctctctctctctctctctctctctctcacacacacacacacacacacactcgtacaagcacacacacacaagcacaacaatatgagaacccagcttcggcctcccgcagttacctagtttgctaatcagcaacacaggcccacttggggagtaaaaattagtgtaactcattctggaaacagcactgttaagaaacctttaatgagcccagtggttataatttgaagtgttgggggtttaatgaaatacaaaaatcacactttgcagacccaaaagcccctcatttactggagacatttacgaagcaggaggtgtgatgttgctctgtgggaaagcttcgggcctgcaccttgtgtgagccacagaggtcttgaatcagtctttgttccctgagctgtcagaggtacaacaagcacttctgcgagcaatcgccctgcgccccaggaagcttaggagtccccggtggtttcccctctggtggagagagagaagctgcaggacacttgagcttgggagaagctggggggagtttggaatcctgcagtttcctcctctttctgcttacagcagggaggactgggttccgcccagcgtttgcaaatgccctctgccagcaacaccaggcctcagcttgttttcttggttttaaggctacctgctggttctttgtaaaatttagggcttcaacctgtaagaacaaacttgctttgcaacagagaacgcaggacacagggagccagggagccagggagtcccgagggacaactttgatttgggcataacttagagtctctggctttgcatgactaggcttgtgatgtgcctgtgtcttcaaacaaggtctcatatagcccattagcttccaaatccctgggtagttgaggttggtcttgaactcctgctcctcctgctcccaccccacccccacctcccacggctgggattacaggcatgaaccaccacccttggtggtgtctgcgctttgaatgccagtccctctgccatttctcatggcttgaatgtgactgtctcctcaaggctggtgtttgtcacttgtctctggtgggtgggaggtttagcatccagctggcaatagatgcaggctattaggggtgaatcttggggctctttccctctgttgcttctgattctctctctcctttctgatccaacaagccatgtcacgaactcctgccaccacaggacaagctactgcagcctgcatgccttcttctggactatggcttcccatcaggatggaccatcccactgacactgtacagagaccctcaccaccttaccttgctgctgttcggttctttttcaga

SEQ ID NO: 539 - DNA, 1850 bp, Mus musculus
ttgctttgagacttgttgtgcacaagaggccaagaagagaagagcagggccagcccacccagagctctgttccattttcccaatagaggagaatgggcaggggctgagggctcagggtgtggtgcaggaagccaagtggacagcatcccttgacgctccagaagccccaggatgcagcgccagagggagggaaggacgaaagagggaagggcagaaaaatggatcccgttgtgcagactctgaagtctctgatgaagggctcctaagggaccctgagttgtggctctactccagggccagacctccgaatgaaggcacctggcagggaacagggatcattctttcattccctacaaggcctacctcaaggctattcaccaggttgaagtggggaagacgacctccccttccccatggaatctgtgaggtgcagccattgctgttctgcccgtggttgaggcagaaagctcacgttgacttagagcctccgagtaagtgtttacgagaagtatgtgcaatccagacaggaggtgatggtgattttggactgggatggattcagatcttagaatttgaaatccaggagaaaaatgatggctggtgagaataaattaagccatgatcaggaggggtgggaggagctaagtggtacctttgaaggggtgggaggagctaagtggtacctctggaggggtgggaggagctaagtggtacctctggaggggtgggaggagctaagtggtacctctgaagagactgagtgtacagacagtagccagatcctttgtggaggtggggaccgaccgaccgaccgaccgaccgactgacacctgcaaggacctgcccaggagagcagcccattgttaacagattcaagtcctgccatgagtcaggggagtacaccagctccttggacagcagacagccggtcccaagcatcgaggacttgtcagttactgacagctgctctcattcgcttcctgcttacagctgagtatgaattcaagaaagccaaatgtgctcgctaactctccacactggatgcccccacttttactagccagcttgccatgtccccacgccagcgcctccagcttgggcagaccagaagctttccctctgtcctattctaacttggacactgccctccgacgcctagcttggagtttttcccagaacaggccaatctcttagtagagccaactctgaacgagtggcatttgcttgttttttaatcacactggtctttattttcatgattccagtgtgttttgtgtgtgtgtgtgtgtgtgtgtgtgtgtgtgtgtgtgtgtgtgtgtgtatgtgtgtgttgtatggtgtgtgtggtgtgtgagatgtgtgtggtgtgtgagatgtatgaatgtgtggtgcatatctgagtcatatgtatgtgtgtgcatgtacatgtgtgtcggcatggaggccagaggaaggacactgggtgtctgtactagcactgtccattgtatgtttgtgcagtaaatgttcatgcgcactgaatcaccttcccaaccccttcctgtcccttttgatgttttcttccctgtgatgggttaggggcattggtgactcaacatcaagtgggcattacaaggctaccaacttcgaatgtttcctgttcttccctccctctgcatccccttgaacacacttctttttcaccagtccttttcctttctccctcttcttcctcttcccctcttcccttggtagaagtctaagggcctggtcatagatgctgatcttaattacgcacattgctgtgttgagagatcctgaggagagtggtaaagcccacttctgtgggtgtgtgtgaggatggatctaga

SEQ ID NO: 540 - DNA, 1975 bp, Mus musculus
gaaacttcagttgagaaaatgtctccatcagattgtctactaggcaaaaaatcattgagtattttcgtggctgaggatttaccattacaagtgccatcctgaacagctggaataagaaatcagtctgcacaagataataattctattctttcatgacatcttcttcagtgcctgcctccaagttcatgtttgatttcctgtttcctgttctgactaccattcataatgtactgtaagatataagatgaaataaactcttccctctccaaaaataaaaatataaaaaagtaaaaaatttaaaaattacatttttaaaattaaaaaaaggaaaaaaaagaaaagaaaagcactagcaaataacatgatacatattaaggcagagagaatactccaatcaggtacaatatctgcagtgtgttagaccagcattttaggagagccctgttaattatactttataatttcagatgttttgctttggactaagtgaattctgagacgaaattctgtggatttattacaagtctaatgtagagctgttagtagctgtggcttgctgaaactataaacacagttatactcccacacaccagtgagctggagataaagcaaatgaagtttgaaaataaattaggttaaatatgaaaattagaaaaaggactcaagttgataccgagagcctggttatccaaccttctattaaatgcttgaaatgaattaactttgcaaagagaaaacgtttattttagttctatggtctgaaggcttgttctgcatttgattgactatgttgcttttggagttacaacatgacagcacatcctggcatcctggcaggagtctgacaggaccagggaaggcactcagctagtgactgggtagaagaggcattcaggatccttccatctctttttaaaaattatctttaatcttttttttttcaatccagtcattatccccctcccggtctgccctccagcagtttctcatctcattcctcttctcccatctccaagaagacctccccattctctgtggtttcaagtctctagagggttaggtgcctcacaaggccagactagtcagtcttctgctttatatgtattggggccttgtaccagctagtgtgtactgcctggttggtggctcagtatctgagagatctcagggatccatgtcaggtgagactgctggtcttcctatgaggtcgccctcctcctcaacttctttcagcctttccctattggttgggtgtaagtacctgtgtctgtcttagtcagcttcttgttgggcctctcaaacggcagtcatgctaggctcctgtctataagcacaccatagcatcagtaatagtgtcagggctttgagcctccccatgagatggagggccagcagagtgaatggaaatatgcaaccttgggaggtgggaggttgggggacactgagaaagtactagagacctgggaggtgagagactctcaggactcaaagggagagaccttagataaaatgcccaacagtggggagagggaacttgtagagtccacctccagtagaaagtcagggcataaactgctgggatggggttaccatcccacagtcaaaaacactgacccagaattgttcatgtataaaagaactccagggacaaaaatggagaagagacttaaggaaaggatgtccagtaactggccttccatctctttaaggagatgcatcttagtttcctctacctctcattcctagtaacaataaggtagggatctggtcttttccgtatgggactttggagaacacttcatattgaaattatagtgagaactgtgtatcaaggagtgtcatagctattgtcattaacttatttatttaagttgtacaaataagactaactcaggagagaatcttcaatgcttataaatacctattgcctcaatgacatggtaataaatatgtttttaaatatgcaagaatgcaa

SEQ ID NO: 541 - DNA, 2875 bp, Mus musculus
gtcaaacatcccagtcaatggttgttggccccatgtgttcagggtaacagcaacgtatgacaggggagcttttttgtagcagacagaaaacagaggaaaggacaggaagggtgccaacccccattgacttacttcctctagttaggcccacctcctcaagttttcaagaagttccaaaacggcacccccagctagggaatgtgtataaacacaggcctgcaggggcacagtcaggtcccaggccatggcctgcataaagaacaaagagcaaatggactcttgttaaagccacagccatggcacaaggaaaagtgacagggtgtcacagaggtcaggaacagagtgtggccaggaggtcccaggatgaatgtgactagtggactggcttggacagagaaagttcaaaaacagtgaagagaactggaattgaccatcgggcacatgggaaactttcctgggctctctgatcaagtttgaggggaaaatacagggaacagagggagagacaggaaggagaccaatccctctgactgacaaaaatgccttggcaaaagtattgggtgcttggttctcaaacagccacgtgagaactttcaaatagagaagaaagaatctgaagaagctcaccagggataaagaggacacccgggatggtgacatgggacatttatagggaagcaaacgctgaggcaattgtatcagtctctgaggaaattgagaggttctggatatcaagagacagcaaggggttgttatgagtagcagagaggaaagagaataggatgatgcttatgaagaggaaggtgtgtggtccacacccagcctcacttgggcttcctaaaggactgtggatgagagagcatcatcctaaggacagcagccaggagaactgggtagctcagagtagagcagacactcagaggtaaagttcccagctagttctgagaagctagcctgaaccaggagaccagagtcgaggtctgtggatgacagtgtggcctcatgaatgcagagcctcacagtttggcgtgtcttccatgcgttgtctaatttaacacccagagcaccccttttgagtgtaagagacccatttgaaagcagaccaaaggaacattgtatttgtcagtgtcctgcttgagtcctaggcattagcagaagcctgggactcagggcttcagcttctccaaaggcaatgcctgtctgctttcctggagagccactcactggctgctgctgaggtacaggacaggaagcaggaggctggtgaggatggggcaggatagtgggctcccgagcatggggcaaacctagcaggaggggccactctgcagctgtgtttattttggaaagtactcttagcctcttgctttattttcagtgaatctgatgaccagggcagggtgcaggcctcccaggttaccacagaccagccatcccttggtaattgcacccagcatatctcttgcacaggatgagtgggaagaagccagcccttccacacaatcctaatttgtcctccccagagtgtaactctgtaaagcattatccttcaatttagtagacgtgactttatttcaccgggaaaccatgctaaatgctattcttgtttagaaaaaaatattcccttaaaccatcagatggaaggcagactttaagggaaatggttctgctaatgtccatctctaactctgcaaatttgactacttaggcttagcttgtgccttattctgtttatatccatttaccccttctgcctctaacagcctctgatgtcatttttaaactacctgcatgaatgtattagcttctgacttagtactttcaattctgaaaaagcaaaattaaaaggcgggagtgcccgaggagtgtgggatcacagaagctgtgggctttgggcagcttgctttgctcctccgggatggacttcatgaagccagctcctaggcgtgttacgtttcataatggatggccagcctctgacgacttagcaacgatggcacaagaactctacatcctctgcttagagaggaaagcagactcacttcaactctacgactctctgctcctctccaacatgtaggctctggaactgttccaacaggcctgctgcacttaataagtaaattcagaaattctgggcagacatccaaaattcaaggatttgcttaagttccctttagttgttgatttgtttcatcttcttaaaaaaaagttggctgagaaattgagatgctatacctcaatatatatatatttacagctagagaatgtaagtgttaatattatgatatacctcagtatatgtatttatagcaagaaaatgtaagtgttagtatttcaacatgagatgatctgaccttgattctttgacaatgcagctaccagaatgcaccagaaatatggtgatctttggttaatctagttgatatacgcaaataatatcaccatactgagcggcacactgtccttgggtgggagatgatatttttcgtgtacggagagcaccatcacataagtattcattgaaaaagacttgggttgaatggctttggtatgggcagcattgctgggtcttggcaagctttcagcttcctctgaaagattcaagttaaaatgccggtagttcgtggatttagagtcactggcaacttaccagttattaccatctttctttagttttttttaaacttttaagaagaaactatttcttaaactaccattcttaaaaaaatggctgagcaattaagagcaagtgttctttcagaagactcagatttggctcccagcatccatgtagtggatcacaaccattggaaattctgattcttgggatctcatgccttcttttgacctctgtgggcaccaggcacaaata

SEQ ID NO: 542 - DNA, 2250 bp, Mus musculus
aaatgatgaggcctttattatccgaatttctttgaatattctcatcttcccacagaactggccactaagttctcagacccaggggcttttccagacccacgttcccaaaacgtccactattctccccaaaacaacatagccaggtccatcagcaacagctaacgatcagtaccaattttctgtcatacgtggctttctgttgctgtgataaacaccatgaccaaaagcaaattgggaaacagcctacttcattttacagattacaaattaccgtgcatggctgagggaacccaagacaggaacctaaaacagaaatctaaagcaaaaccgtggaagaaagctgattactgattggctggtaggctcacagtcagctaccttccttaccagccaagcccacctgccaggcatggtaccattcccaagatgctggaccctcctgtgccaattactaatcaggaatatgtcccacacacatgaccacagaccagtgtgatggacacagattctcatgtgaggtttcctctttcctgtttttcctcttcccaattgacaaccaaaattagccattgctgccacacaagtacaaaaggcagtggtgaggcaggaatggggacagcaatgacggcgagtcaacagctgccgctatgcatattgcagttcagcctagcaccacagtgatactgtaagcaggaggatggggtagagccaatgagtgactttttttaaagatagggtctcatgtagcccaggctactcttaaactatacagctggggcaaattctaaactcctgatcttcctttgccccaccttgaaagtgatgggtttacatgtgtgtatcactatcctccagtctactctgtgctctgcgctccttgctccgtgatgaagattcaattcagggctttgcgcatgcccggcaagcagtctactaaacaaaccacattcatagcaggagcattggcttctaggaactgtctgctagttctagcagccagcacagtcctcggacctggagtgcagagctatgccatcaggggtggctgtcggtgttcgggagaacagaccacagagtttgctgaaaggggcaaaggggcaaagctgtgttcacctcagctggacacaggcagcaagaacacagtgacatttagaaggctacttatgcgtgtttggttgcttctctctggttgccgggaggagcaagcgggagagcggaatagagctgcttgctgtctgcgtcagggtaggaagagggtggcctgctggttctgcagctggggagtaatgggcccttattgcttggaggctgcaaaactctaattagaatgaagatgtagtttaatgaggatggaagtgtaattgtgcctggcaggcttccctccggtgccgctttcctgcgggcctcttccagctctctccggtgggctgcagttggagtaggtgggttggagagggctgggtctgtgatgagggacagttcagcacctctctttctcctgcaagtcttcccaagggactcctccagagctgtgggagagagaaacttgcccccagggcttgttccacttgctccagccctttctttctccactcacccagtgctaaaagagccacactctacggagtccctactaatgctgggcatcatgcactctctttatagaaagcgacctatatgatccttgaaagcatgcccattgtacagatggcgacactgaggcatgcagaaactatagtccaagtgggaatttattaggatgggaaaatggactgagacagtcctacacaggaaagttctggggagtcaggataatgaggactgcttatttcctgcctcctccagcccagtttctttaatatcagacattctcttaatgtaaatgtctgatatgtgaccctgtaaaaggctcattcaacccccaaaggggtcttgacccataggctgtgcccggtactctggggcaggggatggggtggggtgggtgggtgggtcagtgggattcagatctcttggaattggagtcacagaggttcattagccaccatgtaggtgctgagactcaattcaggctccctgaaggatcagcaaggagaccctcattcataacaataacaccaccacttcctccaaagcagataacacaagcaagaattaacgcccacaacatattcctagagctaaagattctgccaatctcagggtgtatacctttaattccagcatgtgggaggcagcccctgccacacc

SEQ ID NO: 543 - DNA, 2425 bp, Mus musculus
gggccatccctgggctgttggccctgggttctataagaaagcaggctgagcaagccatgaaaagcaagccagtaatcagcacccctcaatggcatctgcatcagctcctacctccaggattctgccctgtttgagttcctgtcctgacttccttcaatggattatgatgtggaagagtaagccaaataaacccttccttcccagcttgctttgatcatggcgttgcatcacaacaatagtaaccttatccaagacactgaacaagtgcaattcttctttggggcttcttaatccactgcagtagcactcactagcactaagaaagggtcagccgctccattctacatgtttatcctagtcagcaagcatttactgagcacttactctggcctggcactgatctaggtactaggcatacagcagagataaaagaccacaccctcttggaactacctcgaaggatctcacagatgttggggtggagggtgcttgaagggtgggggtggggagtgttttctatcggacccgaggctgacagtgtcacagctactacaatactacaaagcgaagtggaaacaacacagttccgatagtatgggctcttagcctcgcagcctcagccttgaggtgggccatgaggcagaggtcacctacccaagaagcagccggcaaggcctccagggaaatggtgtccggaatggagacgcaggggctagtatgtgcctggcacatcctaatcttcccagtgatcttcacgcagctggcgggcctcacaggcaactgtgttcctttgccttggcatcttctctcaagggtcaccaaaggtgataggcctggacctgacaaggccttcgcaaggactctgttatatgactagatgggaccgggcctgggcttggcgttaaaactaggagcggccatggcaggtgtaaattatgcatagctatttctagaatcttctcagatttctcaagagagagaaattaatttgcctgtttgggcaaataacaccaattttttccccctgcttaaggtcattttgttaaaataaaattgattaacgttctctttaaagtttaagtagaaactgctcaaacatatttttatgcacagaagcacggcttgtgcccttcagtaattaataactccacaaataagttcacacagcgtagcccacgctcagcccctagcagcggcggatgaaggtgggaggggccatatgtgggcggggccgttcaggccggacaaatcaggaccagagggcaggccttgggggcggagctggctcagcagggtgctcagggtccggaggtgcctgggtctcctggcccgtgtacttggtgattaaaggagatcctcgcagtgcttaactcggtgtcccggcctgagtgagcccgatgtcatccgcccttattcagatctacaacttggcgagctcagctctgagtttgtttgccgcggaccacaccgcctggcttgagggtgcacagctagtgacagaattgctcgaacccaggtcggtggatttccgcagcagttggggatctgagcagtttctgagcccgcttcttttgtcctgtccttcactcaccttcacattctctttctggttgaggtaaataagacctgctgtgtagtgtgtgcttgcactggcgacacccagctttcagcttctgcagtcttgtagttcctcaacctctcttctaggtggcagagagacacatgcgcgcgcgcgcgcgcgcgcgcacacacacacacacagaggattccttgcaggccatttgtggtggagtagggtcacgtgtcagagtggctctgtgtgtgatgagggccctcatgaaggagtacagagactccccaatcagagtactaagttgtcattaggatgctcctgtcctctgcctgggttagtgactacatttaaagtgctggttgctctttgagccagacttctaaacatctctgaagaaaagtccatgtggattcgattcaggattgccatagaacacgagtgagcagtaaatatttattgtgttagccactgaaaatgtggactctttttgttccatgccataatctagcctgtcctgactgatacaggttccagttgacagacaggctccaattgactgtgtgcacacccagtgataggctgaccagcaggtcttatcagaactccagttttcggagccaacctcaggggtccagtgtaggggatagtcacgtgaatgagttcctactttagctacaaagttcagtgcgttaaaaaaaaaattcagcaagcaaggaagcagactattttcatacaatattttcgaaaatcagaattaacacaaaaagaaaaatcccctggacaaaaataaccaattgtgaaatacagatttgatgctgtgacctcctcaccctgatgacatcatcagctgtg

SEQ ID NO: 544 - DNA, 2675 bp, Mus musculus
gactgtcatcctgggattcttcccgtagacactcctaattgtgagggcgcagccttagttgctccctagttgtgggtaacacagcaagaaccatgcaaacgctgccatggtacaaagacatactgtgcaggaaaggataattctactagatgtgcataccccagcccctctcaggcttcttagcgacagcctcagttgcacatcttgctacctagagctaggaccttgcatttgctcctccccaactcatctgtggttctgtcgtgtccctgttcaggtgtcagttatggtgtgtgacacaacttctcctggtgagacgtaatgtacaagtctactcgcccctgatagggagcccacaacagactaaagtatggatttcaccactggtgaaccctgagttttattggggttacttgtaggaatgtgggtgaggggttacttacagaagcagaaatgacccaaagacagctgtatcaccaatgcccatcccagcctgggtgacaactcgcaaagcttgaaacctagagcacactgcagtttgcagggagtttaatgggttgaatcatgccctttccaagtgactgagttggtctaaacctgttctaggcagctgggttgttttctgtttcctccaggcaactggtctggtttcagaaccttctttgtagttgggcatatctgagagtcttctttactctgctgggacagaggcccagattttgtttatggtggcaggggcctagtgaatctagtctgtttcagggacttcctgaagtgattttgaattgtttaccttcttgcttaaggagtctccctgcagataatgtttcaatctcagagggaactgtttcataattggagaggccttggatctaaggaagcagcattcattatatgctgattgggaattctcccatctcttcttgatagagaagcacctcattgggaggcattgcttctaaggatgattgcttgcttgtccagccctggctatagcagagagtaggaaatgccatgtttgtttgttctaagtgtatggcttcccacaacagaacaaggtgtttttaaaattattattattaaaataggggagaaagggacatgggtattgaatagctaggcataaaggaactttagacaaagtagatttagcagagttaataggcgcaaagactgatccacagattggtactaggaactaggaggggtttaggtagctccacccagcaatgatgggagcagtatttacccacaggaaaaggaaataactagttggcaatggctctccatttgcctcatttggatgtggtatgagttgccagcctgtgacctgctgaagtgtgggtgttgtgattgtctgaaacctagctacttgctgcaagaatatattcttgttagattgctcttcatttgcatgctatattaagttacagtttgctgcaaggaactcaaaagtatggagacaaactcaggctagctttggtgtaagttaatttgaacgcataatagaaagccaggaggctttttttttttttttttccatctgtgaggcttaggccagcaaaggttgattttcttgtgtctggaatgtctggaggtaggcaatttagagctggaatgatgtcgacagcaggttaccagggcctcgcccgtctccatctcttcctgtcccatcatgcttagtgtatgtcttcgtctcatgatcaaggtagctgctccatctgcagcaattacttttgcattttttcaggattcggtctctgcatggtataagagcaagagaccagcagagcacctccctttccaaagcgttcctggaagctcccatctgtcagctttccttgtgtacccatgactgccgtgtgtcacttggccaattttggttgcaatggaaagcaggaaataccatctccttcatgaagtacatagcttctcacgccaaaaagaagtttcgtgttgagctaggaaaaaatgagacattcataatctaggacagcaagagtatttatagctgttcacaatggggatttttatacagtggaagcatggaccacctttgcacggctgtcctgggactgagacccctcaccactcttgtctactcttatttttatgcatgttgggattttttttttaaaaagaggaggtcaacccattttgacatcctcctccacagtcaatgccctaaggacctcttctctgttcttggcagcctagaggaaaaccatatctgtgacgaaggggtatattctctcgcagaaggactcaagagaaattcaactttgaaattcttgaagtaagtaccctgtgatggtacaataatgcccagtgtggggagggattttagggtctgagatcaagctctggctagctctggaaacctcactgaggtgtctggtagggaaagcttgctttggactgggcaatgaggataccagtatctattgcttacctggtatctgggtggctctgggaaacattgcaagaactaggtttggtgtggcagaaagggctggcgcctgtggaaggtggatcttgggtcagttatcactcaggagattagaactcctgcaactggagccttcgggagttgacagaacaagctcgacacatatccactccaagagtggagctgctggatacttctcaagtaaacacctttttgcaagaggtgt

SEQ ID NO: 545 - DNA, 5575 bp, Mus musculus
agtgatttgactccataaatcaataaagcctttcccataatcataactcctctcaaatgacagaaaccacagcatatatcaagagggctttggttaagaactcgaatagaaccaacccctcgggctacaagactgttttacctccttgtggctacaaagctgattactgggtcagcaatgtcacttggacacttagagatacaggcccagagacccatcctggcctgctggagcacagcttatgctgaacattttcaagactgagggagaacatcaactaagcccatagactgaagccgcactgcccaggtttaaattcaggctcttaaccaccgtgtgatttagaataagtttttttgtttgtctttttagtgaatttgctttgcttcagttttttcttattttttaaaaagataaggactactattggtctctgaaagctgtattgagagttgtataccaaggggcttaggatagggccttcagcacactgtgcacggcatgtgtgcttgcttcaggagttgccacccccatgccaactctgcactacttttaaggtgaaatgaacagaaatccataccacccatcctgaaggatcccagaatatgtctgctctaaacctcagccggagtcttaaagacagagctctggcttagagactggcctatcttctgcactgtagtctctgggaaagggagaaaagttagagaagaaaaaggtaagctatatcattagtccatgaaacactttatgtgcatgaaaagagaatctgctgagacacagaaccaaaaagccacataattcaaatccattttgctttgaatttgttagagtcccttcaaagccaaccacagctccttggaagggaagagatatctcaagcccctcggcccaactctgtaagtggttggaatgaggaatgtagcacaggacctcatacaagagtctgtctctagaaggctggtgtcccatggctttgctcaagggggatgaaggacccttctcagggtcttccatctcaacagaagatcggcaaactgatcccagattgtttcattgtagctaacccttcagaccgctctctttctgagaacagtcacagtgggaaaaagagcagagagagagagagagagagagagagatttacatgaggaaaacctactgagaagagtgtgatctcacgtgccatccacccctaattctctaactgtagtcaaattaccttaaatgtccaaaaatatgttgtctccccaaaaacagatcatcttaagcaccaagaaagagattgattttattgtcgagggaaagatgttaaattccaccataacagctatattttcatcatagaacacattttccttttgtctgttagttgaagcacttccaataagctattcttctactgcctttgaaaggggaattaatacagtttcagtaagattctatttatttgaaacataacatgtaggcagaaaggacgaattttcaagcaggtgttacccataatataaatctcacccactccctggaggccattctaggctctcatggccaataacgccttcagttaaacagatcaccagacttagaaaaggactcttgaaatgcactctaggagagtcaccatttggctgctctccaccacgtgaaggattcatatggaagcatgctagccttttcccacacgttctttcttccttccctcactcagtgatgtctaataggtccctagcaagtcttaaaaacaaataaaatactatatcaccaaattcaagtttatatgtctaaaatactagtgtttgtttgaagaagaacaaaaggatggacagagacagagaggcggaggagaggaattgaagagagggagagggagagggagagggagagggagagggagagggagagggagagggagagggagagggagagggagagggagagggagagggagagggagagggagagggaggagaatatgatggtataagttttggtgtcactattttatcagagcagccaccaatgctatttccttttgtccttgttttagccaagtgtctgcccgtttttcttaggtagactcaccatagccagactctgctcctgctacaaaggactcagcatggcctcatatgaacacaagtatttgtgacactcaactgatttgtgcatgattagaggagactttgtcttgtcgaagctgccagtttctgaagggacaggggtcgttcatgagactcctccttggagaaggtgacaaatgagaaaggaggactcttctttgtagagtaggcttctatgctttaaggaaggaaagatttcgggctgatgcttctccaggcccttgtaataggaaaaaaaaaaacctaggtctggagtgttaatgtggctgttggcactgattcttattctacctggggtctcaaatatccttgcaataaattccaatcaccctgagtaattggtacacgtttgttcatttcaccccagggaagctgcttggtccaaataccagagctgctcagggctgtagtattggcccaaactctgtgcaataagacctcacacaagagaagaacccaggaatacatgaaccaagctcaggggcccagtgttttatgttcacccttctacataatgtgagacaggtggcaatgtgcccatttgacaggggagaagcctgaggccctgaggattatgttcatggcctgaagctgttcaaatagcaagtggaatgaaaaataggactcagagacctgagtgactccagagtgcatgctctgggcccatcctctgtatgattttatctaatccatgatgaccctgtgaggtagggatgactcaccacctagagatactgagagaaggcagtacagttgacatggccttgctgccagggaagcctggttttagttatctaaggagcagggggcgtgtttcgactaagaggtgtgcagcttagctctagaaagacgagacagtgctaagaatactggagtggtggagggcaggttgcttctatctgattttgagcagccctggggaggatgcatcatggtttgggttttgccgttttctgctcagtttgagttattttccatgagccctgtctgatccttgctttctggattcatttcacacaaaacacatctccactggcagaagaccagccctcctgatatttttaaggcttgtttcatttttgtattatcgctttaactaacaatttgccttgtgaatcctcatctcacagtggttcagctgatggggaaaggcattaaagagaagggatgacctggctagtgaataggccattgtgtgtgaaatagaaatcaattgcagccatgcagattgcaaaagaagctgcaaataaaattactgtaaatttaattaaaacattccagccaagtccatacatttggtattgattacctggcctgcaatttcagggagttaattaacagcctcctcctggacaacaagtaatgccagatctaatgctggttgtcctagcaacaagtaggcaaaagcagcacacagattaaatgggaaggaaatacagaatcgtattgaattagactcaaatgcaatgatttaaaaatatgaagaggcaacttcaagttcaagacacattttctgagcccgagtcattttatgattctaattgggccagaatggagtgttggtgttgatggacaggcaggcagagtgagaagggagggacagatgtcacttcagatcattcattaccattagagcattccacccagcaggcttagggtcctgtctccacaagaagtcatctaaagggaaaataggccattgtgaataatcccttgcatcaacaaagagaagcatatttattttctcttccccagagcacaggcaatgggaagaagtccatcctagaagccaccatggaaactttctggtcccgtgttaatgcctatgccctaggcactaatgcttatgcactcgggactcctttcctggcttccctggctgcctatagactctgtttctttttgatagagatagacttctgaatctggtggctacatgcaagttgcctaatggcaatggtccttaattagccttggacttacaacgaggtgccaccgattatccagtctgtaactgaacaccaccgtctctcatcaaaactgccaaatatgtgcatcttactcatggaggtcttcctagggttcccaatttggtattgcactggtctgtgttatgctgttttaactaatgccaccggatgacacatttttgcagaaagggcatttcttctctcagttctggaggctggaaaggccatggcacggcatcagcatcttcttgattcttcatcttatggtgcaaaagcaaaaggatgaacagcatacaccaaggggggagaccaaggtagattctcagcttcctgacaatctgttctatgggtaattaactcattcttaaaacaaggtcatcgatcctttcatggggactgtgagtttacagctcaatcgtctcccattaggccccatcttccaagaccagctcagggatcgagccttcaacatgtgggtctgagggccataccctaactacagcaggtattcagcccctggttttgttccctatgaaacaaagtaatctcaaagaggacagcatgaagatgataatagtaggtagaagttcccccactacccagaatttactccatatcaagaatggtgctggctcctttcctatgtactgtttcactgactatttacaataaatcctaaaagaccacagttttgatattgaggaaacaggttctgtgggtgttcgaatgaggatgttctcaatagtcttgcacatttgagctgtgataacatatttatctgtgctataattaagaatactcttggagctgaagagaagcctcaaggttaagagcactagatgctctaccaaagtacccacattcaattcccagcacctgtgttcctgctcaccatctgtaactccagttccagagggtctgatgccctcttctggcttgctttggcactgcatgcaagtgttacataaacacggatacagataaaatgcccatgaatataaattcatagtttaaaaaaatgatttctaaaatgagaaaactaaaattatttcttaaagggattcacacattactaaaataattactacaagtgtagtttgccacgtaaatgtacctctagctgcctgtgaatcaagctttgagaaaggctgtaaagaatcaggaatcttaaagtcaagacctaccactttccattcgtaaccttgttttctcttgcaaatcaagtcaggacctaaggcattcacctcccttccactgcccagccctgcctttacccagagtctggtgccaggtaaaccaagtgtcaggagtcagaagcaaatcaggtagacactcttggtttgggattaggatgagagaaggggccctgacatataaacacaaactaggtgcactagtgtagaagtgacatgacctgaaagtcacatgagttcttaatgacaaagaacctgaggcagtgcctggcacacgaggaaccccaaa

SEQ ID NO: 546 - DNA, 2700 bp, Mus musculus
agctgcgttcgaataaaattgtatttataaaatcaaggaaccatccctgagctggattttctagtgttgatttaaaatacttatttttctaaagatgttattgatgatggtctataatgacaactacctttgttcattaaagaaaactgacaagcatgaaaaaaatgcataatgaagaaagaaaggccatgaagctgagcagagctggcttccagaacagcgtgtgatcttctggtgtcagtttctctgctggtaaaactaagatgtgatggtgctgacccatagcatctcaaaggtcagggctgcactcatgaatatgcatagactagttaacatagtcacatgtaaccccacctaccacacactcccactccaacttctactattaacttctggcttacaaccagcgagatcacacaacacccagcacaacatcagcctgagctgagctgatacccactttgagtaaatgagtgagggagatggcaaaatgtcaccttagtttccaattcaagaacaatgctttataaaaatgaaggacaacaggaagacataattggtatttaaacagttctctcaggttttctagagaaaagcctatacagcctccacctcgcaactcccaaggaataagaaacgggaagtgaataaaaagagcagctatttgtgagggatgagagctactctgatctgtggtctacgggtaagtattgagaatgtagatagagaccattaaagagcccgcactggtcagaactcggagagcgaccaatcatggggtgtccatccccagtggatacacataaaccacagctcctgcaccgaagcctcaggggacatcatggaagagggcagagagactgggagagccacaggactgagaggcctgcatacgactggctctccgagaactgacagagaagctatgcacacgatactttaacaatttagtggcctaattagttatctaaatgagacctgaaccaggacaacacggattaatatgctgatgcggaaggggacatcctcacagggcccccagccttagacagacaagcacaggcaactaaagacagctgaaagggagacaattagccatccacaggaatgagctctttattagttatccaataccaagttatctttcctgaaatcatgcgcataaatgcagcactaaatggactcagtaggctgtgtgtgtgtgtgtgtgtgtgtgtgtgtgtgtataaagcaataataaataaatataaagaggctgtgaatttgagatggagcaagggagagaagttatgggtggcataggaaggacgaaaggggagaagaaacgatgtaattgtactttcatttaaaaactttagaaaggttaaaaggagctattaacatttgaacgaatcgaaaagaaaaaggctatagcaacacacactataaataaattagccagctctgatattgtaatgcaatactcggagaacaagcatgtcattgaattcaaataagcccaccatggcaggtaataacagatacatcacagaatatagccatcactctggggtctgcttttctgttgttgttcaaatcaaggagtcctcttctggcatctgctctcccacagtcgcatcccctccacactcactaccgtatgagatatttaataagttatgggtcacgacaatccaaagatcaggaagcatcttttagggaaattgaacatgagggcaacatatgtcagctattccaggtcgtgcaacacagtttgctgcacggggaaagtgaggatgcttccatttgttcctcttagaagctcacgcttggaaatgaggagaagcgggaagtggtcatgcacatacgaatccgagcacaccaccagctgagcgcaaggccatctctatactctccctgtcagagtgagatgtcagagccaagatgaggtctgaaggctgcaacaaacctttgtttcacatcagcaatgactgtggtttcaggaggctcttagaggccaatgggatggaccaggcaaagatcagtgagggatggatgggcagggcaaatacccagagaagtgacctgaagtgattccaacagatgtatgcctaaaatgcatccaaaaaccaacagcttttaaagaagcaaggcaagaccaattaaaggaaaatcaagtgggtaaggtagacatcacctgggatccctcctgctctcccttcctctgtcaccctcagtggcaatacagctaagatccgaatcaacccaatggaatgaagcaccaagtgactgatttttcccagccacactgccattgaaaatgtccagcgggcatggtggtgcacgcctttaatcccagcacttgggaggcaaaggcaggcggatttctgagttcaaggccagcctggtctacaaagtgagttccaggacagtcagggctatacagagaaaccctgtctcaaaaatacaaaacaaagaaaggaaaggaaaggaaaggaaaaagaaagagaaagagaaagagaaagagaaagagaaagagaaagagaaagagaaagagagagagagagagaaagagaaaaagaaaaagaaaatgcccctgctgacgccgtcctgaaagggtccacttgtttacttgcttgcttctttcttcagctacaataacctctggatgccagactgcaaacaagcattaaacaaagtcaatcttagagtataaaagta

SEQ ID NO: 547 - DNA, 2100 bp, Mus musculus
tgtgacaaccagatgactcccaacccccatcaccccgccccatgtgattcagcttcccatcgctataatgaaatgtccgagatcgttaacataagagaagagctttgctctggctcatgatcctattgcttatcctattggctctattgcttacagtaaagcagcacaacctggcagaagcccatgagagagcaaaactgatcacctcatcaatcagcggccaaagggaaagaaggagaggccgtggttccactgcccattcgtggacaaaccccagggacctcaggacaaatccctaaggcccaagtcctatgtccctgtaatgccaccctatgggccaagacattaacacatgagcctttagggcacatcatatatcctgactgcagtatccttggagggacatgcacacatgtgcacacatgtgcacgcacacatacacacatgcacatgcacacagacacacaccacacataccccatcccatatcatgccacatacatgcaccacacatagacacacacacatgccaccccacaccatacacacacacacacacacacacacacacacacacacacgagttgatatattcatggaagacctccttccatcaaacacttactgaaggctgaagaaatggaaaaagatcagacctactatctaaccttgaagacctgtcaagcagggaagatgattcatccctacaatacctagcaagatgttgtagctggttcctaggcctgctacaggaaatccttcccacggacaagaatcaaacaggaatctgacccacaaaaggacccactgtgcagcagaggattgtggaacttcgggcaagatattaaaatattctcttgggctgaccaaattctaagcattagagttgatgaacggctttattgaattttgtggataaatatttaaagctttccagggtttgtgtaaatcacacccagcagatgcacttgctcacagcgccatctgctggtagattccagtgttgtgcagagaaattaaaaggcatccaacccagaattgggtctggtagagataaggcattgccgggttgtcccacaacaggagactcagtgcaggttgatgtgaaggcaccaataatcagaagctgcagagcttctgagaggaaaaaactctagaacagccagcagaccaggacgctggcaagagtgctcatagtctcacagtctcaggatgcacactcccaggatgcattgccccactgattataacacctgaaccattacacttgtcacataaaaggtactgcaccgtcctttaaaaattatgttggaggcaaatatcctttagtgtctgttctatatggttcctggctccagctgttaaatgtgcatacctggttgggagtgaatatgggaaccgtcagggggagacaacgaaagaggaggaagggagaggggggagagggaggggggagggagggagagtaactgtttaaagaaggcgatcgtggaaagctttagaactaaacagaaggcagactcctgccaggaggaggggcagcagagaaaagggaggagaagaattaggggagagttgaccaaaatgaaatatgcatgaagtcccatgcaaagcctgttgtttgtaagttaacttatacagtaaaaaaaaaaaatatatatatatatatatatatatatacatatataataaaatgtttttagaaagaaggaaaatatactacccaaaagaattacataggagaagcacatttaatggcatgaaaagggttcagatttgacgttgtaaagctttcaaagcaaagggggggggaacagacagcacaatattgacaacgtatctgtagtggacagaatattggactgtttttgtagttctgcttctagatgttttcaaattttcactagtgtgtatgaaccacttttgctgagaagaaaaagataactaccccaagagtggatacctctgtccttccaccagctgtgtgtggcaggtcacttcctgtggctgtacagtcagagcagaggaagtcaggtcacattgacaacaatggctacagcagcaattcccaggggagtcccttcctgctgaacatagcga

SEQ ID NO: 548 - DNA, 2800 bp, Mus musculus
gtgacaggtaggtatgccagacctaaggacctacatactgctggaggctacaggaggcgaagctgcccttcgttcgcactagtattgggatgtacaaatatgttacagcccatttatttatttgctttggccatgctctggcttcaaacttggggcttggtggatgtcagacaaggtttctatcattgagcgacatctgcagccctaaaaggaaagagggttctggagcagggagacttgtgtgaaggagagataacaaagggggagactcctctaagtcaccctgagaaactagcttgcagaagagcaaaatccttctgctctgcccgctgcaggaactcacagactccccagctcacttcccatcaagcgtttccacactcactttcaagtttatgttgctttagatacttctgcttattctcctaggagaggactgacttggagcagccaccacttgtctctggcctgctctggcagcaaagcgagatccttgagtaggcatgggtattatccagtcatggccaatcttcttcgagtcccattttagcacagagaaccatcaaggcttcagccttctggccagcatcccacgcgaagatgcagagctcagccaccagatccatctccatcttctctcttcctttcctcgcacctacttgaaaactatttctagaagctatgtgcctcttccaggcctacctgggtcactcttgccaaagaaattgtcatattttttttttagcttgcaaagtactgaactttggttttggctgctcatgatgaggcgggggctggcattaggttgagtgtgtgttttgctactaagctacaatccaggaccatgataactatagtattagcagccccaaatccacgagtccctcttcagaaggataacaaaagccatgtggtctttcccagttgccacatcctgctttacctaccactgagcctgcatgatatcaggaagaggaaagaggctcttgggagatcctacctttgctgtccaccaatcaggccccatgtttttagcagaggcccttttactctccaaaattctttcactgatctccttatgggcccctcctgctaccagtcagtcccacccctcactgccccttcttggtggacagcagaagacagttttcctgtcccctcctctgtcatattacaagagggactcctatctttgagtaatgatatctaccttgcgatgatttgaaatcaccatggaaacacgcctctggatttgtttgttgaatatttccagaaatatagagacgaataaggaagcctcactttcaatgctgtaaaatcatttcatggaccagagtctcaagatgaatagaaaggagactgcgagctgaccaccagcgttcatctctccctgcttcttaactggactcttaacaggtgtgaccagctgtcctgtgctcctgctgacatttgttttcctcaacaagagtgggttgaatgccctgaaaccacgacccagaataaaccctcccttgcttaagtttctcttgccaggatgttgtcaaagcagtgaatacctgcccccaccccgtgttggcatttagtctaggctccgccccaaagttacctggcaacagccagatgtgcctgactcactgtaaaaggggctgcttgcccccacctctctctcttgcttttttgttcctgctctgtcctcttgctcctgttcctgctctcccgctttccccatccccctcctccctctctctccatgtgctcatggccagcctctaatcctctactctctctctctctctctctctctctctctctctctctctctctctctctgcctttttctgtctttactcccttatctcccactccccatgcctgagtaaactcattctatactatacagtcatatgactggtccctcagggggaagggatgcctcagcatgggcctgcagaggcacctccttgctccacaccacaccacgcctccaccaagcatatggtgtttccctttcttttataaaacacaacaccccacccctggctttgaactccataagaacaagatgatggtgtgattctaacaaagaatgggaagaaggctgctgtgagaatggagcagacgccttccagcatcttcagcaagaagtcgctctcactgatgatctgtaaggctcaacatagtgtacctcccttccctggcttccaagatctctgttgtctgtgttctcttctccttagagcacttggctctgcagcatagctgttcctgtggttctggcttcacagaacttttcaacaagccaaatatatactaacctcaggacctttgcactggttgttgcctgtgccttgaattctgtttcctccctcccaacctcaagtctatgcttctttctatgtctttctctccctccttctctctccccctccctcccttcctcctttccttcttctcctactcaagtctctgtttggccacttttccatagatgacttctctgatctccctatacaaataatcaccttacggtagcatttcccaccctcactattttttctggtgctctgtgtcaccttctgccatgtcattaactgtgctcttgtgcatgtgcaggtcaagtgtctctcaccaactcatgagcttcctgaagacagacatgtgctgtttcgttctcttctattcccagtgcttatgacaatgccagcacacaatagtctcaataaaaatttgaaaatgcatgcatggatgaacaaatattgagctccaaacatccagcatgtgtgcgccgtgtacacacaca

SEQ ID NO: 549 - DNA, 3300 bp, Mus musculus
acaccaattaacatgataatgtggaagggggaaaacttatagatcttcaagtctagacaaggatctacagggaacataaggaatgccaagagttgggaagatggtctttccgagggaagagcttttcaatatcaaatggtctgccctgagatcatacatacacctataacattatatggactgagccagttgaatttatctacttagagatatgggtgtttgcgtttgtttgtgtgtatgtgtacatgtgtgtaacaataattaaagaaaaagattatgaatttaaaagattaaggtaatgagttgtatcgaagaagttggagctgttgggaacaaaaaaggggggggtcccaggggtccctgtggaaaagtggagaggaaaaatatgccacgtcctgccagagttcccctgtgctctggacacccggacacgggaggactgccaggcgcttttccactcagccccaggtgagtatgcctgacccatgaggcagagagtggagaaaggggcagcccccaactgaggacccccattggaactactttgctaaagccaccatggttgtaggagagagggaataggggaagacgttctcaacactgaccagagtgtgcagcgggccttgaaggagtagagacactctgtgttttaagagctgtattgtagaaaggcagggggaaagagagaaggtaggagagagagagagagagagagagagagagagagagagagagagagagagagagagagagagagagagagagagagagagagagagagaaggaaagaagaagacaaagagaaagggagagaggagagaagacagagggtgagagtgaggggttagaggtaagagcgaaagagtaagaggagagagtggtgagggctgaacacccctttttatggtcttcactgttgctaggtaactggggaggagtttagcctgaaggtcagatgcttgggccattgcttatgtgactaatgatcatacttctcttgtgggggctgtgggaggtgttaccttaggcaggggccggagtgccaggagcatgagggaatgcatatcatgtcatgtaggtgaattaagaccatcagggtcagacctcagcttgactggatattagcctgcaattccccacaggagagaggaaagaaaaggggggaaattatgtaattataatttacaccacacacacacacacacacacacacacacacacactgttatatataaccatggacttttgagtactctaaggaatctactgctcttgtagaaaatctgatctgtactatccctttgtttctgaataactttttattgccactttgaaaaaggaagttgaatatttttagtaatattaactttcaccttctctgaaaattgaattcatttattctgcgaagttctatttctgaacttgttatttattttatttatatactcctatatgttcatgtgatttccctatacatatatttatccatatgtttattttattagcatattaataaagtgcctttggttagaaaagacagatttctctaaacattaaaagctagagatgattaaggtggacttgcttggtggcatattcagaaggttgatcattgcaagattggggtctgacttagttgtgtaataataccctctcacaaacaaacaaacacacctaggataaaatgacaaaaaaaaaatctcgaactctgaaaattcacaggaatctaatggcagaaatattagaataataaaaatatagttctaatgagtagaagaaatacaactttctatttattcagatcctttttaatttatctgaaagctgggtagttatgctatattaaaggtcttatagcttagagaacgtacccaaggagctgaagggatctgcaaccctataggtggaacaacagtatgaactaaccagtacccccagagctcgtatctctagctgcatatgtagcagaagatgatctagtcggccatcatcgggaagagaggccccttggtcttgcaaactttatatggctcagtacagggccatgccagggctacgaagtgggagtgagtgggtaggagagcagggcggagggagggtatagggaacttttgggatagcatttgaaatgtaaataaagaaaatatctaatttaaaaaaaagaaaaaaaaagaaagaaaatcagtaacctaatcttccccctaatggttaagacagcgaatggagactgtgggagaaagggcaggtgttggaagggacagtgtaggctctgagatacacatccatgttcagctgactatgaatcagagcctcatatgcctttcaagggctccctaaaggcaaaggagaaatgaagctcttggagaaacagtaactgtgaccatgggtctctgatagggtaagagtattgtatgccagatccttgactatagagaagagctgtacttaggggacagtctgttgccatatactaacatttagcactacacactttatttgaactatttgagatattttgaacacaaaataaaggaatgaagaaaaacaataaagcatctatgtagccagatgttaactttgatatatggaccttacctcaaaacaagtttacatttagaatctaagatttcatgcctaaccgctgccctcaattctctgattttcctcaattctctatttttaagataatcaggtaattacaataaaatatgtctgttatccacattctctaacagtttcacaagcttcatgattatttttaaattaagtgacgagaggatgatataaaaataccctgcagctttgcactaggcggagcctgcattttaacaatgttttcatgacttttattatctgcctttctgacagtgacctgaaacaacaagttcagctttgtgtttcagtctccacagtgatagaaatgaagagattgaactagtcagacagttttacatctgatattctaaattatttaaccccataacccaggcttgcctattacattgagttattgcatatacataaatgtgtgtgtgtggagatatatatacatatgaatatatgaaatatctgtaatttggaaaactgagtttatttcttcattaaaacttgatttaacaaaatttctttaatacaattagaaagtaggtaatgctgtctagattatgatttctccatatataattataggagaaaatgaagggagagaccaattttccaaatgacttcaatttgaatagggaatggaggctggaataagtggcaatcccttgtacacagagcttcctaatttaaaataaa

SEQ ID NO: 550 - DNA, 1925 bp, Mus musculus
tctggatagttcatgtcacttgattttttttttccagaatgtgtggccctttctgattggtcttgttcacactgcagcctgggttgggggtccacccgtgtcgttgcctgcagtgttaccctgtgcttatttgtgattaaattgcacccgactatagggatgcatgccgtgttttgtttctctgttcattggtaggtggctcttcaaagtgcttccactttagaatcattacaaatgatgctgtgaaatgtctgtttgcatgagtttttatgtggatgcacatcttcaacattctgtttgcttttgagtgtcaccgatccggtgggtaactgtagcttgttgtctcagcacctgtgactacacattaacagccccccccccctcacacccacacaacacgattttgctgtgacagtgctccagctcctgccttcccaaactaagtagggagaaatgaaagaagctggctccttgggacgtcttttacacctacagtcttggggatttctcggggtggggcagggcttaaaaggcaaagagagtttgttctcttactgtaagatctgtataagaagagttgccagatccaaagaggatctgcccagggttcctcaggtttctcttgtacagaaaaaatggtgttaagaaatccattttggatcatgtatgtttgctgggacgtccctttggtgtgccaagggtcttccttgtgtctctctgcaggtctttccctttctgatctggttggtttgccactgcagccggggaggtctctaccagcaggtggcgctgctccgtagcttgtgtctcactagaaaggatatccaacctcccagtgaatgactgactatgggaggttcctcagaccaacaagaggcagcgcccgcccccgcccgtatcaagttggtgttcatgacctttgctgatccagaagcaggtggcttgctgtaggctgacgtgatccctgatacagcgggatgagaagtaactgtatagagggccgtgtgacgtaatagagtgtcggggtgatctcttatttatttaaactattggtaatgttctatttatttctaggctaccttgggggaagctccatacacacaccgcacaccccctattcactcctttgtaaaccccaatgattaaataggctctgcttttgtaaaccgaaataaagcatttgtaagtcattgttttccacgggtgtgcacggatgtgtctcactctggttttaaccttgctttcccccaatgtccactggtgtcactcaccctcacatactctttagtgatgtgtcagggcaaggtactttgaagggccctgcatgggggatgggaactcgaggtccaggaaagaaagcctgaacggaggatgtcggtcttagaatggaagcaaaaggtggatgagagggagacttggcacacgaaggcaagccttggagcaactcctaggccccacccctcttcagcctctctcttgctctcatcatgggatgggtgtgtatattcaggtccaccacaccgaaagacacaagtgtgctcttggagcttgccaggttcagaggagccccatattctaagcaggaatgctctggttcacctgaggtgtagtgtgttccccaccccaaacccccacccaaaggttcgtgtaacagggaggttgccccccagaggttcctggaggacctgtgacttcactgcaacttgggttatgggctggacatggtggcgcatgccttcaatggacgtatccaggaggcagaagcagagaggcagaggggcagaggggcagaggggcagaggggcagaggggcagaggggcagaggggcagaggggcagaggggcagaggggcagaggggcagaggggcagaggggcagaggggcagaggggcagaggcaaaggggcagagaggcagaggcagga

SEQ ID NO: 551 - DNA, 1650 bp, Mus musculus
cttctgtaggcttttctatatcatctgttttcaaagttttaaattatttccggctggagagatggctcacaggttaagagcagtggctgctcttccagaagtcatgagttcaattcccagcaaccatatggtggctcacaaccatctataagggagtctgatgccctcttctggcctccaggtgtatatgcagctgagcattcatattaaatacatttaaaaacattttttttaattgtttcatcttgcatttacaatagctttgcttgagtagtggggttttggcaagagccccggaccatgtaactggatataacgaatgcaggtcagcctcgttttcatcctcaaccaaaataattagaacacaactgctcagcctctcctgtaagaaaaatccacaagaaattacaaatttaataaatgtgagtcttgctatatgctcataaccatccacaaaatagtaccaagattctttgaccagaactttggtgagaacatagacacagactgtctgctccaagtgaacggtgtgcttccctgacattagaacagatgagtacagcaacttccacacaaacacgcggggatgagcagcagagtatttgcaaaggatcagtattaataacgcagtccctgaggcggcgcacaatttctctctttaatttttttatatttatttttttctgttggggcagagggagacgatcatgagtaccacactctgtgtgtggaggccactggacgactcgtgagggacacttctctcatgaggcttgacaacaagcaccttcacggctgtgccatgttagcatgtctatctgtaattaacaaaaaatctccacaaataaaactgtgtgttacagaaatgagagggaaaaataattttccaaagcagagctgaaaataaaccaaactgtaatttaatatatctagatatattaaagaaaacaaaacaaagaaatctcttatcaaagactaattaggcagacaaaaataaatagcaccgtccagtcttagaacggcttggtgtgcctgagtgcttgctttcccagggtgacttctgccctctagtgcatgctcagcgctcactgctgtcactaaccagcagactttagtcctctctagatgatcacagtgctctcttcacaaaccattcccacccttaagctgggtgaattctgcacgcgcagtaactttccacgcctgctctactcatgcaaaaaggcttgttgaaagcactgcagtgttttcacaccctgagaagtgcagcacagctcagacctaagaacacaacaaacatggtctacagtacagacacacctctccggctctctaattttactttgtgaagacttcacacacagttcttttgttcttgtgttattttgttaagtcagggtttgctaacatccctggcttgcctagaattagttgtgtggatcaagccagcatcaaacctgcagcaatctatcttcttgcctctggcttccaaactctgggattaaagacttcagtagccacacccagctagaggtcctttttttttttttttttaaagaacactttaaaagtatgaaaggaggctggagatggctcagtggttaaaagcattgactgcttttgcaggggacacaggttcagttcctagaa

SEQ ID NO: 552 - DNA, 2025 bp, Mus musculus
taccaccctccagccacacacatgcatcaagcccacagaagcatacgagagacacactggtagaagtcaacctgtgacatgtgtcctgactcaacagctcttgtactacaaaactctaaggccttattctgttgttgcctgggccttcatccatgttttcttgcttttcctctattttgaaagccagtcatttgtctctggtaccttaactagaaactcaatctgggtgttttttgttgttgttgttgttgttgttttgtttttgtttttttgtatttcccagtgacgggaagatctttggtaagatccaaagctggaccccagaaatagccctgggttagggtaatccgacatctgagaagccactggtgctgttggaaaactgaatggcagactgggggaggttgggcattcttatgggagttacccgcgatgagtagcgagcctccaggccaagaatgacctccatgcttcttttaacccaggtattttatgggagccttccatgtgctctatggaagctcattgtcacttgaaaggccctattaaatatgaagcaagggacagcaaagtggctaagatcctaggctgagccaaaggcacctgtgagcctgtatcctgctccagcccatatccatgctgtccctactgccccggctgtgtgagccagcacatagtacatgcctgacttggtctgtatgtggcgaaaggctatcatgggtatttgagctacagatgcctctgtttatacacatatctggctacttaccagctgtgtgcctctggcgaggtaatttaacctctctctggacccagattttcaaactggtagtaaaactcaaacctaagggttctaaggacctttgagataagccatacaaagtctagtccccacaacatagtatctgctcgaggaacgctgtgtgttcccattaggctgtaagacagcccctttcggctttgcttgtcacttcctgaagatatattaattatgcacacgcatgtgtgttgcgtgtgagcctatgcatatgagcagagttgcccttgaaggtcagaagagggcattagatctcctggaactggagttatagacatttagcaaccaccacgtggatgctgggaattgaacctgggtcctctgcaagagcagcaggtctttttaaccgctgagccatctctccagcccctgcttggtgatttaaaataaaagcgtcttttacctatgttctcacttgggcaaatgctattagctgctcaccgcccacccccactgcattgcattcttgatttagaaactaatttgacaccctctccattgcagagagctccctgggaaaggcttgtcttccatgagtacggtggcaggactcacccattaactgggttattttaggcaagagtggtttttaactcattaccaagacaattattgtggatctctagttgtttctccctgaaaagacttaataagccccgagtctgagtggtggagttttcctggctgagatgggaaaactctggaaactctcaggtaaaactgtgacacctctgatgtattagagagggacaaacaccctcaccgtttgaggggctcaccggcatgaaactggtgctgtttttgttgttgttgttgttgttgttgttgttgttgttgttgttgttttcagttccatggcattgtcagagtgctggaagatgtcccttacagcagagatgtgcgaacataaaagtgacatgtgtacataggcatgtaatatagtaagcgccacacaaattgggacctagagccttggcactttcccttcacctccaaaagcgcccaacagtcaaggagacttgttagctaggtcttgaaaagagcgagagcagaggtcagcaaactttctggaatttagcatcacctttgtagctcataaggtccagttatggctctggtgctagcatgaaagcagctaacagctaggcagaggtcagtgggtgtggccatgtaccagagggcttgacctgtggatatgggaaattgaa

SEQ ID NO: 553 - DNA, 2750 bp, Mus musculus
caccaatgtttctcagacatgaccccatcatgcccaccgtccttcagctgtctcttgtttcagaaccctctgaagactggaccatcccccatccccatctgacagagaaaccctctatcccgcagcacacctcttcaagtagtcccactgcaaaccacaaagttaaggcccaaggaaaggacacttcatctggacatctctggaaggcttcctgcgagtccctgaggggttgaacaagtgtctctgacctggcttgctctctcctggactctcatagcctgtgtgtgctgtggtactcgtggcctgtgctgtgtctctcatggccagtgctatagctcttgtggcccatgctgtggcttttgtggccagttctatggttcttttttttttcttttttctttttctttcttttttttttttcaaaacagggtttctctgtgtagccctggctgtcctgaactcactctgtagaccagggtggcctcaaactcagaaatccacctgcctctgcctcccaagtgctggggttaaaggcgtgcgccatcacgcctggctcagttctgtgactcttgtggccagtgctgtggctcatgttgtgttttttgtggccagtcttgtggttattgtggccagtgttgtgattctttgtggcccatgctgtggctctcatggatagtgctgtggctctcaaagcctgtgctatcaacaaccatataactcacctaaggccttcctccccgtggccctaacccaccgggtatcagtaccacagaggctacttaggctccatccaacacgggcctattgacatcttctctgttcccctttatactgcactatgttcacagtttgggtggatacaggagcaccccaaagctgactggctacccctgcctcttaggttgggccatgaacgtcctggaaggagagagatggctctcacagtgtacggaaactgctcatgagcagaccagtgccacatgtcaccttcccaagcccaactcctggtcccccttcccccacaacacactgtcagcaactggggaaacatggccaaaagcaagccaggaggatacaggggagtaggctttcccagctactcttgggagctgaggtggacaagggaggtgctgggaacctcacccgtgcagaaaatagaagccaaaggaacgaaggccctgggggtggggcacttggcagaggtccctccccctgacaggcatccctttcttcacactgactagaagatggaagctcccagagcagcaggcaaacagatctggtgttttcctaattttggaaatcgtgggagaccagctgttttatcaggctgctaaaaataaaaaaaattaaaaaaatttttttttaatatggcagagagatgggccattcatgagcagcaggaagcggcttttggggtgcagtcacttctctgccgcacccattaatctcttgtaatgagatgatgagccccgagaagctgggtcacctgcgaggcccaggcctggctgtgctgctggggggacagtcgcgctttgaaggtttgttttgctttctttgctctcacccaccccctgccaattaacgccagggagaaattacacccaggtgtggcccagtcctgaccctgccaatcagggttcttttatccctcgggaggtgggggctcaggaccatgacttcagaggccagtgcctggcaaccagagagtcaaggcgaattgagaggcctgtagtgtgctagaccaccccaggaccaattggtgaccacagagctgacacacccaagggagagccttcgtagctgtaacccctgtagtgtgaaatgctctccctacagaactccttctggccggcttctttttgttcaggctggggctccgatgctggccctctggtgggagcatcaccagaggtgttgctttccctgtggaattggggtgtgaggtgtgtttattccttctggagtatttgttataatgcaaagacatccttaggggggggggaaagatctattttattatctgactctgtgtaagtgaatgtatgtgagcagaattcccaaggaggccagagagagagagagagagagagagagagagagagcatcacaggcacctgtaaatgacccagtgagggagctgggaactgaacccgggtctagccagagccgtatataccttcaacagctaagccatttccccaggctccaaaatgtgtttgttttccttttctctggtcatgcctcttgaatctagcagccatgactacagggcatgggggttggctaccgtcacctctgaaccctgggttggtgatatcaggcgttcgctagcacctgctgtctgataggtcactgaggtatcgacaccattggccacatcacagccagggttggcactgggtgatctcacacgtgtgcatgcacacactcgtgtctacctgagcatatccacccccccactcacccatctcaacagctcttcaaacacagtgccataaatccctttcatggatggggaaattggctcagagagggtgtggacgtggctagggtcacacagctggggagtaggtttggggtccgggtgttgtaggatttctattgctgtggagagacaccatgctcacggcaactcttataaaggaaaacatttcattgaggctggcttacagtttggaggtttagtccattgtcatcatggaaggaaacatggtagcccacaggccaacatgctgttggggatagag

SEQ ID NO: 554 - DNA, 4925 bp, Mus musculus
atcattgttaacctgacagctcagttcacagtcacctctgggatgcagtagattccatggacccaagtaccacagtccaaatgtacatcattcaactcatgtcataggtcatccattcctcaatggaacaaaatgtttttacttgaaaagtagggagggagggaaaaagggggggggagagaaagagaaagagaaagagaaagagaaagagaaagagaaagagaaagagaaagagaaagaggaagaggaagaggaagaggaagaggaagaggaagaggaagaggaagagaaagagaaagaaagagaaagagaaagagaaagagaaagagaaagagaaagagaaagagaaagagaaagagaaagagagagggaggcatggataattgaaatacaaacacctactcacctcccttccccttatataaaactcactccctctggactacttgcaaagatcttaagcacatttgtgcctgaggatttccaccctcaggaacatcctcactctgagatcccctgggagacttgcaacctccccatgtgacaagtacagacactagtcagaggagagagtcactgacaccacagcatggctgcctaggcagggctcatcccttatgagcacaaaccagggtcatctcctctgactggagagactggggtggacttgggcaaacacccgggtcagaaatgagctgagtcggcttcccacatcgccactaagcttgtctatgcttaacaaaccttgcaagagtctgtcaccatcataggcctggatcagagtcttgagaactattagaatttctaggttcttgttggggaacaaagacttggtccagggaagcatggggagcagtagaaatagtttattatgaaagagaaaggtgttcctgaaaatgcacgtgggccggagagttggggaaaatcctagagtcctggcccggggcaagaagagtcctccttttataggtcatttacatagccacgccttctattttcttaacttttatcctggttagaggtttccatgcccccccccccacattggtttcttttacaggcccttcttgatgcctctccatctgtactgcttcataatccgtctatcatgagctccgcttttattagcaaacttgagactgcatcttccaaaccattacagaaacctggccctggtgtttgttcctggagggtgaaaactgtgctgtggacttcagcgtgagctgcagagaagtccctagagacagagcaaaacacaagctgaaggtctgttcaactcacacccatctctccttccccttccccatagctctgcttccgtctcccgagaggagaggaaaagaatgatggccccagttcaggatgctgccaggataaagcttcttcctcgagacctgctggaagccatgcaagcctgttcaggagctgcctccggctctgtcaggccaccagctgtgggctgtggctccctgaagaacagcctgatgaaggacatggtgtttattagcaaaatgaagatagacgttgagccaagtgtgttgagaactcagccagctcttcccacagcccacatccactgctttggctctgctcttccaaagcaaagatggccagggaacatctaggatgtaaggcagaattatttgggggtggggtggaggtgggggtgggggagagatacaggaacctacctgtttttaataaaagaaaagtcttgatttgagagataacttttcagctgaccccctccctcccccgtttggagctgtgcagttgctggaccagcttcatcccataagccacctacctccagacctgagattgctttagacaccctcagagaaactcctcagagaaatctccaggccaatctcctcaccaaaactctataaacccccttgctttaagcctaaatgtgtgacttcacctgtgaggtgggtgaacccacccaagagaactgcctcctaatagacctgcctttatctactttttttaaatcccatctaatctggcctatatactcatggggggggtgaggaagggagggagggagggagggaaggagggagggagggagagagggagggagggagggagggagggagggagggagggagggagggagggagggagggagggagggagggagggagggagaaaaagagactagactattatacaggacctcagcagtcctggtctgccaatgattgtttttagtccaagttggaaggccaaagaattgcaatggcagcaagaataaatgcatccatcatcaagagagaaggttggcgagtaacattgtttctttctagctggcaggtaagtttgtttctttctttctagctggctgataactttgtttcttcctgggaagactttgtatctgggctacttgaggatggtgacaccccctctgtgggaggggtttcccctctcccttatcattcctggcaatgcctcaccgtcctgtttgtgttgcagagcggggacaaagcatcaccatgctaccccaccaccctaccttggcaccctgtcatctttacaccacacatagcaaaggagccaccacacctgcgattatgttactccacagaggctccaggaagattggagaaccactgcaaaactccttcaaaacgtatgcatgccacacacgtaccacagacgctcagaaccatcctgccaccctgctttggtggcaaaacattgaagatctggatggagccagggccctgtgctttctccctcagggagagtgagcaggagaatttctgccagcgcagttgcacatatgggtgtggaaggtccatggagcatagcacttgccaggggctaccaccttgattccatgatcaaaggggagcctggctctgtcactcagagcagaaaaggagaggggcagaaagccaagaacagtaagtagctaaatcacaggtcacctgtagtagtgaggatgggagtccaggccttgctgtcttcaccgactaagggcgttctataggcttgatgtccacaccctcaacctaccttctgcccacgcctgctccgaaaagcgcaatgtcagacacaatgggagctttatggacatcttgtcacctccactccctgatacaggttctgggcctgactgtttccacagtctgtgacagttccaagtatttgtgccagagagctgaaataaacaggaacaccccacctagaacagatgggctaacatgtggaagagagtgtgggggaggcaggggagggtagaagaaaaacagatagaagaccaagccacagatgaacaaaaaagttagcttatcattattcagtttgactgagagtagacgtgtgacaatagacgttcccaagccattccaaatgtccacacagagttcatagggcattaagatgtatttgccttcaaagagacatggggcttgaactccagtgtgcaggtcccatcaggaccctgggtaagagttcccagcacctatatcagacatgcacaaaactaactctctctctctctctctctctctctcattttttgagacacggcctcacattgtatcttgagatggccttggcctggctgaagatatttaaaatgatcttcaacttctcatccttttgcttcccaagtgctggggttagaggccaagcgccaccaagcttgcatcagctggccttcatgctaatctgcgaagggctcagcagggttatctcgaagccaccactgtggctcctttcctcccagctctggcctttttctgcccatctctcctcgtacgtgactttaaagcagatgcctcatcagcaggtctgtaggcttctgcaattgattcgcaatgagaaaatgtaactcaggccccctcgcggccatctgaagtgaccttcaggaacagtcttgtggctgggagcttgcagcatcctggaacctgacggtaacggtaacgattgtttcatcgatagaagccttcttgccttgtctctcagaatgcggatcctggaaggaataataccaaggaagccctgatcccagggaggagctctgcacatggcagtgtccactttcattccagactccttccctttgttcatgggcttctagggctgagatctttccgtccatcaaaagctgtttcttgtgtagaaagggctgacattcacttgactacaaatggctaaagtgtgcttaattttttaatatgtaccttatttgttgtttgaaacatttatacatgtgttctggtttgctcttctgctcctgtgataattatcaggaccaaaagcaacttaggggagagaaggatttatttggaagctcacatttccaggtcacagttcattcctaagggaagttgggccggaactgaagcaggagcttggcacagaacctacagatgaatggtgtttgctgacacacttcctggcctatgccattggctttctcagacaacctgcccaggcccacctgcctagggatgacactgtcaaaagttcctcagctgggggtgggacttggtgagtgcttctcctgcccatgatggaattttagctggcttgatcttgtgcaggccttgtataggtatccaactgacggtagactagagcaggacacagcttccagccatattctgcacccctgggaaagtagtatatctgtctagcatccgtttatccagctgtggagcaggagtctgtgacgctgcctacatgccacttctgtgagaagatgtgaatgatatctgcaaaggccaggcccaatgcaaaccttggcaagcatccttggctgttggaaagtcattggctttcaaggctgatgctgtaggtgaataaagatctaacaagggtgcaggccatggaggataagcagaggcctccacagcctcctgaggagacctgctttcccattctgttctatctgcatctccctg

SEQ ID NO: 555 - DNA, 1950 bp, Mus musculus
cgtgtttgaatgcatgtgtgaatgtatgagtgtgtatgcatgtgcacacgtgtgcacatgggagtgtaggagtgtttatgcatgtgtgcatgtgagtgtgtgtgtgcacatgtgcttgaatgcatgtgtgaatatgtatgtatgtgcatgcatgtgtgtacacacatgcttgaatgtatgtgtgcttgtgtgtatacatgtgcattgtgtgcatgtgcaagtatgtgtgtgtgtgtgtgtgtgtgtgtgtgtgtgtgtgtgtgtcaatggaggctagagattggcatcaggtatttcttcagttgctctccacactatgttttgtatcagggtctctcaccactgtagcacttgtaaagcagactgagtggcccctgagacacagggattcatgtgtctgtgcctcgcagcactgggttaaagcttatgtcacatgactaggttttgttctgttttcttggcacggttctgcagaatctaactaaggctcccatgcttgcaagctttactgtgtgagccatcacctctgcccacatggtgtatttacttgggttattgagccacagggcaagagcacttgtctctttttgctggctgctttattatatcactttccatatagcaaaggaactgggagtctatggaaaagactccttgaattactacaaattactatgcctgcctgatcttctaagcaaaatcaaagcaattccctctatgtagactgtgccttggctaggtactcagtaattgacctcttgaccaaaacacattgtaaatatattgtatcttcctcgagcatcacccagagcaggtgaggcacatgtgtcttgactaggtactcagtgattgaccccttgccccaaacacattgtatcttcctcaagcatgagccacagcaggctaggcacatgcctagctctcttgagatagccctctttcgagctgctttcccacctagtcctaaagggaggggtatgagcctcctgctctctctatatccttcttatcataaagcatttcccgttgtgttctacgagaccctctctgaacagttcccaagtcagagctgcgcacccttctggtgcacattgcctttgtggccctgcccccacactgtctagttgaatcgtcatggaacgtaagcactgtgaccagccagtgcagactgcctttgctgatgcctgtgtacaatctattcttgggcttcctggaccttttaaaatagactttcagtaattacatttacctcctcagctgcttcctactgaaccctgagacagcaaaggcaacttatgggcttaatgcaacattgtggagcggggttgttagttttgtgtatttctttcctgcctgattttatgatgcttacatttaatgagttactctcgatcgtgcatgcattattaatttataacataaaggaaattaaaagaactagaaaaagtaaagatcccttgtttcagggatgtattgttagaccctttatgtaccagcctttctttcaccactcatttctccaggggaggacagaagaagagaatttttaaaatggtttaagtatttcaccaacaaaatggaaattctggatgagcacaagaggtctgtcaaatgctggctaactgttctgaccagtgtgtgtgtgtgtgtgtgtgtgtgtgtgtgtgtgtgtgtgtgtgtgtgtgtatagctacacacatgctcatgcctcagtctgccagaggttgacactggatgtcttcttgggttgctttccatattacttattgaggcaggatccctcactgaacctagggcttatggagtaagttgggccatctggctgttgaacttcagagactcccctcgtgtgtgggattataggcacacgtggccatgcctgactttttctgtctggaatttggaaccaaatcttcatgcctgggaagccagagctttacccattgagcc

SEQ ID NO: 556 - DNA, 2575 bp, Mus musculus
atttcttacaaacaaaattcacagtatctgctatgatagtcaacagtctgttgtatcccagtgattggcactctccttaacattctcagggccactgtgtaaatgaaagcattgtcctttaatcgtatttctcttgcagaagatcagaattcagttcccagcacccacagggctgctgacactcatttgcagctccagctccagggaatctgacatcctcttttgattcccaaggcatatatagtaacacacatacttaaaggaaaatcattcatacacataaaataaaataaaataaaataaaataaaataaaataaaataaaataaaataaaataaaataactaaatctttaaaaacagtactaaggtgggcaaaatgttaaaatttaataaagctaatatgtagtcacaaaatttcctttgtgttttaaacacttcacaattttaatcagataaagtttagcacatttgatgtagatgattaagtaaaacagtaggaagaataattttatctctttaacttgcaacatttgctttttttcttttctgcagcatctgctaaagtaacaaatagaactaaaaagtaggttttgcacagaatattaaggagaacaaaaagaatgcataattaagttctgaataaacaactcttggctgactttagggattggctgcctaaaaaaatgtacccagatgtaggaatgatcacaagatgacacagaaaattaaaatagatgaaatgtatgaagcttttccagtatgaaagtatgagcataatctacagaggagaatagagaagtgtagtcaggaagggacagcacccacaaaatgaagaaaagcaacggtttatttcaacactgtatccttggttttggaaaccaatgaaggtttatcctggccctcctcagacttgatgcctttcacaaggctgataagacatggatcccagtgaaataacatttatagatccacttgtgaacatcctctactggttgctccccatgattgagttcctgacgaggttttggatgctgtagcttactcttaactgtcttaactgatgtacagttctcaggatcagttgacctctttcagcaagagaaacaatacaaccaaagagggagagagaagcagaggaactgctgcaaattaaagctatagcctaccaggaacacacagtgcctttgagctccaaaaacaggaggactccctttaccagcagggcttcccttctttgactttgtctggagatccacaccctctacctggggaaggtcacaaagcacttggtaaacttacaagctcaacttcctctttcccagcaagtacctgagactcctggaatgcctcgccatacaaatgtggatatatatatccctatatatccctagctcaccccagtaaaacatattgtacaagctcaccatgagtaaaggaaggcacacaagctaagatcatctcagagagctgtttaagtgaagaccatcatcagagaagccttctccctgccccctgcccccgctgaactgtgtttcatcctctcagcctggtgtgcagcagcatctggacaccctaagagggaagaagtggaaccatagctggaccccaacatgcataccacactagagtctgttgtgatacaatgttagtagtcaggttctgtacttctgtatagccagttctctagtagacatctcatagctatgattatgtgtttggggcggaggaggggctgggggtggaatgggggatattaaacaaaaggactgagggataactgtgagtcactttagaaacctactgttatctacatattcagttcagattcttttttgacaccagaaattggacccaggtatcagaaaacctgtccaagaatggaatcatgcaagttttgtgaggaaaggccaagaaaacaagacaagagtcttgtgacctcaattcttttcagaataatggaattgctcttataatttgtttctgactcctgatgtatccattaagagcgagattacttcagattattcattaaaacttgctgtttttatttgtttatatgcttctactggaaaagcatcattttgccatgtggggcttgtccttgccattgtaaactttactcatgtgattgtgatttaccctcagagtataaattttctgagtctgagaataaatttagctattgtatgaaactttagtttgtgattcccagagttagaagagggtgttggatcccctataattggagttaccagtgactgagattctagatataagtgctgggaaatagacacagtcctctggaagagcagccagctctctttcaggctgaaccatctcacatctcagaataccacattttaatcacttcaaggagatgatataatacctttataaatcaccattatattatgatgtatatccattagttgaattattaatttaataattaaattattcattttaaatacttagttttccatggggtagaaaaagtatacaagttttccagtgtctatttctacgcatatgctgcaatgaacatactttaaacttgcttgtatctgtgtgtaa

SEQ ID NO: 557 - DNA, 2225 bp, Mus musculus
agctgagaggaaaggatggaccatctagagactgccgcacctggggatccatccagtaatcagcatccaaatccaggcaccatcgcatacgccagcaagattttgctgaaaggaccctaatatagctgtctcttgtgaggtgatgccagtgcctggcaaacacaaaagtggatgctcacagtcagctattggatggaacacagggcccccaatggaggagctagagaaagtacccaagtagctaaagggatctgcaattctataggtggaacaacaatattaactaactagtatccctggagctcgtgtctctagctgcatatgtagcagaagatgccctagtcggccatcattgggaagagaggccccttggtattgcaaactttatatgccccagtacagggtaatgccagggtcatgaagtgggagtgggtaggtagggaagtggggggaggggcagggtgtgggggacttttggggtagcatttgaaatgtaaatgaagaaaatacctaattaacaaatatattaaaaaaataaaagtgcgttttaagtgaatttttttcaccttgagaatttttcaattcttttgtgaagcattttaaactgataaaaacaggtgtttcttgtttcaaaatcctgctttcacacagcttgggacactcatttttttttcttgggttttatatttttatatatgacgtgactacaatcagatgaaagctgtgaactcccaagtgtcagcttgaaatagtaacaaaactgactccagtgtaccaatgtataaacataatttgtttaccagcctctcgcttgtcatgctccaggggaggctgtcgtttagaggacattcctttcttggttctctgttttcacagctatatacatagctgataaatacgtgtggaaaaataaaaattactctgtaccctgggatttcacttctcttcagtggcccctatgcagaaaacagcagattctgatggcactgaacctggtcagtgcccagtgaggaaggagcagtaggaagcgggagagttttccactccttctgcagctctgacttgtctatcttcatcacctcatgttttgagctcctactcatcatagcccaggttattagacataaaacgctgaggcagtgggattgccagaagttcaaggacctaactaacaagtgagactagctagctagtctgggctagtgagactctgtccataaagaacacatagtctcagagggcatttttcctgaagctgtggaaattgctagcagaggagccaccagagctgcacttccctctgctgccgataggggacggtagaattaatggttcaaggatgataaagaacgcagtgcatgacatgatgcgtggaacggcctagttgtaactggctgaatttagctttaaaactccggtctcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatccctatttaaaaaaaaaaaaaaaaaagaaaacccaaaaaaaaaaaaaaaaaaaaaaaaaaaactccggtctggcatggcaaaatcgctcaactcccgagagcccggtggagaaacttagggtcgagaagtaagtctgcgtggaccccgcgcaagatgccacagctatactccagcggatccgaatccacgaacatccagtcgcaccttacctgcgtgcagctgcagtgaggattcgcctgccagactggaaaggctagtaagacagtgtttgtgtgaacgaatgaatcgggcctgttttacctttcatttgcttttgccatttatgaacaaataaaagtattggaacctttttccactggggttgaggaatttgtttctaccacgctttacagctcaatttgcgacacggtccaaattttaaacaaacaaacaaaacaattgatagaaatttacatagaatctctgaatttttgggagcattgtgaaatttaagcttcaaaggcctaaagagaattatgtatggataaaaaaccaaaaccacaaccaacaaagcatgtcctccagtgaacgtatactaagtcatgtccctagtatgggatttttggttttaactctttggattattattatattgtatttca

SEQ ID NO: 558 - DNA, 1875 bp, Mus musculus
cttttctatagctgcagcgctgaggatgaaagtggaaagattactgggtcctgctgacttctatgctgagttagtgtgagccctgacttcatggagaccctcatgggtgcaaggttcagtaatcaattcaactacacaaacctgactcacctttggatatttggaactgttgaaagatgtacatatacttgaaaggaagcatttttgatgaatcatattataattgtcaaactctaaaatgtccttgactaaatttccttgggacaccctgaatttattcttaactctttccatgcagaggtgctgatggagcttattgtagagcaacattcctttactggatgtgaatattaaatgacatgtctccagtcattacaaaaaatcacaattaaaaatataagattttaaagcatgcatgttaattcatatcctagactaaggtggtctgtggcagattgcatggattaaactcttttagttcatgtatagaagtcatcagatctcagaaagtgcccattagtaagatctccataaaacagtggtatatgcctagctcaccttaccatgatgacaaactggcagttaaaggcagagcaagcttgaggcagaggaaggcaggtgaaaaaatacttggatagagaggagcagaaaataagtcctaagctttaattatcttggaattgatgagaagtctcaggaaaaaatagaatgagagcatttaaaaataaggctcacatgatgaatgggaccaaattgcacagaggctggaagaggctgccaagttatgcagactaagaagatggagatatggagagggaagcagagagtcaagtgatcccttcgagccacaggaatagaaagcctgtgagggagatctgccttttccagggaaaacaatttccatgtctaagccaaacacagaaaggtcaaaggcagcaagcgggccaagccaaaggcaggctgacattaaggcgttccctgggaagctctgacagagatcagtggctgactctgtgtataaggaagagtgtgaggcacctcgcacacttgacactgactttaacctctctgcatttcattaatctgcaaatgaagataaaaccgagaaacagactaatgcaaggaataagtttagatagtgtttgtctaaatttcaggaacatgtgtggcatgtaagaataatacagatagacttacatatcctttcccctccttttgcatgccagataatttaaaataagcatataaataatagtaatgtcaatcacaattagtgtcaactcatttctcattgtatgaactactaattatttcacttgggattaaaataaatccctaaaagattgccatccaacaaaatagctcaggctaatttttatgtgcatctcaaataacatggaaaaaatctagttcttccatgtttttatgtcaaaaaatttccactaagaagtgatgtgcagaaaacccagaagaaagttaaagatggcattggaacactgttttctgagaaggttttttttttcttttgaaaatattttctctgtctctgtctgtctctctctgtctctgtctgtctgcctctctgtctgtctgtccctgtgtatatgtgtgtgcatgtgtgatgcacaggtatgtgtatgaggacttcctctatctcatctcactctccatagtattcctttgagacatgatgtctcattaaacacagaactaagctagaaggcagcaagtcccagttatcctcctgcctcaggactccacagtgcttgctgagtgtatggccatgtttggattttatttatttatttttaacatgaatactggtatccaaactcaggtcccagtgctcacatagcaaatgttctcatgtactga

SEQ ID NO: 559 - DNA, 2200 bp, Mus musculus
tcttggaactcactctgtagaccaggctggccttgaactcagaaatccacctgcctctgcctctgcctcccaagtgctgggattaaaggtgtgcagcatcactgcccggcttgccaaactgttcttttgctacaaagaatataactgcacctttgctacacctaacttttgggctgagagaactgccttcttgcttctttcccccagggcttgccaccaggcagacctgtggaccaacgctagaggcactttctagatgcaatttgcaagaagcctttgatgtggttcccaccaccagccttcttaggctgccaaggtgaggaccctcagggtgggcaggcatacactgggctgagcagaaaggcaccctgggacgcaacatggctctccacaggctggaatctgggagcccagaggatcctgaagaactagggttgtgggtttcttctgggaaaccctctacgccccaaggctctgatccaaagaaaaggaaaacaaaagagtaaagagtttgtgctagctgtcctacctgccttgcttagcctttcaatctcacactcctgccacctatctccagagctgcaaacgggcagggaggacagaggacgctgggactcacataatttgccctcctcagacataccaggagccagcctggccactcatcacagctgggcacaaatactttggcctagatctgcagtgccttgtgggtgtccaggggaacccagcagcagggaagaacccagaaagactctggtctagagtgcagttcccagcaggggtgctctctccaccaaggcctgctgggatccagggtcttttactcaagcatctccgagcttccaggcgggtgtatgtgtgatacagaagcagtctgtgtgtatattcagcagctgcaggcttccagaaccaaacactgctcactctgagctcctgcacagggtgcagaaacacatgcaggagtgcatgtgcagaaacacatgcaggagtgtgcttgtgtgtgccagcctgtcagagggtttccatccttctcatctctggcctctgaatttgcaggtttttacatctccactgtgtgtaaaggtcaccaaacaattcagcgcctactcctgaggaaaatgaactgttgctggcatttttatttttaactggaggctctaatttgacaaggatattgtttggggaggccctgcaatctctgccttcaaggaagacgatgctcctccgtggccagttccgtggctcatccctagcctctccaccccgagctcccacctcttccaggatgtcgcaggccccaagcccctctctttaggggagatttctgcctggagggagaagggagccccttccttgtcacacccgggaaagtgggtggagctttgcctgcactgtgagtaggtgccagcccttgactcttggctgacagcactagccagagcaaccgagcccccaggcaggctctgaactctgtgcaaagtctgctgccaacaacagcagaggagcctcaaacacagcacagtctggcttgaagaaattagctaggaacaacaacaacaacaaaaaatagataaacgcagctaatactgaaatagatacgcagcctacatatgcagatgtagatgagagatacagatgtgtagataatatacagccatagctatagaaatatgaacacacattttcccacgtgcccagagttgaggtgggaagccgccgagacactaccccctttccatcccagacctccaagagccctggcaggcgttccctaactccagttctatgcccagtgaatggcatcagccttctgcctatcactggtaacctcagtctctgtgtgtttcctatactgattctttgctccacacaacattatcttgcttctctagcaaatctgtgtggtctcttacttctcaactctttgcacgagagaccgagagaactgcacggccaaaacatgactaccaggaacagtgtgccagcctcgggacctcaggctttcagagacgacagggaggtagagtggggaccaatgacagaggagtcgagggaatcgggtgcagatggagggataggtgttctgggaacattttagaacgtgttgccaccctttcctgataaacatgacccccacccccaccccgtctccctctcctttccttctctttcccatttctttgcacccataaaccct

SEQ ID NO: 560 - DNA, 2025 bp, Mus musculus
ctatgaaggtgtttccagagaggatttactgtggaagaaagatccactctgttggtggattagtataatcccttggatgggggaactgaactgattacagagaggaaaggagaaagctattggagtgccagcgttcccccttctctgcttcctggtcggtctgctgagatgagaccaagtagctctcaccaccttggagcaatgtgctgccaagcctttgccactttcatgagctatatacaaaaaccatgagccaagagaaagccttccttaaattattggtatcaagttgtggggcaatgggctatgcacagacagcctggtccagtcgagctgaggtcttgaatcctgtgggacccggtgggtggtaatttccacctacatgggaaggtaggagttagatcatgtctcctggacctccggctcctgtcgaagttattgccccgcccccacagcccccacaagagaagcatgtggctatgtagtcacatatacaatgtcctgagcttctggcattctggctagactcctccccacagttacctagcaacagcaagatagtagcccactataagaggggctgcttggcccctcctcactctctttaagctctcttactctctagcctttcttctctctctttctcttcccccttctctcctcgtctccatggccggcctctccctctctctttctaccttctcccttccccctgcctttctacaataaagctctaaaactatagactgtctctaatcatgaaggcccactgtgcttgaacgatgggataggttttctcttaatgagccgtgtctaacctcctgccaggaggccttcctatgctgcagccacagacgggactaagtactctcgcctgtgtgggaaccacccagcgccccctctccctctgccctcttcctttatctccgagctgagttccgcccccaggggctcctattctgttctcagcttctctgccatatccagcgtgggatgctggagactgggaacctggtacctggggctgcccctgtccaccactcgccgtgtggcgtccatggcctaacacatccagatgcccacccggggccatgtggaaagtgtccagcagtcctcccatgtccgcccatccagaacacagaaactctggcgggacatgggcactctctcctactcccctattccccacatacccacaaccccacatcaggtatctggcaacagcaagaaacaaagtaattcagagcccaccctggctggctggcactgagggatctgagaaaaccagaagcaggcctgtttcagagcatagcatgaagttagaagaaagacatgctctggggctctggtgctggtgagagcagttgtcagcatcttgttttagcatctccatgtaccctctatggccaactgtctctctcatttcaaagagcagttagggaagagagagagaaaaaggtacaaagctgaatgcagttttgaaaacacacaaaacagccatattcaacgtacacaaatcctgggctaggtctctcccagagtagcagtaaactgtctcacagactgtgtgcaatctgcagcttctcaggggcaaagatttctcctttctcctgtttccagcctaacagggaccattgtcaaattagtcaagaatttaaggcactcggcttgcatatgaggaggcagcaaagacatcactgacctgagactcacaaattatcattgtcggaagaaggatcggtctcaggacaggatatgtaccatagcgctagatatgggttactcttcaggctttggcttcggtttaggcagcaggttcaaaggtgtctaatacatagtgaaagaaattcatcaaatagctaaccatagagccaagaacaggtcacacctagatacctacttagagggtgccatagaccacggactgtgattaatccagtcctgaccatgtggcctgcctaccaccgaacctaacaacaaagggctgaacagaaagccaatgaagacagggagttagaggctcag

SEQ ID NO: 561 - DNA, 1775 bp, Mus musculus
acagaggaaatttccccaccattgttgaacagaaaattcttcatgtgaatgtagtctattggtccttccaacagactggtcagttacaatgctcataagactattaagccatgacttatgaattcattttcctgcatgtgtctattttcttaatttctcataatgcaaggccacatggactaattaaaataaattaaaaaaaaacatcagaggagtcagtccatctgaatgttaacagtgtgataggatttttaaatcttcaaagaagctaatgccttctggctccttttgtaacatttaagcttactatcccaaaatagtgccagtagatcatgtaagtagtacatttaaggcagtaaatgtggagaaagaatttactgatgttaagaattagaggagagcataagaagtggtacttttgcttatttttaagtgtagtttagatggtacaaaggaaccaatattagcttctgtaaaatacactacagtgtccaaacaagagcccagaggcctcatacaacaaagaatatgctctccaaaagaacatgtagtaccaactgtgagaattttttttatgattttttcctgattgaagttttcttgtatgagctttgtaaataacaatgccaggttacaagtaaaaagttggacatggatgttatttttcagagaaatgcaactgtaaagtttacaacagtgaagagacttgtttttttttatattaatttatcccttctttcttaattttttcatttttctatttttgcagtcttgcttccagtcggtcctcccacagttccacatcccattcctcctccctgccctatcttcaagaagatgtcccccaccaaccccaccaggcttccccactctctggggcagcaagtctatcagaggttaggtgagtcttttcccactgagaccagaccagacagtcctctgatgaatatgtgtcgggggcctcatatcagctggtgtatgttgtctggttggtggctcagtgtctaagagatctcaggggtctgggttagttgagtctgctggtcttcctatagggtcgctttcctcagcttcttccagcctttctctatttcatcctcaggaatccctcacttcagaccattggttcagtataagtatctgcatctgtctcagtgagctgcttgttgggccacttggagaacagccatgctaggtttctgtctgtaagaacaccatagcattagtaatagtgttaggccttggagcctccccttgaggtgaatctcaagttgggccagtcattgaacctccttccctcagtcgtttctctgtttttgtccctgcagttcctttgtgtgtgtgtgtgtgtgtgtggctgttttgaaaataatttattgattgaatttatcttcacttttcaatctaaaatagcatatttaacttcactgactcatctattatatgatgcaatcttcttctaaataagcaataattatgattttaaattagtccaatttgtcacagtaaaatccttaaaatattcacattatagacaggaaccattctgggtcagagtttttgactgtgggatggcaaccccattccttcacttgaggccctctctttctactgaagatagactctacaaattccctctccccactgttggtcattccactagtatttttatttaattgtttacttactattatttgtttatttgtttgtttatttgtttatgtttttacttagtcacttcacattccactaactgcctctttcacagtcaacct

SEQ ID NO: 562 - DNA, 3900 bp, Mus musculus
cccacactctctcaatgattttgcatgaataactgccgttcaatatcaaaaccaggaaaatggctaactgtgatgtatttgtattgcttgatgccattctgccactcatgagtccatgtagtatgccccaaaaatatattgcttaggtgtagtatgctgtgatgtgactcagtggagaacagatgactgacaggggacatgagtcactaatatgcagttctgatatgaatgagtgtacactcagtctccaacattatcttcccccaaacattttacttctgtctctgaagttcaaaagaattaaagataatgagaaattgatcactttctggaaagataggaaaaataggtcaataaacacacagagaaagtgcgtagtagagaaggaatctgaggaagttagccaatgccattcaataagaaatcaggataaaaagctatcagcagggaaaattaggaaaatagaggattccaatgatgtaaggatgtcagaagaaaatggaagattgctttgaaaagctgcatggcctaatgagaaagctgaataaagaaacctattatttaatgaacaaatatataaagcaattagcttttgtacatactagcaataaccaattagaaagtataataaagtgaatggattttctgtagcagttaaaatacaaaatacaggtgaagaagttcggaaataaccatggcagcatacaaagaaagctgcagagctttattgagtgactttttaaaaatttagtattgaaaattcaacgtttctggagaggaaccagaatgaaaggtcagaaacaaatcaaatatacataggaatttaccatataagaaaagtgcatgtgaaatgaatggggtctaagctgtggcgaataagtggtagcaaacttgtgtgtcccggttgattggcactccactcctgctttttggagcatacttaaccgtgtgttgtctgaagactcctctggaagagaagactggagaagccatctccagggctgcttgcccttcctccaagtgctatcaggcactcaggctctttataatctattgtttatgtctacctgatgctgggcagtatttcagacatgcaaaccagcagacactataaataattaaatgtctatttatttgggctatacttaaagcaattacatgtgaaaactgaagtcaaatacagatggcttttgagccaacaggtctgtgcccactatgaagaagcagcaaatgtggccctgctgggaagctatgctctgctctcctctgctgtgtcccacttctgtcctccaggttctccctgacactgcaggcctagcacccatcaacctgtgacattacagtctgcacgtgcttgattttgtgtttctaatcttctttcctcaccagcacgcagatcaatggaagcagagactaggtcatctttatttggcagcttgagcacactgcagccctataaacatctgctgaagagggtaagaaggaaaagagggaggtgagaaatatactagaacagagcattcatgacaacagtcttatagcattaattttggaaaaggaatgtgaataatgccaaaggattttcctaagtataatatcaaagcggacatcactgcaaaaaattagctaaacatatgaaagtcaaactataagataaaaacattaaataaaattacaaattaattcaaatatttgcagtataaacagtatctacacagctgatacatgttgtgttcaccaaaataagggcttctgctgtgcatcaaccaataaaaggtaaacacttaatagaaaaattaacacaaatacataaatagctaagattcaaagggaaatgtgactcaccagcaagcctattttaaatgttcactcctacttcaaacaaactaaatgaaaacagaatatctatgagttgttttattttctaataagaaaagaaagtaggtttcaggaaatcagtaatgtaataagtcttttcactctttttaaatatgatatgaaatgatgtaaaacatttaaaatacttattcttagatcatttttcttatacatgatttaaaattatttactaatatgcattacttacacaatacaaatatagctgaatgtaaaaaggatgatgtccagccataggttcatgcccagaagactagcacttgcaaggtaggaagactgctattttaggctagatctggtccctaaagaaaataataattacaagtccactttgactgccaggttgaatccatcctgggcaacacctaggtgccagcaacaagcagacatggtataccttccaaccacagagatatacatgatgcttttctgcattggatcaggggtgggggcgggggcaagcagaggtgagggtcaacagtgcacaggtaaatcttaaaagacaaacagcattttttaagtaggcaaagaagaaagagaccaggaatggcatatgtacagacaagcacagagcaatgttctatcctaagaaaacaaatgacactggacactctatgagtccaacaatcatatctgatcctaaaattctatctcaaaacagagctcaggctgagattcacttcactgggtatgtgtataggtttggcatgagccttactgtcaagtcagatcaggagtgttcttccaggaagagttcccagacttctttctcagtcaacaaacagctgattgctcacagtgaaaggaccgggtgagatcagtggtagagcacttggtgagggtatgaagagctcagagttcaaattcaagtcctataaccataggagggcagaaagagagtgatagacagagacagacacaaggagagacagagagacaggaagatagagatagggaaacacagagaggcaggaagagaaagagagacagaaggggagagagacagagacagacagagacagaggcacagaaagacagatacagagagacggagaggcaagaagagacagagacaggggaagacagagagacaggtagacaggaagaaagagagatgcagggcgggagagagagacagagagacaaggagagacagggagttgagacagagctgtcatttggggaacagttctagtgtcattgcaggcagcaatttgatactaggacatgctatatgtcactgattagatgcaggaaattcactctaccttcattactacaccatccagacactacagagaacccctcagtatggcttttggactatgttgttttccataccagaggtccatgacaagacataagttttggattggccaaggctagttttgccttatcaatgacagcaggctgctgtgggaagaacacatcaaaacctagtaagtgagccaagccgaccactcagaagccttggctctgcctgatgtccctctgtcacacttgacaatggagtttgtgagctgcaagtggtagctacagaaggggaaacagtttggggacaaacaaactcagctttctggtaaataaagaaggtgaaatattaattcatctaaaaatatgaatgtcaacaagtgtaagatttggggaagaagatgatacaggaaatgattcagtaaatatttgcttgagccaatccaaagctcattcctcagattatgattatgaaatggacagtatggtagttagacagcaatggtgccaggtgtcttaacacaaacccacatagagcagaagcaccatcaacaattgggacagcatataaggcaaaacaaaataagacattttgagaaatcattttctttgcagattttaaacaaaagacttttgtgaagagtagttctcataatcacacctctatacaaatgcgaactctataggaataatagcaccattcatcactcttgttcagcacttctacagagatgcagctctatactgtgtaga

SEQ ID NO: 563 - DNA, 3150 bp, Mus musculus
agaagaacgaagaccaaagtgtggacactttgccccttcttagaaatgggaacaaaacacccatggaaggagttacagagacaaaatttggagctgtgacgaaaggatggaccatctagtgattgccatatgcagggatccatcccataatcagcttccaaacgctgacaccattgcatacactagcaagattttgctgaaaggacccagatatagctctctcttgtgagactatgctggtgcctagcaaacacagaagtggatgatcacagtcagctattggatgggtcacacagcccccaatggaggagctagagaaagtacccaaggagctaaagggatctgcaaccctacaggtagaacaacaatatgaactaagcagtaccccggagctcttgactctagctgcatatgtatccaaaaaatggcctagtcggccatcactgcaaagagaggcccattggacttgcaaactttatatgccccagtacaggggaacgccagggccaaaaagggggagtgggtgggtaggggattggggggggtggatatggggggacctttgggatagcattgaaaatgtaaacgaggaaaatacctaattaaaaaaaaaaagaaaatcccttgatggctcacactggcatggagatgtcattcaaacaattcagagaaatacatcagggtgtagggtcggaaacactgcttggaccatcaacatcctttccttttcatgctctgaatgagggccacggtacattatgtttgcagattcccaagaatagcctgcttgtggcatatctagtgtggtattcctatttcatgttcattctcatctagccacccctccacttgcctccattacagggatcccttctacggctccatgcaccttaggtagcctcagcatcatcttttgctggccatatgcaatttgtgaaggcaaggatagtatactttctccacttgtcttttataccatatacctattatgcctaccatcactccatgtttacagacattttcagtggataaaaagtgctttcttgaagcgaaggcacccggtagcatgtgtccatcctaaaccagatgtctttgagacaatagccagcctcatacccagccctaatcctggactctctccaatctttctccatggtgactcatgctggctgccagcatcctaacatgctccaatctataccacacaggagtcacactcctggaagtcacaaggtcaggttcagtgctacccccccaaaaagcctgcaaaagaagaacgaatgctgcaggtacatcacaagaatgtttttgttaactaaccagaaaaataacactgcaaactgtctttgtgcctgacagcattcaaagctctttttgctttaattagcatctcacagactcaccaaaacaaagctaggggcagagatacatttcaaatcctgaatctgaagatttaaaaaagtgttattataggccagtcatttgtccccgctgggcctcagcttccatctctgtctctgtctctatctctatctctgtctctgtctctgtctctctcccccctcacacacccctacacacacacacacacacacacacacacacacacacacacacacacacacagagggtgatgtccagagacctagctgtgtaagccccaccaggccccagctcttgtcttactttccagggatctttgtagatgttgctagctgcctacaattggtgcctatatggacacaaaaacccccttgttctctgataggcaggtatatctgaaactattaactgtaccagtctcttcccacttgagcagaaagagcaaagatagaagagcctaggaaagagatgtggagaagtgcagaattatgaagccaggataccaatgctgaaatgaacaaatacaaaagtggctttaccccttattcatattcttggcagtgtgggggagtacaaaagaaaacatttcctgttacttccacaaaacatagaagaatcataatattaacaagaaaataaatatatgtactaaaattagcattgccttggctgatggcttctgtaatgttctcaccatgggactccaaagtcagaaggaggtgggtatggtgctttctgtttgcttctacctgggcgatgccttcaattcctctctgttttatgaactaatatggcatctccctagccaatccaatgatctgactttctctctttctctctctctctctctctctctctctttctttctttctttctttctctctctctcttttttctttctctctctctctttcttccttccttccttccttccttcctttcttttttctttttttgtttttcgttttttgggggtttattttggttttatttgtttgtttgtttgtttgtttgtttgtttgagacagggtttctttgtatagccctggctgtcctggaactcactctgtagaccaggcaggcctcaaactcagaaatcctcctgcctatgcctcccgagtgctgggattaaaggtatgtgtcaccattgcccggctggatctgactttcaagatgcactcgattatctctgaatccacttaaccaactattttctcgttgcaaatcattgattctctctttccagatgagctctcctcaaagccattcttcactgtttggaaaatgcatcccgagacccatgtgggtgcctaaaagtcgcatagcactggaacttatctattttacatgttcacctaactgaagagctgagtgtagcaactcatgtctataatctcactatccatgagtctgagacagaaggatcactataaactcaaaactactataggctacagagaaagataccatctcaaaaaaacttataagatagaaaaattataacaatttgttgttaataaactcctatgaatgttgattctcactgataaaatgcaatgcaccctatgttggacaaagaactgacttaatgtgggtgctgtagatggtgcaggagttcatcactctggtcagagcaagacacaatttccagcttacaaattgcttacctctggaatttttaatcaatattttggactgcgatgaattgcaggtacctgaaattctgcacagggggccaacagactggctaagacaccggtctcgcat

SEQ ID NO: 564 - DNA, 2125 bp, Mus musculus
tgggagtaagttttagattaattattcagatataataaattaatgtagatgctggattttttattagcatgtgaaagcaataggaatttacttttaaaaagttctgaaaatatgcagtttggtcaagtaataagcattaatttaataagcatttcttattaaagtatataaaaaacgctaatattacttttgttctaaataaatttatcagttataaaagtttatttttaaaagagttacctattgtaaaataagtgtagtacctttaagattatttctttctgaaaatttttttgagtctgagtcttactatgtaaatctggctgtcctggaactcactatgtgtacttggctagtcttgagttcacagaggactgcctgccgctgccttgtcagtgctgagattatatcttacataactacattcattattacattctaggaaaaaataactttaagatttatatctcataatataaaggtccctattacatttctttagtttttgttatgtctaatttaaataaacataatatggataaaaacttagataaatgaagataacaaaagctgtcaaaacaatactttgagaagcacgataattataagaaatcagaaagccactcgtgtggatgattgtgtttgactagaattattactttatgcccaggtaaataaatgactttatttcacaaaaggggcttgatagcttagagttgaagtgttcttgcttatgcaggtttcagatgcagcccaggctgcagttgttgtagccctttttactgaagggatggggacaacagtttgcttgtaacagccatggaactgagtacaaagaagccagtgacctctggtcgtctgaggctgtgcatatgaaggagggattgtttgaggatgagagaagctgccagtacacttgggatagtctttctccttgttttctgcagaattcttgaatgaccctactccagaaaaacacaaaagtcagaaagtctcattagaagaaattactaatggtctcagaagaatcttgggtctggacagcaaaatataattagatattcatattccaaagtgacagtcattaaaaacattgtctccctgaaaatggcaacattaattattgctattttatgtgcttagaagaatggtgcatgcctgtggcttcaccctcagcagctcttggtatgctcctgtttaaagctgtctgtcttctagctccagtggcccagaagccctgaatctgggtcacactaattccttggcgttttattttttatttttaaaacattgtttaaacattagacattattctgaggctaaagcgtataaatatttgtcggatgaaggaattgctaatggcagtttcagtacttatttatttttcttttttcttccaaggtaattaataaaaatctggtaacatttctctatgcaaggctaaggtaaatacggtaatatgtcttttggcggataccatatatggatctgcaagtgacagagcagctcagcctttggtacacttggttgtattagttatatactggtatatacgatacatactagtgatcaagtttggggcagtattagaatcctgtaattaaaatccgttgtccttggaaacagtttaaggaagatgttgaacgagacctggttttgatttatgccaccgtatgactatttcccatgattaataaagagagatgcttgcatttgaaaataataccctcatttattatagatactacatgtttttcgatgtattttatgtactcttaggtagttttctttataaccagtagtgggtatcaggccttggtgtacaggctaggatatggtgcaaaaatctggtatcatattgaataactggagtcttgggatagattctgacatcattagctctgtcttagataatgcatgataaggggtaaggagggaaaaatttgtatggtaattaattatggtaaaagagtgattaaaattctagtgctttgaaatacactattgtatacctcattcaaaagtttaacataaaaattaaactagttgatatttagagaatttcatccatcatattcatgaaaaatcatttggcaatttagcctcgagtgttgatttattagct

SEQ ID NO: 565 - DNA, 3125 bp, Mus musculus
ccttgtcttttgccccctctttatgtgagttgagtatccatgcatacaaaccattaattatacaatagacaagatcttttaaaaggtgcctatagggccggagaattgcctcagccattaagaatacttattgctcttgcagaggagccaggttagatttccagcacccatgtggtggctcacaactatttgtaactccagccccaggggctctgatatcctctcctgacttggacatgtacatatgtagtgcacatacatacctacatacatgtgggcaaaacactaatatacataataaatctaaaaacagtttttaaaaaggtttgcatatcaatctacttttaaaagagattcctttttaattatgtgtgtaggtgcccatggacactagagccatcagatcgccctgaagctggcggtacagacagttgttagccgcccatcacgggtgctgggaactgagctctggtcctttgcaagagcagtgcgtactcttaaccactgagccacctctctagttcctgaatctacttttttatgattgattaaatactctaatgcacacaaagtacatgctatccagagtgtgatgctcacgttgggcggtggtggtgcacacctttaatcccagcactcgggaggcagaggcaggcagatttctgaattcaaggccagcctggtctacaaagtgagttccaggacagccagggctacacagagaagccctgtctcagaaaaaaacaaaaaacaaaaaacaaaaaaaaaaacaaaaacaaaaacaaaaaaatcaacagagtgtgatgctcacctacaatagatgcaacttgtgcattttaaaaaatagttgtcttcatcagggaagcaaataaaagcatccataaaaaacaatcaccccagacctttctgttgatgttcacttccctacacccctacaggaagaagaccccagagaccagaagagcaaggtgaagtctgaagggttcgtgtgtggtaggtggagaaaagtcaggcacatttttggcaggcagcaaggtgtaagttaagaaaggacggtgctccctgctcatattagccgtggtgagaagtgagcctgggggagcttatcccgtctgaacagaggtgctttcagctggaagggaagggggtgaaagatggaagaagatgaattggcagcaggagggtggagtagagggttggagggttggaggcaggcaggctgattcagtatctgtaaatagaatcgtattttcacacttaagattgggagcccagtgacaaccgatcactgcagaaaacttgcatcttcatctccaattaaacgtttgatactagctcagccagagtgtccatcatccctcagcttcagcagctacatgtaaacactgacacgcaggaggaccttctgttctcattaatgctttggaaaagagagcgcatctttgcaagagagctaccggctggttaattggtccctggtaaattctagtcttacattctgggacctgctagaactggggcatgcctgattttttttttcacatccataaaatatatccagacccatgaaaccagacaaaaatgggagctgctgtgaacctctgtgatcaaaagatgctgccgaagagagtctgcctgtgccctgggtctctttattagcttctttagttgttgctttgcttgcttcgggaatgtggaaaggatagacaagtggatatgggagaaaggcctgatgggagaaagactgcacagtctccattaatatttacatttgtagagaagaaatgaacctcaaagagccggttgagcgctggagctccacagcatatgaaaccacaaggttaagactaagaatgctcaaggctctgatgggaagatgaagttttccttcacacacttcaatgggactctctatcttagctgcttttctcctgctgtgataagacactacacagaagcagcttctagaagagttggatttggtggagaaaaggaaaaggttgccaagcgttataatctatgaccatcatggcagggagcatggcagtagacaggctggcatggcactgaggcagtacctgagagcttatatcttaattcacaagcaagatgtggatgactgagaaggacttaggcagcctgctcccactagtgactcgccttctccaatggccacacctcctaatccttcccaaacaagtccaccaactagacaccaattagtcaaacaaatgagcctataggggccaggctcatctaaacaactagattctctctatatagaaaggcatcattctctttcagtgcaaggggagagtggtgcttttattgtgaagacttatcccaccttcacaaggggaaatggatcttctactccaaggtaaaagataggtgagaatttttcctgtacttgttgattctttattgcctacagctcaaaacagttcttatatcaaaatagcatattttggagtgctgtatattgatcttctttgaaaattaatacacacatcaagtggctatttatttatttatttatttatttatttatttatttatttatttatttgagaccatctcaccaagtagcccctggctggtctggaactcaccatgtttgaccttgttctcacagagatccacctgcctctgcctcccaatttctgggataaaagctgtgcaccacttatatataatgtctgctaagggtgtagttcttggtccacagtttattttttgtcacttgccttcacatgacacagtaggttcttggtgctttctttcagaaaaacactagttgaattcacagagtctccactgtcacatcctaagcgttcgccaagcccctccctcgacatagtatcctacacagaattatgttgcaacagatggaatttaaggacacaaacaagctacaacaatgactgtggcaagtgtcacacggtaaatacatggtaatctgcaaaaactgtcacaacaacgaaaaaaatgtctggggcctgaattttctttctggaaatttgcacataatattatttattataacggtattttaaattattttagttggtaacatcattatttatgtatatctattttgcttaggcaagttacttaatgtccat

SEQ ID NO: 566 - DNA, 2100 bp, Mus musculus
ccactgtgggtagcatcattccctagacagggtatctgcgcctgtgtaagagtggaggaagtgagctgagcactaacatggatgcatccatcactctcttctgacttcagatgtagctgcagccagctgcttcaagctccttgacttcctgccatcatggacagtaacatggaactgtgaactacaataaacaccaagttgcctggtcagggtacctaatcccaataatcagaaaataaacccaaaacaaggccttccctgctaaaagttccactcatcctgaagtagaataagggccagtattttgaacttcagtggagggttttgtgtgccttgtaactagccatctgctgtgtcatcattgctagattcgaatcatgtaagactccaaacaccttttgcatatcttaaatatccccttctgacatgtttaaggtgataaaatttcctttttttttttttttttttttttgtgacaagctcctatatctcaatctggccttgaacttgttacataggtcaggctggccacacctttatgatcctcctgcaagatccctcgtctactgctgaattatatatggaccataaccatctctgatcgggtataagctttcaaacttgttgcctctcacttctttggaggtgtgaagatagataatagcaatgacctcattttacctagaaacaaacaggaatcccagacactgatttgtctgagagcaattacacgtgggagtggacgtgggagaaagacattagggaaaggagaaggcgagcctgggaccgatgtttaatgcatttgtagtcagtctccctcctcctcccgccatgcaagctcctctcaggggcctttcttcagggtcttgttcttcccttaaaagcaatagccaagactcttactggctctgcccggatccagtccccagacatttacagatgttgttttcttaacatttcagaccatctcagcctcaacctttcctacaaagccacccttccacagtcaaagcatcctctttgctgatcggagaaatggctaccacctcttccccacccagagccatgcttttccatggagacctggacccacccacgtctgctgctgctgacacacccagccctctgctcactgctgctcctttcctccactgacatggacactcctctgtgctcactggagaagaaggctgcttgtctggagtctgcttaggcttcatctggtggcctctgctggaccaggaagtagcctccgatgctgcagtccccagaggcttccacatcaccagaccacagctggagcagaactccccagagtgctttccaagagcactgtaaagaaatctgttccacttcattctccatgagcagagagaggagatgccacattgtacccagcagagcctagtttatggtacatctcacacagtgggaccctgagagacacacttagcctctcatcaatcaatagcgaactcatactctattcaggtttcaccctaagagctattgtgatggtcaagaaagattacaaatggaaatactttgtcaatggaaatctactatgaaaacaaaaaggatttctattataacagagatgctttgtattgtacaaatgaatgttgtaaaacacttacttctgcctataaactggctatattagttttctgttgctatgacaaaatgctttaggtaggctacttgtaaagaagacaggtttatttagtccaagttgcggagattgaaaatgcaaacagtaatgctggttggtggtggcgcatgcctttaatcccaacacttgggaggcagaggcaggcagatttctgagtttgaggccagcctggtctacagagtgagtcccaggacagccaggactacacagagaaattctgttttgagaagaaagaaagaaagaaagaaagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaagaaagaaaggaagaaagagcgagcaaacagtataatgccatccgagtgtcactttagct

SEQ ID NO: 567 - DNA, 2750 bp, Mus musculus
caaagagagccatcattcaccctttgtcacacagctccttggtaggaatcagtgagcaggctccagccttgccatcccatgctgttcctcttaggcaataaaagccctgcatctgttcatgggtccaactctctgactgaggtaagactgcctcaaggctggggtcctgcactgtatccctagatcctcctccaggctcagcacagggctggcctcatttataatgaccagaaaaggaagatccttgcagtcagttcttccaggggagaaacatttcataggcaggagaaggcagctggccccacggacctcccgacttgcccttcaatatactggtgactgtggctcacatagactcacattgtaccgagctgtcaggcattgcgtttctaacactgcagccagcatttccatccagtcttccacaggagacctttaaatatttgaaaacagctgtcaggattcacttagctgttctgtctcccaggtttaggttccctggcaatctcaaccactctccacatggcacggtatagtgaccttgggccatcccatttccctcttccaactgccacgccatttgtcaacatcctcgctcagccgttgctcctggaatgaaatgcaaggctccagatgtggaccagcaactgccaagcttggaggaagctaccacctcccctgtcctgcactttgattaatttagcccgagattgcaccctcacaccctgccttggcagctccccacatggctggctcacagggcattttgtctgctaatccatctaaccccattactgtctaccccacaagtctccatcttgtccgagaggagaacgccatagtctttacaaaacacctgccgaaacccagatttgccacattcctggtgtactgtctgtctagaagcaaagaaatccatcagctggaagtgggaatttgtttcggttgaacttgcacttggtgaaccccgggataattcttagggatcactctttgtttttttcctacaggcccatgaaccatctactcaataatctttttttcactgccctctatggagcttccttcacccaaggtgcttgctcagtgtctggactgagaaacggtgacaggctacctgatcgatcactgtgccctgagctttatggtggtgtacggaggttgcccagggaaaagcgagaggggagtgagtccgagtgtcaaagactcagggatgcccagggaggccgtaaatagcgtggcggagggactttgagtccctgggttggaaaatttattaagagtgagactctatttcactcccttgcacaatgtttgattcaaagaaaataggaaaacgtcaccggaatcccaattctgtagaagcatttccttttctcctataattaggcactctggatttttagtatcatttttgtgtgtgtttgtttcttctgatttccacaggctatttttaggccaatcatgactcactttttgaaaagcttaaaaaaaatagaaaaagaaagaaaaggctttccccctcagtaatcaaatgttcctgtcctctgggtgatatgcagttaggtaagtcagagatgagtgacagttgggggtgagggggcagaaggcactcaggaggaaggctctgctgtgggaggaaggataataaggcaaagatctatatggggacctgccagcccttgccagtcccactgatagtccctactcagtcttccaaagaagggtcggattgagtcccaggcctggtcgcaggaagatcccagaaggttctggaaagttatttcacccctgtgacaaccatcacactggtattctgtgaacagagcccaggaaacagtaaccatgagacataatgggctcaagtcaggggagaattaactcagagttgttctttggtataggaagcccaaactaagtaacaactgttctgtccaaggtcccttccatggctgactgtgaaatcagcaaagaaagccgctgaaactgagccacagtttccaaggtctcttccaacactgggactctgggaaaggaggaaccatcgagagctacatctgcacttgttcttaaagcggtcaacacagaggcacaggtccttccaggaagggcagcatccattttctccccatcttccacaccaaagggactctgagtgccgtggatggagtccttgctcacttccttttaaatacccagattgtccagaggttttcgcaggtccagtcccttcttcctgtgagtttagactctaacataaacatgcagtcgttaacacgtgtatataacatgtgctgtcacataataataccctacagggggagaaggggagtgagcacgtgtgtcaggagaaggaagttctcagatctactttgagctgacatttggccaggaatcagagggatgagggccatgtaagtgggtacagggtggggagatggggaggtaaccaggagtctaatattgtggatgattgaaaggtgtactccttgaacaaggggcatagtttattagatcaaagtggagctggtacctattggatgttgctcaacactggagacatgtggttctccagccaatcctgccttcctgtactagaaaggaactcagatagctcaaaatttcacaaataactagctagtggcattcaggaaagctctgacaaggaaattttcagtattaggggaaatcggaagaggaccaacctggggcattcttaggggttggaattaatcagacttggtggctga

SEQ ID NO: 568 - DNA, 3650 bp, Mus musculus
gccctgtgggcgcttggattgcagaccctgtgatcaggatagaacttgtttctagcccccggtgcaaggtttggtttggtttttgtttttaattgcgccagccctgggcaactgttggtagctgtttatgaagacgttcccacagagcaagttccaccaggagcatggcgagaccaagaagaaggcatgcaggtgtggtccctgttctcaggccaggctcactggtcccagtgttctggtgagctcagatacagaactatctcaaagacgccgagaagagggaaggctaggtactgtcacccataagtaacatacaacaaagataccaactttactttttgttttctccttagacaagaaagcaagttcaaagaaaagctgtggttgttggggtggtgcccccccccccgacaccccaatacggctcttcgattttggagtgctcaccttcacctggttggacgaagggttctaagaaggaaaaaccaaatgtggtaggaggtagtatcaggccagactgagggaagtactgagcctcccagaatgcacttcaactagaggctcacgggatgccctgaagagcaggaggcaacatgggaacttgtctcatttcaggcctggaacctgggcgccccagacccttcagcttctggatcctgccttcctggttgaccggaggctgtctgaagcccctccccagcacagggctccctagctttctgtgggaaggatatgcctttactggctctgagcccccatgctgcagacaacctcacaggatggaaggctcctctgacgcggtgcagggctccagaggtaatcagtgctgactttgagaaagtgggagctgtcgggtgttttactggtgttaatgtgacacaggcagaattaacagctccccatgtgaccgtgcaatatagcatgtataggaggaaccccctttccctccatccagtatagggtttgattaaatcagtgagggagacagaattgaattagcagcctcttgtcccttgtgcctcgaggttttctgcgagagagccaagggagacaccctgccctctcaagcctgcctcctggactctgggaactgggaatcccatttgcaaatgctctgaccacttccctgccccatgcaagctgagttccaggggcttctttagagagaaagggtctccagagtcctagtcagctcatccataaagcaagagcttggtgccagcgagagacagacggggaggcggggagcagcagagccctgtgagccagccagccccactcagggcttgggcttctcagttccgggcctgttgtacattgttttgtttgcttcccaccagccttcagcccctcccctcttgttgaccatgctacctcaggcccttgtttacattcatttggtgctgtccccacctttggttgtatcttcctgctccatcctgggctcaccaagtacatgagcttttccacggtccacgtgactacacctctcctccgacgatctcctggttcacttagtcctccctggatattcatggaaagcccatgcctagcctcttttggagtccaaattcccgtctgcacagccaaatcacgagcatgtgcttgcacgcaatcaagctgaggggtctgtaacacataatcacaactcgaatatctagttgccaaacactgattcccccccccccagggttctagaacccagtcatgatagtgcttagcccaatctgcatcactttgcctccaatggtaccgagaatgagaaagtctttagaggtgtgtgtgtgtgtgtgtgtgtgtgtgtgtgtgtgtgtgtgtgtgtgtgtgaaaaatgcatgtggtatgtgcatgtgagtgtttggctgcatgtggaagccaggcaggatgttgggtatcttcctccatctctttccaccttattattttggggcagagctaggctgactgaccagcaagctctcaggatcctcctgtgtctggtccccatcttccttcaatgctaggattcagccgctcacagccatactttctgtgcaagtactggggatttgaacccaggttctcttgcttccagagtgagtgtccttacccccttgggccagcttcctaacccctacagacagttttacttaatgcctgtatcaaccctgcagaaggcaactgcaacagtcccatttgacagatatgaggcaacaggaagcagttggccaacatgggttgcccagttccatctgagttcacagttcagtctgtctggagcaaactgggcccacacacggcctcatcaattactgacctatcatcctattaagtgttccagagctatatttggtgacaccatgacccacaaccaaaacactctagggaacttttcaaagtcccttatttttattccttttctgctttctagcaggaaaacccaggcgctggtatcaggaggcccgtgtgcccatcacccaccctcagaacaccaacaacattttgccagtcttgttgcttctgttccctcccacgcgattcttctctcctgaagattttaaagcaaatctccgccatcctttcactccacctgtaaatacttcacggtgcatctctgacagatgagggcttgtcttccttgaacctaattacaataccattaccacccaacaaaatgagcactgggctcccaaggttatgaaattcgcagagcatctttagattccctcagtagagtcagcggaggcttttgacagttggctcgtttagctcaagatccaaacaggcttgtctgttgcacttgggtggcatctcccgagtctcccaccccacttcttcctgcccccaccacctgctacaagctctggggggatgggtgtcccttgggatgtaccacattccaacttacaatattacttgtttttattaatgttgtgggtttatgcgtatgtgggtgggtttttaccggcacacagacattgataggtatgtacatcctcatgtgtgtgtgtgtgtatttgtatattcatgtgtatatacatatgtgtgtatgtgtgtgtgtgcatgtatgtatgtgtatatgtatgtaagtgcatatgtatgtatgtgtgtatataagtgtgtgtacatgtgtatgtatgtgtatgtgtgtgtatgtgtgtttatgtgtatgtatgtgtgtatgtgtgagttcatgtgtatatgtatgtttatgtatgtgtgtatatgtatgtgtatgtgtgtgtacatgagtgtatgtatatgtatgtgtgagtatgtgtgtgtaggttgccttcagatgtctttctcagtcactctctaccttatttttttaatattttattttttgtgttttgttattttgattcaaggtctctctgtgtagcctccactgttctgaaacttgctacatagacaagcctggcctctaactcagagatccacctaactctgcctcccaagtgctgggattaatggtgtgcactactaccccactttctctttaaattacatgtgtatgtgtgtgaggatgtgcatacgagtgcaggtgtctgtggaggcaaggagagggcattggtcctcagaagtttgaactacaggcacccgtgtacactggcaatagcacatctggtatgcattctgggaagggaactcaggctctctacaagagc

SEQ ID NO: 569 - DNA, 1975 bp, Mus musculus
aattgaacctgggtcctttggaagtcagtgctcttaaccattgagacatctctccagcccaggtaggtgtattctttatgtactccctaaggaaagaaaatggcctaagcatttgcagccttttaaaggtgatccaaaaaggcctctgtgagaaattcaagtgaacagttaacgcacatcgaagcctctatgatttagagatgttttcactggaggccacctttaatcacagcaggcagaggcaggaagatctctgtgagtttaaggctagccagatatacagagcaagttccaggacagtcaggattacatagagagaccctgtctcaaaaaaacccaacaatcattcatcaaaatacttcataaagaaaaataattttgattttcctaaagtgctggatgttagtggcatactcctataaacccagaacttgggaggctgagaggcaagagaactttgatgagtttgaggccaatttgggctcacagtgagttccaaatgagccaagaatataacaagacactgtctttttaaaaacaaacaaaaagccataaaggataaggaaaattctgcttagccttaccctctatttggtaaattttattatatatattcttctaaagtgtctgtcttttacaatttccagctatatatttatagtccctcagaacaatgtcaacatcgcgtgcttagctctggaaatccaacaatgtctgtgtgcagctgccacaggctccattcataatagcttctcactggcttcacttctccctttgctctgccaaggctcaatagtcaacagacaaaaaaaccactggaaaccgctatgatcacagtagagagaagtaaaaccaagctttaaaactgctacatctgggggaccgcaagatggctgggatgggaaagaaacttcgtgtaagcctgacatgacagccttggttaatttctggaacccacatagtggaagtagagaagcttccacctgccttctgcatgtacgccatgcacgctcgcaagcacgcgcgcgcgcgcgcacacacacacacacacacacacacacatatgcatgcacacctagtaagtttttaagtcgctgcatttttataagtgagaaaccacagagaacagtgcctgcctgcttttgttctaatacagagtttctccaccagtgaggaatctgcatttccaactaggcaggaaaggtatatctaagcttgtttcctaagggctagagcttttatttgttgtcttcttaactgtgtctttggttctctaaacaaatgtgtagcactcagtaaataatctgaaaatattctgtgtcacagtacttatacaaaataatttttaaataaatgttttttctccataaagttcaacctgcccataccagcattttttacaagtacgcactatgtgtgtacatacacaggtggaggccaagacagcctcagatgttgtattagtcagggttctctagagtcacagaacttatggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagagctagactcccttcttccaatgtccttatattgtctccagcaaaaggtgtagcccagattaaaggtgtgttccaccacacctttaatcccagatgaaaggcatagcccagattaaaggtgtgttccttaactcggagattcaatcttctggaatccatagccactatggctcaagatcttcaaaccaagatccagataaggatctccaagcctccagataagggtcactggtgagccttccaattccgaattgtagttcattccaaatattgtcaagttgacaaccaggaatagccactacaatccaccccttgtcaacttga

SEQ ID NO: 570 - DNA, 1825 bp, Mus musculus
ccccagcgaggctgtattgcacacatgtgagctgagcctcttcactcactatagagtaaaacgatgctatccagtgtgtggggagctgggcaggggtcagggctggcagcttggaagctgggcggtcatcatggtggcacaatgcaggcgctaactgtagcgcctgcttctttagaacccccgttgtcctgctgcagtcactaggggctcctatgaaagtatggatttgtctgggtttctctgtttaatcccaaatctgtcaggccttgttaaatttgatggggcctgaaaggtctggtgttaagcaaatactcagtggccagagtctttgatgagaatcaaactgaagcttaatcctgaggtaatggctttgcccacaatcccaggaggccagggataagtgagggggaggtggaagttaggaggatgcctgaagcagagcttgctgggagcgagttgtgtggagaggggtctgggcaacagcttccctttggttgggagttccagagcagtgccccctcctcagcctcctgctcctagcacgttaaatgtctgaatctcttggggaatatattctgacagagtggagtgagacaagatgaggctctttggtccctgttttcgcagatggcgttgagataaagaagaaaacagaaaggcagccaagaagaaggataaacatcccctttaggttttcaagtgttcaaaggttcccttggaggtaagagtggaggggcagggctgggctgggtcccttccacctcttctcacagggagaccatgatctacaagtggtgtgccaggcaaaacaaaggcccctagagactaccagactgtggcatctggaatccccttgagattcttggctctctgggggagctggggcatcttgcagtgttatagaggtcttcagggcagggtatagaaagcaggtggtacccacactcttactgccctatgtgactaaaagaactgatcgagccatctccagcagttctctggagatggctgctgtgtgcttcgtcaaggtacctgattaaagattcatggggaaaaaaaataaacatttgcaaagcgatgcttaagcaatcaggcgtttcagggggtgagttgccacagcacagcaatcccatgccccgagagtaatcggcatttaatgtcagcagcacctcctgtatccccacacggaggcaaggatgcccgcatcaccctccccggaggccccactcaccaggagaagctaggctctcccagcagctcagactttgctctttagttgtcttcccccaccccccacattttgtttattgtgcacagggcaacatgggctcttggcagagaagaaacatgggagatttcatagcagacactcactcctgcaaagtacagaagacactaagttctggaaacctggcctgagtgtggttcacaggtccaggttggccagtcttcccgtcactctttgaggagctgccacacagatttccatgtgattcctgccttcttggaagctgcaagtccgtggacagagtgaggctgacggtgatgacaaacactttcatatgtcagagactggggaacggcgcatcatctgtattacctcatttatttacttagtgtgtgtgttcatgtgtgcactgtgcatgcatacacatgcgtgtatgcacatgctcctatgcacaggatacaagtggaggtcagaggacaaccttcaggagcaaattttctcctaccatgtgggtcccaagggtcaaactctggtcatcaggcttggctgcaagcaccattacccacggagccatccctcagccttgtcaaatctctt

SEQ ID NO: 571 - DNA, 2100 bp, Mus musculus
tatacatacatattcctaagtacataaatgctctgttagttgtatgtatgtgttcagagctgaccatttattggttttgatagccaattggggtactcaatgcttttttttttaatttatctctgaatgtttcagcttattagaaaatttatttgttacagtgtggttttttttttcttatataagcagagtagaaagtttttaaaaatttgcatttaaaagctaatatgaaatactactttggtcctttcctgatgtccacatgcaaaccagcccctcactcaaagatgttaggcctctgtcataattctgacaatcatgctacgctgatggtattaacaatatctcttgccttatcctggaaacccaaccaggaaaccattgtttggctccacataatatctaaaattatgttttatacataggaaacactgaataaatgcatagaatatgagtcattttgttctcattcagtcttatatttgtgggggagtttttgctttagctgggagatgtttttattttcttccctttttatttattttttcaattacataatacatatttggtcatattttccctttccccaactcctcctaaatagctctcccctcccccacaacctcagctgtctattttgtttggtttcaatgcaggctttctccaagatctgctttatcttataaacatagcagggcctgtttattttcctcttacattaggacgtcactcctatcatttcaagctaacttattttggctcgtaatctgaggagaaatcaaaggagctgcttttaatattgtgagcaaacactgtccaccactagcagccgtgtgtctttaaaattaatttggggcatcccttttgaccttagacaatccagtaggtcgagcgctcgagaagccaaagccacgattaagcctgccagagatggaacggctgatgccaaactcctggagattactcccgggcttgagcctctcctctccttctgaatgaagctcattactgataaatcatcattctgcatttatgggcttcaacatttaataaaccagtgatcagaatcctggaacataattaaacctttgatgaaaatgaatgagcatgggaccaaaaccaaggagagcccagatcagagggaagaggagcaggcaagaaagaggtttctctggggcctcaggacagacacgctgagccttcccattctcctttggaccatgatgtctattgcctgtgatgaggaacagcaaacttatactaaaacaaaagacaaatttcagtggacatgtaagaatcttccaaggggttaggaaaggtcacttcagtggggttggggtggaagttgacttcgaacttagtcattacccttcagttgttcctggcaagaataatttgagtgcaataaaaatcccagaggggtgtgtgtgtgtgtgtgtgtgtgtgtgtgtgtgtgtgtgtgtaagcattactagatcagagaaaggaatggaatagtgctaccacatagttatgtctgggtaaccagcggctggtgtggtgaagagctggaagacagagtgagaagccactgggccagtggtcttgctctatcatgaggtggttgtgtggcctgaaacaccgatttcagaagacctgttctattctgcatatctcttctcagtgttttttcctatacaccaacacagctgcatgttttatggaagtagaatttacaataaacagatacgtgtttgctacaaaattatattgttttctcaatttacaaaaaaaaacatgaaaatatgatttttaattttattatgttcaactctaagactattctttgtttgtacagtagttgttgaatgtttatgggctttgctgcaatttgctgtttctggtatcaggagcctggaggcagaaactgaagctgagcccatggaggaatgctgcttactgggccgttctccatggtgctcaccctgctttctcatatacccagaaccacttgaccagggatgacaccacccatagtgaagtgggcccttctgtgtcaacatcaataagaaaaatgctctagaagcctgggcacagaccaatcatattgggccattctct

SEQ ID NO: 572 - DNA, 2875 bp, Mus musculus
ggtcactttactgcaggacttcctggcctcttcagatgtattatgagtgcctaagttccaaagatgacttatcaagaaatagtctcatttaggcacctttaccaacgtctccttatcaatatcttcttatcaatctctccttctgtagcagcccaagaaaactgtcttagaaaaagcatgatccggatctagttgtgcaggcctataattccaggtgtggagggggccaggattaaggattttctgttaaaggtcagaatgggtgacttagatgaagcgcagtgggcagagggctttgcctagtactcaggagacccaaaccttaacgtcacaaagcaaaaagaaagcgactcttcctagttgttttttctttcgagtcttggcttcacgtgcaattcatcagagtataaatcccaccccctctgcacattagctgtgtgatctggggcagatagaatcctagtatgccttgtgtttgtctgtggtaaaacataggttttgatttgggaggtacagaattctcatgagaattaactgacactataataaatataaaccaaatctatacgattagtaaagtacaaaatacacattgatccatgctatgaattcagacatgagttataaatataatcttgagatattcatgttaagagtggattttcattaatttaaggacattagccataaaactgatgtcccactgaaaacacgatctagtatttggccatactctgcaaaacagttcacttttgatatcccctgtccaaacagtgagcagatgagacccaaaggagcacctctctctttattaaaaatggctggaggaaaacaatctgcctgattctgcgcgtgtgcacacacacacacacacacacacacacacacacacacacacacacacacacactattgtaacaaactcctggagcagttggaaaggacacagccagcttaggatttatgtctggtctttaaactctgaaataagctgaattatgtaaacattttggcacagcatacagggagggaaatacattcctcctggcattattaacaggtgctgtgggaataagcagctatggagagttcacattgcagtgtcagcagaagaaaatgtattttataggcttatagggatagaggagggccagcaagagcccacaggtcccatgcaggaagatggctgacaaatactttccagctgtcacaactgcacacggggtctcatgatttcttatagtgttatgaatgtaaacggtattcaattaactgtttcaaacacagaaagactgcatttacaagagagagatttctaggcacctgtcatgcctgccacctctgctgttttctgtggtgctcaggggcaggagagaggttgccccccacccctgttctaaggccactcagctgtgctcagagaatataaataaaaatagacatacaaggagtgagttctcagtaagcagcaactccatcacctgaggctgagcctcagtatttagtctatccacacagcatctcaacctcctgcatcagccccctcctcccctggccccagactcaccaacactaacaagtaccatgagaggaaaagagctttatgtccaggaggtatgcatgctactgcatagagcaccagagagactgatagaagttctttctctgaagagctaggggtgagagtacctttaaagatcaaaggctccctgcctggctgtatattcccttttaagaatgagcaaaagggaaaaaaaaaaaaaagcaatctgccagaaacagaaggccacatgctagaaactgcagtcaggtagcaacagaacatgacataagactctccccagcagttgaaagagcctgttgtaaagacagatgctgtgagcaaagttctaagttgtgggattaggaaccttgtccagccccagtcatccaacagtccctccaggaactctgaggacttgagccaagcagggatgagtttgcatggcccctgttcttcctttcctcctgcaggaaggatgaaaggcaagcttttcactaagatgacctgtgactgcagctcactcccgctggaagtcacaaggtcttgtttcaaagatccatgtcctggcactgagagacagccagaggccccctcactgttggccattctgctttccaacgctgtaatgcttgccagtcactggactgtaaactcagagaagctcagtctggaattaagaatgctaactttgaaatgtaagaaacctgagttcaggttccggtcttgggtctgccaagcagccttgtgatgttggacaaggtctataatgactctccactgttctttccatagtcttttactcacagtttggggaattgaacgagatcatttatatgataaaaataacaaaaaaaaagaatggtgaatactgtttattgtttgtttgtttgtttgtttggttggttggttggttggttttttatctctgccgagaagtgaaatgcttgccatggccttatgaagataaacagaccacattctgttatgtaccaacctacttttatgagttaatcagttaacttggaattttttagatagagtctcacatagcccacatatcctcaaacttgcctatgtagccaaggtttgccttgaactcctgatcttcctgtctctacctactaaatgctgagatgggaggtgtgtaccacatacctggctcatctctagtttccttactagaagtagggggatgaagcgaaaagcacctaattaactcaaattgctttcctgtgacctacatcccagaaaatctgacctaggcctgggccaggtactctgattggttagcatctatgtagctaagcagaggaggctttcataccctcgttg

SEQ ID NO: 573 - DNA, 2050 bp, Mus musculus
aggaagagatctgaggttcccctcagacctgaagaggaaaagatccctgaacactgggagctgtgtccatgttggctcaaggccactgagggaggcaccacttcagcaacacccagctgaggccacttctgaggtcacctcagcaccatggtagggcctgaaaacctcctcctctaccctccatgacccgtcaccgttccctgtgtggaacacacagaccctgacccacataggctcagcatcatttaacagctatgtttatatgagctgtgggcatctcagagctcacagggatgcagggagagatgtataaacaatcacaactgaacactgacacagtagttggtgtagacagctgggtggagtccaatttcctatattgtccagatttttttgatatatatatatatatatatatatatatatatatatatggacttggaagatggtggctcaggagcggtttaaaccttttatttactattttgaaaagagaacacatttatatgttttaaaaaaaatttaacaagacagtccagaataaagtaagaaatcgttcccatccccctcccccccccccagccactccttcccagtctaatcctgctttgacttccagtgaagacaaacatgcacagactctgaatggatgactagataactttggggatcttgtggtgcaggggagggcccagccttctgtccctgcccaccctcagatccagggttgcagccataccaagatgataatcgataggacactttcaaatatttatgaaaccccggtgtattttctcagtctggagttgtaggctttcatggaacttggcattagaaactagaaggtcaatattttccctgggccactcatgactggtgagatgtaagccttcttggcttgcctctggccctttgggcctggctgctcctaccctgtcagcttcttgctgatggttcttgaattttctgccgtggaaaactggtaagaaaaggacacagagaggccaaagctctccatgggagctttagagtgggcagaagcgctgcgcagactcactgtggggatttggagaagtcagtttcctttcttgagcctgtcagccatcctcagagtgggaagttaggccagtccccgagctccttccgaggtttccacagagctctctgagtgcaagtcctcactgtcttctccaactcgcccgtccacaaggcagtactgaattgggctgtcttcctccgggagttgaaacaagctcctgcttgtttctggagccgtttccaagttgccgaggaagctgtggccgaagagcccaggcatccttagaccttctccccacttcgtggcttcttgctggggcccaagggaacggatgttacaaagctgatggtatccagtctgatcaggattgagagatggccacccgctcagctgatggaaggttgtggaaatcaagctgacagttccataaccccgagggcagagccagggcagccaagaccaaatgagcttggctgtgatggggcagaggaggggcagcccgggagagccaggcagaacgaaccgcaagggtcttcctcacccctatgtagcctgtgtggagcggagacagtatttaattttgtataattgaaaagtatttgaagattactatgcttattattttcaccacaaaactcaagcagtgtaccgccttaccatacgggtccccttccctctgagcctgctcactcctattgttaactctgagctggctatctctctgacccttccacccaatgcatggtgagccatgtattgagagtgagacagagctgcgctttggtgttttgttttgtttttacttttgagacagggtgttactgcgcagaccctgtctaggttggccggaaattcatagagatctctgcttctacctctctggaatgctgggattaaaggcatgtgctaccatgcctggcccaaactgtgttctttttaaatgacttaaataggattctacttcatagaactcattctggaatttacttttcccagtaagtgtggaggaat

SEQ ID NO: 574 - DNA, 1975 bp, Mus musculus
tcaacaccacttgaagtttaggatcagaagccactggggctggaaaaacaacacaaattagacttcatttatcttacgcacgttcgagaccggccaggaagaacaaaccggaatcttctgcggcaaaagctttattgcttacatcttcaggagcaagagagagaatggcgaaatcccgtaccttttaaggagaattatcctccgcctaagacgtgttgctccctgattggctgcagcccattggccgagttgtcgtcacggggaaggcagagcacatggagtggagaactacccttggcacacgcgcagattatttgtttaccacttagaacacaggatgtcagcgccatcttataatggcgaatgtgagggcggctccccacacatttatatcagttacttatttcactgttgtgacaaaagactggacaagaagcaagctaaggaagaaagggctcattctggtatacagttctggtggatacatgccatcatggtgggaaaggtgtggtaccaagatcagttgcagtgaggaagcagagagagaggaaggaatggagtcgggctataaacctctcctcaacccctcagtgacccactttctccagcaaagcactacttcttaaggtcttctaacctccacaaaaacacctccagctcaggaccaaggattcaaacacaattgcctatgggggacatttaatattcaaatcacacttcttcaccttttacaaatgaagtttatttctaggtcaagtatcccttattccatgtgacagtttcctcgtagtaggttcagagcttttcctacccttctccctgggattgaagctaggtccctgggacttagacggtgtcaagtgggaaagttctcactggtcctccatctttattctttgtctcctgacacctgctgggctggacataatcccagccgaccccacacagacatccactgagatgtggcaaactccccatctgccaaacagagcgctggatgctcggcagtcagcctccccactttcctgggctctctacattttcttctgtaaacatgtaacattttcaaaatcggaaaaaagccattaaaataagtccattgaaactgccttcaagtatctgtcttatttcctatggtaaaagtatactaaggcaggccctgtgtggggtggaaggctgtcttgggatctgggacacaatctggatgaaaatcatcgcctgcgagaaaaagtaggacaatctaactgaaatagatgccaaacaaacccacctagggatgtgattaccaggtgttgctcgagatgcctggaggatgctctgactcctcgtgtgcagggaagtgactgggctgtgaccgagagtaaacaaagctgccctgccctgctgtgtgcttatggcaaaagcgaggctgtcttgtcagacaatgatccaagcagactcgatcagcagagaatgcagctgcccttctgggagaagcctggctgcgcaaatatgattatacacattacttccttctcctcccttgaaatggatccccagctttgagattatggtctacatagccaaaacccaggttttcctcccctaggtctctgacattgcccagagtagaggatgacactggcaacctgaataaaggctctgggtgtctgggtagacgcaggtgtggggatggggctttagactaatgagtttgacctgtgatagacctttatagaaagtaatatagccatttgtgttgatagcctttcaaaagttcacactcagcattcaaacagagctttatgggtaatagttacataatgatattccataaaatggtaaaaaaaaaaatggaagcaacctcaaagtttattaacaagggaaagagataagctaaatcatcgcatgccctacattggcccaatatggagacattaaaatgatttttaaaggatttaaccagtggttgggattattcacagtgaagcaagtt

SEQ ID NO: 575 - DNA, 2700 bp, Mus musculus
cactgacctgtggtcttgaaactcaactgtttcatagaaaccctgctgagaaaaggagactgaagcagaagaagctatgctccattaacatgtctctagtctatatccatccagcttatagtgacagggtgagggaggcctattatggtactatcaccattagtaaagggtaatactttagttttattttatttttaaaagatttatctattttatgtgtatgaatgtcttgcctgcatgtatgtctgcactgcatggatgcagtgtccatggagcccagaagagggtgtcagatccccaggaagtagtgttacaggcgtgaactgccatgtggatgctgggaactgaaccagtgtcctttgtaggagtagctagtattattaactgatgagccatctctgaagcccttattttccttacattttgtagtgtgtatatatgtggtgtgcatgcatatgtgtgtgcgtgtgtgtatgtgtggtgtgagtttgtgtgtgtgtatatatatatatacacacacacacacacactcatatatatatatgagtgtgtgtacatgtgtatgtacgtgtgtatgtgtgtgtatgcggtgaatcgtaagtcacatgtgtggaggtcagaggacaacttgcacaaggccagttcttactttctagcatgtgagttcttgggcctgaactcaggttgtcaggattggtagcaaaagcttgtatttacttagcagtcttactggtctcaaaagttaatatttaaaaatgtcatcttagttatttcagaatgctgaaaatagaaccttttttctctttcattcaaaatctgcccttaaaagacatctacaaagtgagccactaacagctctccaggagtctgctctggaaaaggaaaggggaagggagaggggaactttcctcccatcctcctgcacctgtataaaggaaagcaagcgcttcccgctgtacttctgcatttgtttaccgaagagtttggcaaatgtgtgtgacactggatggaaaccacaagtgatggcttgtttaatggaactaaccttttcgaaattcaatttctaagtttagaaatgttttgagcctgagttctttgttctgcagttttttatttcaagtgtctatgcagttaagagcactgtaaatactgtgcatgtgtttctgaaatgacttgcattttgtacataatgttcttgcacagagcaattgaaatcctgctatactacaatacaacactattacaaaaatctagaatttaaaaaaaaaaccttaccatatgaaattctatttcagttatttactgatggctatgccaacccaactcccaatctaaacaatgcaattatttctacctagtggtaagagcacatgctgtacacatttggcttcctagctggcaggaaaaagatcacaatgagagagatagcagtgtttagaaaaagtcatagaacatgtttccaccattgtatatgtttacaaatatataacaaggtggtctctgaacatacaaacacattctcgtgcccacaccaagtggggcttcctttccataggttattgaaagcagtctggcactaggctgactaagtgagcaggtaattttgttggggtcttgagaaggaaaagggtacagtaagtcaggagtttatcctgcaatcaggtgggcatccctggttgggcagagccatctgggggctcaagatgcctgtggagcaagaagaaaggatctggattatgcctctgcaagactaaagggtacccaagtgtgctctgttctcagagatcatgaatgctttgacaggtcagctgtattcatgcctatcattgcttaggtggctgccaattgccaagtatatgtagaagtggaaaatatctggggagtgaagttcatgttcttccagttgagtctacttgtcactgtccaggcagaaccttatcagtgtatgtcacagtgatcacctcaaaggtggcaggtgagacgggaagacatgaggatgtggctgcagacacaggctttgtgcgtcatggtccctcccacacagcttccaacatctccaggatcagtacttgcatctacagggatgcagcctgagatgtgctgaagctctgttctgatgtggcttcagctctcagcaatggctaaatctgggcctgctgatgccaacacttctcttatcaaaacaaaaagctaaagttcataatcaattggagctccaggacttcaaacaaactgctattctctaaagttgtcactaaactttccaaacactcttttaaatgttcactaaaacccatggtacatataatggtaagaagcagctgaattagaggatgggggtggtaatactgagataaagtttcagttgcacagaaagtcaagttgatcctgtgcctggcccccatgtatgttctgttcacatgggcaggttggcagatgcctagctaaatcatcaacaagactacgacgctcattcttccttgccatgctctgggtcaatcgcacaggagggttcagcaggcctcatctttactctatgaatgtacacacgtgtctcaggttatcactaactcactcacttacacaggagctggacagcagcaacagtgtgacgcagaaggctgtgtccccgccatgagcaatttgggaaggcttgcccacagtgtggcctggcaagggcaaatcctactcttcaaaact

SEQ ID NO: 576 - DNA, 2150 bp, Mus musculus
agaacatgctctagggttgcatgggaattcatggggtctcagaaatgcagggcacagagaattccacactctgaacattttctgggtttgacataagttccttttttttttcatatttgacaatgtcctaagcctcataagcgagtcttatatttgctaatgaccatgattcttataattagctttttttctataggggatggtcacataaaggtaaacaatatggtgactatatctttgttgtatccatggaaatcatcattgatgatttattaagaatcctttctcctgatctccaaacagtacattgtgctggcccatgttccttgaagaatatatatgcttttcttatcagataaatcagctttagttttgtttatattttggtttcttcaactgttttgacagtggcattggcctcttaagacattaaagttagagttattttcaaaactagtgttcaggggtcaaagagacaagtcagtggttaaaagtggggctcctccagcacccaagttggggtgcctcacaaccacctgaactccaggagacctaatgccctcttctgaccttcataggcatccgaactcacatggtcacacctacacataaacaaaaataaatcttaaaaagtagtttttgagagggtttcagacatagttctgtggctctgcagaactaggtaatctgttaaagtagtcagactgaagacaccccaggtgggataagatatcccgctgtcataatgcccttatcactgaggaccctcgagtctgttggtagagccatacagtggaggagtgcttctgggaagtggagtctttgtgcacctggccccagaatgcaccgggcttctttcattagtccggctcccgcagttgcggtgcagcagtgactgctggccgcccgtttttgatggcaatttggcagagagtcaaactttggccccgaagcagaggtggcacaattaggcagctgagaagcattctctcaacacacacttttaattgatttcagcttgtttcagtttgcaaagacagagctgttacacgcagcgcagcggccttctttcgaggggcttatttttactttccctttattcagcagcgctaattcaacagcaccagaagcgacaataatggcagagcgctgaagagagcatctttggcatggcttggatgcaaaaagtattattaagaactaatgagtaggatagttagatgttaaccagaaaagcatcaatgagcagaagagcgaacgagcgatcgagcgaacattctggggcaaacatctgcctctgaagcagatgttaccttgtaagtttacagaaggaaaggcagcgtaagtgtaagctggtggttttaggtatggcagggacagggagataatcacggggccttcttgttcttcttgaactcacagatgactgtggatagaggtatgggctttaaataggaaaggtatcaagcaaggatgaggtgacatcagtggcagctgtggtggattgtgacctgagactgtcagcaactaactgtgttctcccctgctttatctagagcccagacatctcttcagcacacaaggttacagctgctataaccttgtccaatgagaggttaagacctgtgacccgttcagccccagcccaaaattacctaacctactgctgacttgtagaacagcttggtttatgcagatgataatgagccagtggccacacattttctcgttacacagtaagtcaattgttttgttttgtttgtttgttttccagctttcagtccttgatccaaaaatcaccaactagtaggatttttcaagactaccttgcaatctgggatgtattttaagattcctcaaaggacaccagattagcaactgtgttacttttgtttagttctactgaacaaacctgaagagaaaaggaagccctgggaccctttagtctgtcccaatgccttcaagaagaagttggaaaatatgagggcccagggatggagagatgactcaggcaataaagtactggccatgcaagtgtgagcacacacatcaataagatgggcgagccacttgtaagcccagcactggggaggcagaaacaggggcatccctggggctcaatggccgggcagtcttgcctaatctgtgag

SEQ ID NO: 577 - DNA, 3875 bp, Mus musculus
actggacttgtgagagcctagaaaattcctccataatgtcaggataaagaatggatgtctcctcatgccgctcctatttaatgtgctcaaaattttgtacaggacagaataaaatattaaatacaaaagaggagggtgaaagggaaggagagatgaagggagagacagagagagagagagacagagggtagggaagtgaatatgcgtaagttcgctcttttgttccagaaagtagtttaattacatctgtctttccaaatcagctctccacccaggctagcccatactgatatatagggagaagagatgagtgttatgggagtcaagaaaaggctccaagacacctctcacccatggcatgtgtttcttacctgagatataactgaaccttatgtgttcagtggtagtgaaggagaagaaaaaaaaggccacagaccagacatgtaagagccaggatgcatggggttgtacatgtagctctgctgggagaatgcttacctagcacacaggaagccaggagtcaatccccagcatggagtaaaccaagcatccaggggcatgcctgtgatcctagcacaggggaggaagcagaaggtcaaagtcttcctcactatgtaacaacgccgaggccagccgtacccagtgagaccctgtctcaaggatagagagaaaaagaaggagggaggagggagcacagaaggaagaagggaggaaaaggggaggaagggagggaagggggggacaagaaagagccaggggatctattgaggctgccacggtttctgtgcccagcttggagcagagccagcctttttccacccactcttgcagctctgacccctccggcatacagattactgtccacactctatgcacatgaagccagaggaccccaaattcagttcagctaggaaggaacggagaccgaattggacccccttccaaaaaactgggactattgtgtacttcgttgttcaaatgtccctttaaaagtcttctcattccgtcacacgatctgctttgatagatgacagttatatacctgcagtgttctctgtgcaggttatcgactccctggggatcatccgatgcagcagcttctacaaacctctgggcctctgtgtgctccctgccttccccttcctacctctattctctcagcagaaggcttttgctgtgtgcctcccatcacctctcccagccctgaagcctgctgttcccgcctctctgttcaccttctggaaaggttagccactccctctgtggaggccaagtctcagcagccagtccctgggctccttttcctgggtggcacctgtctaggttaagatgtcttctccaagcccagacagacaaacactgcctggctggattctgaccacatcaatagtgaaatgcctttcttcaggcgcctaaactagggcagaaccattctgctgtgttctgctgcagggcttgacacttagaccctgaaatgctacctccaattggtccctgagaactcatctgggatttcttcatgctgtctccttccatggagtctggcacaaaacagagattctaagcacgtggactgatgaggactttagagagatgacatccccaaacagaacatacatctgtctgtcttgctcctcagaagccacaaaggtaaattacagagtgaaggacatctatcagggagaccaaagcgatagtttagttggtgcagtgcctggctcacagtcacaaagccctgggttcaattcccaacaaccacataaaccaagctggtgcaagtaaagagagaaagagaggaaggaaggaggtggggaagggagggagggacaaaaaagaaccaggtctattgagtcttccttggtttctatgcctagcttggaacagagccagccattttccatctactcctgcgaccctgactcctcagatatacagattactgtccgcactccatgcacatgaaaggcagagggccccaaatccagcttggccaggaaggagaggaaatcgactccctttctcaactcaggcagtggaggtaggaggagcagaagtaaagttaatcatttgttgtgctgggaattccatgccagcctaggctacctgagaccctgtttcaaggaatggcttccattcttaccccagggtcagctgtctttggccagcttcctgctcctcacaaagataccactgaatgcagatgggagagttaggcatggctttcccatgcatgtatgtatatatacatacaatacatttgagaattaaaggagtgctagagggaatagtggttgggatttatatccagacatggtctccccacttcctaccacaccttctttaataaaagcctgggaagatgggaaataacccaaggtcattagcagattcagggatgaataatggggtgcatcccaaggagacctcaatgttccctgatacaggctctctggggctcaggagggcaagtgaaacgggcatccttcctcttaagtggacagccgactttctccaagttagctttcatctgctgccttacccccaggactctgagtgcagttctctaactaatgaagtcaattaagagtctggaaacgtagtgtcctacaacttgggtgtgcaataggtacaaaaggtttgtcccgaatggaaaggttgaaactgtactaaaaataaatcccacataaagctatcctttgtgggctaattgctaatcggggttccatgtatgagacactgcagccccacacagggcctaattggctggtccagaggcagcctctgctgtctgcagccctggtccagaagtggatgattgcacaaggcctgatggagccagagcagttcccagatcttcagtgccaaggtgactcttctctttgttcttattaaggcccaaccctgataatgtcacctcctccatgggcctggctgcaagggtctgaagggcaacttctgttgtaagttgaataatgttaacagctgggatgcgccgtctggcagaggtcagtgctgttacacgtttcagagagcacatttttagtaggaggtgaggcagcagcactactgcaggctatgctttgaggctccgggcttggaaatcagagctttttcccagcagtcagccaaggctgaccagctaccctgtgtgaccctcacaaaccctttcaactcgtatgaagcctactgggcggcagtgtttttttttttttttttttttttttttttttttttttttttgagtgagcgataaagaaaagtcaggagactgaatcgggagacaggagcttgaatccaaggctggaagatggtccccatcagtaaagggctttccttgcaagcatgaggacctgagttcagtctttagaacccattacaatgatgggcatggtggtgcctagcaggtagttgttggggcttcttggccagccagactaacctaactggcagccgcaggataatgaaagagcctatctgaatgactgaatctggggtcaatcctggccttctataagcatgtacacatgtatatacatacagctacactcccaccaacagcacccatacagctgggatcctgttccttcactcagaagcattgccaccatagacaaggaactctgtgtatctgcttgctccagtcacattatctccactggtgggaggcttttcgcggatactgctcaaccactgagtaaatccttgactctgggcttctctcttgtctcagcatcagttcctttctggaactttccaataaaccctccttttgacttcctcaccccaccaatatatatgcatggcttttgtgttccccttaagagcagaaacccagaccacctccactccactccggaggagtcagcagggagtct

SEQ ID NO: 578 - DNA, 2425 bp, Mus musculus
aggtgaggggcatttcccacttttaactgtaacaatccaaaatgtcttcaaatacttgccactctggggtggtgggaaacggggtacaaattgcccctgattgagaatcattgtttctaggctgcaaataaaattcctcatctggtaaacggtgatgtttataacaaaactggtcttgtcctgtttgctggcttgctccacaccactatggccacagagagccggtagaggtgggactgacaggaaagggtaccgcctgtgattactgtccatggcatctcgctgggcatagttccggacacacacacagaaagacaatgctgaacgccacagttaagtgtcaggagtctgtaagtggtgggtggggagagaattacatttcttttgagatagtctggttggaagccaataaagtgatgaattattgaatgggctcccttttaaaaaaaataaacatatttttcctttttctttttcatctgtcctgtggcgaacaagaggaagcaggtgaacagtttacaaagagtttcaaatgctaactccctctggtgtgcgaccccctagcttgatgtgttatttccttcttgagtggtttttaaatgcaactgttgttcagagaaagagttaccctcttttccaacactttctttttcattctctttttatggtgtttatgcggtaaacgaaagcctgggggactgttaacaatggcctgaagtgccagggtggctatgctgtgttttgaatgactcagatgcgagactgccagtccagtagagtgagccccatcttatcttactatgtgatggggctgagttttagtgggtgaaagcaatgtgtgttctgatgggcgcagagggtatttcaaaaaagcatagttgattttaaacaaaaggctttaagagccaagctgtcatctctagggaagtccacctctccagcagtggtgggtgggtgagccctggctcaggactacagaaggggtgggtatatagctttggaggccatgagaacaggtctgagggtctcattgggaagacaggaaggggtagccacaaaacctcacattaaaataaaacaaaacaaaacaaaaaaaccctaagaaaatgaaaactcagccccatggacaaacctatatctgacccattttatctttctatttcctaacttcaaaatttataaaagtcacacaatttggggtgtgtatgtgcatgtgtgtgtgcgtgtgtgtgtgtgtgtgtgtgtgtgtgcactctcgtgcgtgcatgctccatacactctccataccctatctactttgccagagtgttgagccaacctacagcaaacccagaaactaagagctaacactagattagttcaaatgaagttgctaagattcaatgactcgttttgtaacttacacaaacaactcagatccctgcttagaaaccaggacagagggtggcccagtgaaggacacagtgacaatccagtgccaaggggaagctggcagggggaaggacattcagagacttgaaactcagtggggttggagcttagtggggtctcaaaagtatctaaggaaccagaggataaaccaagctgtggttggtctgaaggaagagattaaatcctttttatatcttcttctaaaagtgattctgggtgcaactgcctcacggggaagaggagaagggtagatcatgtcttcaaacacactcacatgtcaccctctagcaccccagctgccatgcctgcagaggagtcagcctttgtgcacgctttgagaaggaatgttttgaaggggcacatagagagggaaggctggggcttgccttctttcaaaacagacagtaaagttgtccttttaatagaaaggggtttctagatcactaacgcaaacccccgttctgccagcatatctgaaactgatcctactgccaggatcacatctgaagatcacccgtattgcctcatgtcccttttaaggggacattcatcttgtgcaaaaagaacaatcgcaaaacctgttttaggtgtttggggagggagaaggtttgaaatcatggtaagtgtcacagtggtataagaaggggagcctgcactggttgtgtctacagtttagttgtcctttgtggtctcttgcttttccttctccaaacagcagcagcctctaacatttccaaacatttgctgtgctcctgggggtgtcctaaaactcacacgcttcccaacaactccataatgcacacactactacaatcatttctattctactgaagaaggagctggggttctgaaatgtggggtggcagggcttcccaaggccaccttactagtgactagcaaaacaacattgaccagagcagtgtgggccccaggacccttgttcttgatcagggaacttaactgcctccctgcagagacgcatgcaatcgtttga

SEQ ID NO: 579 - DNA, 1975 bp, Mus musculus
caaagtggtaaagatgacctaggcaggaaagaattgtaagggtcagtgcttgctcggacacacacagtttatggcagggaacatggtgggcgcagaggagtcttgatcagatcgatggcctagttgcagctttctggaagaggtaaaggctgagctgggctttgaagcaaggaaaggtcacttccaacaaaggggagagcggatgaaaactcagagggggtcaacgatcagcaatttgggggatagcaagacgttcggtgtgtccagctagagactgctggaaatgaggcacccagagggagctgcagggttccaatggtgaaaagcccatgctggccactccctagggtggtggtatttggtttcagagtgctgagggcatgctgagggaggttgtcaggcatttttaaggcacacagagtcacttagtgcaatcaggtgtgcttagtggcgtccctttgcttcgtcattttggaggggagagggataaaaagctttggggacccttctctggtatgatttgggtatcagtgcccatgttcccccagtgtctgtgtgctgtcatgagatgcaagaaaggcacccatcatggactctttcaatgggttttttttttccttgcattttgcttattataaattgattccaggacttcattaccgtgtcaccagagatgaatggggcagtagtgttttgccttgcactgccagaaggagggaaaacaagtttgtaaggagctgtagttcaatcatgatgcttgcagaagcaaggccatgaaaggctggagcagcgcggctttgattctagaaaccccggtagccctgtgggtgctacaagcaaaggcgtaaattaaaggttggagcctgctttcaagtatcgactatcgagcaaaaggctcagcccacactcatgcacttactcgggcttgttaaaataaaaatgcgatcttggctgggctcgtgtcgcagccagtgtaattatgacattgaagacggctgtttgaatcagggctgctacagcacgcgtttatttaaagataggcttggcaatttaatacatgttaggcaggactgaggtccgaatcaggcaaagctttgttgccagctgcctctcacgtcgtttctcctccaggtaaatccaggtaaatacctggaactaggtaaattgagccagaatagaggtggtctggttccctgactgctggtttgttcaaggttgccgtgacattattggctcctggttatttcacagatgagatatgataatttgttagaggcagttggcttctaaaaatgtgattcattgtgggcattgtttgtatgtttccttgtagtgtgtgtgtgtgtgtgtgtgcgtgcatgggcatggaagccagagggcaacttcagctgttgtctctctccaacccctttccactctcctttttgagacagggtctctgatggaacctggagctcactaattcctcgagactagctggccaaccagcatcagggatccttctatctctgcctcctcgactgtagaattagaggcacacctggctttttagacagatgctggggatcagagtcccctaatgcttgtagtctgaacatctgaactatcttcccatctctataggtagtatttatagttttggggttttttaatgctgggggattataactaataagctactttccttttctcttcctaccagtgcctaagataggatgaccaactaggtaaacagttgtgggcctatgaaacacagtgggttatattgactgaccatccccaacctgaaaaaaatcacaaacctaagagctgagaatgaacccaattttggattttggaataggttgggttttcagttcagatattgctaccaatattctaaaatccagaagcaatgagaaatgtcccagcatctcgggaaagagacactgcctctgtttctcccttggtttttcatgcctcatcttatccagag

SEQ ID NO: 580 - DNA, 2350 bp, Mus musculus
tttttttaaaagacagcttcatgtagcccaaactagccttgacttcactatgtagccacgcatgaccttgaacttgtgattccctttgcttctgggtgctgacattagggatattcactaccatgcctggtttacacagagcatgggaatccaacttagggttttgttattccagacaatcattctgccaactgagctacacccctggtcccagtttgtgactacttttaaatgctgtcttttctttctctcacaccccactctgcttcccctgtgcctctgtgatgtgaatgatcagtatctggctattaccacttttaatgagggaaggcctgtgtaactcaagccaaggtgcctaattgccaaagccaatccagcttgaccagaccaaggaaagaccactataaacaaccatagttgtccatgttcccaaagatcctcagacaacagactagaacaagaagtcaggcctggctccttctttgtagtcagcttatctgccccatcccaagatcagaagtttggaaaccaggtgaggcattcctgaagagaaaaaaaaatcctggtccaacatattcaagaatggaggaggcattaaggctgggaggtggacccatatatggcctgtgagacttacatgtcctcacatccaagacacacagctttacctatacctgggccatggcaggtgccttgcattcattaatcacaccttgcctagatcctacatcaccccccagaaactcagaaagccccctccaccaccctggaaagagcaggacaaaggcttgttgtgacagtagttttgttggcttccttgtttgacatgagatctctcaatttagaccaaggtggcaaacaatttgctacggagaccagggtggcctcgaactctcaatctccctgtttgactgagtgctggaatgacaggtgtgcaccccacccccaccccacccccgtgccctgttttacagtacatttttaaaacagtagagggatagctgtcaaaatgtaaccaatagcattaagcacatttttattctgttctcattttcaaaatactttaataagcatgttatcgtcacaattacaaaaattcgaacaagcacttctcgaatcaaacaatgaacccaccagcagtagcgagtgtagaaactgctcaccttaggctgttaagaatggagaagcaagcctcattctgggtttagaagacaatatgactcaattagaacaacatgctgtcggtgttaccttctcactctcttgtgggcacattacgagacctgggcctggtgctgcaattacagtcacagctgtggctgtggcctggattacctgcccatggggacttgggcatatggcacagacatagcagctctgaggtgccacccaaggcattttaaagcccccccaccccactgaggatgttgagcttataaggtcccaggcaggcatttccagtgcccccgccccccatcaaatggcattgaatccactgggcaagatttgtcttctttaactccattctattccactcacaacgggaacgccattgggctagacaggtgagagaggatctctgtttgattcacaaaactgagggtcagagagctggggatatagttcagttggtagaatgtctgccaagcatgcagaagctctggatcccacccctagtacagcaaaacccagtgtggtaggatgcacctactagcctagcgccgaggtggaaggaagggaaccaggagttctaggtcatcctggactactcactgagttcaaagccaacctcaggtacacaagacccaatctcgaataaaggggcaggggctggagagaaggctcagcagtgaaaagcatttgttgttcttgtggaaggcctggtttcagttcccagcatctacataggaactcaaaaccatccataactccagttcctgagaatccaaccccttttgaataaccaggtcatgaatgtggtgtgcacacatacacacattcaggtcgaacgtcagatacatagcatgaaattttaaaatctaaaataaatacatttttaaggaggtttagaatgtttaaaatatttcctggccttgcaagcaacagtgagtggcctctgtcaggtctggtggattcacaaacaacccccccactccagagtgcaagaaacacttggtggttgctgcgttagcccactcaccaaggctcagagtgataccagtgttttgaggagaatccctgcaaaaaaaaaaaaagatcagctttgttctcatctattaataacagctattttgaaatgctatttgtgtctctattgtttattagaactatttgtggatggtgtcttccc

SEQ ID NO: 581 - DNA, 4075 bp, Mus musculus
caagtgttagaacataaagaaactgttaatcacaatcattatgaataaccaagaaataggtgcatttattttggagagcagttagacactagcaaaactgaacctttgttcctgtaacttgcctggtaatgcagacacagaggtttgtctgaagaccagtgtgtgaactaacactcaaaggtggttctgtagcttctcttactatttcattaaacaattaattttttggggagggaatttcatatatgaattactatatttccattatttccttcatcccgtctttgtattccaactcctcatgttcctttcccactctttcccaaattcataacctcttctttaattattaatgacacacacacacacacacacacacacacacacacacacacacaccctgatgagtatatttaatgatgcttgaacatccatgtgtttagaaggctgacgatctgtgtttggactgaataacctgccaaggggatgcttttctctggagaagaccgatgctcaccatccagcagttattaattgcctgtagctcttcatcttgaagtgggacctttcgagatttcccctatctgtgctagcatgcccactggtgtcattgtgcaggtcttgtttgggcagccaaattgttgagatttttgttatttttcaagataggattcctctgtgtagccctggctgtcttggaattcactctgtagaccaggctggcctcgaagtcagtggtccacctgcctctgcctcccgagtgctgggattaaaggcgtgtgccaccactgcccagctattgttgagatttttatgggtgcagtttccctgtcgaatgccctggtgctctggctctcacactctttcgtcctgtcttctttgatattccctgaaccttagatggatgggtggtgttgtccaggtatcagttgggctgggcaccctatggtcagttgttctctgtagtttgaccagttgtggatttcggtaatgatctccttgagctgcaaaaagaagcttcttggatgacaggtgagagcatagttctgtttctaataccaaggacgacattcaccaattagggattgactcagtaggttatagctgatgcccagtttggatcctggggttggtttaaatcaagttatttttacataatgctgtgttgctgttaaagagaaagacagaggtttgtgctgacttttggggatttcagctattgaaacagagatgcagagaagcatatgagatgcttatagatacagaacattggaacgcacatgagaatctgctaataccatttccaaggaagtgaatcaggagggcttaggaaaagaaagagatttggtttttatcttgtacattggactgttaaaatttccaattaaaaactagacagcagatggaagaacccaatggcctctaatctctgtggagcactctacagaacagccacaaaatagaaagaaatctcgacttagctcaggctgtaccaataggcctaattgttttctggtcccctagtggtccacagagcatccactccaatgtctgaaatatgccggctgctccccagacgaatgagaacaagaagctagaataagagaggagggctgtggtaggtgttttgttttgttttgttttaattagaaaatgttagaagcaaataaaggtgacctgcttagtgagctaaccatgaggacacaatggagcaagcttaagtttagggatgttctcaaatacagccaatttgacctcttaaaatgacataaaagaggaacattaaaacaaaggtgacaacatatggtgggtgatacagttgcaaacagtgatgttcatgaccttgatggaatgattggctaaatatgtatggattgtggatgaccatgtcgtgcttaggtagcatttctggggtgtgatggttgtaatatagttataaagaatgtattatttacaggagataggagctgaattatttatgggtaaaaagaagaggttttcaactgactctcatggatcagcaaaaatgtatattcatgtatacctacatatatatcaagagagggggaagagatgatgaaatatttaagaactgtgagtctggatttagaaagtgtaggtggttattatgtttctgttattttttagttgatgtgaaaagtatcaaaataaaactccctggaaaacaagaagcaaccggaggagcgtaagtgtggatgacttaaacgatatagaattgaacccgagttttcatctcttcctttaatgttgaagcgtgtggggaagtaggtgggaggctgagagtggttggaacttaggctttgagagcgtctttctgggtgttcagaatgcaggagactctgggttccattcccagtaccagggaagaagagctttgtagttgctgtgggaggccagtggtggatgcagcaggcccagttatgaggtcactgagtccagggaagagatctaaatggctcagaccaagaaagcagaaagaggaggtggtaagatgcccccaattctggaggtatctggaagacagaaccaatagagtatgctggcaggttggtgtgggattcagaagatgccagctaaggaagactccagtggttttagtctgatcaaacaggataaaagtaccttcaaccgaggacctggagagagggctcagcagttgagagcactggatgctcttgtggaggacctgagttcagttccaacacctgtatggttgctcataattgcctgtgatgtcaaatccagatctggtgttctcttccagcctctgtgcatgtacatgcacatgtacacgtgtgtaaaaaaaatctttgagtttggggaggcctcaggaaacctaggttttgtaggatgagggaagctcaggcattgcttatggctacttgaaccctccaatgtttgagcagagatctaagtggatggttctctgtgttagtctagaggacattagcatggaaggtgcaggccatcaagacagatgagagcttggagatgtggctctgggtaggaagaggagatcaaggggatttcagtgttgagattaaagaggcgacgaggatcaactgaagaagatggagaacagcagtgagttagaagctgcagaatcttctagaagctagtgtggaaaacactcaaagagaaagaagagggctggagagatggctcagagtggttaagagcatatacaacaaacccaagtttgatttccagcctccacatcaggtagtttacactgcctataactctagctccaggggtatcccacacctctggtggtttccagcatctgaactcatgcacacatagcttctgccagtacacaatttaataaaaacaaataaaaatgctgtttctcaaagagaagtaagagttctgctaccaaatatcactgttggatcagttaacatgagtgcttagaattgaccattcagcatacattcagcatgctgactgatgcctttgccatgatgacaaagaccaactcctttttgaagcaagaaaactctagtatgcagcaaggaagtcaggaaagatgcacagcaattgtgtgctatggtgcatcctgctagttctagttgcctgaaggcacagatgtgagtaagggccattgaagtccaggagtttgagaccagcttgggcaacagagactcacattttggaaaacaaactgataggctgtaggttatgagaggaaacaaaacaaaaaaccaaaccaaaccaagccaagtgaagcccaagccaagccaagcccagcccaatccaacccaacccaacccaacccaacccaacccaacccaaccccaaaccaacccaacccaacccaaccctaaaccaaaccaaaccaaaccaagccaagtgaagcccaagccaagccaagcccagcccaatctaacccaacccaacccaacccaaccccaaaccaacccaacccaaaccaacccaacccaacccaaccccaaaccaaaccaaaccaaaccaaaccaagccaagtgaagcccaagccaagccaagcccaacccaacccaacccaacccaacccaagccaacccaaccc

SEQ ID NO: 582 - DNA, 6600 bp, Mus musculus
aaagctgagaatactcacttcagatatgaaagtttaaaaaatgaaagcttcattttctgagacttcagggagctggcccctttgggatctgaaccgcatcccttaggggatgctgtattgaacacaaagcaaggggtgagctgggatgatctgtggtgtcatccaatgatattttgacattatgggttaaaacaagggagtactcaatggagactgggccatatccagggcacctggcttcaagatccttaattcattctctgagaacttaggtctagagctcagagtgataaggaaacaaagaagtgggtaaggcatgtagttaactaggtcataacctagttgtgttttttatatatatataaaaaacaacttatgcactttggtctagataagggcaatttatatattctttactggttaataaataattaagaaaacatttggttaataaataattaagaaaacatagtgtgataggtgttcattcctacttaggcctgggaacatgaactaatttgatcttgccagcaagatggagaagttgtccctgagatttctggactcagacaactgtttactgttgggaacaaaataaaaggggggcccgggaggagggcaggggaagtgggggaagggaaaggtgtgaccggccagagctcctgtgctctgggcaggcagatgaaggcagagctcctggcatcctgacccatgtgggaggggtggaaaaggggcagccccagaccgggaccccccctcccccacgtgctactttgctaaagccaccagggttgtgggagagagggaataggggaagaagttcccaacattatccagagtgcgcagcggaacttgaaggagcagagactctctatggtttaagagctttattatagaaatgcaggggaaagagagaaggtagaaaagagagagagagaggggtagagggagggggagaaggagggggagggggagagggagggggaggagagagggagagggagagggagaaggagagggaagaagacaaagagaaagggaattggagagagatgtgagagataagaggacaaaggagtgagagcaagagagcttgggggggctgagcaccccttttttgtggtcttcactgttgctaggtaactggggaggagtttagcctgaaggtcagaagcttgggccattgcttacgtgactactgaccatgcttctcttgtgggggctgtgggaggtggtaccttaggcaggggctggagtttcaggagcatgagggaacgcctaccgtgtcatgtatgtgaattatgaccatcggggttcagacctcagcccgactggagaccagcctgcaattccccacagtttacaacaggagctattcagctatagggaaggtcccagctcctctagagcctggaactttgaatttagttccttcctatgattaaatggtgactgaaaaggaaatggtagtggttagaatacatttcttttgcttgttcccaacactagtagtagagtggggagttcactgagtcatataccttgactactgatatagacacgtcctcattctctcttgaatcctgttatcgagtatactcacatcatgagaaacaagggggaggcattattaaaacaagggtgaacatgagaaacagggagctctcacgacagagggagggatgaagggagagatagagggatggagagggagaaagtgttacacaattttaacaggaagactagcaaaacctgaattaaaaaaatctcaccatgagcctagaaagatgaattctaaaagttgcttttagtgacagtttgatgacaatgaattatagacagtgttgctattcatccctttgcgcatggaccagacttcagattagaaattgtggattttatctttgttcttcaacagtcctgtggttttatttttatttatttatttttgttttttcgagacagggtttctctgtatagccctggctgtcctggaactcactttgtagaccaggctggcctcaaactcagaaatctgcctgcctctgcctcccaagtgctgggatttaagtgcgccaccacgccctgcgagccctgtggttttaggaaagaagagagagtaagtcaattttaatgaaagcaatgggttaaaatccacagttgaataaaggaacacaggttttgaataagtgtgcttccaactaggggtcagccaagaatgtctctgtacaataaattctgcacgagagagctgagttgttcagtaagaatttatggagcactgtgcaggggtgtgtagaataagaatcagagaaatgcttaatgtctggtaaatctgggaaaagcttgcttcttaaatcttgtggcctttagtttgtggtaatgatactctgcatttaaaaagtgatgtgtggttatattgctgcgggaatttcaataacggccaagacgagcctgccctcctccaaactctccctcccaggtttccagatctatgttatttttttcaaaatgaatcactgttattaacattggaggtagcttgtctgcttccatttcaagaacagagtattttgtggttttaaatgtatggccacaaatctgtgttggttagcgatttccttttcatttgtgggggtcaggcttcttctggaggcagcatagtagggccacatatatggtgtatatattagactatccattcagccctttggtttcccttttttttttgtaaattatttaatgtgcagtggtgtgaggctgccagacagttatgagctgccatgtggatgctgggaattgaacctgggtcctttggaagaacagacagtgctcttaaccactgagccatctctccagccccccattcagccctttgtatccacttttccctctctctaaatgaagcctggggtttctgggtccacgtgagcacgtgtttacagcctcaggagaggcttgagtattgtgccccaagtcacagtctgtcctttaatgcgtggtgagagcaacgttcccacagctctgggagggctctatattatcactcttccacattttagtcaaataaagctggactaaccttatttattactcttgcttttatgctgctgctactaaactcgtttccatgtttctattagcacctgtgagtttcctgaactttttaaaattttttattttgcacctttttacatttggtaccttttaattccagtattttctaaacacatcgattccagatagaaccagttactgtgtgatttgtgctgctaacaggctctccaaccagcttctcttttaactccatgactgattttgtgcttctcaaacttgaagtattaaaatctactcatatcttctgcatatctctgcattctaggacacagctaaggggccttcttctatctccatgtgggtttcttgatagaaacacaatcctcattctaatagctaactggaaactaatatcaatagttcaatccattttcaaagctgtggagtttctattagcacctataaaaataaactagaatgtgagggaagaggacataaagagaattaacaactatctattatccatctgttgccaaggaccgataaaactttaattagtgagttgaattgatgtttctcggtgatttgacctactttcaaacaacttaaggaaaagacaaggagatgggggtgggggtggctgtggacttccttatcaatcttggggaggtttgactcatggcttccagtgtcagtaccagatcgactcttagcccctaattgaaagttgcccaatcatagcaaataaaaccaaaccaaatctctagctaaaatttttattttttatttcatgtgtatcagtgtttcgcctgtatgtgtgtacaccaaccacatatgcacagtgtctgtggaggccagaaggggactgaattccctggtactggacttacagatatgtctgtggctgccatgtgggttgttaggagttgaactctgatcctatggaagagcatgaatgctctttctccgtttctccaggcgctgtcccaacctaaaattttgtataatgaattcaaagaccaagtcatcctggaatgttattacttctagttataggaagtaatttaaaagtctcaagaatattagttatttataaacaagcttaaaacagagacacctggcttctcaaaacgagagttttgggagaaaggaggcagaacagcgtggcactgccacatggtggagagaatgctggtttatggcaaggacataaaccaagatagtccgtagttgtagataagcttgcctcccctagttgagactctagtgaaacttccaagcatttggtaatgagttacctcattgcatggattcctatttggttagaatcacataagccactgaggcttgagagttcctctgaccaatcctggcttgtcttaatgttcctaagtcgggaggtctgctatagaagacctctgtccaaaatgaggagaggggagatgggctgtgaggatacccagccagctttaggtttccctcatttcttaaccccctttaatattatataactgtaaatctcatgctttaacagagagaagaatggaggagggaagagagtctttatctttggctctactctgctgcccagatgtcacagattgttgattctttcttcgttctgtttaggttttctggggaaagggtgaaggtggtggggccatgatacttaatttgtgcacaatctctagtcaggcggcaggagctcatgtaaactttcttttcctggggcttacatagatattatatttaatggaaacaaaagcattacataagagttcaggaatgtttaatgacttccttaaatttaatatatatcaaataaatgtgtaagatttgagcttagaaaactgtcttacagttcgtcaacctagaattctgtgttagaggggagacctttgggtttagaatcgggcacagaatgtagcgccaacagcacattgcagaggcttcacgttttgtttctgatgcttttatgtctccaaagagctacaataggtcatattcctggggtttccttgtaaaagtactttgtccatggaatcaagataaatgtttaaaattcacttccaaaataaagggtcacactctccattacagtagtatgtttatggaattgagatgattaaaattaatttaacatctgaaatggtcataactttacttagtaataatgttagtattgattccagcatctactcgagtatacccatgccctacttgtgaaggttttgtttgtttgttgttgttgtttttttttttttttatttttttaatttttttagttttgccttgttttggtttttgagacaaggtttctctgtgcagccctggctgttagtattctgtctggactctacccccacagttacctggctgctgccaggtaggcctggccctataaaatgggctgcttggtccctcctctctctcttactctcttgctcccttgcctcttgcctccttactccccttcccttcccccctctctccatgtggtcattgccagactccacttccctactctctctttctctttgcctttctctgccttaactcccctccccatgcccggaataaactattctatactatgccattgtgtggctggtctgtcggggggaaggtatgccttagcatgggcctgcctaggcaccccctttctctaggcaagtcaaatggacacttctcaacacggagataagcattagctaatctaaatagggcaacaatgtaactaaaaagaattagcaatatactgtttcacacatctcaacttggtggtaatggttagtgcccaattaaactcccactacttttccttgctcgatagaatcctcttggctgcctgtgagatgcctgcaaatccacagagcacttctgcacacattctgtacctcaggtgttttcaagctgcattcccttcttttgtttaattattcataggcttgcttattttatagcagagctattgttgatatgggaaatcccctggaagtcactatgttgaccaacttgctagagataaataattgcaaaatttttttagatagataaactgaaaacactctgagcttttgtgtacgcacctgaggtggtggtttcttacctgtgttaatgcgttcatcccctgtaatgacctttgggttaaatgcagccaccatccctgcatttcagatacagaagcagaaagatggatagctgcacagctgcaagttagaaggagccaggtccagggctcccctggggatactgtgctttaacttgttcacagtctctgcattcagcaatatgctaccctggagctgatgtgcccaaggccgcccctgctttcctgacactgtaggagggtcatccagtctgacatccctgtctctaggtgctccacctttttaagttccattgcaagtgttttgtttggacttctagtcctaattcctagtttgctgttgtctgctttttgtgtgtttgcgtgtaggtgtgggtgtgaacggagaccagaagtagcctcaagtgccttcttcttcagttctccaccttagt

SEQ ID NO: 583 - DNA, 4975 bp, Mus musculus
agtcacccaggaacctgttcttcagtgaggatctcttagtcaacttctcccaagttttgtaggtgggactcgggcagtttcacaaatgtgcctagcactgtgctagatgctggtagagatcaagacccaggaaactgagaagctgactggcaacagttggaatccttcgctatgcctgtcagtgtctttttggtatgatgctgatcttgaaatgagtaagtcctggtgttgcctaaactaaccaccttcctctgtgttcaactttatactctagggagtagtgaggggtccgtctctattctctgtactttccttttcctgcaagacatttagttaccctgaagaattttaaaaaaggaactttaaattctgaaataatagagttcttacctctctctcacccagtttcccttaacattctcatcttgcataactgcatactgcttgtcagaagtaaataaattaaagtttgtagatcatgcctcactaaactacggatgttattcatattgaccaaatatcacctctccaagagccagcccagaataatgatgtgtagcatttaatctcagtatttttgaagttttatccaataacgttggttcagtagcccgaggggagataccaagcccattttcagtgctctttgacacaagatcaacaatcaagaccatgaccttctgcagagttttcatctcgatttgcaggagaagttgctcaagggtgttagggcatggtaaaggaaacttaatgtgaaatgccaccttctttcccacgagtaataaaattttaagatcacaatattatttctatcacagtatagatggaggctttattgtcacggaatgttttgttgggcacatttttattgaatcaatttatgttttaaaattttagacaccgagaaaatagaatcgacgctgagcatcaagggaagctcagctcctggtcagttgccctgtcattttccttgtgaaaagccaggcaccaagctggcagttctgacctgctggcatggtgaattttaattttcactcttgtagatgaaagactttagccatcaaatacttctaaaatttccttgatttatgtgctagttagttttgtcacccttgagcaaatgcaggtcatctaggaagagggaaccttaccggagaaaatctcatcactctggcatgtaaccaagcccatgggaacattttcttgattaatgattgatgtaggagggcccagtacactctgggtggtaccacccttgggcaagtagtcctgagagctataagaaacaggctgaacaagtcatggaagcaagccagtaagtagtattcctctatgacatctgtttctgttcctgccctgatttctcttagtgatgaactattaccttgaaatgtaaactgaaataaaccctatctttcccaggttgcttttggtctgtgttttatcacagcaatagaaggcaactaagacagtatattagtaggccacctttagtaaagaatccatcaaaccccactttcacaggtccaaagccgtactattcccatgatgtcacaggaccattcattgtaggattgagcaaagcatgtgtgtttattaaagcgcttctagccttcaaagtggccctaataggattataatcattgcaagtattataatctgaatttgttctaaaaacaatttgattctggtacgcataggctttcctagaggtgcttagctattatattctgaaaaggctttgagcctaaaccataaaccccactgtcttgcatatcacatagcagaggagcatctgcgtttatttttgagtttctaatgaatcacataactgccaaaatctgaacaacagaattaatattacaaaaaggtttctgttcacaggatgctaaaagtacaagacgcctacatgtgtttggactttcagacatttgcttgaggattaattataataattttgctttaataactgtagttttgtccttttactagcaagggcacaattagctgtttacatctgataggtcctcagctgagaatcaatacactcagcttctacatcatctagtaatttgtacctgtcctgatctatgtatcagttattaccttggggagggtgcttaacctctctggcatccttgttcatctttacctcctgatgtggttgatgtgggtcagtaaggtctatgtatgatgatcattgactggatcagtacctgtgagcactgcatagactagatcagcacctgtgagcactgcatagactggatcagcacctgtgagcactgcatcgactggatcagcacctgtaagcactgcatggactgttgagtcacactggatcagcacctgtgagcactgcatggactggatcagcacctgtaagcactgcatggactggaacagcacctgtgagcactgcatggactggaacagcacctgtgagcactgcatggactggatcagcacctgtgagcactgcatggactggatcagcacctgtgaacactgcatggactggatcagctcctgtgagcactgcatggactggatcagcacctgtgagcactgcatggactggatcagctcctgtgagcactgcatggactggatcagctcctgtgagcactgcatggactggatcaactcctgtgagcactacatggactggatcagcacctgtgagcactgcatggactggatcagcacctgtgagcactgcatggactgttgagtcacgagggctcagcttcatcttgagctccccctctattcatttcttatccaaccattttcacctcaccatggctgagcagaatactttgtctaagttgtgcaaatagccagtgatggagaattagcagaggctctctgactctaaagtacactctgctctcagcacccactttcctaatgtagcagtttgcgtgatgtccagcttcccttattatcacctggaactgtccctatcccttctacatggcatctctttcacctctgtctcctgccttctttaaaatgactttcatcactttggatagttccctcccctgggactcctctctgtcatctcccattatgacatccctcctttggtctcctgtcatctcccattaggatgtcctgcctctgggactctgccgtatcattccctgttatgatcacgtcttcattttcatgcgccctctcttacctctttcttcatgccccacctcctttgttcacagcttttccaatgacataggaactagaagaccccattcaaatcctagctcgtgccttgactctattttaattgggcaaccaaccaagttttgaccttggtttatttagaaacattaaagggatctggaaagtctcatgtcgttgttggaaccttggaatacaggtctacctctgtcttccctggatgctcaggttagaggtgttcagacttcatcggtcatattagttctgtgtttctgttggcctggcccacccccattgctcatcaaatttttttcttagacagcaaagagcaacaccaggcgttcaattaattcattacatagaataggttagcttcctgcttaaacatcttgtatctgagctgtggtctagaggtagcccttgggctcaagattgtagacctcttaggtttggggcagatctgagggaggagtgttctaaacaaagcagctgtgtgaggaagaagaggtggagtgagggaagcctgtcttactagctgggggagaatgagccttggggatgcagaagattttcagtggaagtggaattaaatttggggccagagaagggaaagcccagtagttaataactataaggctccaggctttggtggttgagaggatggtggcaacattagaaggaaggaatgtggttgggtgagcagcatctgggttagtaggacccctgactctataagcaagattgtatcttatcatggcttcacatttgctgggctagacaaacagtgaagggcacagattcatgactttgggacccagctgaggagggcatagctctgcatgcaactggataatcatatcagacaaaatgttcatctctttgagaagtgagggaagaaataaaagttggcaagaaaaccagatgctgttcagtggtgagaggtgaatgaggcaggtggaccttcacaaaagcagtccaggccttggctgttgggtagggctgctggatcactctcagcaaataccactcaggatgggtgaatcagcttggagaggcatgcgggctgtgatgagaaaagccagcggcccgtagagaagcactttcatttttcttttcaatttgtttcaccttcatcggtaagatatccattccttgccacaacaagcaattcctcatgcccggcttaacctctcgctctggcgaaggtgcctcttgcatctttgtaccatctgcttctgctttcgcctgtttcagttttggaaatgaactctgctctgtcaaaaatcctccaagcaaatttgcccaacagaattctttgaaccctctctgtcttaagatgaaggtctggagattatttgctacaaatgagcatgggttgggaaaaaacaaacaaacacagaaaccaaacaaaccaataaagctaaagggttctagggccgtgtgtccaaacccttgacattgtgacaggcattgctgtttataaattcatgcttgagagacacacaatagaagagtgggtgggagacgtgtgatcatttccctctgagaattacacactaccactataaagcagaaagttatctgacatttaaaacacattagcatttgtagtacttaagttgggaagctctatgttcacacttgcccaatgactgcaactggaatgttttcactagacttatacaatattatgactgttttaccatcctttttcctggccccttcctcctcagctaccttgtctacagcatgaaggggaacggccatttgcagtccagttttctac

SEQ ID NO: 584 - DNA, 3175 bp, Mus musculus
ctggaatccttgcaatcctgtttgtactactgtgctggacacagtgttagggtaagtgtcaatgtgtgttgcagaggggtctgaacagtggttacaacccagtgtggttgtactgatgtccagtgacactagctctagtatgctacgactaggctccctcatggtttcctactccatgtaactgtccatcagtgaggatcaaagcattagctaagtgtgttactagccattttcaagacacagattacattgacaaagatctgttaagctattaatgagagcatacatttagtgtaatcagtcatgtatctctttactggcgatgcacatgaaacttaatatagggccacgttttctacaacaactctaggtatttgctttagattcatatgggcttggtcccatgtgaagcattactgaattgaaatcttattgttcctcaaggaaagcaagaactgctatcagctcaatcagattacaagagcccctcacacttgatactgaattgaatttgaaattatatagaatgtcactaaaccctgcaggctctctatgtccaagaaaaaagaaaagaaaatgaaaaaaaaggaaaaggaaaagaaaaggaaaagaaagaaagaaatatagaaagactgaactagattccaggggccagagggctttcagtacaaatacttacaaataaagcacttcttttattttaaaatttgaattattttcatgcaattcaatttttcttttcattttaggtaattattttctggcgaaggcttgggtaaccccctaactcaatcgtgtctgccgcatcactaacagataatgtgcacttctgcagtctttaacaacaaagatgcatgtgtttattgtccccaccggatcccattcttcttgttttatattgtgtcagttaagcaaaagactccttttctcactttcacaatgcttgtgggtagcaaaggtcagactggagtttctcatcagtgttaagagagaaagcacctgtgccaaatggacagcatttcagcccaattgaaagaaacaagaatttaaacttgcttcaacacaattatatgatttttattgggtttttaaatgcactcaaaatagcttattttcatggtacagtctataaatacccatagttgccaacgatccccaaactgaaatgagcttttttcagaggtgagatgcttatcgcctgcatatgttagtgttccccaacacacaccacagagctatgacatagttttgtaaacgaattattctagaaagaacaagtcatataaattgggttctattaggatccataatggagcaagataacccgaggagcctgtgaactgctctccatgctcctaatcctgcccctccaattaagtctctgctgctgtcagctccatctttacaaatctcatcacgcaaggctcctatttaaaattcctactggctccacagttctttcaggacaaactcaaactgttaaacttagcttcctatgcgtctttcacttcttggccttacctgtcaggaaaaagggaccccatgctgcagtccccacaaaatccgctgtttagttacttgtgtcaaatgaatggtaacaccttcattcttactgggcctcagggtcagctcagcctcgccattgatagcggctgctccagatgtgctctctggctgcatcagaccccctcccaagtctgagattgtgcacagatgcgaactcatttttcttctcttttaaataacactctgtctggaccttgtgcttccacgcctcccatccttactctctcgggccactttccatctgttgttaaaacctctccttttcttctctgagtcacattgtgcatccatgattctcaaacaatgatggaatagccgaatctcctgcagggcttgttgagcagtttggtgggtcctaccctcaaaaccttctgcttcagagctgggggcgggggggccctgagcatgtgctttgctaaatactctccaggagctgctgatgccgtgggccctggactccaccactttgctaacaatgcaataggaaatgaacttgggaggtgaatgagttaacactctggtccatggagtgtcacatggaacaggaagaggccagggaccaactgcatagacaggcacatctgtggggcacataaggataacggtgatataggagcactcggttcatccctagtttaatctcaactgatgcacttccttgaatgtcaacatcatccctgagtaccctgccttcccttggtcaaatatttgagtggattatgagaagagccttgggggctctttgaatataaaatcctctaaatggttcatttttcctttaaaactaaggcatctgggtacacctctaccattaccacagccaagactacacagttttggagaaaagtcaagaaaggaatagaaatattcttttgaagaagaaaacacaattctggtaagaagtgcagttctaagagcgagggggacatgcacagccactgagggagtccactgggaatccactgccactgagggagtccactgagagagtccaccaggaatccagtgccactgagggagtccactgggaatggcttacatggatttccttctgcctttctgcctttcttgtgattagcttcacaaatggctttctcctaaaaattccacccttgccaatcagtttatttttctgaacttatctttttacccccccaataaaccagttaagagagagctaatttatgtattaccatttacaattttcagtgtacaaaaagtatgtataattttacactcctaaaaagaaatagctggccctttcgcctttaaaaaggattttgagcagtaaatttagaattgagaaagccactttattcctgacatggggctttacaactgttttcaagtttaatatttcatgaaaccaatttccagagtcctgctacacagtggaagaaaaagagaaagtccttccgctcttctctgggctgtattttaggacggatgcaaggcaaggcagggatgttatttgttgatttaatactcttctataattcatacttttgttttcaaactttcactgaaatattactgtaaggcaatgtttcatcacactccatagcaggataacttctcagggagtcaggcatccaaacattaaaaaggt

SEQ ID NO: 585 - DNA, 2300 bp, Mus musculus
ctgtctcaaaaaaaagaccccaaacaacaacaacaacaacaaaacaacaacaacaaaatacaactaactaaccaaccaaacactcaaaactccattctaaaatatttccagctgttaacagtggtaaccctagcctgaagtagatcatcttttttcaaaacagagcaataatttgaagatttcaatggactaacaacaaaaatataaacttaaataaaaaacaacttaaattgcctagcttaagaatgggaaataatatattctaaggagtgacatgtttgatatcttgaataaacatccatgaaaacactgctaaaagcagagtaattaaaaaacacttacttttttgatgtggtaccagaaatcccaagatctacaaatggataaaagaaaaagagtttaaatctttatattcagcttatatattacagtacttaagaaatccaggaggcttagaagaggtctgtattgttgcctagcaatgagtgtatccagttagataaaaaagaaactgtattaagaaacaaagctagaatttttaattttcttttacttcacataagacttaaggatcacatttaatgtggactggctcagaaggtttgagattgctatctaaaaaagccctggaaacagttataaaactgtctctaatgacagctaataatgactaaatgactctgtgcctagagtgtttacatgggcactgttgattatgctaaacacctgcctcctgcaagtctgaaacttggttaggtgccaggcagtgtgtgcccgcccacatgatcagtggttaatggaatccctgggtgctgacaccctaaggggcttcctcaggccgaaacacctcaggcagctgcgcacccttctcgtgttgctgtggtggtgctcggatgtgagctgaagtgtgggctgggttccaggagctcggctggtggagtgtgaatgtggacgtggtcctgggactacctggcttaactctctaccctcaccacattgcatcatcccagacactcaggatacatcagtaaagagaactattaaggaccccctccccatgaccgggaaggagcctgcacactaatggtgtgacacagatgagaaccgatgacacaagaaagtatatggtacaggcttctagaagggggtgaggaggcacactgtggaaagtctcctggagagtgtgaggctttcccaaagctgtgctctgtagacacagggagcagcttgcacaaagcccctatgaggtgtctagctgatttgttacacaatgaatttatatatatatatacttgcattttgtttcttagcactacaaaacaagctatacatattaactaaaccagataaaagaatcattatacataattttgatcatttttttaaagactgtatttccctgtgttgcctaggttagtctcttacaccgcaggttcaagaaatcctcttgcttcagccttgcaagctactgagcccacagagaggtatgtgctatcactcctcgccagtcatctttgcttttagaagacagagaagtctcacttctaaaatttttgttttcaattaaattacataattgaatctctacagtaaacaattacaagaccaaccaaatatttatgtcgatcatgtgaagaggcaaaatcaggcaggtactccatacacacacatgcaaagaatccctttggggcagatgggaatgtggtgtggaggtgtgggtgtggctacaagccagcccacacgggaagaaggctgtgagcagcatgcaggagacttactatggacaagaagaaaacagactgagtagaggagtctcagtgggagcttctgctaacactacagagtattttataaacaccctttgtgagatacgattcacataccacataatccatccgtgtctaagtccattgctttctcctattaatggaggtatacagctaccacctgtagcagacttttttggggtcacaaatgaaatcttgggcctatgagcagctactcctgtttcttctttattacttcagactctacagcctctaatccactacctgtctcttcaaacttgcctagcctgtacattttgtatgcacagacctgtatcatgtgtggtctttcacttagcctaacatacacatggcatatgctgcatatgttgtatgcattagtatatcactccttttctaatccaaataatagttttttataagtaataattatgaataacaaaactattatatataacatatatgtatattcataccacttttcactagctaaggagtcatatgattgtgtcc

SEQ ID NO: 586 - DNA, 1750 bp, Mus musculus
ctagctacagtgagtgatcctcctgtctccaccccctcaatgttaggaagacaggtatgtaatcctaattactattggaaaccaccatgcccggctttttatactggtcttgaggctctaaactctgttcctcggacttgcatgggaagcacacactttgagggattctgttgtggcagagcctctctgggccagactttggccttattttatattaccatcgagcgttcatcttcacgaatgacaattttcaaaaccccagccagtctttcttctcctagcactctttgatttctttttttcactcctttaaatgctggttgtgaaccactgaattgatttcatgacctgacggatagaaagttccaggtgctcgctttggcagctcctacactgacacacaaacataccctatgggtccccactccagacttccactaagccaatcatctgccctggccttgagaaataatggataccctgaaaccagcagataagacctctaaggctcacaagaccccacggtcaatccattcctcctcgtgctaaattcaaaaggcagcagaagcttccagatggcatgctctaaatgaccctgctttgagagtgcccttggtcagtaggtctgaggcagctgttgccatggctcagtcagagagttgccacggtcactggtcaccgttcaccgtgcagcccaaacctaggcacagagtgtagctgtctacttcctagctgcgtatgcctccctctacaccccaggagctgtaggacagggcaactggacagcaataggtaggtgtatttcatcagccctggattttacctttgactaaacacaagctgagctcactaagatgctagattctaaatttagcagcaaaccctgagaaactggtgcatttgcccccagcgcctgcggcaaggctggctgtgaggagcttgctccacttcagcctatggtctatcctgatgtacaggagtcctgctgactcgcccagtactgcaggctggcagggaggcgcaacagtgaccctcctctgctgtgctgctgggaaagggggctgaaaaacttcttggggagctcacttctcgtggtctgatagcacccccaattcagctctataaccacaccgctctatagagatggcttccaccccccacttcatctgatcctcctggcctgaagggctactcccagagttggggtaaaaatcactcatgaaagcatttcttctatgagtgaaccctgaatacttgcacactcttgagtaactcactggattctggacccttgaatcaactccttaacccacacagatgtcctgtgaaatgggcaccatagtgagcccacttaaccttgcagcagaatgatttgctggggtagatacaataccagcccacaccacatacctctgtgtgtgtccagggactctcacctgagccttgactactatacatgggatttggatcttcccccccccccccaataaccccatctgataacagcatgagtttcccacagcctgcgagacacagcctggttgggacagagctccagatccaagattcctttgctagctctgtggacctgggcaggtgatcttgtccctctgaggctcagtttcccacagaaagaaaggggaagggttttacaaatttggccgagaggccttccctttccaaccatctcccccataccccgccctcgcccccaatcctatccctttcctggacaggaaagtaatgctgg

SEQ ID NO: 587 - DNA, 2800 bp, Mus musculus
aagaaaggaaacagtagagtgaagaaacaactcaggactgaggttagagttagggttagggttaggcaaaggttaggcttaggtttaggcttagggttagggcaacagggttagtgttagggttagggcaaaatttagggttaaggttaggggttggggttagggttaggggtactgttagggcaatggttgagctttggcttagggtaagggttaggatctattttcctccatcttctctgcaagtttggattcctactattgagcctctctctagaactctgtatctaccctcttgtcaatattgctgttcttgcaacagctgccattaaagaccactttatgcctccccattgttgttcatacttctgctattgttctgctgtctctgtgtattacctgatcagtctggtctctagtaggcaagaaaagaccattcagggaaagcctttgactaagcctagttttccaaccccaaggagctatcttaaaaagtcacccaaacatcttatatagccaggaatgggtgggttggggttgagcaggtggacaaatcaaaacctgaatttgtattgttcataatcagtcacagcatagcttcctgttctttggccactgtcttcttgctgtattaccaggaaggcactatctttcatctggaactttatctggccatctaagttttatgtggaatactgtctcctacagcagtgcatatttggagtggttataactctaacctgaagcaggattgtggcttcagttccagtagtccttgtagcctgacatgtctcagtattatcatagtatcccaaatagccagactgccataagggtagtcttctggttgccagaaaatggcctaccaggaggacactttcctgctctaagctataagcataagaaccattagctgccagggccctgactggccagatcctggggatttcactcattcacagagaaaggaataaaatcttattgttcttgcaatatgaactttaacaaggtacaactctttaataaggctaacatgctaaacagggtttaatggcacataactctgctgtactctccaagggagagatgagtctttgtctcaaagttaagtaaattcttaagttgttgccatgtaattactaaaccatgtcagtcactgactactcaaatggcctgtttgagtcaggcattgatatcagttgatatcagttcagacttcatacaactctccaactcatgagactttcactataacaagccttcaaacagtcttcctgctgatccacggattctctgctctagggttacaggatccatttatatcacaaatgaactacagacatgaatagaacaggaaaaacagcgagttccattttatttaggaaaattaattacaccaaagcatgtgaagatgactttgctaaaaaaaaaagaaaaaaaaatcagcgatgaatatattttcttaatcatccaaatgcataaagctttttaaaaaagccgtaagttaaaagggaacaaatagttttaggtcacagcacatagcatatttagcactagataatgagaaactgaaataaaatgcagaactgtagcttctcccctgctctaaatcagagctctggcttgcaaagcatccagccaccgtgctctatagcctcatttccaataaagattcctggcctggcctactttagtccagcttgaaccttcttctagcttgacctccttgacttatatagaacaaaaacaaacaaacaaacaaacaaacacacacacacacacacacacacacacacacacacacacacacacacacacacacacaaagcccaagtaagtgtggatttcaggaactccagacacctgctgaactttgtcactgggaaggtttctcatcttccacatctcttgggagctacctgatcactcccttcagcgagactcttgttaggtttacccagaatcctctgatccctgaggcttccttgcttggcaacttctgaattcatagagcctctctcagcaacctccctgttcattacctataatttgtcccgactctctctcaatactgaagtttccattgcccttgtcttcttcctgcgtttaaagacttaggattatttttcatcccttatgtgtgtgattgtttctgtctgcaattacatctgtgtaccaaggtcattgcctagtgccttctgagggcaaataaataaatagatagatagatagcataatattccttggagttggagttacaatcattgtgggtcacaatgtatgttctaggaatcaaacctggctcctctgcaagagcagctagtgcttttaaccactgaaccatctctttctccatcttcccctcctgtgcttaatcaggtatcaggtatgcttgccagttactggtctgcttcatgtttcaggttaattaaatagagaacttatttctctgattttatttacttaatgttcatttttcaagtccctgatatctgattgctatccagcagagtcactgatccaataaagtatccaaatcccaaggtccctcctcaatttttgatagtttcaatttttttttttccattttttattaggtatttagctcatttacatttccaatgctataccaaaagtcccccttacccacccacccccactcccctacccacccactccccccctttggccctggcgttccatgtctgactatactgctgctactgctgctgctggagaaagcgcttcttttctgctgcgttgtctctttagcctgtgatcatccagaccacccaatgga

SEQ ID NO: 588 - DNA, 2900 bp, Mus musculus
tggtgacctgcactactatgagtcaggatttccctgttttctaaaaaagaacatttttttacatccaatatattttattgggttctaaagaaaatccttctgctatgtttagccagtatttctctcaagtcacttctaatttataatagttttccctttagatttcagtgtgcacatgtgtatgtgtccttgcatatatatgtgaagaacctagtatattcattcagtagaagtcactatgggtctgaattaagttgttcacatcttcaagtattaattaactccaatggtgaatatatccccttcaacacattcattcattcattcattcattcactcattcactcactcactcactcactcactcactcactcactcactcactcattcacacattcatatatatgtgaatgcccttgtgaaagccagagttgatgtcaagtgttttccatgaatgttatccatgttgcattttgaggcacagtctctcattaaacctagatttcctctattgctaaactagctacccaacaagacccacatatccttccatctctgccccttgcctctagagcagatattattggcatgtatgatgccaatatgtatatgtcatggtgatgcctatcttctatatgggggctaaggatcagaactcaagtctcaagtgattagctattgagacatccctacccctccccgagcctgcagccttcttcaggtgttcattagcaaactaaatacaaaatggccattttaattgggggcggtatggtggtttgtagagcagggatttatggaactagatgggttttcccagaagcaatcatgtgtccacactgcaggttagagtgagaacaggggaagaaaggactcagatgtggagagatgctggactcacacacttcatttcagtacaaagtaccacttggaatcccagccacccatcatccctgtttgagtttctccctcatctcttttcctctccctattggccagtcagtgaacagtagtttaaatatgatttaaaactgtgacccagacaaggcatttggatttttttctggagttaaaaattgtgcagttcatgtgatcaagtattgctaatgtcacagactagtgagtgactgtaaagaaagcaaaatcttccatttcatcatgggctgctagccaacagagtgaattatcacaagggcaagccaagtgcagaaacacttatttagagggagggggaatggagagaattatttatgctgtggatgaaaaaaagccctagaaaagggggggggatcacaccacagaggtggggagaaaactacttcaccttcagtgtgaaattagtttaccttcgctaagattctgatcccataaaagctataaatacagcatcctgattatttaggagaaaaacgctaattttcaagtttgtgctatttctagagattccaatctgctatgcaggaagtgtgagcatgctgataattaaggaacaccgtgttgggcgatgataacatgctgccgctggatcctagctcatggtagcttgtaaatatgtcaggagcacacgttagcagctctctgatttcaatacagttcagcgatgtttagctctacattgcaatcctggtgtcagtgcgttccttgtcataaagcagataatgcggattcgagataattattacaagggaagagcaaaaagctacaggctgaaataatttacaaatcacttcttcctgcgctttctgtcaccctgcctgtatcaatctcacagtccatagccatgaggcaggggacattgactgaacttctcaatggcctccgaagacggaagcactaggcaatgagctcacaattatcctcactcgtcagttcaacagaagcctcgacagtttctccatctgtagcatccaagacacagttcactggattgcagattgcccatcttggtgctgatctcttcagtgtgggtcacctttatcaactcctgcaactacagtttctgcttcaggccttgccaatctccaaaaattagggccttgtttaaaaacatcatcgaggctccctgggttcatgctccagtttctatggatgggctgcccttacagacagacagacagacagacagacagacagacagacacacacacacacacacacacacacacacacacacacacacacctctgatgtacctcccctgtgggtaggtgtaccttccaccacatgcccttatcattagtacctaaccacatgagactccctgttccagctgcatgctttcattcacagctgcctcacctactgccttcacatgagagccacacacagccttaaatgcttcccccagaacccagtctgttccacagaacgttagcttccttcgggcctgacagctgggagactctgatgatagagtctcattcatcttcttagccccagtatagaacagcatactgaaggatgctggaagcatcttgtgtgttttcaagaatcttagaaggtaagatggccaactggtctgaggtactggatgtagaacctgactctggctatggctttatatcacgggaataaactgcatgaactcagactatataaaggcactgcactgccttcaaatcctgaaattactgtattaaaggaagtgaagaagagatttgagcatgtatttaaatgtcataaaattagtcagttcctgaactacatgctaatctatatccactgtgcatttttcggtactatagaattagcatactggccacccaaaagtgacaccttctgctttagttcacagttcggaggcgtcagtgcacggtcacttgtccctttgcttttggacccaggatgtgacaaatcttgatgatggaaatgtgtgaaggaggaagctgcctacttcctt

SEQ ID NO: 589 - DNA, 3150 bp, Mus musculus
ctgtgtgttcttcactacctgtatccatcatgagcctctattaactaccttcttacagcaataataccaagagctgctgaggatattttgtgaggtgatacccattaaaactttctgggcctggggcgatggcttaggggctaagaacatttgctgtcaagtctggtgacctgactttgaaccatgggacatggtggaaggagagaaccaactctagcaagttacctctgactgtacacacatgtgcgtgtacacacacacacacacacacacacacacacacacacacacacacgaagcagtgatagatataatttacattctaaaaatctatctggcatagattaaagaaataatatatcgacaagttgtagtatcagtctgactgcaaggaggtttgatggtaagcaatgaggacatagaacacagggagcattcagagattcttgggtttaatcacgggaaaggagttgctcctctgttcataccccagcactgggaattgaacctagagttttgcatacactaggcatgttctctgcctcagagctatgttcttggcctttttaaactcagcatgtttttcatcgagtttcttattacgttgcccatgctggccttggaacattgccatttttagagcttcccagaaacgtattctcagtttcttctaacaatacaaacaagagcaaccaacagaaggtcctttgaccttgggaataagagggcaaaggctgcagtgggccagccccacccacacaacagctttattgttgttgttgttgtgtcttattactcctatagcacttcttttttttaattaatttttttattaggtattttcctcatttacatttccaatgctatcccaaaagtcccccataccctccctcccactcccctacccacccactcccactttttagccctggcgttcccctgtactggggcatataaagtttgcctgtccaatgggcctctctttgcagtgatggccgactaggccatcttttgatacatatgcagctagagacacgagctccggggtactggttagttcatattgttgttccatcctatagcacttctaaagtggagccttggtcttcccagtttacacacaaggaaagtgaggttcaggcagatcagttgttggagccaatgctgaattctaaaccacaggctagtcttcagtatagcaaggggggaaaatcattcctgttccctgtggacatagcttcagcctttaaaagtgtatctaaaatctgttgaattgattaataaatacgcatacttttgctgtaaacattcctctttttttctgcacgcactgtatcatcctgccctgtgtttgagcagcgtaccctgcggtgtgtaaataagagatgatgactctcgaatgtgcgtgtgggtggaatggatttgataaaacagaagcatgcataattcaaatatgaaaccccgtcccactccatttttgcataaataatttgcagactctctggatctctgccaacagcgcacctccccgcttccaccgctgccttccagaaatctctcggaattttgtcaggcacggagtaacacgccgaaggtgcaggagacaaagttattgttttcatttagcatttgaaaaaaatgctttatgaatatggttgggtttttacttattttttttcctgcatacaagtgtagagagagtaaaagtattgctggcagaagtaaaattgagtccaacccacttgaatatctgtgcaagacttggaccttggacttggtgaattcttcttgtttaattcccaccttggataaatgctgttcttgtccgtggttcttcccaccatgggacctctgccgatggctgtctattagggtcagtgtttctttttacatacaagtaacttaaatgttttggtgaggactcagatgtcaaaaatgggacttgttttttctgcataggactacgacatccttccatgctgtctttgtactcagtggttggtgacaaagacaagcgatttggccagtggaagtggcttggtcatttccagtttgcttcagcctcgtgcagattggtacaatcgtcctggtataagtggtcaactgagggtttaaatgaggtcagtataaaatgcagtcctcttacccttgtgatcctctctcttcaaggaggctccttttcctctccctttctggcatacaaccacacagcattggaaggcttccttattggtacatcccccagttccctgttggtcacctccgagtggatgtctgtgcccaataggaagtttcttttacaatggaatctcctggtcagtggcaaagtgctaagacctgctgatggccatggttcctgccttgtgccccttcattccaagtacaggtttcctttctcttattagtgtgttggaaacctgacaaaccagtcagccgctataaactgagggtgcttcctcaatcccgtttgaagttgctcttctgctatttaagctctccagtcaggggtgaattggcccagctgttctaggaaagtcaggagagcaagcccattgagagtttctattcccatcgctgccaaaagaaggagattggggtctaccctcgactcatgtcccacatcctgctgtaggcattagtaacccaggtagaccttttcaaattgcttccaatactactgaaagccatcttccattttctgttgtgataatacctcctgtacctgggggctgccccaagaggctgtctgctgactgcatccatctgctcggggcaatgagggtgaaggaagctctgggtgttccatctctgtttgtgacaacgatagatgacttctctgcttgcatcctgatgtgatttccccttactttaaatattctccatctgcatctaaatgccacattactttccctatctgtcctcatgggaaaccgactctctgtggttgagggaaaacacagacattcagtgggaatgtctcactcctttctgtctccagtagcccagtgatttctccataggcactgacctctgggctgtagctgttttggggactgagagggtatcttgtttctcctcagatgctaggttagggaagaactgtgttaaggagaactgtgtgggtgcagtgtggaaacataaaggctaaca

SEQ ID NO: 590 - DNA, 2350 bp, Mus musculus
cactcaaacttaattgatgggcctttttgacttgatgaaacattccatagcacttattaagttggacaattaagctaaattcttttacggaaactggagaaagaattacaaggggtttttgggtttttttgttgttgttttggattttttttgttgttttttttttgttgttgttgttttggttgtggttatgccacagatactccttgtgtgtgtgtgtgtgtgtgtgtgtgtgtgtgtatttcatttacacacacatatatttcctatccatatccatatacaaatgctacatgctaaccatgatctggttcctcatttttttctcaaggtttagagagattttgttttgaacatggaagtttgaactcaaatacttattcttgcatggcaagcactctgctgactgacctctctcccaaggctaaacattttttaaagttgtcattacagttagagctgggaacatgacttctgattccttgtgattttgtaattacatcaatatcccaataggtaagaacccaatacaaaagctcctggatgccagacaatgtcatacactcaaacaatggtcaagagacaatttcctgtgcatgtgtaaaaccatctaagtcctaaccatcattgacagaatagcactaagggagatcttttattctatgtatgaggaattgtcatttacaagtgctttttaaaaatctgggccaaggcaattatcagaaatccacaggcctgcccacacagattcaaattagtttgtcttgggctgatggggtggctcagcaggtaaatgcacttgtcatgcaaacctgatgatccgagtttggtccctggagcccacggtggaagaagagaaccatctgatgacagttgtcctctgacctccacacatgcatcagagcatgcaagccccggcacatgcacacccctgcaggctgtctctgctgcatactgagcagcctcactctttaatggcctgctccagggtagggagagaaatggttctgatcagtcacttgttaactcttgttgtcacctcaaggcatcgaagggtaacaccagccttccatcatggttaaaagtgatttataagctcccagctggagcttataaagatggctacaagaccattgccagaaattttctgtcagttggtagactattttgcccacaaaacacagctagatctacccattctaaggagaatagaggaaacttctgcatctcagcctgatacagcaatgcaaacattggggactgcaaaaactagcccttccttgattagccatgagaccacaccaaaggtatccatgtgtggccctgtgctggccccagccacccaaaggcttgagactggcttctcaaagcagttccttatttactgcgcaatctgggttccccattttgcttctggctagagcattgtttcccctaggtcaatgacttgtctctacaaaaccttaatgcctactgaaggttacgctgcaaagcactagaccccagggatcctcctacaatcaggttatgtcacatcctgaaatgttgttattcacaagttgatgctgagcttgaggtctccctttgagggctggaaaagataattcagttggtgaagtgtttgacccataaacactagaacctgagttcaatgtctcaaactatactaaagcattctaggcatggtggcttgagtttttaatgtttgttctagggaggtgtatataggaggatgcccagcgctcactggccagacagtctaggtaactggtggagctgcataccaatgagaggccctgcctcaaaggagcatgatggtgttcatgacaccaaggttgttttcaggcctctacatgcatctgcacacatgaagacatgtcttaaagagagagagaaagagaagaaaagagatatgattttgatatttactgaactttcacgaagtagatagttatctggattaggaaaagatgttaagctccatccatctgcctttgaattcctactgatgaccatttcatacttttctggggaaaaaaatcagcttaataatgaatgtattccttctctgtaatttcactttatttgtaaaatagtctcagtctttgtgttgaggaggtcaggatagtctgccctttggtgagagacatggactaattgcgaatggcaggcagtagccaagatatgtcatcgtcattgctttcccctctgtattcccactttgagtggccttaaaccacttttcacttacttggaacctttttctcaagcatgtgttggtcttcttaacaaagagctatattcttcactccctaactggctttggctcttcttttaatggcatggttta

SEQ ID NO: 591 - DNA, 3200 bp, Mus musculus
acacacactagtgatgaatataataaataaaatttaaaaactattttactgcaaagcatcagaagaaccctaacatcaaggccagcaaacagtcgcagtttattacagtgcttctattgtagctaagggtcgcttacccaagctgggctcattaattggttctgctcacccagctgtgtcatctcatatgatttcatgcaggtggtgaatactgaaggacccatatgaggtaccctagctggccaagattccttgctcttgctcatcctcctctcaagaggaggatattcagcacatgtattcatagaccagggaaaaatcttgtacaccctcttaaatcttggacttggaaaggacacactggatttcagtctcagtgtgtacaagtaagtcatagtaccaaccccataggaagccatagagaaatgaggggtccagctttagtgaagttacaatgaaactgcatggcaaaagggatggctgggaatccagaggggaatgtgggtctcttgtagtgtatcatgcatctccaggcaacatccatggagacaggcagactgagacatctgatgcatttgaccaacatgcctacctacagtttatgtatttatttgtgtgttcccatgaaatgaaaatgggccatttgtctgagcagctggagagataggagataattgccatgcaagaaataagtgctgaacgtgggccccaaaagtcacatacaaaagtctgacatagtgtcatacagttataaaagccaacctatgctagtttgataagttctagaccaagtgacacatcaaacctctctcaagcagtaagatgacaggacttgaagaatcacacctgacgttgacctgtagtctccacgtacatttgtacactgtatacacatctacccaaacccatgatctcatccctctttctcacacacatacatgttaaagtttaatacacagagaataaagcaatgccttcaatgaagtatgaagatacagagtcatccagttaagaccgaggcatattctgaatctctagtctctaagacacatcttggggtcacccgattagaacttgctacatgcttatatttccaaagtaatctacagagcaaaataaatgaaaaatattttaaatgcctaagaaggtgcttttggatgtacaattgccttgctctttgtaaaatggcaaacagtatcccatcaagattcatttttatttttttggctgagtgcattttcagttctgtactatttcctctgacttagattgataggcagggagcacttaggaggggttcaggtgttggggaatgtgatgaggatgccaggaaggaagatttttttcattgcgtgttctcagaatgctgtgctggtaaatataaaactaattcccaattgttatgataatgccccgtataactctctcagttcttttctcccgctgcctttattttaacacttagggataattttcacaaggttatcccttctaagtgttccagtagatgtaattatatttatttcagaacacacagttaaatttacagaagcaaaaacaacactatttttatttataaccatggtaaattttaatagtgagtttactctagcagtgcataatatgatagctggggtatttaacatgattatgattgaatgtcaaccctagggaattgctcagcaatgcttttttttctctctctctctccagtctacagattagtgagagagcatagagctagacatcagagcagagaggcagaagctcaaccaagaagcaatgtagcttgggcacccatctctcatctgtctcggtgttttttgttgacatttctcatatttcggcatccacagtgcccactgccagagttccacggcccataggtacctccttcagtggagaagccattacttgtttatctccaaaacacgggtgcccaagctctgttttgaaatcaaagtataaacagcaatgtaactagggcactgctgaacaaaattaattcattaaaataactcctcctcctcctctttgtctcctccttctccttctccttctcctgcctctgcctcttcctcctcttcctcctccttttctatctcagtttctgtctctgtctctctgtctgtctccatctctgtctctctgtctctgtctctgtctgactctctctctctctctctttctgtctctatttttattcacaagctgtaagcctagattgggcaagttttagagctattctaaacttacatcctagccacatgccccttgttatttgctgtttctcctggccatttgctcatggaccatctcttctcatgacagccttctctctttgtttcttctttctcccctcccctggtctctcctgagactcctcattctatattgatgacacttctttctctctccacggcccaatcacaggctttagcattttattgaccagttaactcatggtgcaagggtcacatagcattgcttggtatatgtggggatctcctctccagagaacaatcagatctttagggtcagtaattagcatttgaactcataaaagcaccagaccaaccctaacatttcctgcttcttgtctaaataaaaaaggttcttttccttaaaataaaagcaatatacattaggaacatatatgaaacaattatgaaaaattatttcaaatccatctctatttgacaactttggataaagtattctatcatctatcataccttggtgaatccagagttttgtatttgaaggatttactcattaccatcttaagcatttaaatcctctaactttcataacttgcattaccaacctcaaacacaaacacttgtttacaatttaaactttcctgtcctcaagtgttcttaacttgcttttaccatccttaaaacatctcctaagaacctttataacttaggcttaattgtgaggctatgactatctagtcttcaaccccattagagacttgagaagcaataacattaattagcatgcaaagtcggttcactgtgagttgattgtgacatttacacacacacacactgttttgagttggtccacaccactagtgtttactactcaggttcatcttgttgaaatggtctccatcaaaatatcccaacctgccttcctgccacatacattgaattaccttctcattctcatcgaaagagttctcattcttc

SEQ ID NO: 592 - DNA, 1825 bp, Mus musculus
catttttaacaaatggtgctgattcaactggcaattagcatgtagaagaatgtaaatcgatccattcttatctccttgtacaaagctcaagtccaagtggaccaatgacctcgacatagagccagatacactgaaactaatagaagaggactggaaaagaacctcaaacacatgggcacaggggaaattttcctgaacaaaataccagtggctcatgctctaagaacaacaatagacaaatgggacctcataaaattgcaaagcttctgtaaggcaaaggacgctgtcaataggacaaaacagcaaccaacagattgggaaaagatctttaccaatcctacatccaatagaggactaacatccaatatatacaaagaactcaagacgttaaactccagagaaccaagtaaccctattttcaaaaatggggtacagagctagacaaagaattctcaactgaggaatattagatggtcgagaagcacctaaagaactgttcaacatccttagtcaccagggaaatacaaataaaaaaaaatgagatcctgcctcacaacaatcagaatggctaagatcaaaatctcaggtgacagcagatgctggcaaggatgtggagaaagaggaacattcctccactgttagtgggatttcatgctggtacaaccactctggaaatcagtctgccagagcctgaaaaagacagaagtggatgctcacagctaaccatgggactgagcaccgtgtccccaatagaggagttaaaggaaagaccgaaggagcttaaggggtttgcaaccccacaggaagaacaacatcaaccaaccagaccccccccagagctcccagggactaaaccaccaaccaaattgtacacatggatggacccatggctccatcaacatatgtagaagagggtggccttgtctggcatcaatgggaggattagcctttggtcctgtgaaggctcagtgtcccagtgtaggggaatgccagggcggggaggcgggagtgggtgggtagatggggaagcattctcatagaagcaaggggagggaggatgggataagaggtttccagaggggaaacaaggaaaggaaatttacacttgaaatgtaaatttttaaaaatccaataaaaagaaaagacaataaatgaaaaaagataattacattatgattaataacagtagcaaaattacagttatgtttggaaaggtcactacaacacgagaaactgtattaaaggatcacagcatttggaaggttgagaaccagtgtcctagactaaatcttccccaaactatcttgagggaaagtatgcacaccttgcattgttaaaaatgccagaagaaaacatgaccacccagggttaaaacacaagctaactcagcctctatgttatgtgtccagtttccagacacatccacccctgagctaaaaatcccaagttcatttcacattagggaagtataaattaaagtcaccgtaagcttaccactttacaccctccgaaatgggtaaagcttaaaagattgacaatacacaggattgggtccttgccctctctccccactgggaacccttcagacatattttaactacagacttcaacgaatgggagcaggttatcgattctctgttattaaaacccagaatgtgaagtcacaagacgtttagttcagtagcttgcccagtaaattttaagggatataatgttattaaataagtctctcgtgagttctgttgggacagctcaaaaataattaatcgagagttcccagagtcggtgtggtctctggtgttttccctacaagtttttaaaactt

SEQ ID NO: 593 - DNA, 6950 bp, Mus musculus
gagtgtaggcagacatggtgctgaaagagtcaagctttctacatcttgatccaaaggcagctaggaggagactagattccacactgagaagagcttgacctctgaaggaaaagggtgaaagagaaagagaagatggattctttcccatgttacttggccaggtgagcatagtccagtccataaaatgcaagaggattgctcttggctctagactctagaacaattctcagatttatagtctcaggccagtttcaaagtcttcaaaaagctccaaaaagttttagtttatatggaacttaatatagtctatcgattgatatttgttgtgtgagaaattagaacaaagctacttttaactattaatacatcctaaaattaatagtaaaaaaaacctactttgtattaatacccatcacttaatttatgaaaaataatatcccttctcaagccaaagaaagcctagactaggacatcatcatcatcacaagactaacacagcaagtaaaaccttgctattactttttaaataactttgatctttcggtgccctttaagtggatcatattttgggaactaatgctctgaggaagataaaatttggaatctccaggctgggggacaccagtccataggctggcatctagataactgggacaattaatgaaccagaattatgaacatcgactaaaagatttgcattgtagactgaactctgtcccacttccccaaactccttagcacatctcagaccataaaacaatgtcagtcaagctaaaccctccatccagaacacctcaaccatctcacaggaatttagctgggtgggtagagacttacaagaagacctataatcccagcttgggtggaagaagctcccttgaacctgctggtgaatcaggcaagctgcaaagactgtgagcttcatgttcagtttgagaccctttccccttgaaggagtaaagtggaaaatacagggaggatactcaatgacctgccttccacatgtgaacacactggtgtgagcaccagtgcatgcatacatgcacccacaggtacacatgtatacgagcacccatgggtacacttacatacatgcagacagcacacacacacacacatacacacacacacagagagagtaaaggaagaagtatagaaaactgcctagggcaacaaaaggaactcccagggaatatggaggggtgaggtatgcaagagttggggacatggtgggactgtgttcaatcagtgcacaacatctattcgtatgaaaatttaaaaatgaatacaaatctttaattttctttttaatccagaagtaaaagccccaagatgtaaagggaggtcccagggtaaagcggagaatatctgcttcacctttgggtgagtcagaagacacaagaaggcccttctactacgggagagcattggcaccttggctaagcactgtggttgaaagaagataaagggacgtaaccaagggatgcgctgtgttgaatatgtagcaacgcgtagaaaacagtgcactgcctgagcgggtcgatgcgtgtgttgttccagaggtcaggcaaggtttagagacactggagaaggttcagattctatgacttgacttcccactttggaaaatgcatctagggaaggcctcacacttcttcctgaatcccacattcactgctgctcgcatagcttcttccgagctatctcacggccggccgacttctattccagcttcatttttgttgctctgacaaaataacacaagaaataacagtgcttgaggaaagggggatcgttttagctcacaaacccgggtaataatgcataatacaggatttcgagaaaggtaaaacaaaagggacttgaagcagctggtcatgtcacacccacagtggtgagccgcgagagacgaatgtacgcatgcgcattctcagcttcctttttctactctcacacagtctagaacccaaggtcaggaagtggtcccacacatatgtgggtcctccacaccagtaaaggtaatcaagacaaccccccttagatatgacgacaggctgagctaatctaaacaatccttcactaagactttcttcccagcagattctaggttatatcagttgacaattgggggcaattatcacaacccctttgcgtgctttaagacttggctcaacttttcaaaatcacaggaacgctttcttcacccacctgagcaattcatctccccaactctgtcactctaaaccacaatggtccattcacctctccggtaacaactttcaaagtgagattttcttttttctctgtttattttttgtatcgccttgcctctgtaatgtctactgccttagggcagagcttcttggacctagattgctgtctgctaagcttcccgatgtcccattgtgtatttggtaaattaaaaatctactgaagatgagatcaagaattaggagacgtggttcagggtgagccattgctatggatggataaggccttgaggataggaattgcatctgggataaggtagttgagccaaatactaaattctcctgtggacgagggttatagacagacagcagctgatgaggcaccaatgtagaaagaacaaccttcccagacatcatgcatttcacaggagcaggtattatgggcaggatgggaggaaaaacagcccttacttgagacaaccaaggaatagccacatttcagtgggaggtgggagacaggaaaatgcaaagaacatagccttgagttccctgctgatacctccagtgggcacaatggaatgtgaggttcaattagaactagaagttttgccccagagaaatatttgaaaaagcctagagtcactgtttgtcataacacagaggtgggcagagaagagatgtattgttaagtattaacagagcacttatccgtaacaaacttttccatcccataactttaatactacctgaaaccctggccatgttttggatgggtggaatggataggagggagggagggagggagggagggagggagggagggagggagggagggagggtgggagggagggagaatcgatggatggatggatggatggatggatggatggatggatggatggacaaataaacagagatgggctcttggatggacacggtggatgggtgggtcagtagatgggtagatgaatgggctctggattggtgggtggatagagggaaatggaatctattggattgacggtggatagaagatggatgaagacactgataatagaaataaaagctatgtagttaattaatatttttcattctactttgtcccttggttgtacattttatttactctgctttgttctagcttggttttaaaatatatataatcacccatgaatataaaaggataatgaaatagaaataattaaaaacaaaagacaattcagaaaaaaaaagcctctatattgtctcggtatttttcccgtgctcctttaagtagcagatttaccaaattacttctatttcaccttggcaaatattaaaattatttttcacttcttaaacacccaccaactggtggtgggtgagacaaggctagatataaactgagcggcaggaaaagggaagctgggacataattcttcagagcagaaaagtcacgagctttactacttttgactgggtgatgaagagtttatttataacccccaaaagtcctttaagcttaacaataaataatgactcattcctccataaatatttccttgcaatgatctgtgaagagatattattttaaaatctcattaggaagattttgaccggcctgattaagcctcgtacagtaactgagtaaacacagtagttacatattgactcaaactgtcccaatgggctttctagtcatcccttctcaagccagtcctctgataaccctctgttaccttgctccaaatgcaagtccgaggtccaccagctctcccaatcactcagccagtaggcactgggatgttaagactagaacagcttgcttgttctagaaagctctcaagatgactacataaaaccttgagagtccagtgcaaagtgcagtgtcacttgacaagcataaagggcaggcatggtagctacctggtgctgaggaccatggctccctgagaaagtcacagggaatcacctctaagaacacaggagaggctgtctggttcttcgagcatcctcagacccaacatttgcttccttaacacctttgctcacagatgacaatttccacatcacatcacaacatttgccaagccaaatgtccaagattctttcctcagaactagggagaggataagggagtcctgtatggtccagctgtgatatgtaaaagcatttggatagcaaggtaacagaaggtcaccaggggactggcttgagaaaggatgactagaatgtccattgggacagtttgagccattatacagttgagacttcatacctgtatccctcatgttaccctctcagtccaaaagcctaaccatggtataagcccattggaagtctgcagaatgcttcttatacatcttggtcttatgtatcaaaatcccatttctccttttctggtagttgttttaagcctgctcacagcagggaagcatcagccatacaaagcaaacatgaaatgcagtctaggctaagatacccactcacctacttgctctcctggtaatggaacagagagaaaccatgctgggacaaaatgaacaaaataaacatttatgctcactacttttctcattaatctgaccaaatacctgacaagaagcaacttaaggcaaggagagtttattgtgtctcatggttcaaggccacacagtccatcatggtgggggaaggaaggcacagcatctggagtgggaggcagctggtccattgcttctgcattcaggaagctgagagagagatggattctggtcctcatctaactccttgtttccccaggacaacagcctctgttgtcaccaagagacacatccccctctattatgagaagaatgaagctattaacaaggtatagctggtccagccatgcagacctggttatgagctccatagccatacctgtgcttcttttccttttttttgggggggggggattgagacagggtttctctgtatagccctggctgtcctggaactcactctgtagaccatgctggcctcaaactcagaaatccgcctgcctctgcctcccaagtgctgggattaaaggcatgtgctacccctgcctggccatacctgtgtttcaagttcctacattattggatcactgggtaatctctcatttcttcacaggctcgggggaaggaccacagcatctctagtcttgtagcacctccccttacaatatcactcagtctcatccaagaacatagcacatcccagatgggactgtgcaatcaaggaggcaattcagtgagcactcctcgatatgagccaacccaaggaaaatggaggggtacaacgaattcagagtttagagtcagaaaatctaagagggtccaacttcctggatggatacaacaccctgagaaatcccctgtagcaacttttccaagtctggtttccttatttataaaccagagatgatggtacccatgtacaagtgacatcctacaacatctaaaaggctagttcaaaaccaataaataatggtgggtgtcagttgtacaagtggtgagcttcacttattgctatccacagtgttaacccaatcaggaatgttagctgaaaaaagaagaccccatcagaagcataagaaagcgctactaaaaccacctaaaaagggactcaaggagacatcaatcgagaatgggcacatggctctgccagtaagatgcctgttgtgcaactaggaagacctgagttcagatctagcactgtacaagaagccagatgctcagcacacatctgtaatcccagcatcacagagattgtgataggaggctctctggagctgttggccagccaaatctgtgaactttgggttcaattaaaaaccctgcctcaaacaacatggtagagagcaaccaaggaagacacctaacacagacttctgaagagacccatatgaacagatgcacacccacatgaacacacacatacatgatacatacctatgcacacacagtaatagtaataataaaatgagaaaaaaaagaggcagcagttgatagaacactcatatcacaaaaaagccctagagtccccagccagtgtgctccctagctattagtctgtcattaaactatgattttgttcctttcttgccagggtatctcatagagatttgacaaccaagagattttaaggagtaaacgcagcggttgaggtagaggacaatccattctttcccacagcatcatttcagaggttcactgaagatccaaaggagcagcccataagaaggtactttataaacagccaatgctgtgcactgcagtagcttcaaactgtgaactttgctgggctacaggaaggacagttttttcatgagtcatgacctctgtatccatctgatttaccccaaaggagccaatggagagagccctggctatgaagagaaacaagaaaggatcatggagccaaggttagcaggattcaaaaggagcctcattggcctccattatccatttctccttaatgaatttagcctcaggcacacatcagtttatgtccagctcagtgagtcatttcttgcctcactttatcccctaccatgatccaaatgcctatgtggcctgctgcaaattcgtaaattgagagctttactctcaaattatatttagaggtaatgcctttggaagttgatcaagtcactgggcaaagtcctcatgagagggattaatgccctggggaaaaggcttcagagaggccttcacccttcattgtttggatgcatgcctatgggtggagagcaga

SEQ ID NO: 594 - DNA, 6400 bp, Mus musculus
ttacaaagggatagagataagagtgccatctagaaacaagtctttaaaaaaaatacctcagagttgcttaaaggagtcagcatcaaaggggactctggtaggaagaaagatggcaggatccacgagtcaagtcttaagcctgttgtcatcaatttgcagaactttacagtttgtttctctaatgggtatacggggtgcctgcttcatggcaggcactagactgagctatagtcacgctattgaacttgatgaagacaagggtgagcctcataggaagagagtttccattagaatgtccagaatgctactgagagcctaaccacttacctgctgtgttagttttctcactgctgcaacaaaggcaacctaaggggaaaggggtattttctgctcacagtttcagtgagtacaaccatcatggtgaggaagatatggtggcagtaccatgagacagttgggtcgcatcacaggcagaagcagggagagatgaatgcttggcttcggtgttctctcccctttactcagttcaggacttcaggccaaggcatgttggcagccacactaagggtgagtctatccatctcaactaaaatttcccccagacatgagacaaggaccccatcatctggaagacatgcaaattatgtcctgtcaccaatggtcagctatcaaacaaatcccatagggtcctcctgctgaaggacagacacatttggaaaaaggttgggaaggcagccactacctcttggttccatagacagtcacatggggtctgagaaggtctgagacctgcatgaggttgcacaggacaccctcttggcatctaggacatctcagcatgtcactaagcttgagctagaagatgtgttgacacatcatggccttcctcccatacacagaacatctcaaaacagtgaaatacctctgttctacctttcccacccatcccttggtggggggagcaaatgacaacatgtatttgacaagatgttcagcactagatcaataactgaaactcagttcactcagacctcattgcactctcaagccctagtcatctacaaaactgcccccttgactttggtatcattcctcagcctgtgactggaagtcagaccaacccaatgaactaaagccattcactccagacaaccaacttggccaaacaggactcagtctaagggaggctcaagctaaaaagatgggtcagcaagaaaatatgaacatggaaagcaccagcaataactaccaacagacagagcctgtcctttatgctatagacaagagctgaaggaagacccgtcctccaattgatgcctcccagctttggggtatttctgcagcagttgctcagttctaatctttgcagattcctccatggaaagtggctagaggggatggcgatattagctgatgatctggaattaaactgactcctagggtatgggatgcactttactaaatcagagctaatgaattccacagagagctcatgagggaaaggaaaagataattccgctgtctaaatatacttcacttcatgaaagataaacaaagaaatttcgcctctgaaagggtgtgggtctatctggaggaagaagaggcctggactccagaaactgcctgactaagaacagttgcttctggccatcttctccatgtagacttctgtcttttcgaatgccttttggcttttgagagccacccttcattgttaccatggtcagcaatagcctgaatgggaaggtgaatgaagacaggttactaaggaactgtccattgtaccatgcgagttacatctcacccatatatggactgccccctcctctgaagccaaggaagaaataaaaaaggactcaatgactacatactttttcttcaaaatggctgcaagttcttcggcactcgtcctctgagaaagtaagactaattcccctcctgtttaaagcaatccatgccttaggctccacttcaagcaaaaggaaaaggcagatatgatgctatgtgacttctgagttgctcataaaagagatgtatgtccccacaaggcaccaaggcacatgcctttgatcccggcacttgacaggcagactcaggtacatctctgtgagtcagaggccagcctggtctacaaagcaagtccaggccagccaaggctacaaatagagaacctccccaccccacccccaccccaaaatagctcccatcaagctctggggcaagccagctgccatgtcatgacggtgcacactccaagagcaaatgctatctgtggcctctatggaggaggcagcctctctccaaaagccagcaccaccaaatccccagccccatgaatgtagccttactccaccctagcctttcatgaccaaggagctacccagcatgaccacttctcagctcctgacccatgggaatcggagaagagggtgtttgttgtgttgggacacgatttaagacaatttgtatcaaagcagtaggtggcttgaaaatgcaagcctgattcactctcggtggaatacaatgaccacattgaagaggaggagactggaaggggttgggcataggacagacaagacagagataaagatgaaggaataaaaaaaagagaccgcaaaaagacaggaagcagaactctccttcccactccagatgttcctcctgcttctctgaatttctccactcacttccaacacattttctttttgtaaccttttattgactctttgtgagtttcacatcatgcaccccagtcccgctcatctccctgtccccacatatccatctttcacccttgcaaccttccctctccagataaaacacacacatgcgcacacacacacacacacacgcgcgcgcgcgtgcacatagaaaagcttctcattagtatgccacagcatgtccctctgtccacacatcttcacttacagatgtttgttgcaatgagtcatcaaacacattcttatttccatggtttctagctttatctcatcacttggatgggtgacttactttttaagatttattttattttttttatttttaagtacatgtgtctgtatctctctctctctctctctctctctctctctctctctgtgtgtgtgtgtgtgtgtgtgtgtgtgtgtgtgtgtgtgtgtgtttataagtggagttgctcacagaggccggaagagagcatcagattccctaactctgaattacaggaggctgtaagttatctggcataggtgatgggaactgaacccaggtcatttggaagagcagcaagtgtctgtaactgctgagccatctcttcagccccatggtggctgtcttcttaaagcaggtgcaagggtctcttgattctgtgttgctcatcacacctggcaccgtgttctgcacacagttaaccaagaccagtgggcaaggccggctagttaaccagatgctcagaggaacattctaacagggtttggcgagaagtagctggaagacaggaagtttcagatgaaggctgagccacggtatctcttatacagtagatattattaccttttagtggccctctgtaaaccatgttagccagtgttcacatctttgtcccctactacattgtctttgaacttgatcatgtgactatatctgtccacagctatgtagagtttactcaccaaccctgaattttcccctctgcagagaagaaatcagtctgtcataaagtgtcattgagaagaccaggttagagagacacaaagtctcaggcagaactgagcctagccttcctggaaaaataagtttctccttcattttccttctccttgattaaccaatttctattgtcaacttgactggatttggggccaactaataggcaagctactaggattatcttatccagtttaatggaagtgtgaaggcctaccctagatgtgattggcaccttccagtggcagctgagatagaaggaaatcggagaaacaaaagcttttggtttctgcctgcttgtcgttatgacttactgacaagttcatctactttgttgtcatcttatagtggcatctaattaatgatgatgatgatgatgatactgccatttttctctgccatgaaaacccagcttctttgaccttccagcacagaccaaagaccaatgactatccagtagtcctccagtccttcaacaccaacctagggctgctgaagcatccagctcatggactgagcacctagcagattctaggcccttcagtgtgcaggcacccactgtcatactacctagaccaagctaataaattgccttttactgtacccaggccattggtcatgttcctctagagaactccggggaacacacagctccctgtagtgtgatctttgtactctattctctctaccaattgtgaaccctaggtcatttccctgcaccttactagaacccaggagcaaggaagctaaaggtctctgccacgtgacacaggaagttctcatggagtttgggatggtgaaaccatcctgaaccttatccttcagaaaattaagtgtgcctgctttctatgagcctcgagatacaaataaatagtcttcatccactcaaaaggtagaagacaatttaatgaccccccaaaataatagcaacaagaggaaagaggataaatgcaaccagtgagaaacacgcttacaatgatctatattgtgaatatatatatatattcatatctcagcaggccctgcagagttacagatgagctcattaaaatgcttgtgtttttagcaatgatgtttattgagatcatttcataaccatccaaattggggtttgttttcagctatgatgctatgctacctggaatattctgacctaaattatttatgggcctaagaatagatttccttccctccccctccccacccctgctggcttcagagatagatctcaggatgtggagagttgtggtgcactcctaaagtgcttacaaggctctcccacatttccttcacctgctaagattcgtagagacccacggaaggccacgggcagaagctgacttagcccctccggtgagttactcagctccatgtgggccctacaacatggacgactctccataagttctgctaaatgagtgacagctggtgttgctgatagtgggtctcatagcaacccctagataaatcatgaaagaagactccagcctctacagaggataaggttgaagctcaagaagtcacccaacctgacctaagcctgctaatgaacctggaatgttctggcatgagttctctgcttccaagctcgggtcttggtgcatggtattcttcaggaacaaacacatacatgtgctgaacacggcagaaagtaaggagccctggagatcactaaagcaagggtggagaataagcacagtccttgaggctagctcacaatgatgaactaattatcctgactctccatccatacaaagaactcaccatgcatcaaagctatagaaaacacacaaggtgtttcaaactaaaagacacttgctattaaatgctagtgcttaacaaccatggaagggtggagaaacggtagaacaagaccactgagttctgaaacacaccaatgagctgtggcccaagcatctcactgctactgccacactgccttgaaatgtccatgaactccagctgccacagatacttccataaagtacattttaacacctctgctgaccatgattcttcaagcaaagctaggcagcagggaaacagacttagaatctcctagaccagaaagtcctaattttgtttgagtgcatctcactgtcagaagcaactctgcaaagtccagattggtgggaggtagggaagagaggcttggaaagatgatgtgtcttactttccaacctccatcattggaaggaaggtgggatgtaggataaatgacaagaaagaaacagaaacttccagatagaacaagatgatgcacatattcattcacagaggttggcagtgtatgcatggcctgcaaaggtccaagacagatgaggtcccagtgttgagagaggaaaatgaacatgggctcccaccccaagcaagaagctattgacatctacttgcataggaaacatgagttttctctaacagagtctcactgggtatactgagcatgcttacacaatagatcccatgcccagaattagatggccaacacaaaatgaactcaatggtatttttgtagatttttttttttgcctcctgttgctttgttttagctttatttttgttcgtcttgcttgtcttttgcatgtatgctatggtttccagtttactgtctttatagatttgggttgttttggtgcgtgtatgtgttcacaattttacttttaaaatatttacttattattatttttactggtgaatgtttgtgtgggtagtg

SEQ ID NO: 595 - DNA, 2100 bp, Mus musculus
ttggcttagtaggttccctctggaggatctacccctggaggatctaccgctggcctctctcccagctcttcatggccaccaccctccgtgctccttggcatgtagacacccagccccaatctccgtccctgctgcaacatggttacactctcctctgcgtctcctctatttctttgttttgctttgagatgcggccttgatgtgtatgtagcccagggtgaccttgagctcaagatcctctgcaccaatttcacaaatgccagggtataggcacgcatcaccacgcccaccttctcctctcatccaaaggacactagttgcacaagatgaagagcccaccctggcccgatatgaccacacatgcatccttccgagtatattcacattctgaggttcagggaaagagagttttggagagctgctgttcaacacactgcagtgaggacccgagactctacttgacttgtgtgagagcaaatgagtgggcagacaaatgctgggtttcatgacacccaggtgaaacaaagcaagatgagcctttgtgagctcactgttggatgctgctatcacctctggatgctcggtctgcacggatactcaaaatgcattgttcttaaaatctgtccgggatgcatagaggcatctctccaaccaaaaacacagccacaaccacgggtcccctgacaggtggcctcctccctgtctctcccaatttcaaactcagttctccctgctttgtaattaggcctgaattcgggtccatccaacataatgacaagcgcccagagagaaccgatcttatttccctactcagccctcattataagtctcagctgatgggctgctaagtcctgacaccgcacatttatttagagtcgcaaacacctgtgaccagaaaaaccaggccagcagaaaggctcggctcattccctcccccacccctgtttccagggggaagctcgccctcctgccacccccacagccagaagccaagaaggcacagccagaagccatgaaggtgtgactcccctgctgagctcctgagaaggccttgctcagctagccctcccaggtgaaggtgctagcccaccatgggttaaagaaataattattgtgggtctgggagagttggtaaacacccttcgcctaaggaggaagccagtttcctgagcccagctgagaaatacaattaagttgtaatattttgtcagggcttttccctcctccttactgtttatcagtgttaagagacaatttccactttgcaattctccaggatggtgagtgtagctcacagcaggcaggtaaaattaaactgcctgtcacgagacactggccttgcatgttgctacacacactgaaccaacaagatgagagttctgggtaccaaagatctgctggcctggaaactctgacaaccggacacagggcagcgatggctctgtcttctctactactcagactcttgagtcagtccaacaaaagatgagggatcccctacacttgggcaagctgtcctgtctcttccatagatgaggatctcacataagggtctccagttccccaacaacagtgaggtttgagtcctcattagtgttctctatagctatgatagagctatttggtctatgagataaagcaatggtaaagcaatggtctttgagaagaaagatttggcttacatgtcccagtccatcactgagggaagtcagggcagaaattcaaggcaggaaactaaaggaaggaacagaagcagaggtcatggaagaatactacttactggcttgctcagcctgctttcttatagaacccaggtccacctgcccaggggtgaccccacccacagtggctgggccctcccacatcagtttttaatcaagaaaatgcctcatggacatgcccacaggtcaatctgatggagggagttcctctgctgaggctccctcttcttcaggtgactccaatttgtgtcaagttgacaaaaactaaccagcacactccattaggagcctcccctcctggaagaaacccatctataaacaatctagaggtggcacctagcacctggcagagttaacccattcctccactaagcgtcag

SEQ ID NO: 596 - DNA, 3750 bp, Mus musculus
ggaatggttggttttccctctagctttatgtatttagtcagaattttccaaaagaaagcagaactaagatgaggttttgtttttttgtttgtttttttttttttgttccgtgtgtgtgagtctgtgtgtgtgtgtgagagagagagagagagacagagacagagacagagacagagatacagagagagacagagagaagagtgtatatatatatatatatatacacacacacacacacacacatatatgcgaatgtatacatatgtgtattttgagcatatatgtgtttaaatttgtttgggagtatatcatgttaaagactatgtgtatatgggtgtgttcatacgtgtgtgctgagagtatatgtgtgtcagtatatgtgagtgtgtgtgtgtctctgtgttaaagtgagtgcgtgtgtaaaggcttgttctgggaactggctcacttgtttggaggctgagaagtctcgtgtctgttctctgctggctggagatctagctcagctcactgtaattctggcctaggagagacaatgataaagtctcagctgtgatgacctgagatcactggtgtcctggcaaggatctagaagaaagggtgtctccctagcttgactttttgttctcttcaacctctccaagtctcacgtctgcccatctcagtgaggacagtcctttctgatgctggattcaagtgccgacctctgagggacacaccctcacagactctccggagcattgctgtactaccggcctgggcatcctttatcccatcctagttaaataagataagcataagatcaaccatcacaagacacaagtcaattctaagtctgtgcatcatctgaggtgggcaggcacaaacttggctttcctatgtggttcttctaggttctctggttctttatgctgaagaattcctgctgtgaggagctggctgccagattcctgctgtcagggctcttcagaaagctgggactcggtatgagcttgctccccagagccatgtatgtatgtctggatactctgttggtttacggcctggtgtctttctccaggactacagtgactctttaccttccagaaagaaagccacaccaggaagcctcctattctctctgaataatactttagcctctgtcatatgctgaggatttcctaaagctgctccatgggagaacaaatccaagatttccctagacacagcttagccaccacagtgagcctgggggagtcaggcagtgctgcgtggcacctgtgcaagtcactcagcgcctgctgcttggcaaccatgatgccaggtgaaggtcctccttcattaaacagaaaatcttcaggtaggataaaacagcactgacacagtaaaactgagtggtgaaggaaaaagaatcagggggtggggggagatagatttatgagcaaagtgcttgctgtacaagcacgaagacccaagtttgatccccaagacctgcagggtaaagctgcacatggtggcatgtgcctataattccagagctgggggagcagagacagtggggtccctgacgcttcctgtccaccacacactataggcaaataggtgaaattcgggctcagtgagaaccttatttctaaaaaccaactggaagggagatggctcagcagaaaaatgcacttgttccataagcaataggaccagagtttgagttcccagtactcacaaaatccctagataggtgtggtgagctatctgtaagtaagtgtgagagatgaaggctggagatgaagcctagggcaagaggctgcctgaatcagtcagctctggattcaaatgaaagaccttgccttgacatatagagtggagagggattgagaagatgtccagtgtaaacctctatcttatacacacacacacacacacacacacacacacacacacacacacatcaaagtagagagcaattaaggaagagacctgatatcaacctctaatctcaacatatatgtgtacacatttgcatacttactcacatgcctgcatacatacatgtacacatatacaccacacatacataaacatatacacatatatgagagagacaaccacctgcaattcttctttatataagttttgggcttccttgttctgttcatattattatttttttagtattttatctccttatatttgttattatgtaatatatgtactaatagtatggtcacatgctgttacataaattataaatattgaggatagcttctattattgaattcttgtgcttagcacttttatttcccatgtcagctgatatttaaaaatactctatgatgctaatatagtttttgctgcttggaggttcggggagatttatgctaaactcatatgaaaccccttttcttaggcgctgcagagctgggtgcaaacacttggataactgcgatgcttaagcccagagcctttctcagagctctgtgcacactggcccttctgcagccatcatcagccttcacttatccctcgcacagtctggttgcctaggagagtgaggtcaaggaggctccccaccatgaacctgattgtttttcagtgtgtgactgttggtagccaaggacgacagagctagtggctggaggtagtgggctgagggtccccagatgtctcagaaacaacaggaggcagcatgcagcacctggtgtttaagagacagaggcaggctttaatcttcgttcatctgctgtgtgtgttatcttgagcacatcgctctgctctctgagacttggtgtcctccgtataggaaacaggagttagtaatacccatctcgctctcccttctagggtattgtgataactgggtgactcagccgtgggggaactacttcataattataaagttttacacaacattggttattattatttttttttaatcagggttgatcaagtggggagagactgccatggaaggaataacatgccagaacaggagaaagtgatccctaaagatcacaacttctgcaaagattagtgttctgttactggggcatgggagagggggcgggaacagaatggtaagccaaagaggaggggcaaacactatggaatccaattcttaattgtatgttggattggaccagcaaagagaaacgtggtcaggacttgagcgagtatggaagcacagaatgcacattcatttataccttcagtgaattgttttaaaatgcctactgtgtgcattgcagccatactactggaagaaagtacttagacacttttctatatggagtaatttagctctttatttagctactttgtatttagataactattcagaaaatgaagataaatcatgtgtttgttttctgacttcagaattcctctgcatttttgtttcttaccgctgtgtgctgtgtggagaggcccgaaaggaggactcaggatgcaggatgctttcactgactgacagctggcttgttctctgcctcttgaccttatacaaagcacttctcttccctagactccaatttcccatctggatagtgctacaaacaagacaacatatcccatttggcaagtgatgcacagatgttcattgtgtgctgttgtaagacctggtggcttgtgttggtttgaggcaatcccctgtccataggtattagttagttttcttgtcgctgagactcagcaccttatgaaaatcacctcaatggaagaatggctcattttggcttgtagttcaaggggatacagtgtgtcacggtgaacaag

SEQ ID NO: 597 - DNA, 2550 bp, Mus musculus
aatagaggatagagagggtcaacgccaaaatggcggcagctgggcagagtgttgctttgtctttgagcaggaacttccttccactctaggatagtcttttggcccagggaagacctctccgtaacgctggtagactggctggcagagttccacgtcctgtgttttaccttatgacgtcctgtgttttaccttatgataaagtctatctgggcttcacttcttattctgtgaggcagagaacatggatatcttcatatctgcctcacgttgctgatgtgggggttcagtggggttcccctcaggggcacatgggctgacactggaaggttcagtgggtaagcccactggaaatggttgtaccgagcccagaactcaactgacaccctgctcaccagggtctaaggaaagaggttttacatagaatgtaacttttctcagatttgtagactctctagtatctaatattccttatatttttcacataatttagacttttccacttaaaaagttggaataactattgcaaggggtatttagctcagtgggaaagagtgaccctgagcccaatttccttcactgaaaaagaaaactttatattaagtgaaaccactcaaagcatataaactttttctactttttttttaatgagataggataaaaagtcgaggttagacttgaactcatgatctttctgtcttggcctcctgagagctgggattacaggcatgtgccaccatgcctagagctaggaatacaggcatgcaccaccatgcctggtgggcaaaaaattctttaattgcaataaaaggtactaaggttgcaaaaagaaaaaaattttatgagcactgtctgagataccttttggaaaccctagaccccttcaaagagatcaagtaaattaacctacaaagatagattcactcttattaagcagccgcagcataggggctcactccattcacagaggtttcccagggaggggctcactccattcccagcctttcccagggagccgcttcctgcagagccactgaggtatcgggagaaaacgtggctgaagcactcaggggaggatttccacaggcactgagttaatccagacaatttgaaaaggatcagcctcatgctgtcttgaaactgccccggtagcctggggaggaacccaagtgggaagaaaggcagctggcttgaggtgcagacccagagccttgtgtggagtggctggcccctgcttgatgagaatgatgggccctccctctggactacacacactcatgggcacacgcacatacacatcccacaccgccacaaggagcatggctccctccgaacacatcagctctggtcgccatagcaacgcagtagccaacttcccagctgaacaacttttaccagacacaagcacattttcctgccctgcccttcttcactgggtgctgagagggaccagagtgtgggctgtactgaaaggcctctaaaggggtcagtgaccccagggaaggaaggctgccccacttgtgtgggttgctctaccaggaagggccctctccagatggcaggactgggtgcataggtcttgtctttctggagtacagtgagggaggcctgggctgaacagaaaatactggggttcttacttctcggagaaagaaaccaggctacagatatcgctcagagggaaatgtgcttgctgcataaatatgaggattaaaacttggatcccagcacctacaatgagtcctgggcaggaggggtgccagtctgtaatgccagtgctgaggaagatgaggaatcctcagaacaagcagtgggccagcctcgctgactcagtgagctctgggttcaagtgagagaccctgccttaatatataatcaggtggaggacaatctaagtcacccaacatcaggcctctacccaagactgcaggtatgtctatgcaccacaggtatgatgctggtaggatctcccggagctgaagttacagacagttgtgagctgccatgtgggggctgggaatcaaacctggataagcactgagccatctctccagctccgtcccatccgtttcttctctgaccctgctaacgattctgcaattgctatcctacagatggatggtatcaccacctggtgtaggtgctgaggatctgcaagcacagcaggggctcttaaccaccaccccatctctccagtttccctggtttcttttgatacaaaatttcttaaacacagagctcccagataaggtcactcttgcttgggcatctacccctgcctccaccatccaaggctggaattacaagtgggccacaggtccacccagcaattctgtgggtgctggcatctgaattctgaactctctttcccttgtgtgtagaataagcactgtagccatgtgtccatctcctgaccatgtggtcatctctctaccatgtgaccatctccctcccatgtgcctactgctgctggtgtgacctctccctcctgtgtgcccacggctgcccagtgtgaccatctccctcccgtgtgtccacggctgccaggtgtga

SEQ ID NO: 598 - DNA, 1775 bp, Mus musculus
gattgtgatctacctctgcttgctggccctaccgccttctcattgctatcctgacgtggacgggtccagagtccacttgccttcaaccacgttccatgtgagcttccctttcctctgtggtctcatggctgcatgcagcagccagcactgaatcttcacccatactgggtcctctgcttggaatgcttttcccttgtgagctctgacttcactcctgaatggcaacttcctgaaggtcttgcttccacagatgaactctcaggaggtcctaaacacaattttagttctgattcatgcttattcctgccatgaacagtgagtaagggtgacatctgggttggatgaccactaggtccttgtttcagacagtacctggccaccgcagttgctaaatcaatgtccaccccatgagtgatcccatgtgagtaatccagtcctacgatgcttggggtcaggtcaatgtgctcaccagaaagatgatggtgcttaacaggagcaggggtgggggtgggatgcagacataagcaccgcagcaagggggacttttgatcacttcatctagatccctgatttattcatgggggaagaattttgtatttgtctcttcataggaaaaccaaattcaaagccatttgattgatttccagaccacggtttgagcagcatactgctctaggtttacaccccggtgttgacatttgccagtcttcctgagtctttgtctcctgctgtgttatcagaaatgggactgaaagggtcaaggaggcgctaacaagcgacttgctttcaaggttgctggagatgctgggaagatgtgctgagcatacttagtacaggccctcagaggggcaggggctcctcagggacatgaaagctggagagaaaagctgggcatggggggagggtggggaagcactagatggaagctgggaagctgcctgattcatcctgacttgaggtcagaagtgagaaggctgttcagcctcgtgctctgcttttgggctcctagcctcttggctcctccttaagcaagccaggtgaagatctcgataatttcatcgcagagccccagattgcttctcgggtcttgtgttgacatttgtaggaatggcaaggcagaagattttaaaaatagggttatttcacacacacacacacacacacaaactgtacaattgagctttcaggagaatgattcatgggcatgcatttacagctgaagttgtagatctgtttttagaaattattatcaggcattaaacaaaaacaggccttattaataattcaccaggaaaaagatatggtgcaagatcctacaataataatcgttaatgctggaataagtattctgcttttttttttttaattccttcaccctaactctacgatctgtaacctgaaataaaacagaactaagaagggatatttatcatctgagcaggggttgagtccatttctagggtccccccaaattcaggacagattcttggtgtgagcatttagacgcagaatagaaccgtttgaaggtgaaaagcaaagattaagctgccaaggaaaaatcagcctctgcctttcaggcctcatcttagctccagcatcatggctccagacatcttagctccaacatcatggctccagacatcttagctccaacatcatggctccagacatcttagctccagcatcacggctccagaaacccatggatgcatctgaccccattggcaccgtgcccacacctggtaggcaacaccatggatgttgctatagacagt

SEQ ID NO: 599 - DNA, 1900 bp, Mus musculus
ccctgatgattctcagtattcattattcttcagcttaaatgttcttcagcttaataaccagagagagcctgaacccactcttatttaccagagctacatgatcaaggctttaatcgttgttaataattatcaaaaaattcttagattaggtttacataaactctatgagtcctggatcaatagtcccaacctctgtttcctcagagcagaactaaatacaaagcaagagcacatttccttataggttttcacagcctgttcttcatgggtagctgggcacagctcccacggtttcctagtacagcagacagcagtgttcagtaactattttcagagcagaaaaatgatagactactaaagttaaaatgattccttacaaagttttgaatttatgtaagtaaaatggtaaaacagctctctctaatatctttccaggcattactatccccaattcttcactcagctagaaaaacagagtactgactttttatatgcttctacatcatctgttaattctctaatcttcatttccttatcctagcaattccatagcctcatgcactcttcctctgatactatttactcctacatcttatataatttcctactttttctatccataccttttcttcttgacaccactttaactctctattcttgatgtccccaagttcaccctggctacttagtgcagcagtcattggaccggaggatatatgtatctcctcatgtttccacattcaaggccaagtctggcaatgaactatttctacaaaggaccatccatgtaggtttttatggcccttgtggttatgttgtctagatcctttcccatagccctaaaggccaagtagagggcctgttcttcatcctccacagcctcatgaccatctctattcctcattcctaaaaagtgcatctgtttcaattactatggtgtgattagctctgagtaatgggaggaaagtagattcccctgaaagaaatattgaaagtagagtagtaagacagctgatcaacttcggggcaacagcaaccatcagtgtgggagatcatgggatcaacagcctggcaatgctccagggcaagagctgtgtcacactttcccttatgcagccatgccggactagcaggtacagccttgaactcattggcacagaacactgttagcacaagcactaagatcaacacttaataaatggagactcttgaaactgagaagcttctacaaggcaaaagacaccaccattcaaagcaacagcctatagaccaggaaaagatttatcaactccatatttgatacatagtatccaaatcatataaataactcatgaaactaggtatcaagaaacaaaaagtcaatttaaaaatgggaacagatctaaactgataattctcaacagaggacactcaaatggctaagaaactcttaaagaaattttcaacatccttagtcatcagggaaatgaaattaaaactttgcaataccaaggggcctctctttccagtgatggccgactaggccatcttctgctacatatgcagctagagacaagagctctaggggtactggttagttcatattgttgttccacctatagcatttgaaatgtaaataaagaatatatctaataaaaagaatcaaaaaaagaaaattaaaactactttaagattcatgttacatatgtcaaaatggctaaaatcaacaaaacaagtgacagaaaaaggggtgaggatgtctatctagtaagtggaacattactatattggtggcgtgagtgcaaactcatacatccattatggaaataagtgtggcagttcctcaataagatagcaattcaactacctcaagagctagctacactactcttgggcaaatacccaatgaatgcttcatgat

SEQ ID NO: 600 - DNA, 2175 bp, Mus musculus
aggtgatagttacactagctcctagtcttgttgctttgccaaaatactcaacaaaagcaatcgaaggaaaaattcattttgcctcacagtttttgagtatatgctaccagaaagtgggggaaatgggcagtgctcagctggctttctacttttctgccaatccaggccccagtatatggggtgctcctcacagtggacagacttcccacatttagtaacataatctagataatcactcacaggcatgggcagagacttgttccctagaggatcctggagtctatcactttgacaactcttacataggctataacaagggtcaagacatctggagacaggatattcagtcattgtttcaaggaaacaaaacacggtaaggtctaatgtaatcatagtctgtcagaaaccatccaggagaggctaagggctactggatgactttcctaaaaggtgacccaccattttttatatggtctgtgatgggtgagatcaatggcaaggtaccaaagagagttcatctcaggattgcttctcacatctgatatgcctttcttgtccttattaaatgataatccctgggcatcagcccaccctattgatcagatgtcctgtagattaacataaagatgaacattcatgaattaatgctgtttcgatgggttaatgattccatagaattcctgttttgattcagataattttaggaagaaagtcttaagagatggtcttagtcactttgctagaaagatgtagtaaagtgagaatcaagactagaatgtgcccgctcctcacaatagtaaataaaggcggcataataagaaatacaaggagctttcataatcacactaaaaagagaactaggctggggacaaatttgcgtctaagcaaaaacatctaggtccaagggtaaagccacaggtgtgcactatgatgaagcaaggccacataaaaacggttgctttaaacttaaaatgagcacatcagaacaaaacactgatttgaatcaacatcccctttaggtaggttgctttaaacttaaaatgagcacatcagaacaaaacactgatttgaatcaacatcccctttaggtaatacgtaaaccccttacgtaactccccctttacgtaaaatcctatctgtgagataactcttttttatttagagaacattttgcattaaggatatataaggctgaaagcaataaagaaaggcgatgtagctatattctgcttcattcggtgtgtgtgtgtgtgtgtgtgtgtgtgtgtgtgtgtgtgtgtgtgtgtgtgtatgtgttttgtgtgagtgactcctttcttttctggtttacaaagagttaaccagctaaatcactaaggggctcttagctgcctggctagaaaagagagtgctagcagtaaattttccacttaatcccctgctgctaggcaacagatgttaatcgcccaagccagtggtttctaaccttagaataagcaagaaaaaaaattaggacttttaaagaagccatcagcttcagcatacagcatagatagagagttttaaggccggagatcatcagtcttctgcctacatccaactctgtgtcctggttcaaaccattccagggtgggcaggctacctgccctgatctaaggtgcttattttagtccaaagtcctatatctttgatatattctctgggaaggcataagaagggagatctttgtgaactagtctggtctacagattaagttctaggctagccagatctttctcaatatttctttggttttctggagtcttttgttctagttctgtgaagaacattatgaccattttgatgggagattgcactgattatgtaaattgattttggtcagatggtcaattgtacaatgttaatgctacctatccatcatcatggaaagtgacttccatattaaagtgacttcctcaaactcttttctttagagatttaaagttttcactgtaaagtccttttgcctcctcattaggtttattaccagatatatatatttaaggctattctgaattggagtggttctatgatgtctttctcaacatgcttggtttgggtatatataaaggctactgactttcataagttgatttgtaacctgccacatggctgaatgggttgattatttctagaagtcttctaggcgattctaga

SEQ ID NO: 601 - DNA, 2025 bp, Mus musculus
tgaatggtataaattattggctcaagcagcagctccactggctctctaatcagtagcccagactatagaaatgtgcccttgtcttcaatggtctccgagttctggtgatgtctgctctgggcattctcctacagagcctcctgatgcttgcttgcttgcattttaacacccattcctcaagcaggacagaccagaaggcctctgctctgtgaatggtccactcccccgactggaaatgacagggctttttttctctgctgaaccctgtttctgtgatctccttcaggatgttgctacacttgagaactgccagctccacagtcccagcccagagaaaccctcagaggtatctgagtgtttatgaaattggagcttctgctgttgcagattccagccaggtttagagcgttaaggaatctgtgagttagtgagggtacaattgaagactgaatgcaaagaatggaccataggggaaagtactcaatgttatgattacaccatttaaacagtctttacatctctgtgtcttgaggcatatgtataatcttaggtctctgtatgatcatggcacctagacctttccacgatataaaaagggacacagtctcagaaccaaaagccaaataagaaacagcaggaaaaaaaaaagaggggtttgaaaagatgtctcagtactttaatggcccaagctggttttttttttccctcagagaaccagagttcagtttccagcacccagagtggggtgctcactaacacctgcaactccagctatggggaatctgacacaatcctctgcctttctcaggcatgactggggaagctgaatgaatgaatgaatgaatgaatgaatgatagctcaggattagtgaccagcaactcctcttgttgcaagccggcttgatacctgtgacactttgccgaatgccacctgaagtgctctcacgagcatcttgtgtgataccacctctggcacaaaattctttaatatctacatcactgtctcctttcttccccgtcccctgctgcatttatctgcacacaccagcacagtgtgttcatctgcacatgccaccatggtgtgttcacctgcacacaccaccacagtgtgttcacctgcacacggcaccatcgtgcatgcagtgctgtgtccttcattctgctcatgctttacttactgtgcacgcagtgcaccaccagcttctgtgtgcagccacgtagttcatattccaggttctcccagagcctgtgggctcctccagcgcttttcttcgcctaatctttgttccgcacccttaattacatctctcctgcttgcgcaaatgacagtgtattaagaatataaaggcaaacatggtagccctggaaactaggtttacttaggacattccttttcctttaagttgctgggtttcttttcatttatgtgcaaataatgtaatgaaaacccttttcagctgtgatgagacatgaagaaaattcgagagccttatctggaaatgattgcctttcaacctgcacatagagaattttttcaacatcctgtcctggggtgatgggctctctggactctgcccctccaagaggatatgaagacagtgaaaatttcctgcagataaagccaatgcagctcgacactactgcaagcaaccccatttgaattcactgggtccctccaatacaaaccaacatgtaatacatgatggactagtgatgagaaagggcattggccttagtgggaataaagagagggtaattggaaccaggtgtgctggtgcatgtctttaagtgcacgtcccagcacttgggaggcagagaccagtgggtctctatgtgttcaagggcagcctggtctacagagtgagtaccaggacagccagggctgttaggtagagaccctatctcggaaaaacaaacatacaaaactaaagaaagaaaaagaaaaaaagatggtaattgggatctatacatgatcaattaattgtaatttatatgatcaaaatacattatatatttctataaaat

SEQ ID NO: 602 - DNA, 2350 bp, Mus musculus
ctttgcctgctgcaaacatctcctatgaatggtctcatggagtctgtggatctttgcatgtagcttcttttgctctgtgtgcctccaaagggtttaccctgtttcttacttgagtgcttcatccctttttagtgccagctattattgcttgtatgttcaccccacactttcttcatcctttcatcagttgactgacatttagctcatctcactttctgtgtatatttgtgtgtgtgggggggagacagggagggagagggggagggaaggggaaggggagggagaatatgcatgtatctgtgttgtgtatgtatgtgcatgttaatttgcatatgtgtgtaggagtgtcttcaaaattgttttaattttatattttagatgttttcctgcatatatgtctatgtaccacatgtattcatgtattcatggtacccaagaaggtcagaagagggagttggatctcctggaaccagagttatagatatccaactgtgagccaccatgtggatgctgccaatctaacccaggtcctctggaagagcgggggatgccttaaatcatggagcatttttctagccccttcctgtctttttgacagggtcttagtgcacagactcaagctgcccaatgagcccagaatgactcgcctcacccccactcccaccccagagttaatcagcacgcctgtcctaaggttattgtttctttttcttttggagctagggtttcttgtagagcaggcttgctttgaatttgctgcgtagtagagaatgaccttgaactcctctggatcttcttgcctgcatctgcttaatgcagtgccagggataaagcccagaactccatgaagactccctgcacactccacccgaggaggtacttccccagcccccctcccccatttttgaagatttatctttattttaaattatgtgtactggtgtgtgtccctgtcggggtgtgctcaggtgtacaggtatagaaagcagagcactagggtcccctggagctggggccactgatcagcccatatccttttcttgtttttacatcatcactagctagtcagaaccacattaagaatatagcgtggtattttgcctatttttaaactttatacgaatgtgtcacattatacgtattcttctgcaatttgccttctattttggtcgatattatgtgtgtgacatttctttcttgagtggtgcagctgggatatagcatcttgtttcagtgaacgctcatttctttgtccacttctcttatttatggctccccactctaggggccttctgtgaccccagatcaggcatctacagaagaaggtagggaaggtagggggagtccttagcctcagagccttctgatgggtgtggcagaaaagagaaagaaagaggatgagtagagaaagcccaataaggtagccaacttacttttaagaaaggtcaggctggctgaggagttctggagccaaaatagctggtttagacttgcatcctagctggatggatgaatgagtccagcgctggaagtgatgatgggtgaaggagtgagcatattgtagccctacaaggggattctagcttcttgaagtggcctagcttctccctagcagctggcttctgccctcccagcttcactgtgttcatgaagaccttcctgctcagtaggagatctggctggtcaatccagagtacactaggaggacagcagcatcaatgtgaggaaacaacccaccccaaaccagattcaaatctaaacctggaattctgatcctgaattaactctctctctctctctctctctctctctctctctctctctctgtgtgtgtgtgtgtgtgtgtgtgtgtgtgtgtgtgtctgggtggtgtgtgtatgtgtgtgattgtgcccatacaaggtatgtccctggaacactcaaagatcagaaggcggcactggatcccctagaactgaagttgtgaatggctttgagcagctatggaggtggtcccctggaagagcagctagtgctcttaatcactaagctgtctctctagccccaataatttattgtctttatttcaacttctcaaatgtctctatacaaccacatctgtgggtgcatgggaaggaggaggtattaaaaggaaaaggtcacaaagaaactggtattgagaacttccttccttcctctctactccctccctccctccctccctccctccctccctccctccctccctccctccttccttccttccttcctttgaggcagggtttctctatgtagccagccctgaacttactctgtagagcaggtctgccttgaactcaaagatctgcctacccctgagtgctgagataaa

SEQ ID NO: 603 - DNA, 1700 bp, Mus musculus
tctaaggtttttcttggaaaaaaaaacacttaagaacaaaggtcccgggaaaatttatcaatttaagggatttatatgtgtatctgtttactattggttaactagtcaggagctgagtttttaaaaagagcacatctgaccttcctccactagagggaactcaaaatcacatatactttgcaaggaagcacagtatcactaagatctatgtgtgtctgtatgtgtgtgtgtgtatgtatgtatgtgtgtgtgtgaatatatatatatatatatatatatatatattgaggtgattggtgaagaccctcttgttgccaactaggttcttatcttgccctttccaagaatgaggtgggcaggcagccaagtgtgtacacaggagaggtactttattatcacaggattaacagccttaaatgagattaaccaattttaaactggaaaaactggtctttgtgggactggagggaggctggaggggtggggaggggaatctctagaaagtaccagtgacctgggaggtgagagggaactcatagagcccacctccagtagaaagacagggcatcaagtggagggatggggttgccaccccacagtcaaaaactctaacccagaattgttcctgtctaaaagaactgcagggacaaaaatggaaaagagactgaaggaaaggcagtccagtgactggttcaaagtgggatccatctcaagaggaggcttcaagccctgacagtattactgatgctatggtgtgcttagagacaggagcctagcatgattgtcctctgagaggccctacagaggcagatacttacactgaactgaactgaactgaagtcaggaatccctgtggttgaattaggaaaaggctggaagaagctgaggaggagggtgaccccataggaagactagcagtctcaactaacctggaccccagagatctctcagacactgagccaccaaccaggcagcacacaccagctgatatgaggcccctgacacacatacagcagaggactgcttggtctggcctcagtgggagaagatgcaactaaccccagggagtggggaagcctgtgtgtgtgggggggcatcctcttggagattgaggaaggaagaatggaatgaggaactgtgggagggtggataagaagggggtaatgactagactgtaagaaaataaaagtcattaaaaagaacaatatatgtgaactcttggtagctttgggatactagccagaagtgttacagctatgaaaagtgttatgactattgtaggtctttggagctgtaggtccaaatactttcagttcacgattgggtgggtctctggatgcagatcctgaaggtacagaggtcttactgtatttagctggttagaaccaagaaaaaagcatctggagacagatcaaaaggcttacaacaaactgagaagcatttattcaatacaatctacagaatctgtgaaagaacaatgaggagcctccacaatggagagccaatgtacagggggtcggggtacttacttccccagtgtttagcaaaaagaactgttttagggggttcagcagctggatttcagatctgctccttaaggtaaaagtacctttcagggtagaataggcaaccaccttctccagatatcatactgaggaaggcctaaagggaacaggtgaaaaagccaatggagcagctgg

SEQ ID NO: 604 - DNA, 1925 bp, Mus musculus
tggaagttgtgttttaatgtacaaattttggaaagacacaaacatagaatagcaggtatttagtaacaaaattcagactaaagaactgccatgcacactgagaaatgccacgcactccggtcaagttggcttgacaagctgaaaagtctgtaagcactcatgaggaaaagagtttcaaggaaactcacctcctggagctttagtgttctcatttacccatatactcatactctattcccatgttagtctggtgtatggaactacgagatctcttttagtattattttattataagtgctttttaagattaaattctgatatagttaagtctccccagtgttccaaggtcccagaagcctacaagcttagtatctggcaggaatgcagtaaagaagttacctattcagtaactaattaagcattacaaaagacggagccagtagctctgaactggtctgcaaagtatttactaaggacagtagcaaatcatacccaaacaagggactactatgaaagagccagggaatcccactgatatagaaatcttcagtacaggctacattgcatattagaagcaagttggtaaattcttctgacaaatggagattctccagttacttaaaagttacactcatataagaatttagcaaggcctaggaaatagggaggttgtgatattgcattattcatgaggcctgccaagagcagaaccccctggtcctagccttcacaaggtataactagagtgtgaaatctttacctgtcactaagttgaccctaggtaggactgctttatctttactgtaaatatttacctggttcttgtaaatccttttgaagtaattcctttgttttgtgtcaggcaacttcaatgtactttgcctgctgtgacttctgaccccttgttttttctgtactatataagactggtgttcactttgtgacatacattcagattctacacaatctgttggtctgtctgtcacctgccgacgcattgcccacctgccccagagacctgttccacacagactaagggacccagagggtctgcagcaaagaacagttctactgcagtctgctgaatttcatagtttcttttgcacaaatgtccagttatagatacaaatataccagctttctgctgaaaaccccaacactttctactggaattatatttttgttaataagttacatttgaaatcaaaatttctgagaataaacatggtagtgtgaaacaagctaactataatcatttttatgccaattatttcagttagcctatgattcaatttttattagctgatttaatggaaaatgtcctaaaaaaagcaactgttgccacttatttttattaccctatagcaagtactgagaacattagagacataatgagtgatttttaaatgtactctccaattgtgtatctacctacacagaatcttgaagaacagctctgcattcatctgctgtataatttgagcttcatctaaagctgtagtttgaagaaaagattattataataaaaaaaactacttgcaaacaactacatcatcttattttactatttataattgtcttataaaaactttgcttactttacgcatgaataaattaactatgatcatgaatagaaaatgatgaaatttgaactcaggtctgtctatactaacacatgtatttgtcttgccacattttccaatttgatggaatgtacgtcacagaattttataacagtttctttagttgaaaaaagatagaaggaagatggttgtactctctagtattaaaacagaaacattttgctttgaaaccttatcatatttttcaaacctgatttagcaggagacacaaatatagggattattattctatattttcactggttaccatccacttgtttctccatgtaatacaatggtcct

SEQ ID NO: 605 - DNA, 1850 bp, Mus musculus
tgttcctctgctaaggctgcagccccaaatccacagttgtctgtagcccaaatcacgagttgacagactcaccatctgcttattcaacaggcttgtgagaatctggcaggcttccttctaatcagggggaaacctgctgtaatgacagagaaacaagcacagcaggctgagcataagagcctccaggctcctttgggccttgtgctgtagagggcaggggttgtgactgaggaaggcacctgggcattgagcagaggtctggccttgcagtgagactgttgagcagcctgtgtctgttgaccctgagagggagtaagagcttgcacagcaagaggaagacagagtgagagaatgcagtcaccatctgggaacaaagtgtgcaggacaggaccctagtgacagtccaggagatcagtgctcacagcagccattctcttgtccaccacactgtctgctacaagtcaggcttttctctcctcccccaaagccaaacccaagcacttgcaggggccctgattacttgccttggcctctctgtttatgggccaccattgttctcacaatgattttactatttcccctgttcctactcttccttccctctttggcgtggccacttcccaagctgtaaagtattttgggaccacactaggcttccatttgactcatttcctaccactgggtgtgtgtgagtgctgctgatgtttgtccttccagttcctgcatctcttacctttcactttaagctcaggggagcttagaatgtctagttgcagtaggtggtctccaagtctcctacactagaaaacacagctgtaaatcaaatacccctagaggcaccatgaggtcatgagatctgtgtgctctcaggggtgggtgtggggggtgagtgagagtgtgggaggagggtctttgtatgcaatctctgtctctgtctctctgcctctctctctttctctgtgtgtttgtttctccctccccttctcagtctccctctctgactcagtttctctgtctggctctggctcttttctgctctgtccctgcctgcctctcttggtctgccttctcacaggctcctaggcacaagcagatggtgtccttgtaaaggaatgccctgacttactcaatcccagccctgaggctgacattacaggaagagctgactttaggcaactgggactaagggcagagttaagcctttccacagtgtttttgtaggagtctcccaagaaaaacaggacctagagagactgaatcatcatcagagcctgctttgctccactctttaaacttctgaggatttgaggatcacacaacttgcctgaaagtttcatcaattataggccccaggtcactacttcccttaacccccaaatagaaaatatgttaaatttgtttctgtcttactctatcatcctccttccaggtctcacgtttccctaagcttgtgaagcaaggatccaggttaaagcttgggtgtcttatagaacataaaagccaaggaaaactgagtgtaacaagtacagtagagactggattcgtggcttttcctttaagaacaagtaacctctgaggacaactgctgcttttcaggaggaaaagggttaattcccagaacccgggtggtatctgtcaaccctttccaacttcaatgccctcttcagacaatagggacctgttggaatgtgttgaagccatgcaggcaaaaatacttgctcacttaaaaccacaaagaatagaaaggcgtgaggataagactctgtatcaaagggcagaaagatgtttctaattataaaaacataatttttatattgtagaaacctagattagcaggtaaaagcacccac

SEQ ID NO: 606 - DNA, 1850 bp, Mus musculus
gaaccgaagaaacctctcggctccagtactgcagccccacagagacccattgcaacacagaggactactgcagctcctaaggctggccctgggatggtgcgaaagaatcctgatgtgggcaatggagatgtcgaagcagctgaattgatgcagcaggtcaaagtattgaagcttactgttgaagacttggagaaggagagagacttctacttgggaaagctaaggaacattgaactgatttgccaggacaatgaggggggaaatgaccctgtactgcagaggattgtagatattctttatgccacagacgaaggctttgtgatacctgattaaagggtcccaccggaagaacaggaagagtattaagcagcttgggccagcagagcaacatccgaagtattcgctccaaatcatgtgcttaactgttaaatattcccttttattactcttagaggattcgctggcttcttttcataagcaaaaagtacctcttcttcaaagtgcactttgcagaagtctcaccttttccgatgagtttgagttaggagcttttgccttgtagcagagcagtattaacatctagttggtttaccaggggaacaagaggccaaccatggggctcttcatgtggatgctggtcacactgactgatggagaaggggggttatagttacaagaggtgacaacctcagaagtgtaaagactgaactgaattctaagctaatgtgaaattctggcagagaatgttttaataaataaatgccttaagagtatttaaaatatgcttccatatttcaaaacatacagtgtaacatgacaggagattttttgtgtctgacattgtgtctgggaaggaagggcggactttaggccctttggaacctgctgtgtaggcctttcaaggctgcttgaatcttatagatgtcgactttggcccagaagtaaagtttgaaacgttctgtaaagccattttgtgtcattgaccagttgcacccctgctctaaaagcaagcagcatggttgcttgggtgaataaagggcttcttggccccacagtgcctgaggcgaagagctcggcttcccatcaagcagtcctctgatcttttcaaactgtccccggagttcctttgtattgtgtttctgggacctgcccacgcctctgggatttgaatgggcgtggagtcccagcacaccgtcttttaagtttacagttacatgttctctctctgctccctgtgacctctggaactcctctggcttcttaagtctgctgctgagcattgtaattacagcaggcaggtgaccgagctgcaagttcttgctggacctctggcaaaggagtgatcagtgaaggccagtgtcacctgggctctgtgaggctagggtgctcgctgtctgctggtcactgctccccattgccacctgagtactttgccagtgcactaatctctttggagataaaattctctagtgtgttactaaatgttattttttaagaatatacagtaccatgactgaaatattacttcactccttatttctccctcatttgctttacccacagcctattcagttcctttgttcggtgaattctgcaaaatgtgttacccactaccgagattgttcagcccctgatgtgtttgtactgatttgtttctggtggtagcttgtcttacgctgtgtgtagaaaacaggtatcttataacagattgttatgtagtgcatgctctgtggcattcagagaaaacaagattcagtgattaacaatgcaaaaaaaaaaagccgggcgtggtggcgcacgcctttaatcccagcactcgggaggcagaggcaggcggatttctgagttcg

SEQ ID NO: 607 - DNA, 2075 bp, Mus musculus
ataatgagttcgaagcctgccagttactcagtaagagcctgtgtcagaaaaagtacctttaaatgtagcttaattggtataatgcttgcttagcatgcacgaaaccctatgctagaactgatagcactgcttatagtcaggtatggtactaactgcctttaattccagctcttgggaggtggagacaggagaatcggaaattcaaagacatcctctactacataccaagttgtaggccagcccaggctatataagctcctgtctcaaataaataaaatgtaaggggtggaggcttggaagaggaggctggccttgcatttgcagttcttctgtctcagcttcccaagaagtagctgacattagaggcatgtactactaggcttgagacagtttcttgaagtgtaatttgggtggttctctgtcttgactgataggatacattatataaccatttctctactgcatccatcccttaccataatgcatctgattttaagaatatgcatgttcagttatgcataggcataaggtggtaaacagtgaactcctccctaaatttccatttgaggacacagttggcctttttttcttaattttatgttatgtatgtacacttaaatgtatgtatgtgtgtgacatttatataaaggtacccaaggaagctagaagagggcatcaggtacaattggaattggagttacaaacaattgtgagccctctgatgtgtgcactgagaactgaagcccagttctctgcaggaacaataactgactttaaccactgagttttccttaatgtccatgtaacgacaaaccagtctaagacaagatttgcttcagttccctagttctaggttgtgttctgggccattactagggggttgctagggcatgtaagttatttccattgtttaaaacaggtaagggtttcagatggccaggtgcattattccaagaggggtgtgtgtataacccaaaccaaactgggccccaggttgctatagtattccttgtgcttgcctgtctctttagtctatcataagctcctccaagaactacgatttatctttggcatctttgcagctatctatctttgcagccctcatttctctggactgtttctaacctcctctgaaactgcaaagcagactcagcggccttccccacccccatgtgtacccagaactgctgagtaaattaaactgtgaatctgagagagtggagccatttcccctttcacagcagacaagctcatcaaggtcgatagggctggaaggaggggggagaaatcaggacaaacatcattaagcatccaggctgcagcttaccactaaagcaaagaaaagcttcccaattagaaagtcccttgcaaatcttctttctatttctgacatgtaattattacaacataaactgggcagagtggattgaggctttgttaactgtaatatttccagcaaattatttagaaaaacagggaaaccttgggcattctgctctactataatgtactaaaaacagctataaagatcaacataccaacctcaattggtatttaccactttgtgactgcatgggaactgatctgcagatggaatcttccaccccaaaagttctcttttccaccctataaaacacccaatccctctgcaccacatgcagtctccactcctgtggagagactgcagtctatgcttgtgtgtatttgtactcatactgtgtgaggcaacacacataggcatacaagtataaagggacacatgcacatacttaaattaatgcacacaggcatggctgcacatacatggatgcaaatacatataagtatgcttcacatacacatatgtattcagacagcatcagagcaaacacatacaaacatatgtttgtacacaataatggatgtacacacatacagatatacataaggttgggagtgcacacataaattatgtacacattcatatgaatacacacaaacatgggtgcacatacatatgaatgtacataagcctgcacccagagacaaatatctctgtttatctcccatttcaatgtgtctagtcttctgactag

SEQ ID NO: 608 - DNA, 2250 bp, Mus musculus
ccccctctactgcaagcacacatccctccctgccactcttttctggttcccaccctgatgaaggtcatggaaatctgtcttctcaccagcccccattgaaataagtcagtgcactatcttagtgtggtatatgacaccaagcaactttatgggtttaaaaaaatgaatttagatcagtatagtattaaagatcatgttataattttcattttaatctattctttaataatattcataatatataaggacaaggtttgactttcttccatttaacaagtgatgcatgctgcttaatttatttcaaattaagtatgcacgaaagagtatggcttatctacaaattcaaaatgacattttaattttgtgtttggggaccaaatgtgtattaatatgtagattgaaatttaactatgtgttggagccctccaaactgcttccatgacctgatatttggaattcttgaatttctctctttaaaaaaaatcaattactttattattataattttcatgttttgtttctaaaaaaggagacgtgagcagtttctggctgctatttgcaagtactctccagaaataacacactgtggggttggatcattttatttccaataaaggaaaagccaaattgaataaaaatttcccctgttaacatgtgttttgaagaactagagctctcgtgatgtactcagaggtgcttataagtctgaggtcaaaattcaaaactctcagctttgtgtctattgctcgttccgtctctttatttcccatcagaaccattttaagggaacaaatcagtaattcattctgttataagttggtatcattgatgccacctctctctcccaagttacccacttgagaataagtcagtcacctgaataataatagaaagctacaaaaggggcaagaccaccaccacaggcacaagagccccgtgagccagcgaccaagtggcagaggaactggccagcaaataccttatcagcatctggcagtgtttatgtttgtactggttacttttctcatcactgtgacaaagctcttgactaaagtaaattaagggccagtttatttgggttcatacttcgagagtaccatccatcacggtgggggagtcagggcagcaggagtctaggctgctggcagccttccatccacagtcagcaaatggaaagagataactgtgcctgctcaggtcgccctcttcttctcctgacctcagtcctcggtgtagtactccccacactagggtgggtcttcttacctcaagtaaccaaatctagaaacgtcctcaaggacatggccaggcgttgatctcctagatgattccatcaggttaacagtccattgtaatcatcacaacatttggaattaaatgatattctacaattattttttaaaccttaataaacccctggatattctttataccccaaactgaagttgaacattttgaactcacaccctggctcccagccctatgaccttcagcaacttcttatttcccttttcctttactgcttctgcatatgaatgaggaattaaatttttttacccagtgagcttagccagtccacagtgtgggcacaccaccatcagtgcaaagcgggaagaatgtcccttggactttgattattttcagtgcagtgtattagcaagccggcagatgggtgaaagcacgtgaggatagaagtgataatgatctccatgtgaacagatgcagctcatcaaagcagccctaagagaatgagggcttcacctggcagatgaacaaaagcctcattttcataacataattaggctgaggcaggtagagtaaagatttgcaagtgtggtccccagacctgcattactgacttaagtatttccggaaatatgaattatttttttaaagatctattatttattttatgtatatgagtgctctgtctgcatgtatacctgcatgccagaagaaatcatcagatcccattatagatggttgtgagccaccatggggatgctggaaactgaactcaggagctctggaagagtaggcagtactcttaaccgctgagccatgttgccaccatcccctcccggaaatataaattcctgaacctcagctcaggcctgaggaatcagaaactttgaaactggggtacagcaatttgcattttaagaagcctggctgagattcataaaaatccatggcatttccagggtattagaatctaattgatcagattgattagaatctaattgatcc

SEQ ID NO: 609 - DNA, 1875 bp, Mus musculus
gtgttctctacacatttgattcaatctattctacttttcaaaaaatggccactatcgtcctcatctcttcacagcttaacccagtgtgatgtaataaagaacacagtataaaaaggtatgttttgtgagagttgttcccaatctagtgtacgacgaaatatttccactaggtcagcaacacttcaattttcaaggagatatcatgaagggagtttcactaagtatgattttttttttcctctcagaaattctacaaagcaaaattagttgacttggccacaagccataaatactaattaggtctgtaagattgtttaatgtttaagcctaaacatcagcaggcagtcctacagactaaaagagggtttctcaattgacagcctgaatgcagaaggacaaaagctaaacactgcctataaaggaatcaatttctctttaacctggccaccagaagaaaacctgattaggaaagaaaaaaatattatagggcttccaggacttggcagggcaaaaggaattacccaggatcttacccagggctcagaagatacccacttttttccttctgagtacattggctactttgcatgttttttttttcacattttcctctcagcttggaaagcagaagagacaggtatcttcatgccccaaccctaatatagtcttagaagctttgtcctcatgtcaggagtcttctattgagctatagatacatagatacatactgcataagcagggttcaagtgttgcctccaattccacctcttcaccatagctcagacccagaacaacaaacaaccttgcatttattttccaatatcagccacctcatttgaatgacactattttaatgacaataaatgttgcctgggcaccatgaagagagaaacatctccctgcattaatctcactaagatcctgaggcatgtttcaaagcaagcataggagaatttacacctaattaaaaccacgggggcaatgaaatatcaaagaacaaatctagttccttagaattagagtatttttgctgggcagtggtggcgcacgcctttaatgccagcacttgggaggcagaggcaggcggatttctgagttcaaggccagtctggtctacaaagtgagttccaggacagccagggctaaaaaaaaaaaaaaaaagaattagagtatttttgagctgtcagtccatccataatattagcaaaggaggaaaggagaaacaaaaaggagaaaatatttatgtataggagtgagggtaggcaaggagggaaagccagacagttgtttttttttttttaagaaaaaaaaaaaaaaagatgctgacttagaagttaaataccagaaaggaacggattggtttttaacccttgtaatttttgctttccccctgcatacctaagagcaatgactgctcctttgatagaaaaaccatatgctttgttagatgtggcactgaacagttgaggagtaaagaaaaccgaataatccaaaaagcagaaaatttctggtaatagaaaaagtgaaagtgttttatttcaccattagagaagataaagtagacatagttcttaggcctcttggtacaaagcaaacagaagactaaaaatccaggcattttgtttttttaccctcatgtgtttatagacataaaagatacatctgattagtaagacttatatatactaccacatgtctagctgtaaagtcacagctaggcaagccaagtcaataaaattattcaaattaaaactactatacttaatttcatccattcaacacatatgaggcagaatgatgaggtcagagaaagaataggaagatatttcatccaagagtaagatatgaaaactgtaatgaaacaaattggaagaa

SEQ ID NO: 610 - DNA, 3275 bp, Mus musculus
aggtattttggcacagggcctttctttttgcactagagcctagacaagactagtaaacacactggccaaaatggactatcttttattattggtgtaaatggtgattgcaagtcatcccactgatagaagctcaatttcatagagttcccaatctgttgaaactggttaataggctcaagggaagcaggagtccaagaaatgtggactcttgcctgtttacctttgatagaaaaaaaaaaaaaacctctccatttttcagaccataaagagccgtgttcacttttgagttgtagaggcttattgtgaaaggatatcttactagactttggagaccagtctcattgttccttctatgtaatgctaggttttccataataaggacaagtgttttttccctctctttccccccttcacttacttatttaataatagaaatgtggaggcagttttcctttttaaattttattttatatggatatgtgctttgcctacatgtatgtccatgtaccacttgcattccaggtactccaagagttcataagaaggtattggacccccggaaaaatggatgtagagattgttgtgagacatcatgtaggtactggaaatcaaatatgggtgttctggaagagcagccagtggtcttaactgcagaaccatctctctagtctttgtagtttcttttttggggagttgtgatcgtttctctccattattttttattttttattttctatttttttttttttttcgagacagggtttctgtgtgtatccctggctctcctggaactcactctgctcactctgtagaccaggctggcctcaaactcagaaattcacctgcctctgcctctcaagtgctgggattaaaggtgcctggcttctctccattatttttataaaacattgttaaaacattaattttgacagtgtatagtagagagctcactctgtcgcaggttcatctgaatggtgtctcctatttcatgcagtcagggtagagagcatccatgttggtttgcttacaaaatctagataagcaaacagttctttatctctaaagtaggcttagaatggatggctcaggcattccaggatctgcaccacccatagatcccaggtaaatcaatcacaaggagagtaaatcccccagaagaaggcaaactggctgtccttaaggagctactgcagcctctgcttggtctctgctcagcttcaccatggcgacggctgtgatggctgtgaagaacttcttactctttttgtgatgctcattatctccaatggatattaagcttaaatacatcttcaagctggcttctgtgtccctttgacagtttagtttaattattgttaattctttgaggtaagagaaaggtattcggttatatagaagaatttcttgttcggggagctatatttaggagtgaagtgtcatggtgttttcaacttattttcgaatgtgtgagtaacaacaaagaagtcagtgctttgtatgcagacacgccccctccctctctctctttctgtgtgtgtgtgtgtatgtgtgtgtggggagagaaagagagagagagagagagagagagagagagagagagagagagagagagaggagaggggagagagagagggagagagggagggagagggagaaagaattaatgaacatgataaaaaaatccattctggggatataccagtatttactgcatcaatctttcaattttttgaaggcttaaaactttttatagtataatttttaccaaaggtgatataagcaaagaacaaaagtctctaaaatgcaaatgatctgttcgtctcaaaagatgattctgtatatataatatagtatttaaccaccatattttttcccttcaggtccagggtacaggaaaattaatttttttaatgaacatttctgagtgtcagcttacatctgtcctctacaattcaattaaatgtgatctttgttcataaagtgccccaaagcggtgacctcattaagtatgttcatgttgctcctcagacctcagtgccacaagcaaacctgttttataatccaatccccgtggaaatgactgtaagctttagattagtaatggcccataaaggcagttgaatatgtagagtttatggaagtccccattccatgaaagtatgttaaaaggcaacaaggaagcagggcagatttcttcttttcaattcttcagagaatttttcttgtggttgtacttatgtgttcatgatcactggggtttggcaatttcagagctgatatggaatagtataagaaagctgactggtagatcacttagacaggtgtaaaaggcttaaaataagcccaaacattatttagaactcccctcttctaaaggatagagtcccattctcctcctgagtttgggcaaaacagtggctcacttctacctcacagaatatggcatcagtgactgttgcctttctcatgacactcaagcagcattatagagaggtctgcttggtgagaaactgaggcctcctctcaaccattgtgagactcccatcttgaaagcaaacctccacgaacccgttaagctttcagaccaatagcaattcagttaacatctcgactgcaacctcatgaaaatcccagagccctgagccacacagtcacagtgctcctgaatctcaaccccctggctgtttctgatcctaagtgataattgttttggtctgtttgggggggaatttgtttcaaggccacaggcactcttattgtcatgacttgagcccagtcaccatactccagagtctgaagagtttcctgctcttattcacaataaaagaaaaaaggcagtaaacagactgattcactggattcctttattggtaatggatgtaccctttgcctctttagttttttcctgctaagtttaaaggacttttgcttgaagtaatttgcatgttggtagtggggaccatttatctagtgcatgttttctggggcagaaaatccctaaggaactgagtaaacccagaatctccaattcacttaataaaggattacacttaatcccataaccatgctcagatatagaaagtagttgcataattttttaattttgaagctgaagaaaaagaaatatcatgctttagcagggtgcacaaatgtgggagatgttaaaagccttgaaaaatatcttcataaatatccagtgatttacaaagcacagatgataggaagacagtaagacatcaagaaggggccagacatgatgtactgagtggggagag

SEQ ID NO: 611 - DNA, 1950 bp, Mus musculus
ccattgacagataaaaggcatcttttttacatgattagttggcttatgaaggagcccttgagcccttttgcagagagcccttgtgtatatgagacaagttctctgccactgtgttacctctgtagccctaggaggtgacttctgaagaggagtcaccactttctctctctctctctctctctctctctctctctctgtctgtctgtctctctctctctctctctccaccctctccccatcttttaggaatcaacaaactctcctgctgtcaagggaagtaagaaaataagaatcttttaaagtctcaggttgggggtgtaatagagtcagcagctggctttcctattgcgaatcaaagcacgaacccctgggttttgcttttcagcattagataaatagtaggtatatcagtatacacttgtaatcgcacaacttgggacgcaaaatgatcagaagttcaaggcaaagaggaatagagcctcccgagtgtgaataactataatttcctttcagttgtatgagtgtttgttttttaagactatcctggcctctgtcattgtcatggtcaagcatattggacatgagtactgatgcatcttacatgtgtgtgcctcttccttactgtggtccttcctcgtgaaaggaggaccatctcaatgagcacaccatttaaaaagagatccacaaggttccttcatagcttagtaaaaaggacacacaaccatgaaaagacggctggagaacagatgaatcctctatagccttgggtcagcacaaaccacacagtatgtgtattcaacaatggagctctcagaaagactctacaaaacatccatgaatcgtgtgcttgacttggactgctctcgccattccttggtgctgacagcagcacccgctggatggtacagaaaacctgttatccttttctcagctggcatagggcatcacctccatcatcccacatcccccagcctgtcaacacaccctgtgataagagcaagcaggccacaggtgaattgccttcctgcctgctggatgacagctgctgtcagatccccagggctctgccagaattcttgctcttcaagacctggggatgggaagacatgatatccttacctgggtgaaactctgacctcccaggtaaactgtattgttgcctgtggagtcatatatggggattgtcatagagaaaaacaacctgtgactatagaatagctgatttgcaaatgcttgcctcatttgtacctatgtgaaggatgggattttatatgtacatatgtgcttggaacagagtagagaaataaagcatgttatcaatgaggaggaagggtactctttgctcagataattaaagctaaactgcatctgtggggaggggagccctgggactgaaagaataattgcccccatttactgcttgactttggatatgtggacacaagagtgtacagtatttaaagtatctgatatcctcccagatgtaagccggggctttgtaagtgagctttatgttaagaagcagtgtccagaaaccctggccagagccagtgccattgtttgcagcccatttttgtgtcacccaagtcagagagcatttcgttataagaatagtgcactatgtttttggagagggcttcatccctggttcgtgagaaagttgagatgtggggctattcaggaccagtcttctgagacatgtcttgggggagggaaggaagattaaataacagaacaatccccaccaaaaaaaccttagctttcaaatgctcatagcagttgagtttgcagaatgttagcatccagtctgaccccaagagttcccctaagtgctaaacactgttcaaattctcatttatccccaagctttatcctcactggcatcttatgggtgtctcagataccacagaaagggctgttgtctcttctagcttgttaaaagtaaacctg

SEQ ID NO: 612 - DNA, 2000 bp, Mus musculus
attactaccaaagtttttcaggactttggactgagattcactgacctctgcttatcagtgagcccatgtcacatgttttatgtatgagaagtttatataatgctatatatgtatatatgtgtgcatatatatatacacatacatatgtatgtatacacatatctatgtatatatagatacatgtatatgtgtgtacacatatacataaatagtatgtgcactaccctaccctctgtcttttctcatcaccaataccacttctaccctcgggatgcctttcctccatccttaaagaggaaacacagaggacccatttaagaatcccatttcccctcagcatgacccgtggatacaaagttcctcctagctgcaagactgcaatgacagccttgtgctcctctaattactcattcacaacctatcttctctcagacactgccaaatctcaaccgtatgcttcccctcccccgctcagtgccattctctgtctaatgctatctatagaaagataaatatagctaataagtccatctgggtctctctgtgatacacagaagagagagttaataatgtgcctgtctattaataaagcagttaggatgaaaatattaacaatgtttatcattataaagtatgttctttcggttgccttccaaacctagaggggagtctatgacttcttgtctaatttgcaatgttaaataagaaaaagaatagcagagaagttagttccctggatggctggaggtcatgaaatgttggtgtcctctgtggttttgttgctctaagtggctgagtgaatttgaaagactgcttctgaataagccctttagtcctaagtttccccagcgtacactgcagtagtgacgctggggattctacagtttccttcctgcttagatcccatgttgtcaagtgacggctatacggtgctgacaacgatcctgggatgtgttgcgtgatatcttgcattctaaatgtctacgtcttcatctctgccttttatggcttcattaccttaccacagccgtcaaagaggagccatcctcacaaggagacaggtaaatttttttggatccaatggttcagctcccagcaccggggctttgggcttttaggataaagactgggaattactaaatggctctcagggacctttgataccaggctgcgctgctacaaagactcccaagctttctgcatcaaagtgatttaaggggctcccatggcctaaaagatgaaagtaggtgaaatggttccctgcgtgagcccagccaggtctggagagcttcttcactggggttttggggtgttcttcactgttcagcttaatgaagaactcacccccagatgacagtaactgaaaaccatcaatgctatgcatgagaagatccatacctcaaagttcaaattaatgaacacattgaaaatttgcatatttaaaatggaattttgaattcattttgaattctgtctgaatcactctgtttctttccttggccacaaatcacagatgaaaaaaaaaaaaaacaaaaaacaaaaaacaagaaagtccctaaaaatggtatctaattaccaaaaaggttataattataaaagttcagacagatcaggcaaaagaaagcgtgcttaatgaagtactaaggacaacgaagaccacataccaaccttatgaggcataaagaatggtataaaagaggagaggccacgtcttctgggaggaatattctgaactgcttctggggacttagtcttgcttttgcatgtacctggtatgcctgtgcttggctccactccctactcttctcagccttcaaaccttcatggtttgttctatcaatagcacaaggagaagcccagcagagctacacagtggtgtgcaagcccgtcgtgttgcatcttgcctgtgtgctggatttgtggatggtctcagagtcacgtgagcgtcactaccgcagtcaatctggattctagccacttcagatactttcctgtatgct

SEQ ID NO: 613 - DNA, 3275 bp, Mus musculus
agcctgaaaaaagcagggctttctaaatgttcactaacatggggcggctttctaaatgtccactagcatggaaaagcaggccagtcagagaggccagagtccttgggagagcagtgcggggaatcaggagcaaatgacacagggatactgtaatgaaaactaatactttgtctactatataaaaaaacttaataaaaggaaaatctctcttcgacatttgtctttattggtgattattttcttttttctccaggtacaattttaaaggcttaacttcaataatcatatttattccttgaagacacttttcttccccactgactcctgtgaaattagaatcagagctgtcagactgtctttcagattataaagcaggatctctctaccaccaggtcatgtttctgctccagtcatctgctccatcccacacagagcattaaacgtggacccgaatgactttcttattgtttagtcccaatctctagcctctgcgtggtaaaattataactgagtgggaagcgatttctgttcagttcaaggatctgttgaagtcatccagataatttgcccatagcaacagaaagaagctacatgcagcacttagagtttaatgctaagcctggaaaattgtacggatagaactttccttttaatacatgtgttgttcaggtaggcttctatagaagcaaatcaaatgcttgaagacataaattacaaatctaaatattatatttagtgttttccctttcattaacattttactgcttctacaaattcagtttattgctgtaatcatgtgtgaagttcaaaatcaaactttggttctctgaggttctattataatagacctagcatacccctaagccttgggtggaaccatgaggtcaccagggtgtgctgatgaatggtactgggactccggcctgcctccttccatctcagctgctactcttaccctcccctcatcccacctctctgtgccagcaggtgagccaatgccatgccatgtttgaagttcttcctcacagcaggagccaagtgactacagactgcaaagatgaatgagagtgaattccccctcttggcttttggcattttgtcatagccatgggacttctaacacgtgtcccttataagagcatggagccttcaggatcagttcactcttttctacaaaaatggcagttaatattttacaaaagtaacttagatgaggttttggtcttatttggttaggttttggcaattggaactttgttagtgtttgcatgtaatctgtaaaaagttttgggaaaaagggctatagcaacaaaattaattcattaggtccctgaacacgaaacacttatccatccgtttagatctttgaataatttaaatttataaaaaatagtcttgcagttctcactatacaagagtttgtgcttctctagctaactttattttaaaatattttattgtatctggtgatgttataaattaatttgttaatttcattttcagacagctgattactatgaacagaaacatgatagatttgtatatgttgtgtgttctgctctggtgttatacattgaaattttgctcaattatttcattgaaaatgaacactgtaattttaatgaattcttaatagcttattaaatggaaagattaagttgtattcagctaagagaaatgttagctcctttattttcatcctaatgcctttccagttttttttcttccctaaatgcacaggtaagagcccctggcacaataaagatggaagtatagaaaaggtgtgtttgccttgtttctggaagcttccatctttcaacattgagtatgatatttattctgcgatttcaacagatggtcccttggggacatttttttttctctgttttgcttttggtggcatgtagagggaggtgttttcttttttacaaatactaaatttagtactgtatttttgccatttttctgtttttattaaggtgtgtatatctttttgttcctgtattaatatagtatgttgttgacactgattttttcccattttttatttattcactttatatcccgatagcaaccccctcccattccctacctcacatatccactcccccccccccatctcctacccttctctgaaaagggggagactctcctgggtaccaacctaccctgataccacatcaagtcactgcaggactaggtacttactctcccactgagcccagataaggcagcccagttaggggaataggatccacaggtaagcagcagcatcagacagcccctgtcccagttgttggaggatagccataaaacaaacaaacaaacaaacaacctacacttctgctacatgtgtgcagggggccgaggtctagcccatgattgctctttggttggtggttcagtgtctgggaacccccaagggtccaggttagttgactatgttggtcttccctatcccctctaggttcttcaagccattccataactcctccaaaagactcctcaagctctccataatgtttggctgtgagtctctgcatctatttgggtcagttgctgggtggagcctcttaggggacagttatgcaaggctctactctgcaagcacaacacagtatcactaatagtgtcaagaattagttctttctcataagattgacctcaagtttggccagtcatttgttggccattccctctgtctctactccatctttgttcctgcttaagcttccagaaacaagacaaatacatcttttctgtactcccattcttataggcaggtcaaattttgtgttgaagatttttgtgggtgagttggtatccttatccttccactaggagtcctggctggctacaggagtaggcacttcagtctccaaatctcccactgctataagtctcagctagagtcactctcataggctccctggagcctcccctaccccggagcacatatgagagatgctgcacctctgcctgccaccatttccatttactcttctggcccctctcctagactttctctacacctgatatcccctaactctggttcccttcttgatcccctttactaccaagttccctccctctatccactgtccatgattattttatttccacttcagaatgagatccaagtatcttccctcgggccctccttgttatttaactttttttttggtctgtgaattgtagcatgggtatcctatactttacagctaatacccacttataaatgagtacatagcatgcttgtccttttgggtctgggt

SEQ ID NO: 614 - DNA, 3725 bp, Mus musculus
tgggagaattctattcctcagtagacagataaggctataaagctgagcgtattttaactaagaattctagagtatggtggagattcaattcacaaagcctatgacttgaatgacttgatcatttaaaaaactatgtaattgaatactttcaggtgtacgaacagagttgtgtaagcattactatcattaatgtcgtattttcatcactgtgacaagagaccctgagcccaagagcatcacttgtctccactgtcttcccaggtctaggaaaccagtaatgtacttccattctctagggatacgcctatcctggatacctcatgtaaatggaatcatggaacatttaccctttactcattagtttacttcacttaaaacactagcagaatgtttccagtggtggtttaaggatcagtacccattcatttgtatgcctaagctcgctttctaaatggatctgctttattctatatttccatgcaccagtatgatggacttttgtgttatttcaattgtgtccctgtgaacaatgttactgtggatttcacggaccaacttttggtgactacatgttttcatttcttttggttacataccaggaattaagtggctggtgatggtaactctctgattcattgcttaagaaactggagccagaggcatggctcattgctttgccacctggacaccaatatgaaggcagaaggagaggacagacttaacaggagatgccctctgacctccatggcatgctacatttacttatgctaaataataataaacaaaacaattaaaaaggaaacttgaaaatggtttttccaaagtaggtctaattgtgtgtgtgtgtgtgtgtgtgtgtgtgtgtgtgtgtgtgcacctacccaccaatacaagagaaggggtcagaccccttggagccggtgtcatggggtatttgagggctgagggaaccaaacaatggtcccctgcaaaagctgatcttaactgctgaagcatttctccagcctgtgactactgtggtcttcatttgcattctctttggatcagtgctattgagcatctcttcataagtatcttagcaattcgtgtatctttttcagaaaagcataaagctctcagtttagcttttccttttgtttgtgtcttgcgcttttggtgtcacattaatgaaccaatcgcttaactcaaggtcatgaagagtcacgcctacggtttctttgaagagttttagttgtagctcttacacttgggtttgcttttcaattgttagttagctttttgtatgtcataaggttgagtactcatctgtttaaaaatactgattgattgattaatgattggttgattgccattttagtgatagaaaccaaaactttgtccatagccaaacattctatatctgagctaaaacctcagatcctaccttattcgttttgccatagtcccatttactgtaagatgatttcttctcctttgaattgttttcacagccttattaaaagccagtactctctaaatgtgaaggtctatttctagagtctccatactgctatatttattctacacaaaaatactccatccaaacacactttccagctgagagccgaatggatctggagagccaattaatacactgtcttcaaagcatgacagcaaaccaggtgttttgacttttgtttgtttgtttgtttgttttcttgtccatatccgtagcaaattaacataagggatatagcaacaaccttagagaagcagtcaaggcaacaagttatagttcagggacagaaggggccaggacagctttattaggcaagacgggaaatacttagtcacctgttttgtggcagctttccctaaatccagaggtggtcctcaaagcatcctgggtcgcttcctgatgtgtgctgtgcctagccttgttttcaaaacaccaaagttcaattggaagggcctcttctgggaccactgggtcagaggcctatgggaagaaatgtgcctttagtgaggcaattcgatgtggaagaaagtccagtcctctcttcccaagcttgccagttacatggaggggagtgagtctgttcctgggagcactggtgatattttagtgtctgtcaaagtgtttcaggactttttgatctgggaaaacctcatgaagagggactgggtgctgctcttgctcaaagggtactcattatccatttagggatgctgccaaaaggtgaccagatttcagaaaaatgtgacaacacacacatgcctacacacacacacacacacacacacacacacacacctcatctactccacccttggaaacaaatgacactgtttatatgcagacacacaaaatgaatcctgtctcttagaagtaaggcccagaaacttgagctaactgttggttgatcatgcacaggccaattggaagcccacatggaggcaagctctcgttgtccctttagcagatatttaggacttatacacaaccattccaaggaggagaagcagtcataggaagagctatctgcctgcttgaagtacactttgcatgacactcatgggtcccatctccagcatcaatgcttcaaagacctttccagtcaatcttctcttccatggagaccacaggcccaggagaagatgccattctccacttggccttcccttactacttagcaactaccatcaccatagtcttttcttgccttagcccattttgtttgtcccattccctgcctgtccccattcttctccctcctataaggaacaatacaacttagagacaatctgatctttgtgctgccccccacccccatcctttggatttaattctcagatgaaatctacatggagcgatgattaaataatacacaaggcaagataactagatgagccactccaggatgaaaatgaggctacaagatccttctctacctcataacacccaccagtgtcacaggcctagttgccccactccccacactgccccagacaataagcaattggcataggaggaagcttcagcatgcaatgaatgcacagttcctacatccctgcacttacgggtttcattcctgccatagattacataatatcacaactcttagaacagcccccaagtattgcaatcatggtccccattccctctctgcctccttatcatttctactgctgctgtagttccactgtggccaattgatagcctgtggttcacacagtgagaggcacttagacccaggctctcctgccaacctaaccctccactggttttctatcatagctgtaaataaaagtaaaaactttaaatccttatcctaggctataaggccttgacaagttggcctttgttggcatctgcggtggtttgaataaatatggctcccatagactcgtgtatttgagtgtttggcccacagagagtggcactattaggtttgaccttgctggagtagatattgccttgctggaggaagtctgccactgtctttgaggtctcctatgttcaggctatacccagtgcgacaggcacatagtctccttctcctgcctgtggatcaagatgtagaactctaagctccttctccaacaccaggtctgcctccacactgccatgatgataatggactgaacctctgaaactgtaagccagccccaattaaatgttgtcctttgtaagagttgtgatcatggtctccgttcacagcaatgaaagcctaactaagacagca

SEQ ID NO: 615 - DNA, 3000 bp, Mus musculus
aaatataaaggttttgtgtcttttatttgggaagtctaaggtgggtagaaaccattaaattctatttactgcacaaacaaacctgtcatgttaaggcacattgaagagacgctgtaataaaagggttcagtcaccatgtggtatagcacctatggaaggcagcctagaagagaacatgggatatcttagcactggtgttgcagagaattgtgagctcccatgagagtgctgagtccctacaaaagcagcaagtgctcttaacctctgaaccatcactctaacgacataatttctccacaatttaaccaatccttatatatttttttgtatttggaataaaaaaatattctagtttgcgtgaaaataaaaaagaataaagctcaaatacctgcttgtcagaacaaatttttccataaatttctggcttaaaattctgcctaatacattttattcctattatctgtttatagtatcccaaggaatttgtttaagtgggatatcagaacattcattaaagttgcaataataattctaaatgcttatgtaatttattcacctaatcttaaaatattgtccaaggactattttttcacatgttctgttttagaatactacagaatatcattcttgtggaacaagtgcacttgtatggccatttattctcccctttcccccccttttaattagatattttctttatttacattttaaatgtttatcccatttcctggtttgccccctgaaaacccactatcccattcccttttcctctgcttctatgagggtattcccccacccaccagcccacctacctacccacccactcacccacccacccactctcactaccctgtcctggcattctcctatactggggcatttggtcttcacaggaccaagagcctcccctcccatttatgccccacaaggccatccgctgctatctatgcagcttgagcaatgggtccttctatgtgtactctctggttagtggtttagaccctgggagctctgggtgcgagtctggttggttgatattgttgtttctcttatgggctgtaaacgcctttagctccttcagtcctttctctaactcctccattgggttcttgtgctttgtccattggttggctgtgaacatccaactctgaatttgtcaggccctggcaaagcctctcaggaggcagctatatcaggctcctgtcatcaagaacttgttagcatctacaatagtatctgggttgggtaactgtatgaatccccaagtggggaagtatctgtgtgacctttccttcagtctctgctccacactttgtctctgtatctcatcctgtggatatttgatgagctctttgcctgtggttttcaaggtggtcctgattgaattatagccatcaggattagtttccctgactcagattaaagaatctagtcacatattgctcagaaggtacaaagactgtgtgacatggtttctatctttagaacctagcagctggttcagtgtgtagcaattttgctattagagaactgtgtgagttttccaaaattagaaagatgacatctttaaaaagttttctgagtatatgcacattgtctgtctgtctgtctgtctgcctgcctgcctgcctgctatctatctatctatctatctatctatctatctatctatctatctatcatctatctatctatctatctatctatctatctatctatctataatctgtgacagcattttccctgtccaattacattaaaatattagtgcaacagaaggccctgtgattgagggaggcagagcttagagtttcagagacagagagtatctcgggagaaaaaaaaaaaaaagagccaagatggagatggacggactggaaaaagaaccagatccagtgtagttttaatagtcacagttatgatattataaaggtcagaataattggaacaatttgtctaatctcagtgagcagtttttatcattatcaattggttctgaaattattgtattggaatcttgtaaattgagagtatattgatatatacaaatctgactggttaattataagcttctagagttttgtttctacctagttgctggatgttgtggctgatcactgggtgggcagtcagtgcatggtgttggcatggcagtgaatagaactcaggagctctggccctgctggagagttggtggacagagaatagcttggtgggaccatgcctgggcagaaagtagctggatggagtgtggggaactttgtggttctacttggttactggaataggggaccacctactacaggggtttatggttgagaaagaaggagcagctccagagacaagcaaaccagagcagggaacatagtgattgggttgcttggggctgggggctggggggactagctagagaatagccctgcaggatcacaggggcagggggtttcctgcagtaggacagcaagcctgctggatggctttaatatttcccataactatctatctatctatctatctatctatctatctatctatctatctatctatgtatcatctgtctgtctgtctgtctgtctatctatctaactatctatctactgtctatcatctaccacctatttacctatctatcatgaatctataataaataacatctatatattatctgtgagtgtttttcttacctatcattcatctgtgtaaatctattcatctataaaacataaagctatcatctttctattacctgatctgtaaaatttgtgtttatatccacctatcaatatatggatcatatatgttttatctacataaaatatttatggtcacatacattacatcagttttaattataagtgactgttggaagatagtaatggcagaaatatgaaagaggatttcaaggtgtaaggcagatgtgaactagtaccatcatgctctgagtgcttagggcttttgaagtatacactgctcttattttcacatggtagtcatttttct

SEQ ID NO: 616 - DNA, 1900 bp, Mus musculus
taggaagaacaacaacctcaactaacctggatcccccagagctcccagggactaaaccaccaaccaaatagtacatatgtaaggaccccatgactctagcctcagatgtagcagaggttggccttatctagcatcaatgggaggggaggcccttagtcctgtaaaggctcattgccccagcatagagggatatgggtaggtggggggggggggagcacagtcatagagacaaggaggaagggaagaggatagaggcttgcagagggaaactgggaaaggggacaacatttgaaatataaacaagtaaaataaccaatatgtgtgtgtgtgtgtgtgtgtgtgtatgcacaaagaaaagatattgctgcatttctgcacttaatagttcatagatattaagtgcaaaatagactttcatgtacagaggaatgaagaatttgaggtggtcagattatacaaaatggacttagtgttttatacttccactttgtgttctcaaaaaaaatgaagtatatcctcagtgtaattttttaagtaatttttctttggtgtcttttcattcattcattcattcattcattcagtatcattcacttacacacataggaactgttctagactcctaactgacaagcaaaagattctttcttcatgtagtctttggagaaagacagaaatattagggtgcaaatgccagaactgaggaaaaagatctacagaaacatagaacaggacatctgatctagtcagagcgcaagggcgagcctcctgtaggaaaggtcttactacaatgtatgctggtggcagttggagtctgaaatgtcccacagaggctcatgtcttgaatgctccttcccagtctgtaggcctgtcctaaaggctgtctgcttagggagtgggcttggtcagcagaagtcgatccctggggacagattcctgtccttggctctggcctactgtttctgcttcctggtctgtgccaggtagacagcagctaccttatgtttctgcctctacaggaagagctgcttcccccctccaacctcccattgccataagcagaaacccctccaaaatatcttgatgcaaaagaataccttcctctcctaaattcttctgctgggtgtccctgtcaccatggtacaaagggaactaggacaatgcaccatgtcacgttcttcctacgtagatcagaaggaaagatgcaacggaagataaacacgtcttaacagaaaaagaaatattaggtgcctttagaaaaatgcatataaaaaaaagaaaaatgcatataaattcagcaaataaaagtttcctgtcttaattctatatattacatcagatattcatatatcataaatatattatataatatagatttatatatttatagacctaaatatttagaaataagatacaaatataatgcaaatattacatcaaatatttacaatttaatatacactaatctttttaatttaaatatttccataagaccaaaaggaaggtaaatcttacactaagcgaattctatctctaaattacctggtactaatgttttttttcacatacatttcttacttacaaaacacatctgaacaaagaaacggcagcatggcagagaggatgttctttctgaaagtggtggttacccggtgggtaggagttaggagtcctgtgggtacagacccacctccaggtcattggcagaacaagtcactgtgctctgcagttctctgtcgcatcaatacactgaatcaaaccacaaacagttagggaagggtgcatgtgctaagctgtggtttttaataaagatgccatgtcccacttcctgagtcaacagagttcttgaaaggccctgctaattttaatgaataagtgtgaagtgggtggctcattggcc

SEQ ID NO: 617 - DNA, 5275 bp, Mus musculus
taaagttacacagagtaacaatttgctttcacaaattgtctgtgtgcagcgggtagggacacagaaacaggattcctgctgggaatgtataatgcccaaaagctcgaaacactttctggcaggtggacagcgtctcattatgttaccctagctgacctctctccatgccctgctcaaatcacacttttattttcttcctctctccccccctcccttcagtattttttcctttgagatagggcctccctatgtagctctggctatcctggactcactctgtagaccaggctggctccagactcagagagctacctgtctctgccttctgagtgctgggatcaagcatgtgtgccaatgcctggcacattcttatttcttaagacagaatacacttaaatctagtaattgcttatttaaacaaagtccttacatttgtaattcctccatgtgattgtatctcttgttttattgagttctctgctgcatagacaaggtaggtgagggggagaggggggaagggcagggagcgggggcgggtagagataatttgcttctaagatgtaaggatctgaattgattgcccaaactgaaaatgttgagtaggtgggtgaaccctatagctttttaaaaataagaaataggtatcaatttttaaaaagttttatttttatttacgtgtattcatatatatatttatatttgtctatgtgcatgtccccatgaatgcccacaaggcttcaagagatgtttgcatttccaggctctgtagttagatgcctttgtgtgagacccattcctctggaagagcaggaagtgtcttactgcgaaccatctctgtaacccccagacagctatgcctatggactgtggctcagttagaagtactcagttagaagtaagtactcagttagaagagtactttcctactattcccaaagccttgggtttgagttccactctgtagatcagatagagtggtgtagcctgggagatggaaatacaggggttaaggaaatcttcactacatagtaagtttgaggctagcctgagctacattgtaccccttctctatatcatttcctccatccttccacctcaaagaaaacgaaaggtattattgttgttaatacagagtcctagggaaatatctcagagagccactgaggcattgtaaattccaaaacaatttttattttgttaaattttcatcacatgtaaagttatgagatgttaaaagtacatatcatggggcgttataaaggatataaattagttaaagtaatagaagtgaccaaaaaaagcctgcaagtttgttatataataactttttgtagtgccctaaaatttttatctaagaaaaaatgctggagcaaagaaaaaaatgttgaagattatttaaattttattatgatataatgacactaaattgcagtgtatttaagtgaaagggaaatggaaatagtatttgttaataaattactaaagaacctaatgtactcaagatcttttcacaagaatcttacatgggctgctggtattaaaatagaaagacgatttctttaattctaatgctttatgtaacattcctgctaacattttatcactttaaatgctttacttctttgtttctccatttgacaccaagaatgcactcattctcatattgcaacatatggaaacagttagataacatacacagtgggctttttggttaagtccactggacctccagtctttctaacagctggacccaatcgcaacagccagccttgagaagagtcagtataagagtgatgctcacacttgactagtcagaggatgctcctgcaaattcttgtttcctaagtctgagatgtctccttgaccttgtttctctgaagccctgactttcttcctgtaaactaggtggaaactgataggctgtttgagttgtttttgtctaggttgctaaggaacgccacaagtcttagcgagagatccaagaacgaggtacatagtcagaaaatgaagcaaggcaaggcaacccttggttgctcgacttctctgcctctaggtcccatggagaccactgctgaaccaggccagaattctcaaactctccggactgtgcggcctgcaaaacaaagatccttcctacctctttcttctgtagcgctgaagaatgagtttcagataaaggtactgactcagtggacggccctcacaaccctggacgatgctagatgttctgaatgtcatcattataatggattagatccagagcataacatatgctggtcaggtgctctagcaccaagttccatctatgtccctttccaggattgagtgagtgatcggttgattggttgataataaatccatggtgactaacattgtggtgaattaacactagggtcacagacttctccatcacagtggagaaggcatgtgggtgtaccctggacagcgtgtggtggcagaagcttatagcagcagtgctttcacatggtgaagatcaaaaagcagagagccagactggaagtcgtgttagtctataactctatggcttgacccccccccccagctagacctcatgtccagaatgttccataaactccctaaacagtaccgtcctctgggaaacaagcatttaaacaccatgagcccatgggagacagttcccatccagaccgtaacaacagggtgctgaggccggctagactgtaggcatgattgagattgtagactgtggtaagagattgtagatgtgctggagtgtcagagcagagcctgactcctacaaccccgtctgtgcacttcacccctctccctcctctttctccattcatctgctgttctagccccctgaaagtctgcacttctcagctctggttttctgtgctctccttggtctggagcatcctccctctccttgcttgaatgtagtcacattcccagaactaggctggaatgtgtgctacctgcccctggctacctactctcttacttcccacctcccaccgctcttctgcagggaggggtagtgtctccttccgtcgcactgtagacgtttctcaaatggccccttttgatttaaagtacagggggttgctttgaaattctcattcctctctaatgaaaggtgccatcatctggggacacatgagcccgtggcagacagttcccatgcagactgtgacaacagggctagcgtaagggatcatggatgagctggaggatcggagcagagagagctgggtgcagcttgggccagacagagagagcagagcacagggcatgatcatctcaggtagaatagtccttagaaccttgcccagaccaggagaactattaaattactattgaaggcttaaatgaatgacgagaaggagaaaggcgtgagtgaggaaaggaaggaaacagatgtaaaattctttttaaaaagaacattgagaaaaatacatttagagaaaaataacaccagggatgctttcctgaagttagctagcagccaactgatggccatggtcctgctggttgcatcaaactgaaaattcacctacatctctagggtggcaacctcctggaactaggagtgggttgtcattgcctttttgaagtcagcatgttttcgatgttttacatatttggtgggttagattacaagaacgcacgcctgaatctactttctgtataaccacatcccttccagcctgggctggaaaataacactgcaggccagaagacaagacacttgagagtttgcagttctcttctccaggctgaatccaggtctttggatgtcacaactcgttacagcttgattgtttagtaaaagagaaaaaactccagttctgtacttgtgggctgtaattgctggctgattgctgtatctggggacattttggtaatttcctgttcattggacaaaaggaagaaatagatatttatagcatgttccttttgtctgtgtatatggtatatgtatgtgtgtatgttcacttgcacacttgtacacatgcatgaatgggagccagcaattaactaacattggctgtctccttaattgctctccatttgatgcttttgagacagtctctccctgaaccttgaacttgatgaatcagctagactggctagctaaagcactccacttggatccagttgttgctgcttccctagagctgggattatgggcacacacaaagactttttacaagggtgctgggggtctgaactaggtcctcatgctggcacagtgaatactttcttcactcagtcctccctcccccccaccccctggtccctgattatctcgtctttaaaagtcattacaagggctggaaagatggttctgtgcatgaaggtgcttgctgctgagcctggtaaccagaaccaagttgtccattgaccttggcatgcgcatgcacatgtgctcacacacatatacacccccccaatgaatgtaaattttttctttattaaaaaagtcattactagctttgacctgggttctcatagctatctttagatgcctgcatgatttctggagtggttcctcaatgctagtatattccaactttgataaactccttatgggtatagcaaggccacctggaattcagttcctttgactagtatgtaattccatctttacgacaatgttgttgtaatcccagaataaacatttaacatgcataggaattcaggatggtaggtcttttggaggcctaatctaaagtgagggctgtaggatcattagccagaagtgcaaatggagcaatgggagaagggcatgcaggaggtggagcccagtacagccatgacagaagggtggcccttcactggagttagaaactgagacaactctaactaccaggggtcccagatgagaggaacattccgagccatcattctgacaagcgtagctgaaaagttatagcatgaaaatttggaacttcaacaactcctgaaatcgcttagtaaacaccattcctggaagagcagccatgggaagtcttacattcttcatctgagtctcagaaaatggagacagttgggtaaacacactgcatgccttggacttggtacagctttcttcaggaggaggaggaggaggaggaagtctgtgagaatgacagatttgggacaagtttctccatcactcgaaaaaataaagaagcataacttggaagtctagactcaagactgctttaaaagaggaattatttttaaaattggtgtgtgtgtgtgtgtgtacctgtgcacacccccactcccacccccgccccacccc

SEQ ID NO: 618 - DNA, 2225 bp, Mus musculus
tcctatgggttgattagagcagcctgttcaattctacataataaagcactggaattcagctatctcatggactttgtgtagagtaaaggacagacagggctgagaagttggttttgattttagccttgtctttgaatgactcaatagctacaatactgctttgtggatggagagatgactcagtggttagtcacactcactggctgcttttgcagagtactaaggttcaaatcccagcacctacatggaggctcacaaccttatggaactctagttctaggagatctggcgccaccttctggtctttgcaggcattacacacacttggagctcataaatgtgcaaatacattaaaggaaaaaaattaaaaagagaataaaaatactgtcttgaagttttttgcaactatgtgtttgtatgtttgcatatttgtgtgtgtagatgtaataagtgtaagaatgcgtgtgcttacaaatttgtgtgtgtgtggatgaagtatgtgtatttgtgtgtgtgtatgcataaagtttgtgtatatgcactcaccaatctaaacatatggccagagattaatggatgctttcctttcttgctcttcacctatttttaaagattttttttaactttgtgtaaatgtgcctgtgtgtgttatgtgcacgtgaatacaggtacttgtgggttcagaagaggaagctggaggaatctgccccaggttgatgctgggaaatgaacttaggtcctctgaagagctgtgcatgctctcagtcattgtctcactgtggagacagaaggcggctgctagggagggagccttggggtctgtgtgcttgcaatcccagcagccaccgtgcccagccttcctatgggtgctggtggtctgaacacagagcctcacgtttgtacagcaagcgctttgtacactgtaagctatgtctcctgcccctcttttaatttttatgctgaataaaatggttccctgtatcaatcacacatgcaattaaaaactcctagagtttgggatatctagaaaaaaacgactgtcaacactgataatacttggtatttttaaatcaatctttagaatttttctagtagtctttaatggagaagggaagtgagttacatgcatctcaatgtaatatttagcctctttaaagttggtcagcatttctattctctaaataccactttcgctgggcctgtggcatggacctgctgtgatagcacttgggaggtggaagctggaggaccaggacttcagggccatcctcagctacttagaggtctcagacagaggtctgtcttataaaaaagaaaacaaataaagagggttttttgtaaggtatgtatccttcatttgccagagcataaaaggaacagacgtcagcaaacactagcagggatgacttatttttagccgtgtgaaattcagtctcaggaatttaccttactgttggctccttttataaaaatctgtggagatgggaatatatgtccccttgtttaatgttcagtgtttggacttaaaagtaagactttattcacttgatttcaaattgagtgtggtgataagtcaggtctaggagacagaattcctctagtacaaattaggtaatgggtgaaataatctttgttttgcgactttaacctagtcagataattttaagttctggttcaattttaaaagttttccttttctcttgtaaatagagtcgaattaatacaaataccctttttagccttaatgtgttcagttgtatttaattcttttatggaagtctcttgttttgtttgagacagggtgtggaactcactacatatacaaaactggccatgaattcacaaagatccacctgcctcttccctgagtgccaggattaaaggtgtgcagcagtatgtccagctagggagacatttattgagcaaataactgaaacacacaacccttattttaagggtgccacagccacaatctggagagtctccgaagtcttagcagcttgcagataagctttaagtaatacattgtattggaaatctacacagagcttctaacagcacctggacacacagtaaccacagaagatcatttccaaggacagctttcataaaacccaaacactggccaggagatcacacagtgctagatgcatcatgaagacagtgctcatcacaggacatcagttaaatacttaccaatcaaaagccttggaaatatagagtat

SEQ ID NO: 619 - DNA, 3050 bp, Mus musculus
tgagccgaagacagaggggatctcagcttgtgtgctgccctttcgacgagcttccaaagcttttctctgtgaaaatgagttgtgaatcactctggatatctgagccatggtgtacgtatcattgtggtccaggataagtgcgcagggacctcacacacatgaactgataaaacactgaggagtcaaaagattccccctcgatgaaatgagaattgttcatatcgctaatgagtagacatggtagtgaggatgcagagcacggaggagagagaggagggtgtgtgtgtgagagaacgcgcatgtgagtatgaatgcccaaaagttcacaagaggccactagttgtacctacaccgtaggctcattcaaagtgaagtttgctagaggttgccacagtatctagaaaatgttgagtagaacccactgaactagaagaagtagagctatatgtgtcctagtgaaacatctttatcagaacatcacttataccatttgtttgtttctttcaagagaaggacacaggggctccagagatgagtccaactgttagcagcagtggctgctcagccacaggatcagggttcgattcccagcacttacaaagaggttcactaactggctataacccccgctctggcctttatggatatgtactaaggagttcttacagaggacccgcttagcctcataactgtctttaacttcagatccaaggggatccaacactttcttctgacctctgtggatacagaatatacatgtagtgcacaagcatgcattcatacatacagaggcaacatacacataaaataaaaagaaataaatcacaaaaattaagacaaggagaagtagcccaggctatcttcaaacttgtgatccccctgccttagcttctcaagtattgtgtttcaaggcttgcctgttttgtgttacaacgctatacagacaaatgggagtgaagaacagacttatatttcagaaacttcccagattcattcttacagatgagggaataaatgtgatcaggaggtagacagtttactcagggttgcagtgaggagtgacagagtaggtatacaaagtgttatctccacacctcgagccgcccggggccagtccagaggactgctatcaagctcaccagccctgctcgggagctatgcaaacaggaccctgcatgatctcagggctttcttttcttttacacccagaaaataatttcaggcaattgctgctgtttcgatcaacacagattctatttatacttttataaatgcagatttgatttaagaaggaagatttctaagctagacataaggaaattccagtgtttgcctgcctgtcttaatgagaactgtaatatactctatcatctacatatctacttgttaaaaatataaataggaacatcttcaaactagtgtttatttttaaatatcaaagatggtgatattttcagggaaccacatgattaatagcacgatgttggtagtaatgttaccatagtaactttagattcagaattgagtttgagtccctttaagccttaggtatttttaattcgaattactttcactattttttaacaaagtaaaattaagaacctacttaatatcacgtctcactttatgtcagacactaaacaaaataatcataacagttcttgatcttttaagactagttgcaaacgaggtcaaagtactaattactgctttgacatattttattagctcaatgatttataatgtggctgtagccactgttaggtgaaacactaacgatcatgcaagtcagtaagttggattctgtccccaggcctgctagtgttacggaatgccttaggacagcgaaaccatagtgcctgcatcaagtgctctgaggccgaatgtagggaaccacccttcagtttcatcaatttggtgagtggagttgtctgtaaggggcttacagtggaggcttcaaagacaaggtcttcttaaattgtctcggtcctctcgtgatcaccacattagctccgaatgctgaggcactgagatcttgactggctaggtatcttctaagagttggccctctccctctctctctctctctctccctccctctctctctctctctcaatggtggggaggaggaggtattgtcgaatgacagaggaaggaaggggatccaccaccagaaagttagagaatctgaacacttccagccactgaagtgagcaatgagggtttgtggtgatgaattctgtacacgcccaatcgtctcatcatgcatgtaaagcacttgctgtccagtcaggtgtgaaagccagaaaaactccgaaaagaagcagaagctagagctggcggtcagtgtaatccgtgaagtgacagaactttttaaagcaagggtttgaaaacgtgaagaatcaaggatcatgtagacaaccttaaagtgaaggttgggtctagaactaactcgattgcctgctcacaccagcatctccctccacagggatgtccaggctgtaggagggagaagtgggcagctttatagaaatgggatgctgagccagaacggaaaaggaggcagtgggaggacttggcaggtgggaagggaaggagaacgacagagaatgagggagagggagggggagggggagggggagggagagggggagggagaggtagagagagaaagagggggggatggggagggagagaagcaggtgaaagagaaggaaaacatggaattacctggaagaataatgaagggacccaatgccttcaacatgcctaagcatgagaactacctgggggaatttcccattttttgtttgttgtctgtctgtctgtctgtgtgtttatttatttatttatttatttatttaatggctgttttgtttgaaaagaggccttgctatgtaaccttagctgcccttggagttttaccaattctgtcctcgagggtacttcctctcccttccccacgtactctccatttcatttgccgaaacattttatacagtacacgggatgtgtgtagcccatacatacaggttaacgaaccataatac

SEQ ID NO: 620 - DNA, 2575 bp, Mus musculus
caaggtagaagtatgacaatatccaggaaagcatggtgcaggaggagctgagagttctacatcttcatatgaaggctgctagtagaatactgactttcaagtagctatgatgagggtcttaaagcccatactcacctactccaacagggccatactttctaatagtgccactccctgggctgagcacatacaaaccatcacaggtactaattctttatttccaaatcaaatagaaaccaaatttgtaattattataggaaactattatgaaacactgaattctgaggacagaactagaacaaagctctgccaaggtagacatctctcagtatctgagaagacaagtgttgttctatctggtgctttagggcttcatctgaggggaatgggtgacatgctctgtgctagtccagagtcagcagaacaatggctctgagctctgtgtctaccccacagtcagacctctgcgatgcaggtgcctattttcatgttacaaattcttcagttgctgcaatcaagtagattcaatagtgagtatactaaacatgggatgaagctagatatgaatgggtttttactttctcctactagaaaaaggttatcaaaatctcaatttacatctaagatgctggatggtaagatataaaggagtagtccttgatataattaatattcttgctcagatctcttaaggaaggagataaacaactttataaacaagtgaattcaaaataccatgtctctcactcctttcaacccttgaatctcttccagttgtttgaaacaaactttgcaggcaacataaatatcctagaatgtcctgaaatccttcagcagttaaagagaaacaacagggggcagcaactatattttcctcctggcctgccctgtgaggtcattatgtagaaaggaatctgttttggaagctggaatgttgagaattatacagtatggtggttatttgtctgtttgtctggttgtagctcctaccattgctgctctcagtccgtgtatgtgtaaaagaaaaactaaaacaaaaacaaaaacaaaactaaaacccagactctaaaacagagctatctgcaagcactccctctcactcccttcatctcaaaatttcctttcctttcaaacgaattgattctacttcctagatcccctgagaagatgcccttgctatcaaacccacagggaaaaaacaattctaactgaaagaaaaccctattttgcaatttcccaggagttgaagaggatcccacattttaaatctatgtcacagaaaatgcagtttgtctagggtataaataaccaccggcaactttggagacaggtctgacgctctcacacattttcaagtatattttctggttacagtaaagtaccagttttgtcgcttgcaaaatagaaacagtttgttgatgactaagagtattgttcatttgtggttttattctgggaattttacttcttatatatcaaagtgcaacatttatataccaaacacaccatgagaacctctttacaatgtattgttattgaaagacaggaagcttccttttagcttcagctttattcagatgcatcaagaggtttgttgcctgcaggtcggtggtggcacacgcctttaatcccagcactagggaggcagaggcaggccagcctggtctacagagtcagttccaggacagccagggctacacggagaaaccctgccttccctggtacatttttttttttttttaatttatatgagtacactatagctgttttcacacataccagaagaggacatcagatctcattacagatggttgtgagccatcatgtggttgctgggaactgaactcaggacctctggaagagcagtcagtactctcttaaccacttagccatctctccagcccctgtaataattgttaattgaatggatatattttaagtaaattacataatactttgtagacatttgatagactacagcatgaaatggcatgcttggaatctctacattacaccttcagttttcctgtgttcttaactgtatcataactcagtgtgtttagcaagtggcttccaagaataattttgagaattccgaaacagctgtaatggtgaccatctgcatacattgaggtctgtctttgaaaatacagtgaatagaggaagactgctgggctacacacacacacaaatatgcatacattcatttacgcacacgagagagagagagagagagagagagagagagagagagagagagagagaatttaaaaacactgacattcttagataaagaaatggaacatttaaactatttaaactgactattcctagatctagtggtaaaaattctgtactatttctgtgaagcacgtactgggcgatttaacagaatttttcatcgggcaataagctgataacctcagccatattatgaagaatattctcagaggtctcagggataccaaattacctttagattctatgacctaggccctaaacagatacagaacgaatagtgcaattaacttctgcccttcaaaagctctgagtgtacggactacaaagtgagttc

SEQ ID NO: 621 - DNA, 2250 bp, Mus musculus
cagtactagtaagaattaaaatgggaacctctaaggggtggaacacaagataaaaatagagagggttcaggtttttttgttcttttcatcatgagttagagggcgctgatgttaacttttgatgtcgttggatatttaggaagcaaaacatcggatttaatgaaaaaatagcattcaaattagtagtagtaagaggaggaggaggaagaggaggaggaggaggaagaggaggaggaggaggaggagactattttgaggattcaacctagagttagctcaacaaatgttagaaaatttttggagacctaaccctgccttgaagaggggaggtgggactagatcttctatgacaccttttttttttcttttttttttcttttttttttttcttttgctatgaagtgcacatttatttgacggagaaaaatagcaaggagcccctagactctagagccaatgagcccgagtactcaggggtggggttgggaggggggagaaggggcgctgtttctcagagaagcagcaggatatcaggggaaagtgtgactgttctcatagcttttatcattaggcaaatgtaaaaggcccaacaagtgctaaggaccaactctgtctggaactaaaacgcagtttctatttctgccttcccaccctgttggactgttcaaatgtgcaaggagctcaccagcacaggcagcttcacacgcgtcagggacttctgttgagtcccacatattaggcagatgtgtgtgtgaatgggattgtaaataaatagcagggtagaaggtgaaacagacaacggtcatggttccatcagccaagacaccagcccatactcaggctgtgtggttcaagtgcacgccagctggcctcccttggaccatcagcaaggcaccaaaggctcctttgcacacttgaggaatcaaatggggacagtgagacctacgcagtgtaattaagtcctcagttacacagagctgagcaaattatttccttagtcagtgtgctgctaggtggctaagaggcaaaagctgcgtttgtttttctgttctgtggggtgctgctttattttggggcaggtagttgctaaggacagttttgactgaagcaaggccagagcagtgttagtgaaggggggaaggagaagagacatggaaagtgaagggctgttgctatgacacctttcaattctagcattctgcaacacaatttcagctcactaaagggaaaaatcataaaagaatgaaaccctgttctttacatcaacaaaagtaatcctggagttaagttaaaggactcagcgcaggcgcacaaaaacaggcactgataagaggaagctgaaaagctgacctatggaaactgacgaggaagggagaaagaatgtaatgactgccaaactgcagttggaaaggccgagctagcttcagtattctgccgtgcagtgggtggctctggttaataatatctcactgtatatttctaaaatgctagaagagggaaccgggtgctcccaactcagagaaataataaatgtctgagatgctgaaaatgataattgattagataaagttattacacagtgtatacatgcacagcaagagcacactatgccctatacaaatatgcaaaactatcatgaggcagttaaaaagataaaacttaagaaggatccaggaaagaccttgaggcacaaaagaaaacaaaaaatacctgaacctggaaaaagtagaagaaattcaaaggaaagctctaaaaattaaatataacaaaagaaagaaatgagtaaatcaaaaaaaaattgtggccacatttttcctgatgtataatgctgtgtttatcaaaacgaagtgaatgacagatgtttgactatctgcatggtgtgctgaatatgagaaatgcttacctgttgcatcttcacaccttccattaagaagtcaaatcttgtcttcctgggggataagtagataggtttcatatatatagtattagccaattaaaagcattgtatttttataataattccattcaggtcaaccacttgaaaaaaactacatacatttatgacttaagagcaatatctacagaataatatgtattaaattaagatatggagatagatcagacatcatcttccatttatggagacaaagtgagtcttagtttgaatgctaactagaactaggaaaaaaaacagaagtctattttaagctgacagtatttcattttatacttcccataggcagtgcttcg

SEQ ID NO: 622 - DNA, 2925 bp, Mus musculus
gtcccttctcccaggcgacgccagattctgtcaagttgacaattaactccaaccttcactctttttgatagaaagaaaacatccacttcccatttgattgaccacagcagttcatatagatctacttcttttgcctgggcagttaagtgcagtattctcccattccaggaagcagggtacaccatcaacaaacggcatggtcacaaaagctttcagaaaaaatgtaaaataaataaaactgcttttcctttccaggcctttctccaagaataagactctgagactaattatttattaataaatgtctttgctacgagccttgactcattctctgactagcttgtaacttatttaacccatccaaactattttatatcttccacacagcctgtaacctctccttctgtcctgacctctttcttcctcagtgtctcccctagcatctccccttattcactcctttatatctctcctatttcccagaatcctctctcttcctgccattgtcccacctcctttttcctgcttcagctcattggccatcggcattttattgacaggtgttgcttataagagattctctctagaaataaattcatgttaaattttgatataagtatatattgatattaaatttctaacatgggccaggctgtggtgatgcatgcctttaatcccagcacttgggaggcagaggcaggcagatttctgagttcaaggccagcctggtctacagagtgagttccaggacagccaggtctatgcagagaaaccctgtctcgaaaaacaaaaacaaacaaacaaaaaattctaatatggaacagtgacacctttaagtgttcactggacatgttcctagagtacagaaaatatatagctgttctaaagatggttctgtttctgttacacacattgctgaattgtaatatctttgttttctttcagaaggtccctttactcaggggtcttacagacttaggctccaatggctttgaggtgtccctcaactcctttcagaacccaggcacttgcttatattgcaaagccctttgtggtctcctcctctaatgtaccttgaacatggaagcttacctactttaattattatttggtaaccactgtttgaagaaggagataaggtagatttaaatgttaccagcacaagtatgttgagaaaataaaggatggaaaaattatcctgatggtgcattttgtatgtcctctaaattgtgcccacttatataatccataaaaaaaactgaaaattagaacttagacttttaattcaaaaggggtaggtctcttggtactgttatatgagattgtttttgaaaacagtgaggtgtaaattagctctcaggtatcagtttgaacaagtctgagaggcgaaagggaagaagattggttagaaaaaaaattcttaggcagagaaggaagtgttagctggagtttgaagacaagagaaacattagctgtcctaaaatgcaaattgtgtgcagtgattacaattaataatccatcagataaaaatggaacaaaaccatctggacctctattctgaagttttaccagaactggtgatttttttttaaacgttggctttaaattttgtgcttctttcaacacagcacagggatctcacaaggtgtgcccctgtcttacactgcctggcagtgcacctgcgtgccctgtgaaaaatgcactctcacaatcaaaatattttccttcaggtttcctggggcgagcagttctgcaattttccaataattgttttagaaagtcagccctggattcgggttttctcttaaacctttccctgcctgtggctccagactcctttttgcagggtctctctaaggaaactgggtcgggttggagtggccagtaccacctacccattgggagctggtgctgctatgaatggacccttctctgtgcaggtccagagtctctccctttccacagttgtgctaagggaagagaattcatgagcattggatcacacagtgtgaactgctgaggtggcctttcaaatggacacatttctcttgttcacaacccgggaatgatgaaggtctatacacatacagaattacttataggtaataagttagtaattatttagtatattatacaaatttttcctgtttcttgttgaccctcagtgaaaactagaggagttgaatagctatatacaagttgactcttttttattcttctatcttgctaacgggtaaatggaagctctatgtggctggtcagttcacacggtagaaaaatactggaatctttcctttagacacaagttctatgttactgtcttatgtggtgcttgctagtatgctagttttatggtttagtaacatggaaacagtaatagtaattggggtgtaaccccttccacagttccgagcacagattaaggtttactacaaagctacttgtgtgctttaccgccctctgccggtgaagcctcctgcagttctcaactgttgtttctgcaccccaacccccacggttccaaacacagtgagatgctcttttatgaaattgttctgggtggtgctttactaaggaaaatgtgagaataaaaacaaaacaaaacaaaacaaaacaaaacaaaataaaacaaagcaaaacaaaacaaaacaaaacaaaacggtacagcttgtctatgtagcaaagattgatagatctctgtgaaagagccccattctcttggggactatcatttacctacttcctgcctggcccttgccttacagttgctcagctattctgttaagtatacttaaaaagggtaagtaagtaagcatccatgtccaaaacataacggtgagggaggcagccataggacgagattggtatacacgaagatgcttgggccctggaaggagtagctcagaacaccactctggagccaaa

SEQ ID NO: 623 - DNA, 2000 bp, Mus musculus
tgtttagtttaggtattgctaacttgtggtattaaccttctgacaagcttgtagtattgtttgattggcatttatttttgatttgtaaccatttagtagttcccagctagctatcagtgcagattttaccccatgggtaggagtctatcttcacaccacataacaaagcacactaatcctgacaccacgatgggaaatatgaaccaaaatatgaaagaaagaaagaaagaaagaaagaaagaaagaaagaaagaaagaaagaaagaaagaaagaaagaaagaaagaaagaaagaaagggaaagagaaaactttacactaggaagaactttacactaggaagccgaacaagcaatctccttttctatttgcatgttcccccatggactggctgtggcaatgtaacaactgtacgatgttttcaaataaaaataaatgctttacgaaagcaccacactgccgcctctctcgtgtgtttgtctgcactgtgacagccatgatgccagttccctcgagatgctagaaatagcaagaacagcagagaaatgagcacaggtccaaataaaaacaagagagaaaatagttccaaattaggaacagcagagtctcttaactatagtttcaaaaagtcaaattagacacattggccatttaatttagaatattaaagaaggctgtgggtatacaactttcttttttaaatttatttttattggctattttatttatttacatttcaaatgttatctcctttcccagtttcctctccagaagtcccctattccattccccccctcccccacctacccactcactcccacctcactaccctggcattcccctaccctgggactccagccttcacaggactaagggcctctcctcccattgatggtcgacaaggccatcctctgctacatatgcagctggagtcatgggtccctctatgtgttgtactctttggttggtggttttgtccctgggagctctggagctctggttgggtgatattgttgttcttcctatggagttgcaaaccccttcagctccttcagtcctttctctaactcctccactggggaccctgtactcagttcaatggttggctgtgagcatccacctcagtatttgtcaggctctggcagagcctctcaggagacagctatatcaggctcctgttagcaagcagttcttagcatccacaatagtgtctgggtttggtgtctgtatatgggatggatacccaagtgggggtctctggatgacctttcctttagtctctgttccatatttcctttcatgagtattttgttccaccttctaagaaggactgaagcatccacactttggtcttccttcttcttgagcttcatgtggggaatacaacttacaattccacaaggacaacttatgcaggatagtggaaagctaccagtgagaaatagtttcttatgaagaaaaaaattctgggtacactgctctagatataacagcaggcctaaccatgagtattcttttaaactagggcatccatgaggctagagtatccagattcttgctcataacttacagagaacctaacacttacctctccccaggtaacttctttcaaccttctacccacgaagcatccagagtagacattatatgtatttactttgtacatccttagcagttgtgttcacaatcagtcacttaaagataaatcaagatgacttcgtgtttgacctatatagtcacatgtattcattcattcattcgttcgttcattcaatcaatcattcactttacatccagatcactgccccctccaggtcttgcttccacagtccctctccttctctgagagggtagaggctactcctctaagtatcccctaccccggcacatcaagtctctgtggggctaggtgcatcctttcgcactgaggccagacaaggcatcctaggtagaaaaacatattccacagacaagcaacagctttagggataactcctgctcc

SEQ ID NO: 624 - DNA, 5025 bp, Mus musculus
taaagatttggactaatttaataaaaaattgccccaaaatggtggaattggtttttgtcgggtgaatctcaggattaatcatttatttcctaggtgattctgacagaattagccttccccgtgactaacgctcaccgagttttagggagcctcctcacaaaggatctggcaccccattctacagatgaagcaactgaggcctttagagatgtgccatccacccatagtcacaaggcatcagcgacagagcagcctggaccctgtgaccacagtccccacacagccagagtcacaagaaattgccatgacttctggccttcacctatgttcaccctctccagttcaaaaacggggacactgccaaggaaaaggtgctgtgccttttacgcacctttatgacaacacccatgcttctgataccctctctccaggctcaagagtctctgaggctgcttagaagtaaaggaaaatgtcaagaatattaaattcataattgagtaagacctggggaaaatcgttaagtcagtttcgtatttcccaagtggttcatcgacattttgaagacatgtcaaattctttggcctgaactttctctgtgtgcagataaagagagagatgtctagctgggcgtggtggtgtatgtctccaatcccagcgcttggggaagctgaggcaggagcattgcgtggagttcaaggtcagcctgggggctacagagtgagggtatgggataactgtaccaaggccgactgggaggagcactgtagtgccagcgatagagtctgacaccctgtcacaccatgatgttgggagggtcatcccaggctaagaatccaagacacaggtgagctttcacagatgtgtgcggttgcaggggtcaaggaatctgctcacttgactgtgcctcgtgccaattcccttgcagatacagaggcctaggtacctttgtagcataaaattgtattcttgaggttgacctcaaactcgggatcctcttgctgcagcttcctggatgctgggactccgggtatgtgcagaccccacagtaaggatggctttgagcagagtctgtggaaggcactgaatacaatgagtgagaccctgaggctaagcccttgcacagcctccaaaggctcccaaggagtttattgtcaccatggagattccagtgcaagtctacaacttcaggaggcaaaagaagtgtgagcctgcactgcgtgatgtctggacttagcagccagcttctaagaaaggacagtggggaggaactccataatcccacggtggaggaacctagagggtgtcatcacacaggtcctcaagggcaagtcttctctatggtggatccatgatggaatagcaatgcctgagggggggggaatctctgtctggaaatattatataactggcatcacagcgtgttgcttttcagactgtgttctttttgttttttgtttttaaaagatttatttattatatgtaagtatactgtttctgtcttcagacacaccagaagaggcatcagatctcattacagatggttgtgagccaccatgtggttgctgggatttgaactcaggaccttcagaagagcagtcagtgctcttaactgctgagccatctctccagcccccagactgtattctttctctcatccatattcatttaagtttccgctttgatttagtttttaaaagctaaatggtttactattcttttgtctttgtgcaccaaagcttatcagttcccctactaaaggtcatattgattgcttaaaagtttgggcagttataaataaagctgctttgtatctctttctctgcatttttgtgtacagacagttaattgtctcatagagttaaaatacgagaagcagtgtagttgctggggtaggagaatgcagtttatttttttaaaaaacctgctaatttgtcttctgtagcagaggtcccagggttttttgtttgtttgtttgtttgattgtttgtttgtttccatgccaacaatcagccaatgaacagtcctgttgctccagccctagccagcactagctgctattagagttgcagttccgatcatttgcaaagatgtgtctctggatgttggcttcagtggtagtcctctcaaagcctgaacttctttgtatatcctgacagtcggtctatctctagttttctccagcttgggacttttacccgtttctaactgtaggagttgctccctttggtgttcccagatttcctcctattttaggacaggagagctctcccagacactcgcttacacagacagcctccaagcctgtggtttgttcactttctgggcagcatctattgcagatgtaagggatacattcttctggtccattctcattgtgaggtgtgtttagagctcattggagaatcacagagaagcaggaggcactagctagcctcctgtctttcctaactggaggatggagcctgcttgtctaagcattctcaattcatcccagggttgaagagtttcagccagtctgctgtgttactgagcccatgtatcagaaagggaggaaatctcaggctccaggatgtacattaaataagtcttcatgtttgtgggggctataggaagcaccaggaagattgaaccacagccaatgaggagcttagagagcaggaaatgggctataaagaaagcaaaacaaacaaacaaacagaaaaaatacccactgttttgcaccagatcagcacaccagcctctttcccttttctcttggttgattctggatttttccaggttgcaagacaaactgttttgctttgactacagtgagtctgcagtgctcttattatgaagtgaggatcattgtttcacacaacagagcttttcatttgaagtccagtttatcacctttttttttcttctgccaggaatcctaccttggggtgacaaatctaacatgtctttcttgctcaaagggtcatatgagttctttcttggaccttaggctgcctccaaacttgctgtgaagccaaggatagcttgaacctctccctctccctctccctctctctctctctctctctctccctctctctctcagacacacacacacacacacacacacacacacacacacacacacacacctgcctccacctcctgacctcgaggatcacatgcatgtgccactctgctcaggtttatgtgatgttggggattgaacccagagcctacccacagggctacttccctgatcctattttgcttctctgaggcaggctcttatataacccatactggctttgaactcactatatagctaaggatgactctacattctcctgtctcttgtctcccaagtgttagactgcaggctttatgccttgatggggcccagtgtgaggaccctataacctaggcaggcattaccagctgaactggaaccccagccctctagttactctgtgtgggacatgcaatgtctgccttcagacacatcatttgcatgcgccatgcccttcatttcagcatattttgttgagtaagtgttatttgctctagcctcacagacattaattctgtgtctctcaagggcatccctgcccagaacccccacgtcccccaaatgccagctcacctgcagcaccattctgacaaggaagggccctgccctgaccagaagtcttggtaggcagaccaagaatggcgaggatacatgagccaggcaaatcctcaggatgaggggcagcgccaagtgcttgattggcctgggaactgaaggcaagaggttctctttgcagggaaaccaaagggtggccaatctccagagcaatgggaggaggcctgatgcacacccccttatggccattgaaatgacacgcttctagtgatgagttcaaggcaggggtgggccgtctgcaatcagatctcagctattcacccactcacacccagcttctctggtgtgtgggcgacgcttatcagaccacaccaggcctggccaattagactctctagttgttacagtcccttgtgaggtttaatgtggggcatccagctctccagtggcccgggggggacggaagcccaggaattgctctttgggtaagcagagcccctgcagggcttgcttatggccatacctgtacagcaccatggacagggcccaggtcacgggctgatgtgggcaagatctgagactcccagccttcctatcatggctggctcacaacgtccacaccatcagccaggcaccctgttggcccatctccagccccatattgcctttctgtagaggtccagggagaaaactgaactttaatgacctcccctgcaaaatgggcccagacacacctttcccactggcctgtgagaggtgatgcaggaactcagcaaattgactgttgcaggtcgtgcagttctggatagatgggtctcccaataccacgactagtggcccaccctgtggtatatgaccagagaagccctgttcccactcacacactgctctacccagagcctgggtggaaagatgaggctgagggaggaatgccagaaagcttactactgtggctctgcctctaccagccatattgctctgcatcactcttgcccaagaaagggcaccaagcccagagagggctggcaataaaggcaaagtcacccagcaactcattgactcccagcggggatgcttctcgaaggagcgagccctcactctggccaaagtccttcctcgtctctgatgctttgtaaccacagagtatgacatgctcttgtgcatccaggctggacacagtgtccccagggcatgttgatcatttttctttctgtcttgttgagaattgaatgcttagctaaaatacaacaaatcctgcaatcagaaggacaggcactgtatgggcctctgtgtacagagcactccactctgtgaatgcccacaagcaaactctccgacacttgacaaatgcagttaccaccacgttcacgtgctcaaatgctcacttggtatttgggactcgtggttctgcaccagcaatg

SEQ ID NO: 625 - DNA, 2700 bp, Mus musculus
tctccaaccccttggtctctttttgattttttttttctttgattttttgagacagggtctctctgtgtagcctggctgtcctggaactcactttgtagaccaggctggcctcaaactcagaaatccacctgcctctgcctcccaggtgctgggattaaaggcgtgcaccaccatgcccggctctctttttgattttattttgtgtgtggatgcttatgcacgcacacattcatgcatgcatgtatacatttttttcatgtatgtgtgagtgtatgcataggtgcggaggcctgaggttgacatctcctgctttagccacctgagtagctgggatgacaagtctgtgcttcccaggccagctcaccgaagtgtttccttagctctctccaatcagccctaggtgccaggtcatgacatcacatgtttagaagctgctcttccattatttgcaatatgagcatttttgttgttttctctgatgccaggacctgcactttggccctgggatccttgactaaggatgcctcgtgactagggcatctgtaaagcaacctcttccccctttctttaaaggacagatgttcgtacagtaaagctgggatcaggttgggttctctagcactacggatgcagagcagaacctcagggagatgctcttttgatccagcactggagggtgtgtgtggaacttgtctcagacggaggcctctacgggtgagcagtctcaggctgtaaacatcctaaacatccaggaaggagttgctagtcttttcatacattggtcagtccatcataaacactctggaaccaagcctagtggcactcacgttaaatcctagcacttgggaggcagaggcaagcagatctctaagtctgaggccagcctggtctacagagtgagttccaggatagccagggctacacagagaaaccctgtctcaaaaaaaaaaaaaacacaacaagaaaaaaaagggggggatcatattctgattcgtgaggaatgtgctggcattcctcttgagcctggccaatatgacatggctttgccaatgtcctgtaggtccaagctttggagcctgcacatggctatgcccatgtaggcaatattcatttactcagaacttcactccctccgtgcgtcctctgctccctacaccttgattagattcagttgagccattgagggagagcagcatggatccgtgggcaaggcacagatgagagccgagccttttgctcgattgcttaggtaactgctgtctctaggctgtgaagccagcacttccccctttctaattatgaagtaccctacggggtgatcctctgagaccatgcaaatgtcatggctcgttatatttttgtaccgacttcatagtgttgccacccacaacactgcttctcatcctgttccctcttaatgacattcacatcctctgtatttactaattggctctctgcttcctggcgtttaatccaacatgattgtttattttgttgcttaaactgctctaggtctggcaattgcaattggaagctcacagccgctggcttctgtgtccttcccatatacagccatcatgtttggagtatttccttccttcttcattccacagaatgttctagatcatctcacaattttcttacaccagccctggaattaactagttcttttaaaagccttgtttcctttgattggcctgcactatttagttctattttatgcgcatgcgaattctactcgcatgcctggtgcccacagaggtcagaagagggcatcagagctcctggagctagagagttatggatgttgaaagccaccatacggatgctggggactgaaccagagtcctctgcaagagcaaccagttgtcttagctgctgagccatctccacaggccaaggagtagagtatttacaagcaaaggtctgacttcctgagggtgcttatcagggttagagtggcttgattctagactctgaagggacagagctgggacatgcatgcaaattgccatagagttctttgacacatgtcttttgttgttgttgttgagacagggtctcacatgtagccttggtttccctggaactcactatgtaacccaggctgacctgaaactcaacagagatctgtcttcctctgtttcccaaatgctgagattaaagacatgtatcaccacacccagctccgtcttcgctcctgtgtctggccatgtgcctgtatttcagaaactgtgctccatactaatacttcagattccaatccagtctcagaaaatgtattttagctcctcccttttttgtagctttcttctcagtgagaacaaaaatctttgtttatccacagcctgtttatttatctgtttggtccacttcagtatacaggtgtgataataatatatacgctgtggatatgtgataatgatgattgggtaataacagagctacttcgaggaaggaacggcctccctcctgggctggataataggctccagacatcaggcagggctagatgacctgaaggtcattgacacaatcagctgtcaactaaaggccatcttcctaaaagtagtgttcacacgctggttggctcctcggtcacagtcacagagacctcacaagccctcacagcacgaggatcaatgagcggtgtttccaggagacattggttatatggcaggtgctatgcattttgttgat

SEQ ID NO: 626 - DNA, 2775 bp, Mus musculus
caagatgtgggtccatttccacaaagaggcaagctggcttggctccgagtctagcttctgttttcaggaactcaaacgcatgaccttcatgcactgcctacatacacactcatcgggaaagaacgaacggtcttacactgtagaagttcaaatgcaaacgactaggaactgtaacagtccagggggttaatgtcatttccatcttcccagatcgtttcccagcctactttttctaccacactgtaattacaggaaactctcttccctaatgccacgtggttctgatgaggctgccattcataatgtctctcctgcccctggtttccagagaaactgagtcataagacctaagctgactaatcacaagtctctaaacctacaaccacagtgattggtcccacacctgggcatatagtactaacttggagaattagaattcactatcaagtttttaaatatgatattatcactgaaagaacttctgtacttcatagactgcagtcgtcaaaggcttaggatagggacctgtgtgagatagttccaagtatgtcttccaaatgcttcctacgcaacatccttcctcttcggtttgtattcattctatgactacctcaaacacacacacacaattttacaggggagagatactgaaaagagtttacaccaaaatataaaaatataaacggtgcagtgcgctgtgataaactactctgataagcaacttaaggaaccaaggggctcacagttcccgaggtttatagtccatcacaacgtggaagacaatttgtcaggaaccagccggaacaggaagtgggccaggctacggagcctcaaggcccacccccagcggcccatttcctccagcaagcttcgcctcctaagtggtccccatccttttcaaagagaatcaccagcaagggaccaaatgaaacacaagagactatggggggtatttcacaagcaacctccaacggagggtctgtttaaggggcaatacttaatgtaaaggcatgactctctatgatggtgggatttcaaaacccggaccgtttagggtaggggaaaaaaaaaaaaaaaaaaaaaaaaactatgcagaagcagagaattctgctcatttcctcacaaatcacagtacgtaaataattttttattaaatttacaatcccacctatttaagctcctggaagaggaacagcgtctaaatataaagccatccattaacctgaattttcatcgaagactttaattcactcctctccatcctgtgctgagaacagcagctaatcgcctcacgttctatttatagaagctgtttaccagtttcttgtcttctcattcttcatagatcaggagccctggttgcattacagggaacgcttcaggagaagctagatgctttgtgtaaagtgatattttaatcattcattcctttggaaatttattttaaaaaaaaatcccagctgcctcgaacacatggaatttaatgccttgtgaatagattggtccaagtggccacattctaaaaagaaattagcctgtgctatatcggtcagagaaccgtgttatgcttagcacctgccatccacacatgcctgggatacagacaatgccccacacacctgctgttgccagtatggaccaaggctgcatacactcctcactgactaacaacacaacagtactgacagacgaggttctagtagactcttacacggcaccagtggtaagaagccgggcgtggtggcacacacctttaatcccagcacttgggaggcagaggcaagtggatttctgagttcgaagccagcctggtctacagagtgagttccaggacagccagggctacacagagaaatcctgtctcaaaaaacaaaaaagaaaaggaaaagaaagaagaaacaatcagagactgctgcagagattcctaagtataacgtctattgaagctgttctgccagttgccatggctctgctcaggtgcctgcccttgactgagcaacgctattcacacggccagagagaacagcctggaactcacagcaggtgtgcagccggcttatcagggtttcttttcctgcacaaaacatcatgaccaagaagcaagttgggggggggggggtggcagtcgtggtggcgcacgcctttaatcccagcactcgggaggcagaggcaggcggatttctgagttcgaggccagcctggtctacagcgtgagttccaggacagccagggctatacagagaaaccctatctcaaaaaacaaaaaacaaacaaacaaaaaaagactgccaaagcctcagactctgaccctaacagctaagaacaaacaagtagactgtattcctcgataaaagagtcctgggcttcatgatatcacctgaaatagacacacagaaccaccccatcctaccaggaaatactaacgtccactgaagttacgttagatagtttgatattcggctttagacttttggctaagattacaaactgatatcgaaagctacaagatgtatggtaaacacagcaccatttctagccaattaagaaatctactcagggattgagcaccccgaaggggacaggaacacaggaagaccaaccgagtcgattaacttggacccttgggggctctcagagactgggccactaaccaaagatcatacatgggctggaccaaggcccctggcatatatgcagcagatgtcttcatcctcagtcttcaagaaggtccccaacaactggatcaggaactatccctccagctgttacctgtct

SEQ ID NO: 627 - DNA, 1725 bp, Mus musculus
ctgtcttctgcaggcagccatgaggggagtctcattccactggccagacttgagtgtgtgtgtgtgtgtgtgtgtgtgtgtgtgtgtatgacctcaaagccccacctccacagcgatgcacttcctctaataaggccacaccttttgcaataaggccacacctccaaacagccatttcccatgggccaagcctattcaacaccacacttggctttctaattctcattaaatttcacctctgcacctgaagctctcaaatttagatattcattgtcttctggctcaacacctaccttcctgcccaataatggcaattaaatggaattgatccaaactagagcccgtatctaatcctccttcgccacccatccccccgtggaattagttagtgattccatttttctagttgcttgcacagaaagcctgggtgttcttccaatgctgcgttcacactgagtcagctttgagaaggtgttaatatgtcacctccttccgcactgccccgggcctgcatctgccctagttgatatttctgtttgcattttagacactcccccccccccccaaacaacagccacagggaccggttcattctggtaggactcagaccttagcagctgcctctacccgaaacccaccaacccaccgtgctcacttcaagtatcactcagagaaagatccagtagtatctttgtcccacgagttagtgctgtgtgtagcttctgctccctgctggcccagttggacatccagtattactgagagtctatcccactgctggccagttggacatcaagcatcaccatgagtccgccccctgctggccagttggatatccagcatcactgtgagtctgccccctgctggccagttgggcatccagcatcaccacccttctcactacattccaaccaatcactgcatgggcagctgagccactgggcctgagctcccatggtttttgtgactgagttatcccttctctgctcatgtctccacacaaatatgacttgtgtacaaggggcttcctcttctctgctcatccaaaatagcctttttccaccttaatcctccttctgggccttacctagcatctcgtacctattataattggatatttttttgatttttttttccttgaaagagagcactcctccaccctccattgcttactgtagcctcggtgacacaggcagacaactctagctcactgtcagtcatctttctccaaaagataacagattctgcatccagtggcggataggaagtctgtttcattttctttcataagggaagaacgatattgcttttatccacttaaaacacttgatagttctccaaaatgtagttccaggaaccaagtgaacatctggggagggtgctcctatattataccttgttatcacacagctggcgacgtgttgacaggcagttctgggtgccgttccggcgttccttgtgccgtggagcgcctcagttattttggttcattctccagtcttctccagcacttcctcagttttgcaggggaatgggggtgcacatagatgttaggagaaaataaaaggttgattgtgaaaggctctgtggaaacgtgcatggtgtgtgtcagggatagccgaggttagcccacatggaacaggcagtgctagcagagggtagcccacatggaacaggcagtgctagcagagggtagcccacatggaacaggcaatgctagccgag

SEQ ID NO: 628 - DNA, 3825 bp, Mus musculus
tttatgggattgtggataccttggtcttcatcctaaggatggtgcattggtcttctggagatgctgtgataagagatatagccttggtagcctacacaatgaaaatttattcttacaactccagagctgtggttctcaaccttcctaacgctgcgatcctttaatacagttcctcatgttgtggtgaccctcaaccgtcaaattatttcattgcaacttcctaactctaattttgctactgttatgaattgtagtgtaaatatctgatatgctggatatcaaatgtatggacccccaaaggggtcactacccacaggttgagaaccactgctccagtggtaaactttcaagatcgtggtgtctacggtcaagtatttttctttctcctggattcatggatgggcccctggtctctgtcttctcatatggtctttcctcagtagtctgttgtctgtgtggtacattccttttaggatactactagtcacactgaagagggctaatccagatgaacccatttaaacctgagaaacatcatcctagtcctgtttctaaatatagccatcttttgagcttcgggactcagcactggatattttggaggtgtaatctggcctctagcagagaatgaagctgtgattccttcaatgcaaggatagcctgggatctgtggaccagtagatgatcctgactgttagatggataaatgcttgaagttctgcccctgaagccccacccctaaggccccaccccctggagccccactcccagcccccggtaaggagagttgctgtggtgctctttaattttcattgtctacttaattggtttgaaaatcatgtagcagatttctaaagcaccttgtggggtgtgtgtgtgtgtgtgtgtgtgtgtgtgtgaatgtgtatatgataggatttccagagatagttaaatctggaggcctgaagaatggattaatctgtggaagtattcattacgtccggaccttactgggaggtgtccaaggaggaatcttgctgcaggagatcactgcagacatgccctgactcttcctgcagtctgtctttttttttttttccctccagtttcctgcccttcacgaagtgaataactttgttctccatacccttgctgcgtgatggtctgctgaaatgcacgggtctctatacacgtgaaccgaacgctctgaaggccagaagcaaattaaagagttcctctctttaagccgactttctcaggtacttggtcacagcaacagaaagtctgattaatgtaggtggagaaagggtgaaaatgtaggggaaggagtttgctttccccaccaccttggatctacatacaaaagtatacagaaggaagaagtaagagagacccagattttttccaccaaagactctttctgggttttcccccaggtctgagtctacttatagctccttagttttcccatctggtaagtgggaaaaccaaacgcaggattgtatggctccccacaggacacacttctatgtcactttattgcagagatttgtacaaatatagacttggttatttcctcctctaagaacaacaacaactacaacagtaaaaaagcccttctatactgtacttacagacttatattttccaggtatcagaaagccacggtttgggtctgagatacttactcatttatgatctgagattattctaaaaaggctttgcagctttgtctaattgggtaattgggatgttgccagatgaaattcaacttgtattttttttaaatgctttgaagaactggttgccatggcagtgctctgcagacaagatccctcactggctgccacaaagcagcaataatgggcttctgtttattgtgagtttcaggttaccccacctgaagacccttcagggacggatctgggtgtgggaacccttaggaattactggagacctgcctcagctgtccaggggatttatcttagccaatatggtggattgtcactggaagggtgggagggctgctgctctacagggacttcccagaactcttcactcctagcagttaaggaagaaaccactgtgcgcctgccacaatataaacttgtaattgctttaggatatgaatatgagtcctttcatatctgtgggaatataggtgtctggaaggacaaaatggttttaagaagtagcagggtcttaaaagttaatacaactgcgacagtgttataattgtacatttgagttgtcctttgttctaaattgattccccgccccccccccctccccacagtggacacgatcattcccatcatccttcagcctcctttactcaagtgtttattgtaagaatacgaaacagctctcccagattttttttttttttttttttctggttcctcttcagtcatgtcaatatttaccttggacaatgctttgtatccttttatttataattccagaattctccaagacaaactgattattcgtgactcgctggcctcagtcacagtttaaacatagctcaggttgacgctgaggaacccaagcctcccgaacgacttcctctatttctctccacagatcgcctgcccatacagttccataatcttttcacaactcttgttctttctcatcgctcatgtcttccaagaatgtctttttttttttcctgctggaatcttagcttgcaaacactttcttttaaaaaactccagggtctcctttctcgttggtgatgtttttaacttggcatgctgtatacacactctgaacacttccagtgtttctcaactgtcacagctttcctgtgttggtctgttttaattgtcctagaatcaggaacagagcctcagtgagggattaggtcggcctgtgggcatgtttataggagattgtcttagttgtgtgtggtggtttgaatattcttgacctgttgggagtggcactattgggaggtgtggtcttgatggagtaggtgtggccttgttggaggaagtgtgtcagtcactgtgtaggcaggctttgaggtctcctagtgcttaagctctgcccaatgtgaaagagtttctgttctggctgccagatgaagataagaactcttagctccttttccagcatcaagtcagcctgtgtgatgccatgttttctaccttgatgacaatggactgagcctctgaaactgtaagccagtttcaatgaaatgtttgcctttataagagttgtcttggtcatggtgtctcttcacaataactaagacattgagttacctgatgtgggaagagctagcccactgcaggctgcaccattccctaggcagactgtcctgaattgtgtaaaagtagagagactgagcccagaaagcaagcatgcatttacttcctccctgctcttgatcatggatgtggtgtgacttgctgctttgagttgctgctttgacttttcagcagcgaagggctgtaacctggaattatgatttaaaataaaccctttatcatgtaggctgctttttatcagagtatttcattacagaaatgaaactcagactgtttctctgtgaatagctgatcactgttgccaaagagaggtggtccctgtatctgatactgggaagcaaagcttactcttcccagtgttagaagtcctaaaatgataaacagacaagaagctacagtgtgtctctcctgagaggcccatcctgatccaggaatccttgcttaaccacagaaggctttacctactggtgttcctctttctgttccccatatgtctcttacggttacaaattgttttatattccctatgtatttcaaatacattattgcatttgctgcttacaac

SEQ ID NO: 629 - DNA, 1950 bp, Mus musculus
acttttctgttgtttttaatctgtttaagtagttttttttttttaagtaaatttgttcttagacgttctacacatgtacacaatgcctactgacacctacctctaatctaccccatccattctccctcctctccatgaattatcaagttcatgtctattcattgtattttgtgactctctgatattaaccaagctggataagcaaagctggacgaccaaaggttttgagttatccaccagacctgataggcttgtctgagggtttacaactaaaaataacgatttccctttcccccagaatctaaaaaaaaaaaaaaacaaaaaacaaaaaaaacaaaaaacaaaagtaaaggagtaataagtcctgcccccttcatgactgagagctgataggaccagtcttgtggctgcaactttgaaagcaaattcccaggtgctaatgtggaaaatcaagaaccacatagaatagaacagttttgcatctgtagttctttgtgtacatctaaacgtgtaactttatgaacaagagatacctgggataacacagcaacgcatcaatggttaacttgtcttgagtttcggctgcaccgtatttctttaacacgctgatcttctaatgagtacacagccacgctctaatgcgcacacagcgctttccttggcgtaggctctgcgttagttttgaaacagttcagctttacaccagctggcaggatgaaagccgtcttcattcctttgccgagcatctgccaacacggaacctgttccactctgttcccgcttacagggctgcacctgtccagagaggggagacagaaagggacccagccagctgatccagcgcactgcaccgcaccccccaagggagagcaggtgtgtttcttgtgcctccgccttaccctgacttgttaagtgcttagagacaatgttgtgtggttttggccaagggaaagctgcacaaggctgaagacggagcagtaacagccgcagctgtgggcttgctgcaaattaggccaatgttttcttatatttatttacttctgcttgcgctggggatggaactcagcttcctcgtgccaggcaaggcacacgctctacaactgagctacactccttagtcaaagggtttgaagcaagtcagctgcaggcatccttgcgaagacaccagttagtacttatttctgtttaattggattatgtgtaatttttaatttttttcctctcttcctaaatgtatcagggtaatagagctgttacagtgccaagacatagttaacccttagacctttaggaagacaccataacctataagggtaaagtaggggctttccccagttagctcagaggcacctgcttccagagtgctcttggcgcagtgagtgaacgcctgtcaaacgtgcgcaccctgatgcaccccaactgatccctgaggtcagcctttcaagccagctgccagcttagtcagtatctccacttggcaaagctccaatatggcaaagctgtattgaagctaacacagctccgcgcccgaaatctttggaatctccgcccacctgtgtgaacgcccctcccacagcttccctttccttctaagtaggcatctgtcaattacccatttgctcagccagccctttgagaagcacccacggagagtgcgcattcacactgccaacgggtctgcttttgtcggtcttaaaaatacttttgagtattccagccagttcttaaaccttcaggtctgtggtgattcaccttattccatttggagcggccagagcggaacggagattataaatctccacgtataaataacaggaactttctttgtgtccctatgctacatctctactcaaaggaaggcagaaggagaagaaagaaagaaagaaagaaagaaagaaagaaagaaagaaagaaagaaagaaagaaagaaagagggctggtgagatggct

SEQ ID NO: 630 - DNA, 2025 bp, Mus musculus
aaatgccagtgggcatcagtcctggcttcctgattgtgggcacagtgtgaccagccacgacacgtgcctgtgcccatgacatagcctccatgattagacaatattcacctttcgaataagagcccagaaagttcccttctattcttttgaaagatgttattgggggctcgagagatgagtcagtggttaagaacactgactgctcctccagaggccctgaattcagttcccagcaaccacatggtggcttacaaccatctgtaatgggaatccaatgccctcttctagtgtgtctgaagacagctctagtgtactcatataaatgaaaataaataaatctttaaaaaaaaaaacaagaaaaacagttgctgagtgtaattcaagtactcggtttctttaaaaaaaaagatgttcttgataaagcagcaagaatattgattcatagaggcagaagaattgtgagctaaggttggcatggcaaccgtaagtacacttgtctgtacaaagaaaataattttcattttgggatgtgcacaggggtatacatatgtaatcccagaccttggaaaactgaggcaggaggatggaaagtttgaggtcagccaaggctgcatagtaagactccatcccataaaaggaaaaaagcagaaaagaagacagcatgctatttattcgttgtgtcacctgtgggatgccttaagattaacttgccaagtccccactatacagatgagatggctgtcgttcaggtttagcaactgactgaccagaacacttcatctctgaagtccctgtttccctcagccatagaagattctctccccctccccatgggcacagacatcataatgggcacccagattgagccaaacaagacagaagggagcagggacagccttccattggacttcttcccttaattcctctactatgtccccgacatcccaaagacgatcctatctctataaaatgtatatataggatcaggttggttaaggacaggaagttggtttcctggtaaatattattgtgaaaggcattcatttacatattttgctaatcatcttcctgcaggaggcctgtctcttcctcaaacagaggcttctgcgcaggctcatgagagttcagctaagatgacaacaaactaagcctccaggtctgacaccgctgttggggggagggggggcgggcagccatgggagctttctcttagccagtctgagggacctgaaaggaggaaggactggcttgggtctcacattttcctgaggatttgcttgggtggttcgctgactcattcaacattcacggagcttattactgcgtaattaacttcgttagacgactgagggggaatcactggaaatggctttcatccttaattgcacataattctcggtattcctgaaactcctttgggtgggggtggggttaaggaaaaaaatgagagagctgtccctggcaacaatagtgaatgctagaggcaaaatgtacgtttgctgagaaatctagagactatatggagtgactggcccatcccagttaggtttgttcgtgctatttctggcaatagaatcgcttgacaatgtacctcatcttttgtgaacacacagctgtttatacataacattcaatggttactcataaatgttaaattgatcatagtgtgaaaacttaaaacctcagagcccatacgtgtctaccaacagctatcactgagttgtttgtagttaggtatccacctgtcccagcatagtgtctagttgatggggaaggctttgtttggaaaaagaaagaaagactagtcagcaaaagcaatttaagggaagcttgtgtctcttttgtttctcacagagggtaggaagtcatggcaacaagggcatgaaatgactggtcacaataaacagtgggtacaccgttatgaagcccagagttgaatgcctgtgctcagcctgctcttttcccttgatctccattccagtgtgccctgcccatggtacgtgtcttagttagggtgtaactgct

SEQ ID NO: 631 - DNA, 2575 bp, Mus musculus
gatttaaatgttatttaaatatattaacattttaatttaattatatttcgatcacattcttctccttccccaaggtcctccaaaccctctcctcctcctccctgcccatacattcccttttattccatcttgggttggctttgcctttgcatcttctccctgacggtcttggtaaacttaaggaggatttgacagttcatagcacatcctgagctgatggccatgtttttcaatggaataaattcttttatcaacagatcttgcaagtaatgcaccatttctccaaggttttatggaatcatctttattatacatatacttattgttctgaattgctgaatcctttaaatagtcctgcatttccacacagatctgatacaagactctggtaacctgtagactgtgtctcttccttttctttgaattgtgtttatgctccaggtatctgttaacagtcctctaaaataatatacttttccacactgaatttttctgtctggattcataacagagtatttcccctttaaacaagaataaagcaaaaaaaaaaaaaaaaaaaaggtggggtggggtagaggaaggcagttgtagcttctgagagtccttgaaaagaaaaatgtgatgaatttatgatattatcgttggaaaccctgcttttctgactaggataaacatcttcctccaattttaacacctaccttgatgagcttcgagaatagaccaaagaaatcaaggagtgggtgtttcaatgagcttttctcaaggttgcctgactatggcgtttccatggtaaccagcttgccccactagaagtaagttacctgataataacaaggaagatgttgatatttatgtacaatgttcaagacaagagcacacagcttgtggcagcaccagatgtggcagctatgtacattccggagcatggtgccttactgtgctgcagtctgggtgctatagccatgctttaaaatagataatgtatatactctatgtacaagggtcatgtgtactttatatgaaatgtttagaatagcctacaagagatatttcttctttggggatgagaaacaggagactcccagaggtcaaacactgcgactaaaccatgattcaaatctggaggctgctacaaagctcattcaattgtcttccactaaccacattaaagaaatatctctagctattgtaattgtattgtagtcatatgagtatggatgtttaccttcatgtatgtattgcaatatatgtatgtctggcatccctggggtttggaagaaagcacctatttcccctggaactggaatcataggtggttgtgagccaccacatggctgctgggaactgaacctagattctatgtagaagcaatacatgttcgttatcaccaagccacctctccagttccaacagtatgattttttttttaattttcaaaatgtattctcatcctctttaaagtcacaagcagattttttgcactaatatgctgtgtttccccggcaggtcatcgtacagcgctgcttatgtggcaagaacatgtcccacgtgaaggctgcctgcatcctgtgtggctacctgaagctgctgttcatgttccccatggtgatgccgggcatgatctgctgcattctgtacacaggcgagccatggatatatgaatcctcttttctgtgcttgatgtctgtggttttcaagaaaaacttggataggttagaaggagagatggagggaggcgctcctgagacaaggggcagaaagagaacatttggcagacttggcactcttctgaattacttctgtacatgtgccaggctccttgcaaacttctgaaatcgtgcatcccctccccatgagtggatctgatgtaagatagatcagacattccctgggagatgaggtgggactgagcaaggatgagttagctgagctgttgttgctggatatagcaatgtttttaacaaagaaggtcttgtaggtgcatgctcccatcttggtccctctgaaataattgcaaaattacatccccttttcaatacttggaagcatgttgtttggcaaaatatattaatttctaagtgagatgagaataactactgttgagatttctccttgaaattttacctttttttctttactatgaaaagcaaaggaaatacaagcaatctattttgatgaatggaagacacatctttatttttattggtgtgtaatctttaggtcactgtgttttcccaaacaggcagagtggagttcattcaacttccaagtgaccatcagtgaccatgattctttgcatcgttgtagtattcttcataactgtgaagaatgtaggcatagctaagaggcaaggaatagctaaataataactgtattacacacccctttatggaacattaaatatcctgaagactgttcctaagctttgagaaatattgagattattttgttaaatgtagaaatgaagctcgaaaatattgtctcattagtggccaaatgagatatttcttcagtgagccagtccataaaagtcctgccacaaatttataaaaacctgaattcagaaacccaacaa

SEQ ID NO: 632 - DNA, 2675 bp, Mus musculus
ggtaatggcactcctgccatcagaagtccagggtcatcctcagctacacagtgagttcaaggtcagcctgagatacaagagattccatgtattaaaaaagtctcagcaatattggacctgacacctttgctgcctttccttggggatccaatgggtcttggggtccaagtgcctaaaaatagctgtctattgtatttcctaggttttgtatgtgcacacatatatacatgtaagtgcatatgtgcatgcatatatgtgcatatgtgcatgaatgtatgtgcatatgtatgtgcatttacatgcacatgtgcatgcatgtatgtgcagaggccagatgtccacaatatgaatatctttctcaactgctctttgccttattttttgtaaaaagggttcatgtacttggagctcactgattggctggactggctgggtatgagctccaggattctcctctctgcctccatagcactgaaatggcagctgtgcattgccacacccagctttttatgtgggtgctgaggacccaaactcgggtcttcatacttgcccaacaagtgctttgctgagccaactcctcagccccttgttttgattttaattgtgtcaggttgattctggtcctgactcattgtcatggtcagttgcagaaatctgactatttgtggtggagcgcacatcagacctgtgtgcaatggatgggtaactcactgtgacactgcaaacttagtgacacttttctaatcttaaaaaatgtggagggagattctgcaagatggctcagagaataagatgccagaaccaagcctgaggacctaagcttgatcccaggacccacatgatggaaggcaagtgactcttgcaagttgtcttctgacctctgcacatgcactgtcaaactaacatttataacacaactaacacaacattttttttaaatgtacaaaaaaaataaaacttgtaaccaattttctattgttttcttctagtgatttctctcatttaggaaatatatgtcaatatgaatgttacttttttttttaaagctccttttatttccattgaaagtcagtctccgtcagatccaggtgccagggcaaaggatgagactgagccattctgtggctcctgctgccatgtttctttattgtctccagaaagctccgcatgctcctgttgcctgggaacaggggtacatatctctgctggttgctggctccaggcttatctgctttaatttctttcctttagctggaaccgtgagtaacagcacctagaaaatggttcaatttatttttccttcttctgttcataggaaaattgtgcatcttctctctggataatgggtgtctgaatttccttgtgtacaaagtattcctgagcttggatgacagatcaaacagaattacagtgttacaatgtgtgtaacctcgtgacattttgtaggactgtaagatactacatcttgaataactttcatttatgagtgtgtttcttttggccataatgactagattttgttcttggatgggtgttgtatgcagggaactgaccaattcagaacgcaagctagagctggctggtgagcactcaggatcctcctggctctgtctctccagatagaagattataggcacctcactgccaccacatctggcttgttccttagatgctgggatcagaactcagatcctcctgtttgtggcaagcgcgcgatccactgaaccacctcaccagccccagattgtgttctcagtgtttttatgcacaggactccacccttccctcccctccccctcttacattgatgcctctgtttatcaccatctcaactcagtttttaccacagctgtggctcgatttctctctgtatcggcatatgtgctacaggaaatcaccaggtctcagttcttccctttcaacccatgtagactatgactatgttgttaccaccattttcttctgatctagtattgtccccaggacacatcggtatgcaattatcagaggttgggatgtagcgcaatcgacgaagcacttacttagcatgctggaagctctggggtgtatcccagcagcacataaactagacctgctaatgcacgcctgcgatcccagcactggggagttgtgggcaggagggtcagaagttcaaggtcatcttcaactagcacagtgagcttgaggcatctaggttatgatgtctcaaaaagaaaaaaaaaaaaaaaaaaaaaagcaactattgagagcctgctaggaactctggaggatagacatgtggactaacccaggaatcccaactctttacagaatttgcattgtggctttttgtgtttcatagtctgatttataaacatttacattcccttgctggccacgcctctgggaaggttctagaaattttccatttcaggagaacttccttccagtctaagctgttactgatgcccttccccatgacaggccttgcagctgtgggatctagagtcagtgaattatttcagaacctttttattctaagagcaaggtcaacctggcctgggtgtaaagtcaagaggaaggtcaacccagcctttaaaggtcaacctggccagccctagggaatgctggatggcctctcttactccattcccttctctgtaattgaaacttgtttcattcttatgtctcaatgt

SEQ ID NO: 633 - DNA, 2000 bp, Mus musculus
cttccctccatttctttaaaaaataattttaaagatcattgtatttattttatgtgtttgtgtgagtgtgtgtgtgtatttgcaccgtgcttacctggtgccctctaaggtcacagggaggtatggactctccaggaactagagttaaggatgtttgtgtaccatcatgtggatgctgactgggaacagggtctctcttaaccaccaagccctctctccagcctctccctctgtctcttgtgtcttttaaggcccatggcattaactcacaaatcctgttaaacagggaagaggcagtctgtcagaaaatgaaggttttagttgaataaattataaaccaagtttatacagtttagagcaaatggggtttttattttattttttgccactttgaataattctgatcaaggcatttttgacataaattagattagaaatcttgatcccatttattgtaattatacaaacatggttaaaatgctacaggaggtcagacacttatatatgtttttttattgttttatgatctgatcctttttcaggatagtggtttaaaatttcacatttatgtacctatggactctgatatttttgccacagatttccaaacattacacagttatcttaagggaaaaaacatctctgaaaagaagcaggtgtgaaggagtcatagtctctgcaccctagttgttagctgaccgtgttatctggtttctcaatggcaattcctttcctttctgaaaatgaggttcaattgctctacaaccctgctggcacctggggtgaactgtggctgggtccttccccttaccccagccacagctactaaacacacacacacacacacacacacacacacacgcaccacacacacacacacacacacacacacacacacacacacgcacgggtgtgcccgccattttccaataaggcatagctataaggagatgcagactttgggaaggtgacactagccattcccgctgagcctgcttggttgggcaccggcagtgagcccagcagggagaggctcttctggtacccagagcctggtgcaatcagggtgaagcagattgagacttcctgatagctgattgaagtgggtgccgattacacagcatgctgctgggtggttgttgttgtttgtttgtttttgttttaaaaagaatttggctactatgctttgccttccaagcctgctctgtctgcgcagggtgcccccattctctagacactggaacataatgattcggtgactgttagacaaacactggagaaacgactccacaggagacaggagacagggagttgtcttccggttctgtgctgagccatccctgggatgtgtcgttgtccgtccgtccgtccgtccgtccccccccccccccggcagtctgtgatagcgccatgtgctcttcagcaactgtggcctcaagatgggttttctgtattagagattctgcgaatcaaagtttctcccacctctggatgtcccctcccccaccacacaaggaacaagaatccactccctctccggcttcccgtgaatgaaactaaggagaatattatttctttctggtctttcttctagatcctctgctggtttcaactctgaaaactactctttctttgaggcactgattgtttattatttattcgtactaccaaaaaatcctctcgctggttgtttgtttgtttttttataatttaattttaggtgttttgtatgtttaattttagggtggtgtaaaggattttaaattccaaagtatctgtctctgcctgcttgactccctgcctgcttgcctgcctgtctccttctgcacgcatgtaggcacgcacgcactcgcacactttatggagggaactgaacttgcgttcagcctggtcgagtcacatggcattcggtgtcttctccttaattactcacccacttcgtaagcatgccttccctcctttctctggaacactgtgaccattttcatttcctttgagaa

SEQ ID NO: 634 - DNA, 2650 bp, Mus musculus
caactatatttatttcctaagtcccagatctacgtgctacttccgacatcttaactctttccgatgccaaaggcaagattacaatgtaattaaacacctgtggctctgaaataggtttcaagttccggtccagccattggacagctctgtggccttaagagtaggttgtctacgctcggtgaccatcatgtcacctccaggtgcccactttgcctacaagacacttactgcacattggtgtcaggtcgtgaaacagagtggtaggatttaagtgatgtcacgtcgcatctgcgttgtcctgcctttggttcctggccattcaggcagtgtcaggtgtgggctccccctcaggattctttttctcctactgggttgcttcgtccagccttgatatgagggtttgtgcctagtcttattgtaatttgttaagccatctttgctggataaccctgggaggcctgctcttttattgtttttcaacttatttatttattttatgtatatgagcacactgtcactgtcttcagacacaccagaagagagagggcattggatcccattacagatggttgtgagctaccatgtggttgctgggaattaaactaaggacctctagaagaacaatcaatgctcttaactgctgaaccatctctccagtcctgttttgttttgttttgttttgttttgttttgtttttaagggaactggaggaggagtgaatctgggggagggggagaggggactgggaggagaggagggagaggaaactgcagtcagatgtaatatatgagagaagaaaaaaaagaaaaaaaattcagtgaagtaaagcaagcgccatgctgggacctggcagaatttaaagctcagcgataaagaggagtagagggtgtctcccagagcccctgccagggatgagacagaggagccgtaggtaggggcaaaatgggaggctgagtattagaacgcctgtttaacaggttaaggaacttgcctgagactacacagctgataaatatcagtactgggacctaaacccagctaggcatgctctctaactcactagaatcccactccactgggttgccttgagtttctgcctctcacatctacactaccaatgccaagtggctcagtcaggggttggttagaaggccatggtacgctgggacatttggagacacggaactgttgcctggttcttctcctttgaggtctgtctcatagatctccacccatgcccttcctttcctgatgactctctgtgacatcagccaaacaccaaaccagctcagcctgaactgtccagctgagagccccaaagtggaagagttggctggggaatgatgtggaaggcggggctgctgctcccacccctgaggacaagactgcctttcagcccagtctgggcaactttgttaagtctctggctctttgcccaagtaaggcatgaccccacaatccttgcccaaagccagctcagagcctgagtttacttaatatagactcgtctgtaagagccaccttcagagtccttcagtttctactctgacattattcataactttttaaaccttgtacatgcatgtgtgtgtgcataggtgtgtgtgtgtgtgtgtgtgtgtgtgtgtgtgtgtgagagagagagagagagagagagagagatgtgctcatctctgtgtgtgtctgtgaaagccagagttccatatcagatgtcttcctccatcactctgtatttgtttgtttgagacaaggtccccaactgaccttggggatcattgtttcagccaatctggctggccaggaagcccttaggacctgcccatttctgcccctcagcactggtattaagctgtacaccatcataacaacatggtgatcttttacactccttgcatgcattgtccttggtccctaagtctggtgaactccagatgtactatctttgaacccttctgcaaagtcagtagtacttggagggcaagtttgagtaatgcctcaagaagccatatctctgtgtgaacctattctacagattctctttacaactggattcctcttcttgtaaaacagtattgcataatgaatacttttatgaaaaactttaatctcccaatctcataatcttggatcctgattttttttttgagggggtgatggctgatctagtttcctgcctagttatgaagcttttcattgcacaattggttactgtatttatgtagtcttgtattatttttctattcaacatgattttattgaaagagttagggtggtgggccgactttctcctgttggtttcttagttctttgttgttgttgttgccaaaggacatactttattagctcctcgactctagttctccttctcctgtacaattctggttagtttctcagttcttttctgactgtttttattatctcttcttcttcttctatgagtttagcctgggcccgttaaccttactgtgaacgttccccttaggtaatctggtttatgacttcagtgatcacggactttgaagatggtatgcagtgagtgacctgtatgtaggaactgcaatgacccttcagaccttgtcacctcccctgagactagctaggttatgggccaagatcctgttaaagtctgtattctacttacaggacccag

SEQ ID NO: 635 - DNA, 2400 bp, Mus musculus
ctatcctacccagggaacataaaaaagcacatccctaagtgatggccccttgtcaggcacgccctttcccaggtcactttggtgtgagtgctaggtgtgcagcaaaggtggagagggccactctcctggacagaagagcaggagcctcacattggctctggctctgcagcttggtcctaacagcctggcctgcacctgcatcaagaactccaggctcctaatgaagctattcactttttcaatatgtcttaaaaagaaaagaaaaaaaaagttggagaaaaacgaaacaaaacaagcacaaagtatattttattgtggcttttgggataaggagggagggtggggggactgagggggcagtaatttgcagtcaccctcacaggagcttttgaagttctccaaataagaagaactaatgccgactctttattattttttctaaagccccatttacattatgattaaataccttccttggataagcataaagaaagtcgttaatctatatagctctccaaagaatcaatacattctaaacttttgtaggatttgttacactctattttcttgttacagtaggccggccagctctgtctaggcacatgggtcttcttcccccagcacccccctccgcacctcctccaagaatgaaaacaaagcaaaggtctttcaccgtaaacaaaaccagctgattcttcacagagaacccctgaatagcttgagaagaagaagaagaagaagaaggaaaaaaaaaaacttacaataaatggtgcatttttttctctgctgggtatagtattcaaggatcagggcagtattcaaacagaggtccattttttttgctcagcaagagagtttagaaaagaagcgtggggtccattcagagcttccccctcacaatcacagggctctgtgaaacctatcttccatgccttgtcagagtgtttctggggaccaattagcgctttgttgcaaggcttctttgctgaatctttgagcagcaggaaaaagcgctcttgagtctccccttattttgaccatttcagtcattactcagtgtaataattaatatgacaactggacgctccggtttgtatagaaacacctcagcgacaggagcgagtttgcagtgggtggtaatgagccgcacatcggctccagaagccacacacacaaaaagggaatgaatggcgacagagaaagagaaggaataaagataaaatagttggcacaacgcagagggacataaaacagactggaacggggagagggaggaggaaccgggacaattagaaggggaggggtaaacaccctgtggaggttaacttattttgaaactgttttgtgaatagaaccgtggacgtgagtggccagatttcagtccatcgcccccaccctgtcccccgcccctttatagaccatcttggaacgagggggtgaaagcagagtggggacaggggccgctgcagtcgttaaattgttctcagactcctggaaagctcacaccctggctaccaacctcaaatcccactcacttggtgctcagcaaaagccaagttatcttggagggaccagagctatcctaccatcccggggatgaatgtaggggaaaagacatttcagacgtgcatcagctctgcacagtctactgctgcagggtccggagctagcagggagctcttgggtagcagcgcagctactgaggtcctagtcttgtgctctgcgcccctgggctgcgacccctatgggatggcataataaattattagagcatttgagtgtgttgagcgcagctcatgctaatgaggcagataagagcttaccactaagcccaggaaccaaacaaaatctccctaaatccaaactctgctgtttctgccccaccttcattctggaatttctgtcccaaaccttttccttaattctgattttttgcacacacctcccctccttcagccacccactcttcattcctttcatccaggtggaactccttgtgaagccaccgcactgcctgcccactctgaaggtttgctcccagccacattgctcagtaagatcacctctgtgacacttttctttatacaacatggaatgaaccctagctcatatccttagagtagaactggaaagctcaggaaatccggagtttctgcaagcctgcagatgcttccagattcaaggggctaggggaaccttctggtggatgaagaacaggggcgcctggctcccaggagttcccgatctgctcctacagcccccctgaaaggtgggacagttaacctaagtgtctgaggtcagtcgtgtgtccccattgtgtggccacgcgtcctatgtccatcagcacttccccaaagtccagactcagactgactccttgtggtgcagcctgggagttcc

SEQ ID NO: 636 - DNA, 2250 bp, Mus musculus
acagtggtggagcttagaagtgtctccctacctctaaagaatgtccattaagactaaagagagtaccactggacggacagtgttagattggaattacatgtctaaaaaaagcagcattttattaaaatgcattttacatatatttatttagtgtgtgtttgtgtgagtgcatgtgtgtgtgtgtctgtatgtgtgtacatgcaggtaagcatgtatgtgtgcttctatgtgtgtgtgtgtgtgtgtttctatgtgtgtgtgcatgtgtgtatatgtgtataggcatgtgtgcgtgtaggtgtgtatgtgtgaatgtgtgtgtcagtcacatctgtgtatgtgtgtgtgtgtttggtgtgtgagtgtctgtgtggtttgtgtgttcttgtgtgtgtgtgtgtgtgtgtgtgtgtgtgtgtgtgtgtgtgtgcaggtcagaggacaacctacaggaatcatattcaattccttctctcctaccattgattcctaggagccaaattcaagccatctagctttgtgagtagcatctttactcactaagccatcaggctggcccataaatgtatttttagggccatgatggttcagtggttgagagcactgactgattttgcatggaacctggagtcagttctcagtcccacatgacagttcccaaccatctgcaactccagtcccagggatctggcatcctcttctagcctctgggcaccaggcatgcacatgatacacacatgaaaggcagagataaatatatacacaaaataaaaatagattttaaacatattttaaggatgcatttttgtatcctgcaagttaaattgtatctgcacagaaatgaaccagcattttatttcctaaaaatttcatataagttttagttataaatgaaaactacccaaagaaggacagaaagaatttgatcacagagtatgttgtatattggatagatgaattttaggtcattcactggaaaatacaaagctctggcagcaaagatagccccatgatctcacttactctcggtaaagtctaatggtccccttcgctgaaggtgatggctagcttagaagccctcctaaaggccaggctgagtggtgatgggtctgagtgaggcacagccctcacacatgagagcacacacctggcaatgctccagaactcaaatagtgatctgggtgtggcttatgttcagaggaagagttttcctcgcctctaggaacattcacttccccatgaacctttaaactgtacataaaagcctctccgtgaaacgctttgcaacgagcatgctttatttttgatttttatttctctttacagtactatttttaatagaaccaactggggaaggtgggtagtagaatacattagcagacaagcacactattttatctaaattcagagacttatttttattgttattttatgtaacacttgactgaatgatttagccatgtagtttggatgggttaaagcagaggaatcacttaataatagaatatttatgtaagaatctgaattacagcagttgctaggccagcctgaatcaaccagtctctgtcaagaagtcttgttcaacaagccaaacaactgtgctcagcacaatagacaccagaatttgatactatgtataccaaatagtcctttgcaactaaaataacttgtataatatgtattttgactgtcaaatatggtttctagtctctacttatgaaattgcatgcaatggtcatatgtaatattagccatatcttaagggtgaacttgtcgagtaatagtctgtggcctactatttgcctataatgtatcagttattaacaaataatacagtgagcatacattgcttaagttcaacaaaatatcaaatcctatagaagaagtctggagggtttgaacaggggccattatccacctggaatgcttctgatagccttcctgatacataatcaatatcaaccaacatcagcataaatatttcctaggatgaaaacccactactttgagaagataaagtctttcagtaggaagctcactattattatctattattgttgtgcatgtatgtgtgtgtttgttgaatgttcatgtttctgcaggtgtatatgtatgtttagattcgtgtgagggacaaaggataacctcagatactatacctcaggtaccatccatgcttgtttgatttaagattttgagacagggcctctgattgacctaagactcatctaggaggcaaagctgggccac

SEQ ID NO: 637 - DNA, 2025 bp, Mus musculus
gaattatgcttcaaatgcctttaaccaattaactcaagccccatttcactaaacccttcctcagtctttcacagggaactctaacacataatggcacacttagagatccttaaaataccatgatgctaatattttaaagttgtctaaaccattgcttcccttttaagagaactttaatatagtcaataaacaaatacaccaaagttatagaaatacaggcttgcatccaaatgtgtacaaacatgttttctgaatataccagtgtgcatttctgatttatcaccatttctgtctttttaacagagatctacagccaacagggaaagcactaagtcatgcataaatacgtttccaagcaagatctcacaacgacaacattaaaaaaaaaaaaaaaaaaaaagatgtttgtgcaggattcaactctacctttaccagttaaaaacaaaaacagaaaagccctgttttccccttacaccctgagaaaagaaggaagaattgtatgccttggatatttttatcattttatcaatgagattaaataatacattcccaagttcacacatctgagcacactaaaactggtaaaattccatcgactgggggttgttagcttgcatttattattttaggagcctgaaagaattcttatatttacccacgcccctttcctcacataatctactttgatgataaaaatgagttgtctttgaaagcacaatcatggaaacagcttgaaggagaagaaagggctctgatgtccagctgggtaccaagtactgagaccaactattcagatggggggggggggagggcgcagagtagtgagagcccgctgcagagcccgctgcagagccgtgattgtagcagaatgaatgaaagagatactttgtaaggtaaggagccagatgactggagatgctgatgaattcttgcttcccagcatgccaagggcagcagcatatcctttttgtttaccgtcttgctaactcatttagtggctccaacgaaaaggccagatcctgtctttagggctttgggggtattatctcatttatctcacaagcagttctctctagaaggcaggattgccactgctcgatgaaggagataacgtgtaaaagatgggaaggccttgaccagggtcatgaggttactagagacaagatatggaactgagtcagactcctgagttcaaatccctaaattgtatactttttatctgcaggcacggattatattaaattatgcttaattactatttatcttacttagtctaatatgggcaataaaaagccagaggacgcaagtggggctagggactcctgcttaatatgtaagaataactggtggcagttaggctgatcaaagtatcaccaagaggcctcagtggtataggtaatataccataataagccactctaaagggttcataatgcatattattagtcaaatagtttcccttcaaaaacaattgtcaagccatcaatagtatctggaaatgtgtcattaattgactagagtgtctttgaagaaataatcaaattcaagtgaggtcatgcttgtgggcccaggtccagtatggctgatggcatcacagagcaaatttgctcagggacaaacaagcagaacaactaatgaaaatggaaaccaggatcagggtaatgattctaccagtgagtaacatcagtgtttgccagaacaccaccaagatttggaggatgccctgggcagtggtggcccacgcctataatcccagcacttgggaggcagaggcaggcagatttctgagttcgaggtcagcctggtctacaaagtgagttccaggatagccagggctacacagagaagccctgtcttgaaaaaccaaaaaaaaaaaaaaaaaaatttggaggatgcaggggtgggaggtggggcttacacattttaaaagaaacactgggtcatttgtgttcaaagtgaggactttgatgcataaggcactttgaatagctttagggacatctatgatacgtaacaattacaagt

SEQ ID NO: 638 - DNA, 2250 bp, Mus musculus
actagttcagcaatctattttatacaagaaaaattgctacccacttcatctaaagggaatcttcacctggaaaaataaaacaaaaagtgcaatcaaacagcactcccaagccaaatgaaaacaaacatctcagattagagaaatctcaaatccaggctctaaaacaggggaaaggagacaagcaactcctatagagcaaaacctacttcttaccaacaaacatttttaaaagagtatttttttactgtgtgtgtgtgtgtgtgtgtgtgtgtgtgtgtgtgtgtgtgtgtgtgtgtgtactatgtctatgcaggaatacatggagagtagaggagagttttgaacccctgaacttggagttcattgtaagccatccactatgcttaccggagaccaagcttgggtgctctgtaagagcagcaggcattactaggagctgtgccgtctctctagccttgacaaactcattctcttccttcccatcacatctcataacaaaattacatgaagggaaggataaggaactgcacgcttatccatcaggattctgtgtatactgttaagagaccatgtctctcaagtgtccagatgaggaggaacctatgttgtgacttatcccaacacagttggtacttgtacctgtcagggacagcattgcacttcaagtaaatgtttctcatagtctatggcaaggaaacgttactgacgggatgtgctcagtgttcccgtgcctaaaatcatcacattaaatcctcactggccttgggtccacttattttccatttgaaatattttcctgaccactgtggcatgttcaccgttatccgttcttccgtctttctgacaatctccagaactcagcaggacctgcatctgtgctcacgagggttgcaatccttttctgatgatgccctttggaatgatcccaattgcttggcagagccaggcgcacctcctacatctggtggtcgccaggctagaggactcagttgactttgcctgttcgccatttcttagcggggtttaaacaaaagcaaaaggaatgcctctggaggctcaagtaaatcagctggcgaagagagatgctttaacacctcgaaagagcatcctcgcccgcccgagttaggaacagctgctgacagaaatctgggacaggctttcccttaaagtcaactgggaacttctcggttccaaaagcaaagaaaaccagctgaggacttcaggagtttgggatgtgacacagaacaggctgggacctgaagagcaggggagtcctagcaactccgatgaggtaaggtgatgaggatgcgattatacagtctccagtgatgctgaagcaacagcagaaaggaccggacattagttcctgaacgtgaaagggctggagaagactgtgagggagagaaagagaagcaagctatcccgtgattatttctcccttcatcttaggaagaacgcagctacccagatgataagaagggtggactgcagctaatgagatcataaagatggtggaccacagccaaacagattacaagcacaaatatgtaaaataattcagaggagagaggagtctgggaggagcatagttacaatcctaaagctgccaaggcactgctaaactgccccactgtgctcctacagaagatcctaggctaccaaatggggcagtaataatttaaagccatgcataaataaatacccaataaattaaggaagtttaatatcagtttggcttatagttatgtgtaaattcaagggtacatatgatattttggtattcccattggattcacaaaaacaccaattatttctcttatttaataacaatagcagtaatagtagtagaagtagtagtagtattaatagtagtagtaaacgtgccagaagtgctctcttgcaatccttggaatcaaagaatgttgttacaacaccaaccatccctcccattgaagtcaattactcaaaagatacatccaaaattgttacactgcagaaggttcacattgatgatatagcaactctcactttcttaagaaaattcaggacagatgccgggcgtggtggcacacgcctttaatcccagcactcagaaggcagaggcaggtggatttctgagttcgaggccagcctggtctacaaagtgagttccaggacagccagggctatacagagaaaccctgtctcgaaaaaccaaacaaaaaaagaaaattcaggacaggctttcataaaacattatttcaaagatta

SEQ ID NO: 639 - DNA, 1875 bp, Mus musculus
aggtattgacccagggacatatatagtgccccagctagtcaaaccactgctctacttcctaacaatggatactcaagaaatttgtaaattagagcattcctacaaacgtgctaggatatatttttacatgttggctttctagtaatttttctccgaagcaatgcaggactcactgcattatctcataattacataaaaaatattttacaaagcaaagcacacaaagacattaattatgaagttcacattgccttaaaagcattaccctaaattctttcccaatgttaattagaaaatagcatgtacatacaaggtgttgtttatctgctatttgcaaacattgcagcttgccaataccagcaactgttaaaagatagaggccttgctaaggcagtgcaaggtaagcctacttcatcgtacctaacaatgctgtttaatcaagcagcagcgaagaatctgaaggagaatgggtcacgttaatgaagactataagagagaaaattaactaccggcggcagcaaaatgtacaaagtaggaagtgactggtttggttcagtcttcagaaacagaccagcctggaaactgaatgcacatattttgataagtttgcagcaattttaagcatcagctaaaacagtaatgttaggaaaatgtgatgcttgtaactgaggctctagttaaaaatatttatggaagtagaaaaatctgaagggacgttaaaagagctgaatactcccttcgttgtgcctacacacatcaagtacgtggtaaattaggcccagaggttaacacacttctactttctttttaaaagcattctcttgaaacccaaaaagatccctgaaaagactagcaaacctatccctgtggcaggcaccactcacattgcatcccaccatgctgaacaaatgttcaatgtgaacgaggtccaacagcacaccctggctctctccaggagaccaggatagctcaaatacatggctgctctctcatgccactagctccacaaagagagcagaaagcctagccttgtggttgctttgtgtccgatgagctgacaaagtgaggagctgaggatgaggttggactcttcccgtgtggacttatggttttcctggaacagtattagccaacgtaacatactccagcaatgcatttttataatagtgaaaaagcttcctaataataggcaaggagcctcaaatctttgtccccgtgtatgagaggtatgatgccatcacaggatgtttagcaccatcaacaacaaaactatttaataacaaagaaatagaaactaagatttttttttctgcatctgggcttactgctcacaatgttcccatcatattttgaaatatttcttgtagagcactagagcgtgagctagaccttgcttgggacatccatccttcctcatgtcatcatatacagaaattcaagccctgctgatagcaatgaagagggtagacatttagtcccactgtggtattcagaggtgacctttgtgatgtgattagataaggggggagtttcatgtgcagcttctatgatttataatctgcccagcatcattcacaagacaaaaatgctattagacaatttattgctaaaagtaaaaaaaaatgtgccaattagaaacttatcaaaatatacttggaacgtgttaggatggtatgcatattaaaactatatcaggataaatataatgagaactgtggaacataccagatcaagaaaaggtgtgacctcctcatcctgctcccataaaaaagacacccatagctgcagtagcatgactgttatcagcctacttaaattgccacctgtccatctgtccattggtccatcaggacctagtcctgtacctttgcttct

SEQ ID NO: 640 - DNA, 2175 bp, Mus musculus
agtttgtactctgacttcttccacacacataaaaatgggtactagcaccagcacacatagctgtgtatacctgcttacacacacacacacacacacacagtagtagaataagaaaagctagcctagttgtgattcaactttgagtctctgcctctcttgctttatgtcagtggtccctattagaacttccatattcccactgaagtttaaaccgtgctgttggatagaaacaattgcgcgttatcatcatcctgtgcagatgatgaaatcgagatgttgagtttaattttcgtctctgagctcacacaaggagcccatgaggcactgctcagctcttctgaaacctgtttgtctgctcttcctataatttgtcacattaggaaactatgttacaatggtacatggaaaaccctcagctacaaatgcaataaaggctttgtgatgcacaccagttgagaagataagagcattttagatgggaaccatgactgaaaatgagtaggaacaaccggaagtgttgccatagtagcaaaactgggtgattagagacgttgatgcaaatctctttgaacaaaaataaccaaattctatgaaagaagatcattttgggtctatccttatatagtttgaaaacaccaactgcctacaagcaaaaggaacagtgcaaattaataccagcttctgggtaaagatgtgtggcttgttctcatggaaacatcacagtacaatattgccatgtgtcaccaaaaagccaatggagcctgaagctggagttgcatgggaggttttgggagaagctgtcactttgcttgggttttggtgccacctcaagaacactgaaagtaagagttgtgcaggagctggctagcataggaatctgcatgttagatcctcagaagagcttcagtaggaccagagtattaaggtgggggtggaggcatggctcagtggttaagagcactgactgctcttgtcagaggtcctgagttcaatttccagcaaccgcatggtggctcacaaccatctgtaatgggatccaatgccctcttcttgtgtgtctgaagacagcgacagtgtattcatataaatgaaataaataaatctttttttttaaaaaaagagtattaatgtaaaaaaaaaaaagcaggttctaagttttctacataacacagtaagatcagtattccagggactgtgaagacgctggacgagatctgggtgtgttgggagccatggcgaaggttataggtagagagaggaccagccacgcatcaaaacacgtttccaagacatcagtcagggtggcacttaccctgagaataagccaaagagagtaggcatgatggaagcatgcaaaccagggaaggtcattggcaagagctgagaactgcttacacctcgtgacagcagctgagggaaggagaagcccctgcagctggcaagtcattacgacttggaatgcgttcatagagttagaaagatgtgaaatataccaggtgtacagctttattctcaccactctgggatcagaggcaggtggatctctatgagttcaaagccaactttgtctacatactgagttcccggatagtccaggctgcatagtaagaaagatcctctttgtgtgtgtgtgtgtgtgtgtgtgtgtgtgtgtgtgtgtgttttccagaggataactccaggacccccaagtagagtaaggagagggaacatgtatggaaggtggaattcacctccttaaatttttcagtgacagaataagaaagtttctatcctgtgtggcaggtaggcagcactggaatatattcctcctcccctctcccctctcccctctcccctctcccctctcccctcccctcccctcccctcccctcccttcccctcccctcccctcctcttctttcctcttcatcccctctctgtcataacatttgaccctgtgacacaggagaaaatatttataactgtcaggaacatagaatttcaaaatacctataaaattagcactataaattgccaagcctaaaactgctattacattattacaacagtataagaacaagacgtttctctaactagaaagggagagcagactcatgaagatcaagtctgaggagtcccttggcctccttcatgctggtgagtgagtcctgcccattacaaccaataaaaatg

SEQ ID NO: 641 - DNA, 2225 bp, Mus musculus
ttgggtgctttctctagcttctccattggggggggggctgtgttccatccaatagctgactgtgatcatctacttctaatacccatgaaaggagttacagagacaaattttggagctaagacgaaaggatggactagccagagactaccccacccaggggtccatcccataatcaaccatcaaacccagacactattgcatatgccagcaagattttgctgaagggaccctggtatagctgtctcgtatgaggctatgctagtgcctggcaaatacagaagtggatgctcccaggactactcttatgttggatgtttgattttttttttttttgacattaaacaaaaaagaagaagaccttggaggaagagacagtaagtggaacttttacacacacacacacacacacacacacacacacacacgcacacgcacacgcacacgcacacgcacacgcacacaggagttaggtgtaaataaatggaggaaagagtagagcctgggctaatggatcactcctgcaattggcctcttgtttccaatcaacccttgacatctttggattatttctatacagccgaccgagcattcacaggtctgaccgtgctgacagtggcgtgtgcactggtcaaccatgagtgaaaatattcaggatgacctgcaagctttacccgggtttcgacctctctcctgcctcatgccgtccaggttcaccatcagcatctatggcctcctttcccttcccctttgtgccaagtttggcttgcttcaggcctttttccatgttttgtatcttatgccctgagtttcaccatgatactttccctcctcatttctctcctgccacttagaccttgggttaaatgttcctcagggaagccttctgctatcagagtccagacgagtcccttcaatccttcactgtaacggtattgcactgctacaggtggcaaagacagatgtgtttgttaaatggctccctcccgtttgcactgtaagtaccgtgtaaaaagcagccgtggtgcctaacacagtgcttggggtgtagttcttattcaataactgcattttgaatcatcagcgaagagatggaaagagaatggttggagcagaagcagctggagcagctgacgataaagattagaattagcaagggagtggtaaacaggagatactttacaggggactcagcgacagatctatgtgcaaacagctcacagaacatcattacaacctggggcatggagctgtgtgatttcagccatgtgccccatgaggacatgtgcaggaacatgagcctgctgctgaacagctcctgagtgaatcaatgtgatattcgggaggctcggcaatcaatacagcttagcagcctggagacagctcgcatactgcacccgagtgacgagctaagccgtttgtgcctatgttttgataccagccacactgggagaattggtctcatttgtaacctccagctactattattaaaatatcggaagctatgctgtatatgctagaggctttttcagaataacaatgtaaaggcaaaagttggtcatttaatgttttggggagtgattaatagatcatggtagaattgggatttatgattctggatacctgcattttttattagatattttctttatttacatttcaaatgttatcccctttcctagtttcccctccgaaaatcccctatcctttcccccctccccctgctcactaacccacccacacctgcttcctggtcctggcattcccctataccggcacatagagccttcacaggacaaagagcttctcctcccattgatgaccgactaggccatcctctgctacatatgcagctagagccatgagtcccaccatttgttttctttagttggtggtttagttccagggagctctgggggtactggttggttaatatcattgttcctcctatgggactgcaaaccgcttcagctccttaggtcctttctctagctccttcattggggaccctgtgctcggctgtgagcgtccacttctgtatttgtcaggcactggcagagccgctcaggagacagctatatcagactcctgtcagcaagctcttgttggcatctgcaatagtgtctgggtttggtggttgtttatgggatggatccccgggtggggaagtctctggctggtcattccttcagactctgcttcacactttgtttctgtaactccttcca

SEQ ID NO: 642 - DNA, 1675 bp, Mus musculus
ttgattgtggtcttatttttactatttttaaccatgcattattgttttatctcataaagatatcttacattaaaaatgaactatgctagactcatatttacctttcagaaagaagaaaattctgtcacccagtaaacacactgagtacctcattttaaaagaaatacctaaaaagatctatagagtgtggttctccttatgtaggctatatagcatcagattcataataacagaaaataaaatggcagctgccaaggaccaaggccaaaggagacgattgctattttaataggtacagaatttgtgttaggcagggtgaacaaattctgtggctgtgtgttagtcatggttctcaacaacaagaatgcagtttgtgcgaatgagctgtacattcagagtgataaaaatggcaaatttcatgttctgctttcaccaggatgaaactgatgggataaaaactggggcttgttaacccaggaggcttcagtctggtgtttgaaatctggtgagaccagagtttctacacagaaggctccatctggggtttatgttttgggttcctttctacatctgtgtccagctgagtctaagccaatttgacctgtaattcatctaagctttttttcctgactcaccagatgtaaatatcccactgtccagcatgattcagggcagtgccatgtgaatatttggggctcaatttcactggagctttagtgcatagctcccgagagagagagaatatcaatattttcatttgcttgatttctttcttttttcattacttttatctcgtttacagtccagtcgttttccacctccctgtccaccctcccacagttccacatcccattcttcctcccctgtcttcaagaggatgttcccccaaccctctaccctcccaccctcccacctcacccagcctccccactccctggggccttcagtctctccagggttagtgactcttctctcaaggagcaaaacttttcctttccaggtgacagttattgatggcagtcaagctgataaatgactcctcctacccctattggcacctgcacccctggagcttggtctcagcttggctgagactagattttcattagcttggcttttaaaggctactaggcatgctgttgtgtcatgctgtgtgaactcccactcaccattctgcatccaattgggctaaataggttaattgctcaagggaatcagctcttccactgtcactggcttaacatctggggagtaaatactcaggatgactcttgtgaatttacaattctttgcaactgcttgtctaatgaaggaagatttgaaacagctgcctgagagagacatggcagtgttccctcttgtattccctgctaattgttagatgtgtctgtcattttaaactgggcagcctctaaactccaggtttacaaggttttcgtgccattttacagactttgtgaagaagagggttcttcacagaattgttcagcactaaatgtaagtgctggaggaaagctatttccttatgagtttatcgaaatgaaagatgggcaaacttaagacagcttggcagtcaaacttttaaagtcaaattgtcatgactttcaaatatcatttcttgatttggttttttgtttgaataatatttgtgtgaatttggaaaaggctttcccct

SEQ ID NO: 643 - DNA, 1775 bp, Mus musculus
tatatataattatatactatgtataattatatatatttatacctctgtaattcacatttattttatattattatatataacataggataccattatgtattattatataaaataaacatgttacaaacataagtaatattttaacattcccattactgtgtactgtatttttttaaagatttatttatttatttatttatttatttatttatttatttattatgtgtgagtatactgtagctgttttcagatacaccagaagaagtcatcagatcccattacagatggttgtgagccaccacagaattgctggaatttgaactcaggacctctggaagagaagtgagtgttcttaaccactgaaacatctctccaggccccgtatatattgtattttgacctaatatctgtgagtgccaggctggctcatgtctacctgtaatgcagcactcaggaggctggagcagaaggatccccacatccaaggccagcttgacatacacagagagatcctgtttaaaagcaaaataacatcaaagataataaaagcattatctgtatgtaagagaatgataagtgataaatccactgctttatctgaacctgtggtatacacacacacacacacacacacacacacacacacacacacactcacatgtttagagcacattaccataggaaagaaaacacacacacacacacacacacacacacacacacacacattgctagtgtgctgttattctacaatctaagagacttcctagagggaaggttttgtgtctcacagaataaaccctgaacaccatcattagggaagccaagtgtggctgtctgcaccgcagctgcaggacagaacacctctgtctctaacttctctttatcctagcccagctggaggtagatgagtctgatggaaggcaaagctgtaaatcctgtcaaatttgtctgtatcctatttttttctgtcttttctttccctccctctgaggtgccctccctgcccttttatttttctcgggctccccagtccaaagagggaaggctgtgataatgacccatttgcacctattgtttgactaatcaccccagctctgaaatggtctcgcacacagccacatcactaaccagctctttatccttgattgtagagaggcttactcgtccttagaagaactttatttcctctgcaagctggtgaggaatggttcctggagggcgaggctgaccgaggctctccggagcttctgaaatcacagttgccccattcgagcaaatttgatttacagctgatgatgttttgagctgccaagcagataatgtatatctgggccctagaaaagatacattgcaccaaatattcgtgaaaaatggcaaggaagaatgtaagatggcttgttgcagaaaacaaaaaacaaaaatcaaaaaaaacaaccaaacaaaaaacaagaaggaccattgccagcaggaagagagatttacccaattcctgaaacaaaaggcaggcatgttccagatgctggatgtctgagcaggaaaacactgcagggttttaaaggagagagtggcttctgtaattatactaccatagcctgtgtttactaattagtacttaccaaaacgaggcttccattctctcacagaaactgaaacaagttctctcttgcagtcttcaagtcgctcttttcttctctctcagaccaggtgttttctcaggagcccagtttgaccccaaacctcatgatcttcccgcttcagccttctgatggcta

SEQ ID NO: 644 - DNA, 3175 bp, Mus musculus
ttttctttttctttctttttttttttttttttttttttttttgtggtcatcagtagagtgggattcttcctgtacttgggcgacccgtttttttttttttttttaggtattttcttcatttacatttccagtgctatcccaaaagtcccccataccctcccccactactcccctacccacccactcccacttcttggccctggcgttcccctatactgaggtatataaagtttgcacgaccaatgggcctctctttccactgatggctgactaggtcatcttctgatacatatgcagctagagacaggagcttaggggctggggcctagcaaacacattaatttctacattagaaatgttcttctttagccaattgcatttgggaaccccctcatgaactacttctagtaatcacagcatacttcctaattatgagcaaatgtgtatatgtggtggtaatgccattaggacctgttgtggatagccctggggctaattatatttgatgttaatttcgttctcctgtgagtggtttctaacaaagaatgagtcagcactcaggtgatttcctgtaaacttgcttcccaccttaatttgtaaaataaaggagagctgatgattgggcagataaaagggaaggtggagcagtaggtgagagagagaaggagaaaaatggaagagggcaaggaggcagagaggaagaagaaggaaagtggagcagaagcacatggcctggagaaaccgtaagctctaaggggtctcatagatggggaagatggagtgtggtggtagatctgctcaatctaggcgcacagcatggattcattttagttgagttgtgttttcattaccagggacatatttgggttggagagttattgcaacaaggatttcaattttatttttaaaaatactgcagcaagctattatcaaataataagattttactggggtgtgtactatggcatgtgaaatgtacataactatgtcactgtagatcacctaaggactgagttgtcagatcagaaagtaactctgcattttcctacccaaggaacctatggagctgagaagaattgtcaaagttgtagaaataccatgggttagttggaagcagtgaatacagaaaatagagcagaagcagctatttttcatatgtggtacttgtgactcttctgtcccccacccccctgcagtgaagttttaatgaattgctgtaaagggtgaggtggtttgaatctcaggaaaaataaaatcactgggctccaaaaacccaaaacagatggtatgccttaacaaaattttttcgttcatttttcaattgttcaaaaataccctgtgccaagctggtgtgtattttataaagggcttttacacagtaaggaaggaactaactgaatcgggaaaaggaggttagactgcttaaagcattttatttttattgcaacagaaagattttttaattagttatttacaatgtttctgacttgaaattgcctgcttctatgccagagaacacctctgcttcctcaggaaaagtggactggtttccatcatgttttgattttttttttacatgatatttcaagttaattaaattttagtttcaactatatttttagaaagacaaactttattcacaatcgttggtagaatctgcacgctactcaaagtggactgctgatctcagcatggttatgggtttctgttcatgttgtgtaaggtgctgtgctcattctgagaataaaaaacacagagacgtgagctttgtcatctcaggagacttggaatctggcccttggagagcacatgctctatggaagaggcccaggaaaggcccaggtcttccaagaagaaacaaatgccttcatgaaagtggacttgtttcctggagtgaagagagaaagggtttgtaaaggtttacaaaaggcaaataaagcgctgaagagagcagtggaggtgttaaagaaaacaagtatcaaattgtgaatataaacaagagtttgctatatttgagttatatcacatattttccggtattagaaagcttatcactgtgagagtactccttttcccacccctgttcctgcctcatcaccccagcatacccttacactgggtatcaagtccccacaggaccaagagcagcccctcccactgatgtcaggcaaggccatcctcagctacatatggagctggagccatgggtccctctatgttttttggttggtggtttagttcctgggtgctctggagggtctgcttggttagtattgttcttcctattgggttgtaagccccttcagcttcttcagtcctttctctaactcctccattggggtccctgtgcttagtccaatggttggttgcaagcatccagatctgtattggttgggctttcaggggacagctataccaggctcctgtaggcaagtgcttctcagcatcagcaatagtgaggcagctgggggtgggggatggggtagggggtttgcagaggggaagccgcagaagttggacagcattcggaatgtaattaaataaccaatagaaaaaaaaaaaaaagaaagaaaagagaagcagtctgacagcacacctagaagctctagaacgaaaagaagcaaattcacccaagaggagtagacagcaggaaataatcaaacttaaggctgaaatcaatcaagtggaaacaaaaagaactattcaaagaatcaaccaaaccaggagctggttctttgagaaaatcaacaagatagataaacccttagccagagtaactagagggcacagggacagtatcctaattaacaaaatcagaaatgaaaaaggagacataacaacagatcctgaggaaatccaaaacagcattagatcctactacaaaaggctatactcaaccaaactggaaaacctggatgaaatggacaacttcctagacagataccaggtaccaaagttaaatcaggatcagatcaacgatcttaacagtcccatctgccctaaagaaatagaagcagtcatcaatagtctcccaaccaaaaaaccccaggaccagatagatttagtgcagagttctatcagaccttcaaagaagacctaattctgagtctgctcaaactatttcacaaaatagaaacagaaggtaccctacccaattcattctatgaagccacaa

SEQ ID NO: 645 - DNA, 2225 bp, Mus musculus
gctcattttgactgtggtatagcaggatttacaggtagcacggtctgcttttaaggcagttttcctatagaacaagcaatgtaagcgtatagcttacaaatagatgaggctgagatttgtggttattttatttggctttgacaattactaagacccctaaattacttttctaactgctggactggcaacctccccagcagtgtgccccagaaacttgttgtttctcctggccacatactcatagtctgcctaccctcatttcttcctctcctcttgttctttctccttatcctctgcctctcctcctccaaccaggtcactccaaacccactccagtaactggctgtagccaattttatttcaccaataattttaagtcaagaagcaaggtttgtacaacaaagcttgtaaacatcagaagtcgcccaatatcctagaccttggggtatagaatctagcatcacaatacacagcaaccgactaaacctcaaaaactttccaccacagcacacttctccttgaatcattattttagttcattccttttactgatgaagacagaggctcatgattatttgggggaaatacaaacacttctgaagaaaactcatttcatattccatgttgatttaactgccagtgagtgttggaaccctttctttctagatcacatttttctttccaacatgcttttctcacctacttacttgtaagagagtgctgtgtatgggggagaaaatctgtaatgaggtgagaattgagtggaaaagaaacacagatgcatctcctttatttatggcttcataatcacaatggccacactgtgcagcctagctcaggggtttgcagagcacacacattgcagcaattaatctactggggaataccaaagatgcttataatgcccaaaattcagagtttgtgctgcacttctgtgcatgtgtcgggggatgctgagactgttaagggcagaggggatggctgtggattcctgagggtggattaaaacaccccaggcaggagctgtgaccgctactaaagatctggttttgtttgtttgtttgtttgttttgtttttttttacaaagctgaaatcattacttataaatttcttgttttcagtggaatgtattatataatccctttcatgttcaagaaatatcttttttagaacaatttttattagatattttcttcatttacatttcaaatgctatccaaaagtctcctatacactcctcccaccctgctcctcaatctacccactcccgctttctggccctagcattcccctgtactggggcatataatctttgcaagaccaagggcctcttcttccaatgatggctgactaggccatcttctgctgcatattaaaactcacttttaagagactgcttatgcagttgctcctgtagatttgtaacaagaaatcttggaacaagtctagggtttgaaaacaaagtaggtatacaaataaacagcatctttctacttgtttttcctgtcggtaagccttgatttttggatttcttttagtatggataatatagagaatttatgtattaaattgcattggtggggttatatactcagacaaagagatctagtattgcctttgatttccactattctaaagccaatatatactgtgaatcagtcagatttctgttactgtaaccaaatatttgtggtaatagacttctacagatgaaaggtttattcttggttatggtttcagaaatttcattccctgattcctttggacctatggtgagattatattatcttagtgaatgtgtagcagagaaaaatctccttgcatcctgtgtggaatttaccaaagaaaggaagatgaagaagctgggccccagtgtcttaggcaagatgtacaccagtggctggaagacataataaggatgctggaatcagcacagagtgtctgcgatggatttagtgtcattgacacagaatcacctgagtagggagactcaccagaacagttgtcctaattgtcttaattgatgtgaaaatgaaaacaaacaaacaaacaaacaaacaaacaaacaaagaaaggacccaaaacatgtgcagtactctttggtagcttctcagagaaatcaaatgcttggctgaggaagagtcgttgcgttttgcttgcttgctgttcctgttccttctaccccacttgaccttccttgttgataaatttgttcttctgacag

SEQ ID NO: 646 - DNA, 1950 bp, Mus musculus
ggtaggagtgggggggtaagtgtgacagcttacttgccacagtgcacgtgtggaggtcagaggacaatgttcaggacctggttatcttcttgagccatgtggattcaagaattttaacttaagttttcaggtgtgcaatcaagttctcttccctaatggttcatctggtcaaccccactcccccttttggaaaaaggatttttcatgaattgtatgacacttacaaatacaagatgttggtactatgttgtgctaggactcccaatgggcacaaatctggataaaacataattattataattgaaagctttattattttctggttgcatgaaaaatataaatagttaaaaggaaactgaaggctacataaagaataaagttaattcttgctattcagaagacagattttagcttcaatcatgagagtcagaacttgtcttttggagtagggtgatggcacactagaagtaaggctgttctgggaactgagatgtgcaaagatatggatgtgtctgggggttgcagtctccctatctctgtctgtctgtctgcaatgtctgggggttgcagtctccctgtctctgtctgtctgcaatgcctatggtcttgaagtcttcctgtctctgtatgtctaaaatgccggtgggcttgtagtctcccaggctctgtgtgtctgcagtgtctgtggggtcatagtccccacacatatagtccccatacatagtcccaggtcacaggcctgggatgtatgaggatgaaaaaaatctgtgaagatcaacagatgtaagtgtacagaccggaggaaagtgagaaacctgaagaaatacaataaaaatcaagtgaacagtacatgatgcaacaataacctcacagactttgcagagacacagagacagggagactacaaccctcagacattgcagagacacagagacagggagactgcaacccccagacactgcagagacacagagacagggagactacaagaccataggcattgcagacagacagagacagggagactgcaacccccagacattgcagacagacagagacagggagactgcaacccccagatactgcagagacacagagacagggagactgcaacccccagatactgcagagacatggaggcatggattgaaatcacagaggggctaatagcagagaaagcattcttctcctttctcccaataataacaatgcctaattaatccactgggaaatcaaaagaagtatcagcaaactaaatgttattatcatcaactttatgattgtaacaacatgaattattaatgacattctgcctttaactagataaaaactcactgaagtaacagatttattttttttttctgtttgtctatgcctaaataactgatgttaattttactgcgaaaggttcacaaagctctaatttgtctttaaatttgcctgagaaacacttttttcatcagaagcaaacactagatttttaacttaacaactgtcaaaccaaatcattgccgtaataaccctgcaaaagctcacagctacacatttatttatactttcaaacatcttgaaaagagttaaacttttcaacaaggatatcttccttttataaaacagttttaatttttattacatttacttatttgagggcacacgtggcactttcaaccaccttaggttggaagacaccttgtgggaactggttctcgccttctaccatgttgattcctggatcaaactcctccattggttaggttggcttctagtccctttacccactactccatctaaacaatcccaaaggtcttttaaatcatagataactgtaatattaataaggcaatatcatgagccccacaatttcagttggttgtcttaaaatgtaagactatacaccgtcaacaactatgtcctgagtacccagaatgcactcggacctggaatcagtac

SEQ ID NO: 647 - DNA, 3350 bp, Mus musculus
tcagagaaattcatgtccagtgagaaaccatgtctactgaaatacagtagtaaacaacagaggaagacactcagcatcagcctctgacctccacaagtgtgtgctcacaggcacagaaacacacatacacagcaatcatcacctacctttcaaatattgcatttttccttgtaaaccttagtcatagatatttataaatttagaaataagatggtagccttaggtgctcttttacataatgtagatctattaaattcatttactctccataaaagtcttatgaatgattcattacaaaattctgcattaacaataaggaaatagagagattaagtaatcagtgccagagttctggtaaggacaaggggagaaaggtataaaacaagaattaaatgtaaactttatggctttcttaagtatgccattacaagggccccagtacaactccaaccaaatgctcataggcacaaaggatcaggtttgttgtatgtccactagtgtatgtgtcaacataataagcattctgaccgacttcatgaacgaatacaacgatgaacccgaggcgccaaaatcttagggaacgtccccaaaacgtcagaacttggacacagcaaatcctcagtctaaatccttgatctttatgatttttagtaagaaatgagaagggacctgatggcttttgggcagcagctgtgtataaaactggagaactgatgggggggcgtgttttactctataatgaagtccttgactccaggagcatgcatgaatgaaaagcaagtgcatactggaggagtcaggtttattaccaatgtgacaaactgcccaacagaaatggcataggggaaaagactttatgttgaccatttatctcagagatctcagtctatagtcctcggttttgttgattctgaggtcacggtgatacagaagaagcataggatgagggtgaagtggagggatgaagatgctgtcctcgtgacaatcaccatcacatacacacacacacatacacacacaaactttcagagaagtttatattgtgatgctagaaagaaattaggtagctatttagcagaaaattatttggtgactggaaaattttgtttggtggttcattcagatcactagagcaagtagtcactcaaaaaggataaatagagctgtagaactagctaactcccctgccttccgctgatagaatggcgccaatgaagaaattcttaagagtttagaggaaggaaaaagcagtgtggccttacaaaatgactcaacatttaatgaaggtcttatcttcacaaattctccctctctccctctctctctctctctctctctctctctcgtgtgtgtgtgtgtgtgtgtgtgtgtgtgtgtgtgtgttggcaaattcattagggcctagaaacaaggataggatttatctagaaaatacctatgaaaatgcgtgcattccttctgtaattgtgcagatgctattgattttgttgccctgctgcgttcatgccagttgacttccaatgccatctgtagtgtacatagagttaaaataaccataagccaagtgtgcacatagaaaggttggcgcataagatgtcagaagtgacagcggctggacaggatgactttgcaatcacttttttgttaagagcccatggatacctttgtggagtttttgcagcctgcctgctaagtaatggattgggcagctcaacaacagaactttgttgtatttagctcagaattctcttcccaaaccatctgggctggcaggtgttcatcatcagatctgggttgctatgagaccggatctctaatgcaaatgaggtgtagagacagaaacctaaattttgctcatttgaagcgactttatgtgtgtttctgctggaagtaccagcaacgccttctgactttccaaaatgcgaaattggtaattaaggtttcccaaagaggatgctctagtgatcaaatgtgatagaataaattaatggcaatgtgtgtttattttcgttaaacattatatgaatactgatgccctttctcttggaaaagaaaaaccaagtctgtgagtattgccaagaagaagcaatggagaaggggagaatggctttctttctacatagagttggatctttccgctaacagtgagaacgtgcctctcttggtgagacttagttatctacatgaaggcaagcatgggttaaaagggtcattttcatcacatctttttcttgtctagtttcacagtgaactaacagtctcttatcatgatgcaaaactatgacacacagctggtgttcctatatatgttcaaaataggcagaggcttcaaaatgagtttatgaatggctcctttttatcatgactagtttttataccctggagtacttctgttcaccagtctgtaggcacaaggaaaagtacacaagaaagccaatgcttgacttactagatttcagatgacatcagctgtatagagtgaggttctgtgtgatgtttccttgtgaaggggagggaaagttcagtatcactaaaaggccgccaacttggaagccaattttacaacacatagaaaatatttgaaaggggtttgcttaaagtcaaggttataacagatggcaataaggggtcaatgattcaacaggtccacatctatcaaagggtcacagattcaacaggtcccctaccatcagtaataaaatactgctttgtaccttatgaaatgttctcaaacttaaatacctgtattcattttctaaaaccacactgtgcaaaagaagatttccaccaaattaccaacaatagaatggcttaatgatagtttaaaagaaaaaagtaagcacattttaataaagtaattgaattatttttttctcttttattttagtattttataaagtaagtttgttatattataataaaatgcacatttaatatcattattttgtaaaatcactatactctacaagttatgcacatttatctgaatttttaaaaataaaattacatgagtgtatgaatgtgtgtgtgtgtgtgtgtgtgtgtgtgtgtgtgtgtgtgtgtgtgtgtgtctgctgtcacaagacaaatttctggagtcagttcactctggaccctttacctgtagatccatcttgctggctctacctcaattactcttaaaatttgtctattctaggtgcttaattaccatttcagaaatatacacagcaagacacatagtgatttagtgattatcttgaaactatagaagcagtacaattaccaagagtgttgcaaagtcccactcttgtaatttcataccacataacttgttataaactttgaaaacagggataaaagttagaaat

SEQ ID NO: 648 - DNA, 8775 bp, Mus musculus
tttttttgttttgtttttttcttttgttttgttttgttttttgtttttttaactaagttctccagtgaacagacaaaagacctacttggataaatggctgatcctcaaacctaggcaatcaatatacaggttgaacatggatcattttaggcaaaaagcaaggaagactctgggggagtcaattgaacacggtgtaggtgggaaaagttgagtgattttttttttttttttttatccaaaacatcctttgctttgtttttttatcccaaagttgaaatcaaatattgctgactcatcactaatacaaatgcctggaaattaagtgtatagacgaatccctggaacgaaagagtttttaaaaactgtgaacagccataaatgattgcttcacatcattggaagcttaagagttacctgtgtctattaacttcctacaaggagtaccaagttaataatggagaaacatatgtaaccaatatcatgataaccaggtaatcaagattaagggaataatgacattgaaagtaaacacttttagtaggatgtgatgaaggtggccctttatatctgtgtcctttctccctagaatgcattgttttggtttagtctcaaggaacatatcaggccagatcttatagaattgcattccacaaaatacttcaaagctgttaaggttcttatgaaaaccaaggaaaatgtgtgattacagcaaagagaagctgttggttcgggttcttcttgcctcaggacacagttgcttgggagtttgactgtacttatcgcagagtggagcagtccagttgaagatgggagacagcagacattggtattcccttgcttctaggctatcagttgcggctggagaactgcttggaaaagacaagacaaagtgtcaggggtccacaggcccaagatgggattgagaccagctactcacaaacgccgggacatctaaatattgcagagtcacaaggaggtgggagcagagttgggggcctataggctagctctggcttggctcagcagtgattgtccttagtttgcctgtctttgcggttggaagctcagggagacctccctgctccccactgtgattcttgatgaaagagagtccatggctctaaactgtttattgaatgttcatcatggaaaatggatgaatactatactgtctcagggtagatttgagattaaatgccttttgcagagaagaatgtctagaaagggaagcttattggctaaaccctcaggcatgctaggtacctcattagcatggagaactctgttctgggcctatgtgaccataggtaacattttcttaagtggggagtgtggcccatgttccaggtcaggaatctggcagggagaggcaggtgcttaagtctcaggggtgtccccaccaagtctccaggtctccaactgctctaccttaccaagcttcctggcatggttttaccatcccacaagaagcttaaagagatgtaatgaacagaggcaaaaaaagaaagaaagaaaaaagcatcttttatgaaatagcaggtacaggcaagaacattaggtgcaaactaaggaaatccaaatagatttctttaataagaatgtatctaagttgactcatgaattctaacaaactcaccatagtgatataagaagtgaagatgagagactgggatgtgtgtgttcacactgggaagcatgtatctccgcagagctgtgtggctctgagatcccaggccacacagaactcagaacaattaaattctagtaagcagctctgcttctctgacttcagggtatgctgctaagctcgagccacagaggggaggaatgcaatccttttaacaatgccttccaggcatcaaacattctggagaagcccgggagtcagcagttactctgacctaagactgccaggcaccatagcaccctgctggtatgtagactgcaggccatgttttggactcttcctttcccagaagggtacacccaacttcctgctccaataaaaaagtcggagaacaacacccagcttagagaagagggcgtccttaaagtgttattggcaaccttaagggaaagaattcctagcagggaatgaaagcatttttaataaccagacagtggaggatttggtacaaaatcttcaaagttaatgtagtatgctcttttaatttcaaactaacggtaacagtagtataagattccaatcacccatggaaggagttatagagacaaagtttggagctgagacaaaaggatggaccatctagagactgccatatccagggatccatcccataattagcctccaaacgatgacaccattgtgtacactagcaagcatttgctgaaaggatcctgatatagctgtctcttgtgagactaggccagggcccagcaaacacataagtggatgctcacagtcagctattggatggatcacagggcccccaatggaggatctagagaaagtatccaaggagctaaagagatctgcaaccctgtaggtccaacaacaatatgaactaaccagtaccccggagctcttgtctctagctgcataggtatcaaaagatggcctagtcggccatcactggaaagagaggcccattggacacgcaaactttatatgccccagtacaggggaacgccagggccaaaaagggggagtgggtgggtaagggagttggggggagggtatgggggactttggggatagcattggaaatgtaaatgaggaaaatacctaataaaaatttttttttttaaaaagaaagatttcactacgagccttctatttgtatgtgagggccacagcaaagacattgctgagacaaagtggctgctcccgaggggaagatttatttctgaataagggagagaacacccagaagcgcttagaatcgtctagagcaaagagaaaaattagactgggcatggcccgggaccgggaagcacggaagagagaattttagggaatattgagagagaatagtggaccgagaaagaggtgaatactggagtagctgggttctaaagaggatgaggtgtggctgggggtggggtggggagggaagctcacaagagcaggagcaagcctagaaatttagagtagggaaggagggaagcctggaggggcaaaaagggttgagatgctaatgagacagccttgaaatgtataatgggtacttgtgaataggaactgtaagagcctggaggtcaaaatgggccttgagatgcaaccacagtggggaaccaaccatatgctcttttggtcagaaatagggtaaatggctgtgtttctgggacaggaaccctttaacaagtttctgaggagcactggttttatctagctgccagtagtcttcctatagtccggctagatctcatgtcttggcatatgcattttctgagacctcaaattattcatagaaaccagtggttcccaacttgtgcattgtgacacctctgggagtgacaaatcctttatcatgaatctcagataattgcattacaattcataatagtaccaaaattacatttactaagtagcaatgaaattaagggtcagggtttaccacaacatgaggaactgtaggtcacaacattagaaaggttgagaaccactgacagaaacactttctatctaaaagcaaacaagcaaaacaaaacaaagtaaataaaaacaatagcctcattatcccccctcctctctctctctctctctctctctctctctctctctctctctctctctccatatatatatggggaaaatattatgaagtatacagggaataaaaatcaatactgctattatcaataccaataaaggcagtgaaattgtgtttcttcagagcaattctgcatgtagatatcctttcagatctgtagtcaggtaacttactctatattagaaattttctacttccataatagaacaatacaacaaattaggcagttgggagacagacttcattagaagagcaactagacaaacactgtttgcaaccaatcaaaggagaatatgctaaaagtaagttgaaagctgcccttgctccagggctggctcaagaaaaagggacacatatcccagcatgcttctttgtgaggacaagaacaaggcactctttgcaggcacagggccttgttaatgaacacagacaagatttcagcatctgtgaccaagagttgctagagacccactgctgagctagttttgaatgttgtttcatcttaaaacaacaacaacaaaattagcccttatacaaccatgttattgcatttctctaaatccttagaaactgaaaatcagcttagctccaagaaatgatgatttctaagattttagaatacagtatgtctgagggatcagggtggaaaaatgacagacaaattaagaaaaactcaccaatgtagaagacacagtatagtgcactgagacatcaaaagccaatgagacactgacctttctctctatggaactgagccacttggagcagtagataaaagagattgtacactctaggtataggacagtgtgtggtctagttgaatatataaactccccaatggggggctatggaattgttgctgtgtaggtgactctgaggactagagaacattcatatgtccaggaggcaggggtgtagaactataacccacaccctgcctacttggcaagaaagttctttcttcttagtctataaagtataaagatcttttactgttcttaatttaaatcatgaacattgttgatactaatttcattatagctttgaatgaaaatcctgtgtctaatgaggtaaattagtatcacggtatacacactgtatcatttgacattgttttacctccgtagagccactcactgttaaggaagttgtcagaatatcatccaagttgaactattaaaatcttaattgtggaagtgagatcctatctaagagctagagagaaatatatgggatgacattcccattgtattcatgtccatgatcataaataagctagtgtttttaaagggtggatacgagatatcagtgctcaagaagtaagtttatagattgaggtcgaatgccaaagagccagagtaaatattccacccaggagggacttaaaagtgatcagtagttatttgtttttgctgtatcatagcttacaaaaaaaatatacccttcaagtgggatgcaattatttttaacttctgttcatacacagccctgtttacaatggcgtcattgagcatctgagcagcaatagcttaccttctgttgtgtgaagagagaaggcagtgcctgtttggattcccatcaacaaccaagtgtgagggagtgaaacagatgctgccttgtggtcccggggtctgaggtgttgcaggagaagggggccatgattacactttccaaaagaaacacgctgagcagcaccgggagaggtgaacatcaacactctcagatatctttcttaggatgcataaatacaaaagctcgaatctggggcagtggggttagagggaagaaggaatatgaggaattttatctgtgtagtgattcctataaatttccccagtatttgagctcaaccctgtcctgtgtatccccagcatccttaaatagaagggaacaccttcttcctcactctcaaggagcaaagtcaaggaagcatcaggtatgatttttctccaacacagagtttctgacaaggggcgagtttgcctctttaatacattcgggagtcctcttgagaccaattataaaatctcagaacctggtattcttttatcacgttaccctctagatctacagatggaagaacttaaaaacagagataacggagggaacccatagtgaaatctgcatcactgccttctcaagtagcttttctgtgcctgtccaagagggccgtctgcgcattccagtcccatcttgtttacaacagtacaaacaagaaataatttctggcaccagcctgctgtagacttcttaagcggtgcacagcactctctgcattctctttacaagatttctgtattcatcccttatatcgttaataccacaggacccacaaggcactgtgatatataattttaaatgaggaacacacagcagagaaaggtttttctgggcagagatctgaaggaaaactaaataaggagttgtttgatgtcagggttttgttgctgtgcctccttgccttatgcaggccttcctccactgctctgctcttaaggccaatattataaaaaaaaacagataatcaaagttgtaagtgtatttatgtaagtgtatgctttacaatcgttggcttaattatttaatttacgtttcaccattatctctgttataggaacaccaatatatgtttcagaggggcaatttttgaagtcaggatagaagaagtttctaaggctaagcatctgggcatttatttttatatgggacagggacctgaaggaaatggcgacagtagtgggcaggggaggacataggagagggattgggtggaaagagaatagtcaacgtgccttgtgcgcatgtgtcatcctgtcaaagtctaacttcaattgacaaagagaatgggatcctgtcgtctgtggtgtctcgaagggaactggatgccattgtgttacatgaaatctcagaccttccttggaggacagctagcttcatgcgttcatgtgcagaagctagagaaagccagtctctaagaaacagaaaaccagatagcagcaatcatagcaggagagagtggatagggagagacggacagaggacagatggtgaggtttcataggacgaatgacttcagatggcctatagcgggatacctagctgacaagagttaaatatttctaagcacttctgatattccctaacacaaggaaattatgtgtgattgaggtaatagattacagtaagccagatctgattatttaaatgaacattgaattgaattgtctcaccacaccccataaatgtgcataattactatgtagtattttaaaacaaaatatattaaaaaaattttttaaagaattaaaatctttgcatcatgtcactggaatacagtagaggacagacattctctattggaacagcagttatttttcactgtgtttgcacttggcttggtgtttccaacctatgacacacagcgtgcaaatgcatcaagctcccagacacttaataaaggtgttagtattttcaacggtttctgtcgtccccaaataaatgggaataaattctagttttgagaggcctgaggagtcatttatttagcagataaacttcctgctcagaaaaaaataaaactaataatgtcaggatgtaaatcggagcaaggtgctctaatcaggcacaggggaaggaatgaaaaggtcctgccttcgcatagcaaatgagatgacatactgatggctcgtcttatcacactggaaaggctggaaataataagcaacaaaatgaacagctaaagggtctttctctaggccagtgagttgacagatttcaccaataaatgtcaccactgcgtatgagagatttgtaaacggtgttgaaatttaggaaaaccctttctgtgacagagacatgtatagcagggcacagacctatataaagttttgtaaatataaaatgtatcttgatggaacaggtttggctttgctctcattagtgtcccttcaacaggtgtctaggtgagaggtcactcctcccttataaatccaggctcccacacagtgatatctttaaaaacaaggaaatatgctggtagctgcaaatttcacaaaatgaaatttggaaccaacgataattctagatgtttcaaagtggattggcttaattaacttcacagtggttgatagcacagaaatgtgtagttaaaaccttctgaaaatttgggaggtccatagagatcccttgatgcattcagccatcttgtggatcaacagaggaccaagagctagtggctcatgcagacagaaaggtgaaccatggagctgaattatgggtgctgaaacactgcttactgcacagagcagtcacggtaatcgcctctgtcaagccttcaagaaaatgtttggacttcaaaggacagggtcttgggttatgatgcaagtgggattacaagctggtaggaaacagagactctttcaatgcttccactgccttttggtcctgggagggacgatactaacccacctcaagttttactgaaagctgctagaagaaccaccatgcactctagagcaatctctccctcagtttgagagcaagtgttgcagaaaaatgacccttcctgacaatgccctcattctatgactagatttgggcaaaaaaaggaagaccactaagaaatagcaagtcaaacacccaaagtgagatactggaatcttatttttccaatgcaacttctttattcttgtgaaaggagagttattcggtgttcatgaaaagcacttgttttctgcagtttccaaatttatatttcagaaaatttattcatcaaaacagctacaaacatgatgataaacatagtcttctttcagaaataaaacctagattgtgtgtgtgtgtgtgtgtgtgtgtgagagagagagagagagagagagagagagagagagagagaggtgaagttgctggatgccaatcttgacatcatgaattcgaatcaattccagcaagttgtcccttgatctccacacttaaacatcagaatgcccctcaatagatatttatttttgatgcatgaatagatggattgatgaatggatgg

SEQ ID NO: 649 - DNA, 4600 bp, Mus musculus
acctccagggcctttttgtacacttagggccattcagtcaggagaacaaagggaaggaatctgtctcacctcaccagggaagcatggaagcagagggcatcctgcctccttttgagagggtagaatttcaaaggcttagaagttggtaggaaggagtggggtagggaagaggtgccaaccgataccactgaagttaattgggaatttgagaaggtggagatgagaaaatgtactgtttagttattcacccatccatttaaattttgatgacacattttatcgctctactctaaataggattggctaatttgcataatatggtgctgtgagcatgagtgaatgagtagttttcatgcattgcatgcacactaacatacatgcgcatgcatgtgtttgcatgtggctatatttttgtagtcagatgagatgcacaccctgaagcgcagtatttggatacggtactggatttgaggtgatatcatcctcacaaaaatttcctttcaattttgacgattttagttttgaggttctgtacctccatttggattcagtctagaaatcggtgtgtctcatttccttaagagtagagcatagttgcgatgcagtgtgcctggagttataaatggtatctgtaacactaattatctcagggaggggatggttgctgtccatgatgaggcaacagcagctgcagtgtgtttgaaaccagagcacaggggctggagggctggaggggacaggcggcatgcttcatttgcttagaaaacaactcagttgtgcagcagttctgttagaatatgatcttaacaagttaaagtcaagttgaaatcatttggaattcctcccctccccaacaaggaaatgttctgctaacacactaccgatgtagatcatgcagctgaatcattgctaagcagatatcagggttatgtgacttgtatcgaacactataacatttctgagggttttacatttctaaaagtcctcccccgtgcaaagtgataatgttttgtagctaaaatgcaagatcaattgacttgagacaaaaggatttcataaacaaaatgacaatcctttttattgggcatatcccgtggtgtgacttggagaattaaatactgtaagtcacttaaggctattttgagtctgtcctttggaatttaatgagtttctactttaggctgcatctgtatcacagcactctccctggtttataataaagtaagaatctctgtgattctaaggggatgcattgaatatctttgtctgtctgtctgcaggtgcttattaagtgctgcatatactagtgattcaaggactgtgcctagtgagagagcaatcactatgtcttttatgctcagtttctttataactactatatttccacaaagaaagccatacatcttatacagatattctgtcatcattatgcctgcatctatttaccaagtgttaccaagcttgtgtcaggtgtcctgttatactctaccatctaaatggaacactggccacacagttctcatcagtagaaagaccatcacagacttggggagacacacatcaaaaataacagttgagatgcaaatgtggaattcgttataaagcatgcagaccatccaaggatcttctggttgatttaagtcttgagaggaaagtcagaatgtttcttaaagggtcagagaaagatgaatgatgactgagctggcccttaaagaagtaacgcaactgtacccatggaaaatgcagggtgtaaaaatgatgtggtattttaaagagtctattgctgcaaagctatgcgaaggtggaggaaatagacaaagcacctcttaagtagtgtatattgaatagaaaaatacaaatatattctttattcaccctttaaaatgtggacaggctaaacataactttggaaaactgaaagaaaatctctttgtaaaatcacatttttcaaatgaatggaaaacaagaaagaatgaaggcggagagtgaggagggaggatggcttaggaggggaggcgagaagagatgagggatggaaggagaggaggggaggaggcagaggagaagagggaagagagagaagaaaggaatgaactagaggggggaggaggggaggagaaggaggaggagagagcagaggagaggaatggtggatgtgaggaaaggaaaatgaaagaaaggggaagtctgaagaacacacacacaaaaaaaaaaactgagtacaagggagaaaacagaagaaaaataagaaccgtataacaagaacacacctcagttctttgaaaatatatgagcctgcggcagatagccagtccacatcaaatgactgatgaactgaaccaagagagaaagttcaagtgagtactgttttcaaaaagaagcctgaaagttatttgaagagaagaaaaggtgctatgagaacattttacataaatacaaacagtatgtttacacaccccaaaattaacactggaaagaggacagataaaaactaagcaggcagctgaaaagagacacttcaaccctataaaacacaacagaggtgggcagtcttatgtcctaaattacagcttaggaaacattgtttgatataagaagaaatggaataaagtataatcatacagaaacttagtaatagggttgattactggactcatttgaatttatagacattgaaattatgtttccatgtgccatgaagaacattaatatttattatgagaaccaaagacattaacaaggcaagatgatttgagtaaagaaaaaagttatcaaaatgaaataaaaaaaaagaaagagtaaaagactcctcagggtctgtgtttctggctcaaaaggaagtcacttgacctcaaccatttgcacccatgcctgacatccccatccccatgtccagagcccacacgatagaagcaaagaggcaaagaccacaagttgtctgctgagctccacacaggtacccatgtgagggcaaatggatacacacatacctgtttggacaaataaataaaacttaatgatcattttttaaagaaaagagttgtcatacttaaaaagcaaaagaaaagtccaaaaggcaaacaagaagtaattaatcaaacaaacaaagaaacaatagcacaaaaaacaatggagttggccaggcatggtgacctacaaacagggtgagttcaggccagccaaggatacactgtgacagaaaacgaaaaacaggaaaaccaaagagacagggagaggaagatggggaggaggaggggaggggagggggagggggaggggaaggggaggaggagggggagggggagggggagggggagaacctcctctcacactcctggagcatggaaagagcaatgcttaggacacaatatctgaacaaaaatgaaccattgcaaaagcataggaactatttcaagggaggatgcaagaaaaaagatgttttctaaaaatatacaaacacacacacacacatacacacacacatattcgcactgagaaaagatgggttttaaaaatacctctggcatctggcatccttctctgcagctgtaagtttctaaaataatggggggaatgacaagagagttcctagaaataaagttatggctcagaactcttcacactgcagaatggaagggaagtggcggacatggccagaaagaagatcacaggcaagtggactcctctcttacagtccgtcacaaggcagcacgagtctaaacaatttccatctgttctttggtttcattctcatatggtcctgataatggaggccttggttgtcattttaaaatggagaggggtctggagaactggtcagtgggtaaagagctcgccgcacatatgcaaggacacaacttagaatccccagtccccaggtaaagacggctgtgtgcatttatatggtgaaatcaaagatggagatgggagagcccttggaagctctgaggaaaacttccttgcataagaagaggagaacaaaaagcctcaccctcaaagctggtaacagataagactgacatttgaggttatcttgtattctctatgtatgggttatggcatatgtacctatattcacacacaacttggtacacacacaaacgtgcacatatattatacacccacatgccattttttaaatgaaaaggcagaaatgtagaccaagcagccaggccctcacagccctatttcttacccactccctgaccttaattttcatcttttgaacctcagatggacagactggacagtgacctatgacatgtctgttcttctgtccacagccatccttctaccttgaccgtcctttaagatgctcatgcctttaatcccagcactcaggagacagaggcaggcagatttctgagttcgaggccagcctggtctacaaagtgagttccaggacagccagggctatacagagaaaccctgtctcgaaaaacaaacaaacaaagatggacactctctctaatcccagtacttcctgtttgttgcttcacttcttgtctgctcctccacttcctgtcagttgctccacttcccgtctgctgctccacttcctgtctgctgctctatttcctgtctgctgctccacttcctg

SEQ ID NO: 650 - DNA, 2100 bp, Mus musculus
gaggctccttcctctctgatggctcctcgcttgtgtcgagttgacacaaaaccagccagaacggcatgtgtacttctaactatacacaatgaatacaaaatgctatacagagaaagatggctgacagccaaggctgatgatctgagttcaatccccacagcctacgtggttgaagggagaactgactcctagtcattctctaatcaaagaaaatttaaagctacaaaagtatggtatttttagaaatcaagtttttgttggcatgggtataatctattaataaaaataaaactcttatccattttgagttggaagactctgaattagaagtcttagagacactaacacccaggtagatcctaaatacctctgctgaccagatttggattcaaatatggtaagcccactgaaagaaaccaaaactccttgctgataatgctgatttcacatctgggacaggaaattcacaagatgagcttggagcattttactgctctgggaagcatatcaaagtttaatgagactcttcaaaaggtcacagagaacggctaatgggggctctcgctgaccagaaatgcatctttgcagcaatgtgagcatcaaaataatgattgccgttggttacgatacacaaaatccactgagaaactttcttatggcaaaaggaaaaataaaaaataaaaaaactttgaagacaatgaattgagaattcagcttacctttcttttaaaaaagaatgtaatgataataattcagaaagccaaatagccctatctgagggacagaaaatgacaggattccaactaagaaatggagcaggaacccatattaggaagtcaccattttgtgacctgcattgggacacaagctcaggcagccaagagacattgaaaccgtgaaaagaccacacgcaggcattagcaaggtaccaaagcaagcgacgttcttccaattgtttgctaggcattcggaggaatgctgctttagcatctccacagcagaaaatgcttccagccacggtgtcatgtggagtaccagctcttctctaggcaaccttggaggaaagagttggatttgaacttaatcaagactctggcgctcgctcccggtttacgggaaatagaaggggaagaagaatccgttgaatgtcaccatttgcaaacagatacatcagaaacgtgaggtaggctccatcacaagccatcgggagctgaggcacagttccacactgccacctgcagcctgagatgttcgcttcatgttctgaaactggatccttagttattccacagaaaagaatctcagggcgagccaaggtgaagtgcgggaggggtttattaaaagacattttgatgcaccaagttaagagaaattgctggggaagagggtaggacacctgggagcatgccatgacttctcagaggagggtcacactttatcgtcttcgcaatggtcatatataagccttggtggtttctgaaggcattatctttaaagggttgctgaggaatttcaatgatgctgcggaagccacagaggtgtgctgctagcggactgtgctctctgacccattccctgcctcatgctgtcggctttctcaccagcccacccacctgcctaaggatggtactacctgtagtagactgggccctcctacaacagtcagtattcaagaccacacctttataggcgtgccaactgacaatatggtctagaccacgcctccatgggtgtgtccttgggcaatctggtctaggcaatttctcagttgatgtttttcctttatcctaggttgcatcgatgacaataaagtctacagaggaatgtcatctctttgtcagcaacctttgcagcaaatttggaattcctgattctcacctggctggaggcttcacacagactccagaaaaaggggctcagtctccttcccgtgtcctcaaaagttgccctctagtccccacaccacataaatacacacatgtgtgtgcgcacgcgcgcacacacacacacacagttttggaaattacaacattaaaaaaaaaaaaaaagaattccttaactttaaccaccaaccaaagagcatgcatgggagggatctcg

SEQ ID NO: 651 - DNA, 1650 bp, Mus musculus
tgtgtgtgtgtgtgtgtgtgtgtgtgtgtgtgtgtgtgtgtgtgtgtgtgtgtatgtgtgtgtgtatgtgtgtgtgtgtatgtgtgtgtgtatgtgtgtgtgtgtatgtgtgtgtgtgtgtatgtgtatgtgtgtatgtgtgtgtgtgtatgtgtgtgtgtatgtgtgtgtgtatgtgtgtgtatgtgtgtgtatgtgtgtgtgtgtgtgtgtgtgtgtgtgtgtgtgtgtgtgtcacttagaggatgccactgcttcagaatgactgttgttacatgtttatcttccctgcaaaatgtgtctttgttttacccacaaatcttcatgtggtaagaaaataacttttttcactcttagaaactgtgacaccaggaaacaaggaaactatatataatcagtcagacagcaggcagcaggtgtttctcaggtctgattcagcacacttcttcccattgccatggtaacatctctgacaagagcgatttagggtaaaggggcgtaccctgtttaggttacagtccatcactgcagggagtttcagtggcaggagctgaagagggctggcagcacaggatccctagtcaggaacctgagagcaaagagtccctgtgctcagctccccctctcctttcatgcagcctagcacccggttcatgaactggccctgcccacagttaatagatataatctcataacaaatatgatccccccccttcacaagcatgcctgtgctggtttgagtgagaatagcccccataggctcatatatttgaatatatggtccccaattagtggagctgtcagagaaggattaggaggtgtggccttgttgaagaaggtgtgtcacctagagtgggttttgaagtttcaaaagtccatgccattcctagtaagtgccctccctctcctctctctctctccccctcccctctccctccccctccacctctctccctctctccctctctccccctccccttctccctctccctttccccctccccttctccctctccctctcctccctccacctacacctctctccctctctccctctctccctctctccccctccccctccacctccactcctcctccccttccccctctccctctccccctccccctctctccctctctcccactctccctctctccctctctcccctccccctcccctccccctcatgcttgctgcttatggataaggctatgagttctcatttactgctgtcacgccccctgccatgatggtcatagactctaagctcccataaactcccataaatggccttggtcatggtgtctcttcaccacaacagaacagtaactaagaaaatccccaaagccccaccccagaagattctagattcttccaagttgacaataccactgaccgtcacaatgcatatcaaacctcaagctttgaggctattgagggaacctgctcagcacatgggatcaccttcactatgctctgaacgaccccgagacctccaggcagaagaagacctaactgtgggaccagcctcaagggcagttcacccatatcttcctctcccacctcctaaagttcaccctggctcttaagagggcctccaaggccagtgtcctagtcaatgttctacttctatgaataaacacaatgac

SEQ ID NO: 652 - DNA, 3175 bp, Mus musculus
ttgtagaaaggcagagagagaaagagaagagggaggtagaagccagccatggccatgggtggggggggggggggtgcggcgggggaggtgggaagggaaggcagagagaaggggaggaagggaggaagtgtaagaacagaataagaggtaagagagtgaggagggggcaagcagctccttttagagtgggctgtgccatgctggctgttggcaggtaatggtggagtccagacaaaataccaggagcttgggcattacctacatgactgatagccacacacttctcttcagggggacgtgggaggctgtagctgtgacaggagccagggtcccaggaggtgtggccaaacacctaccatcccttaagaggttccaggcctgtgctggactggggaccaggctgtctgtgcacagctcactgccccacacaagagggcatgtttggccaatcccagtaggagtaatctctaacccataagcatccaagaggagaaagctatggtagacattttctgaaaacactaccaacatctgcacatggaccagaaggctttgccatttctgaggtgacagtccttggcatgaccagctcacatcaataacacacctcctctcaggccttcacgcactcggggcttcctctaccctttgaccctattgctttgaaaaggccttacagtcagtctcagtacagtcagattcgaggctaggatttcagcatagggactggaatggagcacacacattcagagctcagtaatcttctgggtctctgaatccaatctcatctgcaatggccttgtttccaaatgaggtcacattcttaagtactgagacttgaggttttaacatacaattatctgggcacagaagtcagctcctgacaggtaacctagcaacagctcacagcatcagtagcagggccaggagaaaagaccaagggaggaaactcagccaagacgatgtctggggaactgccaacctcacccttccagaggtcatcaacagagaaagaacatgtcccacacccacaatgagcccccggtggtggattgtcacacctgtctactctgcggtacgccccaagacccctttaggtctgaacacctatacagtcatccacagtgaaaatagaaacagaggtgtctcttcaaccttgagtcacagacccccagtgaattgccagcaaccagaatatagcagaactatagccttgggtgggaggtggacacccgctgtacagtatgtgagtccatcatgggaaggcaggtattggggtgccacatagacagaagaaactcatgacagagctgtttgccacatcctgtgcaccaatggtcttcagtgtgtgggacacactgtccatatcctctagagatcttagcagtgtaaattatcgaccctacccagacctaccaaaaaaccacggttgctgacccagtgggctttgcaacaagctgggtgatgggggctgaaggggttctttgtctttgtattttttcttttgtacagctcaaaacaacgctacaacatttaaagtatacaatttggttacctttagtatgtgtataatataccgctgtgaaatcaccgcatagtcaagatgatgcagatgttcatcattccttgagtttcccctgtcccctccctccttcatcatctgtctctccttctctcccacactccaagggaacactgggaacattgattgagcactatagtgcagtttacaacttttatactttgcagtcttctacacgtgagaataataaatctcatgttagtgatattttcatagccagtgttccatgatatagacataaatatttgtttttaactattcccataccctcggattatttcccactagaggatattagaaataaagaagcagccagcatttgtgcacaagtctttgttcacatgtttccatttctgtttgctaaacagaagcagagccagtggtgagtacaagtttatctttgagagaaactgaaaactctgtttcctttttggcttctatttctattttaggatctggacagatgactcagcagttaaaagcacttgctgctcttgcagaagacccaggttcagttctcagaacccatatgtcggctcacaactgcctgtaagtccagttctcatctgaccttagtgggctcctgcatgagacacaggatgcaaaaacatacacgcaggcatgtaggggagttgttctgatgttttgacttaattgggaatctgtgtgtactaacactgaagttcattgtccccaattggttttgatttatcaataaagatgccagcagccaatggctgggactgggtgggacacttagagttgtgagggtaagacacagagagaatcgccaggactctaggagaagaagggaatgaagttgataaagtcagccagccgtgtgagttttcaggtaagtggctactggccacttccccaattaagcctggagtagcaggggaaggtttaggagtgcccagtcattgagttagccaaggcattttaagattaattggcgtgtgtgtatggtttccattcgtggatctaagatagctcctaggcaagtgcatgcttttaattccccaggagctcaaagcagagcggccaaaaaaaaatcaacacaacacaggcatacacatatatacatacaataaagttaatatcttttaaaagcatttgcttgtttctattttatgtgtatgagtgttttgcctgcaagtatgtatgtgcatcatgtgtatgctgtgcccaaagaggtcactggatccgctagagccctgagacagttgtgagccaccatgtgtgtgctgagaactgaacctgggtcttctgcaagagcggcaagtgcttttaactcctgagacaactcttcagtcttgagccaaagtcttggttttccaaagccactgttctgtgttgcagccctccaattcctgttcatgtctttgtcagcgtcgggatcatagccattctaatggatatgctgtggaaagtatagccttcatttgtatatccctaatgcctaaaaccctagtatcttctgtgctcatttgccatctgcacaccttttctggtaagttatctgtttggacacgggacccactttttgttaagctacttatctcattgagttgtgagctagccatgtattct

SEQ ID NO: 653 - DNA, 3325 bp, Mus musculus
ctttcaaggtggacttatttccatttcttatcaccgtagcaggaagcttaccatcaccctatctaaagagtcccaactaacatctttccctaaggagagaactcctcggactgagacacagttacatgatagttggtttttattctctaagactcaagatcctcattgacactatccagggaatgaaaataatatcaaaaagaaaatgatctcaaaatcaaaaccaaccccccatacattggtatctatggtagctatgttaaaaacacattcagttactcaattgtatttaagattattgggggaagccgggcgtggtggtacacgcctttaatcccagcactagggaggcagaggcaggtggatttctgagttcaaggccagcctggtctacaaagtgagttccaggacagccagggctttacagagaaaccctgtctcgaaaaaaaaacaaaaaacaaacaaacaagcaaaaagattattgggggaagtactattctggggaccttccattcttggaggggagctgagtctagctgtcagggaggggctcagaatcccattttacagataagagacaccaaggtcagagaggaagactatgtggcctgtagtcacatctcaggactagagcagattcaagagtctaacttgggtctaacttcaaagctccatgcctgtcatcactctgggccactgtctttgtaaacgctgttctctggaagcaccccacagtttgcatctttgccggagaggagaagggggaggcacggctttcatgcgcagactctggctctggagtcgggacacacggcgtcacagcacttggccgtgtttacgtggctcgtcagacaggctgagtgtgtctgtccaaatggactgtgagttgcgtgatagactggagattttatgtgaggagcctctgacagccagggggcctggcctggcagtgggctgcaatggccaccctgtcctgcctgtagcttcttggttcaccagagttccagagtggaagacaaactgtcaatcctattccaccaccagttatggtatggaagacaccagtgtggtaccccagagggaaagacctgttatggaccagctagagcaggtcagaggtctccactgcatcccttctcacatgaaaagcagaacccagctctcagcttgttatcaagacaggaaaggtccgagaatctctctaaagcacagctggaaggaggtccttatgcaaccacattcctctctcttgctcacagtagccatctccccccaaagctctcagatccacctgggtctccccttcaccttcccagtcattctccagccccacacccaaccctaatgacttttgcagatcatctctggtggcagtagctgagaggccagagactccccgagcccctgggctctttaagcagcctctgagagggctgcaagtgatttagcctgcaagtgatttggtaccgggcataacaacaaacaggcctgcagggaatcacttcagcagaaagatgttggcacgtctctatagcaactaggggaaaatatttcacgcaaaagtccatctgctgtaacataaaggcagtcccagccaataatggagttgtaacaagttataaattaatcctaatttgcaagctttattttaccaaaccacaacacacacacacacacatacacacagcatatatgtctttacacacgtatgcagacatggaacaatagtattgcagttgtgactggattgtctcatccagacctcatctgggggctgggcacttagttgtcaatgacttaaatccaaaccctgttaaaacagaggagaccagatgaccaagttccctacagctttcatgcaagtcagagttaaaactgtttttattcgttttgtcagcttctttttaagggtgaaaaaaattgggtttttgtctctgatgtctttgtaaagaggcatttgtattgattcattggtatgaaatgttttgcagaggctatcggagtggaaaaacaaagtgataatttgcattgtgatgcttttaattttaagtattgtcaacacttcaatgtgggctgagctttgcctaggagcacaagactgtgtctctggctgtgtagagaatcctggctgcctctggctgctgttccagagcacaacgcccactctggctttgaattatttcttcttcttcttcttcttcttcttcttcttcttcttcttcttcttcttcttcttcttcttcttcttcttcttcttcttttcttcttctccttctcctcctcctcctcctcttcctcttcctcctcctccttctttttctcttttttttttctcccaactccacatttcatatctgttctgcaaaattcctgtagcctagatggggtggagagggagatgcaagaacaagaggttcactcagaacttcccaggtcacttgggggagggttgagaccaccgtcactaatcttgaagacgaatccctaagtctgccatagcccttgagccaagtgacgtgccaagggcttgcacttgttaaatgtaaaggacttgccactagccacagatgatcaagtccttcagtcaccatatgctagaacttaacccctttcacagcagtgtccagatgtgggagctctgacatttaaaaaaaaaaaaaagcctgcaaaggagatgagatgagagtcttgaagatgagttatgcagcggtgtgtgtggcatcagaagttgacaaggaccaatagagaacaaccatagagcctcttacaaaactacacgagaagttgccagcaaactccatgtggacttttggacagggggttggtatttgaagcaaactgtaaagatgagacagctggataaatggcctcctcaaaacagaacaaacaaaatggccgtcttgaattgtcaccctctcttattctatgaagcaacaataaaccctttcccagtaagagcacactatgcaatagaagctggactggatataactgggtatgcccagctcagtggctaggctgaggagacacctccgcccccgccccccaaccacttctcaaagtcaagattacacccagcaaaggtcatggtcatatgcatagtgaacctgaataagcgagcatctctgcagtaggacccagaatcctttgggaatacgcctggaagtggcacacagtcaggaggcagtctgtttccaggcttttcagaggtcatcttagatgtctgcgctactctgactgggaatggccccgtaggttcatatagttgaatagatgcttctcagctggtggaagggtcaggaagcataaccttaaccctgcgctt

SEQ ID NO: 654 - DNA, 2500 bp, Mus musculus
caaagtccagcctagggtagagtcttgccatggagagcagcaatttatagaatgttaattaaagagaaatctaaatgaacatagctagggtgaggtatctccaggggtcttcaatttacaaatgggttggccactggtgatgtagaccaaggttccttaaccttttcccaaccctaacccctttcacattctagcacagtccattccaaagatatgctagtttggaactcacatgctgagacatcgtggtagacgaatactgaaaatttattttctataattgaaacatatttctatgaagcagacctcaggtatgtagatatataaaatctatgtagaatgtatctaaatcaaacatgttctgatgattaatcataataaaattgtattttagaagaatttttgatatttacatatgtgtgaaacatattcatacatgttcataaaggacaaaaaaattaatttgcatatgaattagattaacattttttattaatttttatgtaaagaattataccttgaatgcatattttatattgcaggtcaggacttagcctacatagagaatcttggatgctttctagagtttattgacatttttatttttaattattaatgctaaaaattcctcttcacataatttcaaagttgttggaaattttgtcctaatcctaagccagaattcattcagtgattttttttaataaagctcaaatttacaacttaatttttttaaaaatgtatatgtgcatagacattggacacatacaagcatggacactcacatatgcatgcacatgccatgggatgcatgtgggggccagaggacaagttgcaggatcacatgagtcataggaattgaactcaggttgttggacttggtggcaaaatctctagtcactgatccatcttcctgaccctcaagggttttaaaatcaaacattctaactttacccaatccgaagatacactaatctgatacttacacactgagaatgatggcaggaaaacatttaaagcctgtttcccataattagaacattatgcttctgtaagagcataaaaaaaattgtatgcacagcagaaacactgtaattcacagcatagaagagtctggaatctgagtgtgggcgttgtttggttggtgttgctaggtgtgctgatgcaaagtgaaaagtgttctgaatgtgtgcttaaagctgcagtgacatcaccctaactgccgaaacatctctccagccccagtcaagggcttccccatcctagtttataaaacacccgaggtagggagaatgagatgctaggtggcactgacgcccagctaatgatgctcggaggacagcggtcagaggaaggcacctggaaaggtagagttggatactggatgctcccagacagaaggacaagaagccatctggagagagcagagcatcattccattttagcatttccttatgcttcagactcttggttgtgataatctgttattcgctcagacgctgggaagggttagaaggaagccgactgcaaatctcttcttagagctcagctcttcaggtaacagcttgtattggtatacgttacatcatcatatcactgtggacacagaaagaaatgacacagactgggctcagaaacccactggcccccatttctgaggtctagaagcccatatcaagatgtaggcatggatgagtacttcggcagcctgtgaaaccgagatgttccaagcttttcttgaaacttctggggtcctcaggacttcattggcttacagaaaatatttcctctgcacatgtctctctatgtccatatttccccgtttctgtgagcaacagctgttctgtagtagggcccaccttaagcatcttaatcaaagaagatcttaattttttaaaattttcacttatttaatgtatgagagctctatctgcatgtatacctgtgtgccagaagagggcagtagatctcattacacatggttgtgagccaccatgtggttgctgggaattgaactcaggacctgtggaagagcaggcagtgctcttaactgctgagccatctctccagcccaaagatcctatttttaaaatcactcttaggatgttcatcaggttgggcccaaaacctgtgctcaaatgatccttctgcctctgtttcccaactagctaagtgcagataaagccacctttaaaaaaaaaatctttgtttccacatgtacagacacatgcttgttcatgtatgggagcgtgagagtacacacaccagtgacagtaccttccacattatttggggctgatttgcccccccacacacacacccatcccccaccacacacaccaggcaggatagctgacccagagcttccagggacctcatatctccatctctccacagcatgggcattaccaatgtatgctaccacatgtggccttactggattcaagttcagattctcaccctatttctaaataaggtcagacccacagttgcctatgtg

SEQ ID NO: 655 - DNA, 2025 bp, Mus musculus
gaaatccgagataagtgcaagctactcctcagtttgctgtctcaattttgtacagtccaggatcccctgttggggaatggtagcgcccacagggggcagttctctcacctcaatgaaatcaagttatttctccacagagatactcagaagtctgtctctcaggtggttctagattttgtcaggttggtaacactaaccagtaagaattttcagatgagtttggaaacttgcacaataagacaatcaatgacagactaaaaactgctactctactatacttccccttactgagtcacttgttacaagtacttgccacaataatggagcacttgcttgcacattgtgcttttgcctcacactaagcaaatgttcacaagacaaaacatacctcttggaccaagcacagctcagctggtagagcttttgcctagtgtgaatgcaccctaggttccatatccagcacctgcataaaataagcatgggaaataatcactcgagaagtgaaagaatgagaaattcaatgtcaccttttgctacatgataaggctgaggccaaaatggcctacatgagaccctgaaagaaagagaaatgggagaaaagaagatagaagagaggggaagagagagacaaaagggacaatgagagaaaggaagaaagaaagaaagaaagaaagaaaaaaagaaagaaagaaagaaagaaagaaagaaagaaagaaagaaagaaaggaaggaaggaaggaaggaagagaaagagagaaaggaaggaacaaagaaataggaggaatgggagaggacgagggagagagagggagagagagagagagagagagagagagagagagagagagagattgagagattctctttggccagtttgtggaaagagaaaacatcactttgccatgcagttaagacctaggagagagaacaggaaggaatgcagagccaggtctgcaggaacagcagaggatgggaagcagagtatgtgccagctcactgtagtgagtctgcattcctcctccatcgtcctctgcccttcctgaaataactcagccctgtggctaagttattagagtgttccaagttgatcccgcacagtgtttccccagttagctaattaaacgtagcccatctaattgaatcacggagaagctcacagctgatgtttctgttcccagaggggaataggtgaggacggatgaaacccaagtacctccctctggtgccaactagaattttgtataggttttttttttaattttgtatatgtttttttgagctcagcattttttaaaagcacaatattcaaagcaataccatgtagagatcagagcaatctccccaacaaggggagagctgatatcccatttatagagcaacagttcagtaaattttgtttagctggaataggatacagttaattatagtaatttatcaaagtggcataaggtggtattcacacacacaaagagtattttcccacagttgagaattctgcattttatataagctgaaactaggactaattgaattttcacttgggtagataaaatctttaacaactcctgggtaactaaatgctctttgctcaatgatgtggatcgagatgatttacaacgcctatcacacaatcatgctaattttgctttcatatgattaattaaaacaatatgttcattcttcctaaagagaaattggggcagctaagaagccagattttattaccaacttccttctctagcataaaaaccattttcacacatcattttcaaagaaagtggttaaggacacaggccctgatggagttctgtcaaatgcagcttgatatttgtgtgtgtgtgtgtgtgtgtgtgtgtgtgtgtgtgtgtgtggtttgtttttgagacaagttcttactgtgtatctcaactggccatatgatcctcttgcctttcctcccaagtgcagggcttctaggcacccatcgccacatgtggcttcaactttactggtgggaagagaatagggacacattggtggagcaag

SEQ ID NO: 656 - DNA, 1875 bp, Mus musculus
cacacacacacacacacacacacacacacacacacacacacacacagttaactggccccaaaggtcagcaatactgaagctgagaagagagctctacacagcctgaatctcagccctgtgtgtgctttcttaattcctgcctggtgggctagcctgaggtctcccagggccagggcattctgggatgggtttggtaccagctgaagccaggtctccttgcagcctgaaccactggcactagagtgggccacatggtcactgccagagtagacaaggaaaaagacttgtgggtatggactgtgtcttgctttcttaagggaagggtttatatccgtttatagctccaggttacagtccattatggagggaaaagccacagtggcaagagcttgaggtagctggtcatgtcacattatccgtcaaaccaaagaacaacctatccttagctctgttcagttctgtcctccccaggcttccagtcagcaaatggcgccaccatggtgggtgtgtcttctcacctcagttaacagaatcaatacaatcccttacaggcacgctcaaatctcccaggggattatagattctcagatgggtgttaacaataactattgcaaactggatgtcctgcccaaacagtcacaggtcaaagttcctgagccctaagctgggtactcaggttggacccaaacactttgggtcagaggagcccagaaagggactgaaagtgtccaagaacagtagtgcaccctgtaccccacacctccagctccctgtccgtggccctgggattgggtgtgtgctcacagacaccacgtggtggcgcccagcctgcagagccttcctgttggcaggcatggagactggcctccaaacagcagatcccgttttttctgtctccttgaccgaaggagggaagaacataaataattcagcgcattccacagtaaacagtcaagtgtcaagagagcagcggttggaatacagctctctgcacaagccttaattggtttgtttagggtgagaccccagaatctgtctggtgtctagagggctaccattgcccggctgcaagtcagatctgccgcccagcctggaggagctgtgttccttagcctgccgacctccctcaggatcttggcattgcattcttgtagcagcagcgccacctggtggttatttccatagcccgcccttcctttgccttctgtctagaagtagacctacttccagccaaacttcctcctaacctttgtatgacgtccacctccacctcaggatttggagtcaacgactttaatggcaagaggtgaagtttcttatctgggaattaggataatgacagtgcttatgtcctaggcagttttgaattttaaatgagacgtatgcagaggcttgttctcaaagagccaagaatttggctgttgccatcagcatttgggcttgtccctgctggtgatgcttttccatgagttcctaggaatgttcctgcagcctctaggccctccctggcccagcgtgactctccagcgtgtgtatatttgatttttgttcattcattaattcatcccatttgtgatcatcatgaatgctcattgaacagcacagggacagcctcgaccctgtctaacaagcagtgtatctagatatggccctgtgggagcccacagccagcttgggtctctctccaagggcctagacatgttcagttgtcctagatatctctgcctcaagctaagctctttaaaaggtgtttaaataatgtgtgcatgtgtggaggtcagtaggcatggttatgtgcatgagagtagggaaggtcctctgagctggagctggggctacaggtcctctgcaagagcagtatgcactcttgagcac

SEQ ID NO: 657 - DNA, 1875 bp, Mus musculus
aaccgtgtgatattcctcaggaatagtcctctccattgtataaagtgagccatactggtactttccagtcctttgcttctggggacaccatggcagaacattctggaacctataactcattccagcttgtttgtcttctctcctttcatgaaacaagtgtcctggggtaaagtctatttctagcagctgtcagctatcacctacccctctgccatgatgtcccttaggaaacacagtcattagcagaggctggaggatcatcctgagttttaagccagcttttggctagctagcagcaccctgtctcaaaaaagaaaagaaaaagaaacaattgtttatgaccagaacaaagaagtctggagaaggtagaaccatacaggtctaaaatatatatatatataccatattccaaggtctggttgagactgcctgcatctgaactcgggagcaagaaagtcagatatgtaaatctacatagtgatgcctcatagggctgaggcccatgactaagtggtaataaaccttgctcctctggctgtcttgagcaggtgtgtgtggctggctctcagcaaagcatctgtgaatggagacaggcttcataaagaactcagctttgtctcttttctcccacacatcttcccgctctcccgactggagccagctgtgagctgctgtctgctgtttcgggttttgtttggttttgacactaggtttctgcatagctgtgaagctggccttggactccaggcaggcaccctccccctctcccaccccatcagcaccagggctttccaggctgggaggacaggtgcacactaccacattccgctccaacaggcacatcagagagaaagctgtctcatccccagacagagggaagggctgggggtgcccacttaggaaggagactgaacactggtctgtggccacacagagcaggctgaacgctagacacacatcccctcagttctcaccacgcctgactgtgagtgtcacgtgaccagctgttttaagtccccgatatggtggactgtgccctggaattgtgactagaataagcccccttccctcctaagcttctttttgtcaaggtatcttatcattgcaacagaaatgaaactcagtcagggccacacaagagcaaggggccagatttgtttctcagccatagtctgtgggaccttgaggttggggacatggggattcgagcagcacctcttaggagacggcattatgttgggatgtgccaccagcaacacagtacatacgggtgggggtcatcgtgagggcttgggggaccgttatagctaaggagccaaggggaacactcttgcgtggtgcccacacatgcccagacatgctttctcaccatctctcttccctggggctcctttctcatttctgtacacaggtgacaaacaggactgtgcttctctcctggcagggcttcaagcccagtggtgtcccctatggactgccctggcagtgggactctaagtggctgcttcccttcctcagttctcaggccttccttcaagcaggggtggcatgcccacctggtctgccctggggtcacgtcagagcttagataggaaatgatccacaggtgcccacccgtcatgcagctccagctgcctgctcagacccattcttttcctctcccacctcttcctctttcctcctccttccactcctctttctcccctaacctgatggtaatgtcacccacctccttacctgtgtctccctccagcatcctcaagtcaccctccgcactgtcctcggggtcccaggaaaccgttctgcagtagtgttgagagtttgaatatttaccacagtggcccttgatcttgagtgggcattagaatcatccag

SEQ ID NO: 658 - DNA, 1800 bp, Mus musculus
cagggtctagttgcattctgcatatagatatctagtcacagagatatttgggcaaactacttttttctagttctttaatgtttaatgggttctcttttgaatagttttgacttgttaaactccaatgaccacaacgttcatgtttatttttgtatatcaaactctgttccgttgaggaccaaatgaagtaactaatcttacactgatacccacttttcattaaagatgtcaaatggcttaaaggacaacacaaggagcactcaaagtcaagtgcctcatgggtaaactgtagaaaagtggcttttctgcaagaactggacctctctagcagctgtctggtcacattacatgtccagacattacatgtcactgagtcctaaatctaggccttgcttcaaacaaatgcaaaacggagttatttttcaccctgtcctaaaacaaaataaattaacatgtaagagcttttgagtgccaggcggtggtggcgctcgcctttaatcccagcactcgggacgcagaggcaggcgaatttctgagttcaaggtcagtctggtctacaaagtgaagtccaggacagccagggctatacagagaaaccctgtctggaaaacaacaacaacaacaacaactaagaagagctcttgagtaaccacagcacaggtgtcagtgctctggcacaaatcctgtgtgtctgtcatgggttatcatcacccatttcctataggcattgtttattaaatgtatttttaatttttattttgagatagatcctattatgtagctttggctgtcctggaacctctctgcagaccagactggcctctgatatgcagagatgcgcctgcctctgcctccccactgctaggactaaaggcgtgcgccaccacatggagtagcagtgcattttcagatccaatttcctaacttacctgccaaaaacactgtcttgaatttcagattcctcactcaaagataatattctcaccaaggttcgtaaagcataaaagggatttaggaacgacttaaagtccacacagctgctgactcaatgattcagtgagcagccaaatgccatctagcactgagtacatgtaggagagacaagttctctgagcattaactgctccctgctaagcaactgtcctataaaaacgccaactaggactgtgcagagacgaagaatgaagaataaattagtgtgaattctgtgcttctcctctggagttttcaaatatttgagtccacaagctcatgcctaatttgccccaacttaggttcctcttccttgttcctaagagactgagacaggccatttctaatcagagcacttcctggttctcatgctggactacagaacagctcctcttgtgggaaccagtaaacactgtgctatggaaaagaagtcattcactcatttattgagtgttctcaaacagaataaagttgtttatcagcagttttaagcacagcattcccaggcaggagaaatgctacttcacagggtcagctggatagagagggagtgaaagggagtgagatggaaagaggggtgccatcctctctgacctgaagtgctgcaggaactgacactgaacaccagctgcaggcacaagggaggcacaggaaccccgacacgacagatgcatcagggacctactccatgtccacatctctgctgcattcatctcaacttccttctgcccttgtaaactaccttgtgttaactaccgagagctcctacacaagctcctacacctggtccttgtgaggcccgctcgtctttctagaagagaacagggc

SEQ ID NO: 659 - DNA, 3100 bp, Mus musculus
cttgggaagaacaacaggagagcatcatatagcctggatcttatggtcagaaagtgtgccggatggtcacatccccgagtcagactgaggctgggtcattttagtctacattctccctaaattagttcagcatctgtttagaatccaaaaaagtagctgatctcttgttcctggctcattaaacaaactctaatctacgtagcctgggatggaagctcagcatagctggcaggtatggaaggccaggagcagagggagggtggtcctgctgggtgggaggacagaggagggtctgtcgttggagacaaacacatctcaccccatgcaacctttgaaggttgtgctcctgatctcagtgagtgagttcacctggtgatacagcactgcttttataaaaacgcaaaccttgcaacacaccgtgacttgtcagtaggcatgcttcttgctcctagtcatgtacttatagagcgagctttgctgcataatgaaccttgtctcctggctcttatgatgtcggcctctccagccatcccttgcccagtgtggtgtctccccctgtaattagttctctctatgtaattttgtaccgtgaaatgtgatgctttagagagaaattaaagtgatctgaagagatgctttggttcacagagaagtcaagttcctctgagcaggaccaagtgcttgtagacacacagaccttatggatctcacaaaggacagcattgtatagctggatcttgaaatgtcacctaaagtgttttgtgttaaaggctccaagaccaacagttaggaaaggggggcccagatgcagggcccattgggaagtctcctagtcattgggcatgccttagagaaggcaatggagcctctggctccttctcttcctccactgcatcctggctatgagagagtagcagtactccaccatgcctcactggctggtcacaggctgggaagccatggtcccactgactgtggtctgagtcctccaaagataaacctttctctcctttaagttgatcatcccaggtattttgttatggtgaatgaatatcattctatactctgacaattttcagagtttgtttagtacattagtgtgatcatttgctaactgtggctctcaacctgtgggttgtgacccctttctcaggagtcacatatcaggtatcctgcacagcaactatttacattgtgattcataacagtagcagaggattactgttacgaagtagccatgaaataattttatggttggcgtcaccaaaacatgaagaagtgtctcagtgtgaggaaggtggagaaccacgatctaacccaccgcctgttaatagacactggatccatttctggctagatgaaacctagaaaactgtgaagattttatcaccctccccaaccccaagtgtgccctgccattctgcaccatcagattcttctcagtccctctctgctgtcacacagaagtccccaggacacttcttctgagtctttgtaaaattagtccaacatctgtttgacactcatgcagaatcacttccattccctgacttcgtccgagttatttttagggttgataaatttattttccagcagcaaaacagaacattttttaaggtttggtttgggcgaggatctaggaaattcttgttctttggagactgggtaggtttctcactgagacatgaacttagcccgggcagctgttgctgcagctgcagggcactggcctgggctcggcctcctgggcgtcctccagcattcatgcttacagatgcctgaagtgaaaacttaagggttctttggagagtcagttgtgatggatggttttttttgctggggcaaacacacgaaagagcgttttcctgaagtggacacaggtgaaagactaaggcagacttgtgaaggcatgtttagctgaagcagacacaggtgaaaggatgttctgctaaagcaagcatgtgaaaggacacgtgatgaaggattctttgctaacgacacacatgtattggtttaccttacattttgtagttgagctgcatttgtcaggactccatagagagaaacccaccaaaatcttctggtggtgtgctgtagtttcttgctgcttcggtggactcaggctgattggcagagtggtatcagctgaggcaggacccgtgggggacatacgatgtttggagggtataaataaaaaagtgacagaggtggagctagacttgcttatagagctagctgtgcaacacttgtgggtctggagtctttgctgatcttcgcttccctgagagaggcacttcccctggcattcctcctggtccctcctgctgactagagccgaggctgaggcctggctgtctctgcgaggtcgtgccaccactgctgattcctgtttgctatgccgactctagcaaactggactgctggtgtatccgagaagtgtttgcgagtgaattgagctgccgctgctgatctgtgaactgaactgccgatttccagacaacacagacgggagttgctccaaagaacctttctaaacaggtccccccgtattctttctttccgactacctctggtgggtagtgggctagaagggaggtgaaagtgtttaataaccatcattgaaagtaagatttgaaaaatcaaagttacagatgcctccaagtggtatggttgtcagtctcctcaaaaatcaaccgctgctacagttaagaaagcctttcttgggccgcttgagcttgctttctgcagtgtaagctatgggattatacaaacagcatctgatgcgtcggggtacatagacaacatcatctcagcagcacagtttttactgctgcccagtgctagtcctcccgagccctttcaccttaacaagtggccaaaagtctaactgttgataaaaggaacaaataaaaacattactattcactgttaaccaccatgttattacaaatgcaaatgaccatgaatactgcctttcttgaggaagtctttaacaaaagaagcaatgtctgccattagtaaattttcttgttttaaagtagtcattgggcatgctggtgcacactttaatctcagcactcaggaggcagaggcaggtgca

SEQ ID NO: 660 - DNA, 1925 bp, Mus musculus
gttggattcagagtccagaactgcaggggaaaaggtaatacatttaaagtattgagtttatatttcatataaaaaggaaaagatgaactgccggaggccaaaggtatacatcagtcagtagagtgttcactcagtatgcaggaagccctggttcagttcccaacaccacataaactggctatgttggtgcatgcctgcaatcccagcacgtgggtggtggaagcaggaggatcagaagttcaaggttatcttcagctacctagacaatggaaggccagcctggatgacatgaggtgactcaaggtctcttgctaagtaaatgaattaaaagaaaagagaaagaaaatgtgatagccatgtatgcacacatatgtgcacacatatgaatattcttcaggtagtctgtcatgtgtgaatggtgaagtaagctagttgcacaagaacatatgctgtgcaatcttacttatatgtcagagatgtagtgatatagataataaaggctggcgttatctaacaagtagattctagaaagcatactctacgacacagtatctgtagttagcaatgatgtgccatgcagtctagggtagatcccaccacgatgaaaagtcagaaggattgcctttcagccggcttccttggctgcaggtgacacccaagaaaagacatcagtgtttgctgtctctgatagacacgtggtggagtgagcatggacactgcaggaccagcacgtgacaccaggagacagtgcatggtcacaggaacaggaacaggaaatggaacaggaaatgctggatcacctggaagcaggcaagccaatggaaatcacttttctctcagcagaggttgggaacaagtaaggagccaaggggtgctggaggggtatctccccccacccccaaggtgcacttcctgcctcttatttaataagccacagcaacaggagcaacttccaccatctttcaagctcccatccctttgccctggtattccattcccagccccgtgctcacctactcccatctgtgagtgcttcctccctgttccagaagaaacaaaacaaaatcagaaaaccataatcctccattcatgtttaaaaacacacttgatactcccatggttacatgcctccctctcagttcaaagcccatttatataaacatgcacatactgtttgagtctgtgtatgtatgtgtatataggcagaaattatatctgcattgctgtgtaaatataattagaataacgagacaaatataccaatgtcctataaaatatagaagatctgactctactagtatcaatgaattaaaaagaaaaagaaaaagcgatttcttctatgataatcacctttaaagagcaaaacccaataggaagctgctagcaggcaagcactgcctggggtgtgtacttaggatcctgagtcacattactgagggacagtcccacttatttgctacatgatcttcagcttctctgcccactcaccgctgcttaataaagattcatatcctctgcttctcaccaatttgccagttcatttagcagaatctgctgatgggcctaaagatgcaaatgattgtgagggggcagttcagatttttgcttaaagatttattttttttttttttaggagcaaaagggaaacagaagcctgccaatggtggaatacaggacccaagttaacagctcactgtaaaatgaccatcatgttaagtcagagaaagactgcatttttggggaagccctacttctaaaatgtattaagcctcaatatgattaaggggctgctggagaatggccgtgtccttattttgatctgcctgctgatggcctggatatttttagttggtgaaaattcattcttactatcttatgatgtgtttacttgtgggtatccatgcatgtttttacaaagagtataa

SEQ ID NO: 661 - DNA, 3575 bp, Mus musculus
cttattttctcatattaaccttgtattattgtaactcccaaaaaatgagtaacctttcttcacacctcccatacagttgacaggtgctgttactaaagtttataaactgcatctgtgaaatcatcagacctgatgctcttggaggagctagagggcagtaaacttctgattagtgattcagaattcttaaggttactgttttattctgactttctatttcatcttgaatcaattctaacaacatgtttctagcaaactaaattttaaaatgtgttagcagccagttattcaaagcatactgacctccagtgtcagaggttataacggccttccatccaacctgttggtttttatttttttatttttaaaatcagttttattagaggttttgtctatttcctggtttttggtttctccattagggttaatttctgctattaaaattattttctttcttttgagtttctcttctgggtctttgagttgaacctacctacttttagctatctttgttgctttataaaggtgtgccaaatgttgatatcctataaatgatatcaatgctttgtcaagcagtcctagatattttataattttgttgtgctatcctctcaaatcggtgacttatttagggaagcattttatttttagagtttgcaagcacatttaaataacttgttttgaggatggagaatggaactgtctatctagtcttcaaagcagtttcgtcattgctgcccggcatttggtcagttcttgcagaaggttccatttatacttaaaaggactacatagttcctacttcctgggtacagggttgttttgatgtattagaaaaggttggaattaggttttcatagtttcctgtgtttgagacagtctccctatatagctgagtctgacctggaacttgcagtgcggcctaaggaggccttgctctgtcagtcttcctgaggtgacagatctatatttatccattttgagaacagtgatttctttctctagttaaacgagtcaatgccctccacagcactcggctctttcctgcattgcatgccttctttctaggttcacctctttactggatgcagtggattaaagatgacatagagtatagagatgggaggctcagggtgtggacgacattctagccttcatactcattcttctgtctttctggaaatttaattatacaaggggagggactgagcttattcactatcagttgaggcaaaggaatgactgtggagaccacagaaagctactgcatagattcgcccttgtggtatttgcctattgtagccatggtgacgtacagatgcaaattaattttttttacaaggaaaatagattttacaaaagataacaataaagaagaaaacatacaataaaatttccagaagaaatagatataaaggagctaaaattaacacgtcctagaatgctgctagtttatcaaacctgtcaagaacagcagttaggaacagaaatctgttctttaagggaggggaaaataaaagctgcattttaaaataaaatgggaaaataaccagatttaacttatagacaacattacaatcaaagcaacagcaaaaattagaaagaattgtcatgaatcattggtaaagtccagccgtttacagcactgtgaggctgacacatagaagctacggtctttgtttgtttgtttgtttgtttgtttgacacagggtttctctgtatagctctggctgtcctggaactcactttgtttcttgtgtaaatcccttctggccatttgctgttcacacacaacacacggacgcatggcgcatggctacagctacagtcagctgttcccacctctcccctccctctctggccatgccctactttccagcatagattcagtttatcttttcaggtacggtacgtcatacatcttgttgaaaccacaatggcagtttccccttgaccttaatggtagaataaaaagtttaaatttaaaaaagtaattcatctgggatactgtgggaccgtgaaaggcagcctgttttctggtagagctagctttaaatcctggagacccagcaggtgttcctgcaaaggatggaaagcccgtttgccatgctcccagatgctagggtcctgacacaaggcctcagctccataattctgtggccatcagtcacccagggcaatgccccaagctcctggtattctgtcatgactccacccccacagttacctggcaacagtcaggtatgctcctccccacggttacctggcaatagccaggtagccctggaccactgtaaaaaggggctgtttgtcccctcctccctctcttaatcttacttactcctgctttctgcttgcttctctcttgccctcttgctcccccccctcctcattctcttctcccctctctccacgtggccttggctggcctctaattctctactccctctctctgcctttctctacctctactactctcttagctccacttcccactatgacaataaatgcctttaaaaccatagactgcctcttctcattagacccaccgtggggaacaatggagcaggtcttcctctaaagagctgggtgtctagtctcccggggaaggcctccctgcattcccagacatggcttccaccaacctaagccaccgaggagcaagccagagacactccaatgcccacaagaaccagctggacctctcttccctgcccttttcccttcctcccctgggctagagcctgtaccgggtccccactctagtggtgtctgcggtgcccaagagcgagaacctgctgtgcctgacctccatgcaggcccggggaccctgagccaactccggtgggaatctcagactgtgctttcccacccccggactggggtcctgtggcttctcacagcccgatgccagccccgagttgtggggtgctcaaagtcaaacttcctgagtccactcccataagcgggctctagccctatggccggccagacgtggccaccattttaaccgacaggatacaattgttttagtcaagtttttttttttttttaaagcaggaataaaatttttattgctcactttgaatatatactgttcaacttaattaagaaaaatgacctaaaaaataaatcatacctgtgttctccaatgtatgttaattatgttaagagggaatctgtggattataaaggacatttagaaaggaaaataattacctttgaagcaaggttgtctactaaagcaatcatagaattcttaaacaaggtggcagcggtcagaggcctcttggtcacctctgtaatgctgagcttgccttcgggccacatattcttcagcacaggatttgagctgagaaacagagaaagaatgagtcaaagctgcatttaaataaggggaataaaaaaggcaatctgtgctgtcaagtgagtcctaggatcacggtgcactgcacacgggattcacaaagcccaactgggaaaactgttgcattagaaaactatggtcataccatgaggaatattgtaccacagacaattttcaaactgtagcactttaaaaaaattctttaaac

SEQ ID NO: 662 - DNA, 3000 bp, Mus musculus
actcacaggtggctgtgagcttcctgatgtgggtttcaggaaccaaactggagttctctacaagaacagtattcgctcttaatctctgaactctctctccagccctagattgtagttattttaattttaaaaaagacaacagtgttattgtattcgaataggaacagagatttttataatacagattaacttattttacagacagacagaatgaaaaaaagaatgacctttaaccactgagatgctaatgccctgaccgttttgatgaacaaaggcatggaagccggttctgaccccttatcctaaagtctatcacgaacaaagtgagatggaccccaagtgaagaatcactgggcatgggtgtggtctcaatcttctcttagggtctgagtccgtgttttcctgtgcactaggagagtgcccccttgtggtacaaacctcaagttctaccgacatgaaatgctgcttttgtggctcaaagaaggggtgaagaggcttgggaacaactccaaagtcaacttactaagggagtatttagaaactggggctgctggtgcagacctgtaatttgagctgctcaaattacagagaggctaaagcagaaagatcccaagttcaaggccagtctgggtacttagactttgtctcgagaaataaaacagaaaaaaaagatgagggctgagggtgtggctccgtggtggagtccttgcctaccatgtgtgagaccccaggtttaagcctagagctggagctgggaacaactaccctgagaatcacatcctcagaaccttccaagtagctatggcgggtctttgggcatttagcagaaagggttgggtttgggagttaggtatggcttgaagtcactgttatgtttctagcttcctctaggctcatcttatatgaagctagagtgaaaacgccttcacttcagatttgctttaggagcaggaggaggaaatgggggctggaggagagagagaggatcaaaagacagagcctgaccatgagagctcatgcgctatgctctggtctcaaccttcagagcaacaaggagccagcggaggccattagacaaaagtgacaagagagtttgtttgttggaaagataaccattgtcagggctgacaatgaggtggagggactcgacgaagctttatggctatggagctggaaagggcaagaaagttatctttgagggcagaattgacagattgtgggatgatggagcggagaaggtgcaagtgagaagacaatttatatgtagctagctgcttaaatgcgtcccacaaaccccacctgatgctctccactattttatgagctagacgtcatcattattatcatctcctatgtaggaaaactgctgtccggaggggttgagccacagacacacagccaggagagcaggacacctcagctaactctggccatatcaataggatcacactatgtcccatgattcagtgtgcagcgagtgccagagggggagggagtctgggtccagtgttagatgtgtactgggcatccaggttgtgcaatctcccagttgctaggagtctctgataattagagtctccaggttgctaggcaacctgagttgctaagagtttcagtttattataggtcttgggctgttagaagccccaggttattcagattttcagtctacgaacagcttcatgcttcttgaaggctcccagctgctagtgacataagcttttaggggcccgaggctcttcagctcccaggaatctgaagttattgagttggcagtgagtcttttggttgctaggaagtagtgggtttgagagggctttgagtttgtggacagcttctaaaggtgtcagtttgctcaaagcctcactcttctgcaccccaagcaggtcagggttcccgcgttcctaagggcacacacccagaatcacaggtctcctgagtactgagtgctgggccagccaggtttcctctattcagccgggttctagccagtcagccagtggaagtggagttgcgtgcttctctcaaggtgtttccaaagtgtttattttggggtagttgatcgtgctcagctcccatgacagcatggacccagcctgattcacagatactgatttatccaacacagagctctataggagcaccgaggtgctggtgcataaagtcctttagagccagagcttgattctaaagctgcctgatattcaaacatggcttctgttcccgttgtcattattcatcttccaacgagtcaactgttaagattatgatattaggttttgaacaatctggagttgacagacccttaaaacagctaaattagcctatgttttccttttataagaaaccttttatttcccaatagttactgacacatggagttgtaaaaattattggagatgccacattcccttcactgtttccctcaatgggaaacactgcctggccccattggccccactggaatagtgcaatcaggacactgactttattacagtgtgtttgctcaccagcttcaccaagtcacaacactgtcctgccccagcaaagatctgccctctcacctctctagagttacctacctctgagacaggttttcaagtgcaatctcttaatctctcttcagagcctcttgggtgcatcattcattcataagtcaaggaaataaacaggacaccagccttgcccttggctagccagtacacctcaaattatagtgcaagtggtcacttgagtagggttatgctaagtagagagacacaaggaaccaggttggaggcttgaggagacaaagcggtgggtgaacgctctccgcaaattttttaacgctaggctgattttgagtgaacagaaatgggtttggtatctagtgaggaaagattactacgggaagaaggctgtaacctagccttccagaactcaaggggtgaggtgagcttggggcttgtgtaggaggcatcgataactggcggcttgggccccatccaaagagacttgcat

SEQ ID NO: 663 - DNA, 2125 bp, Mus musculus
tctatctatctatctatctatctatctatctatctatctatctatctatctatcatatatccaccaactcatctacccacctacccatctacccatctactcatctacctatctaccttcctacctacctaccttcctacctacttattctttgagacagggtctccctatgtcactctggcagtcctgaaactcattatgtagatcaggctggtctcaaactcacagacatttgcctgcctctgccttctaagtgctgaaattaaaggcaccactacatctggctagagtatactttaaagatttatttttatcattttaagggtgtgtgtgtgtgtgtgtgtgtgtgtgtgtgtgtgtgtgatgcgcccatgagtgcaggtaactgcagaagccagaagagtcagatggagttgacagagattgtagcctgcacgctgtcggtgctaggcgctctttctctggaagagcagtatgtgcttttaacctgtctctccagcctgtaaccttaaaattaaaacaaacaaacaaaaaaccatgttgttttctgttacagctggaatgtgaatctaattcaagtcaattaggctagctccctgcctcagtcaccatatttaaaaatgtgattatgagatgagtaatactcctcaccacgctcccatcaggcccctggaaagattctctgacgctcttatattttatttactaaattctttcctgggccatgagctgaagatgagaatggtaggaagggaagaacagtgtgtgacattagaaacgaaagcccagggcttgcttgaatgcctccctcctctgagctgcaagagataggcagcctgagcagaggctgccgccctggtggcttgggcaggagaaatggcccttggcagtaagaggcgactggagaggcagagtggggcttagtctgtgctcgatattggtggagtggagcatgtgccgaggggattgtgtctgcgcacagatgaggttctgatgtgcaaacctgcagctcccccccttgcttatgaggagcctggctcctctgccctactttccagccctcgctggcagccttgctctggacacagctctgttcctgcagcacatgcggtcatacctctcaaggctccttggattggctgttgctggctcctgttgtacacagacacataaattacctgcctctaatgtcttcctgcattgtccatctgatcctaaccacatttaccttgaagaactctctcagctccacccagaacaacttctcttgcatggctgtagcttcagcatccacctgctagatagagcctctgccacactgcgaccggcccttatctatctgtctccttcctcaggctgcagcttcttgaagcccagagctgggtattgtcagaggactttaccagggtacccagggacacctactaaatgaacatgcagacactctggaattagagcttatctacttactaatgggcaaggccagactgggctccacattaaatgtttcaaaagaaaagaatggggagaggatggggacttgcagaaatgagggatgctagagtgtagggtgagtgttaggaagggagagagagagagagaggatttatcagtgctggatccatggctgggggcggtgcgtggggggggggttgcaccaaggctgacagagaagaaaaggtctgggtgcagccacaggaatattaagactatagaaagtgtggtggcaggtactgactgaggcaggcttggattggtctgtggtttggaactggataagactccaaggtcaaagtgtttggatgtagggtccaacaggcagagagaactggaaatggcactttcatggtttagacaaggcatccagtggctcatatggggcttccttagaagaggacagttgccaggacaacaccatcccatggcttcagacagggcttcatacactgggaagtgatcctaggaggctatgtaagtatatatctctcctccttcctgcgggtcaagtgttttgtgtcttcttcatctagactgacctccctgagaaggtgtgaacgagaatggtctcaactggtgcatgtacttcaatgcttgctctccaggtagttgaagtgaggtatggcct

SEQ ID NO: 664 - DNA, 1925 bp, Mus musculus
ccaggacaatttgtttgtgggggctccttcctaacctagactaaccattccccaaagatccctgcttataacaccacattcagattaagtttgaattctctttctagcattaacataagactttgagggctcaggcagggtaagccattttcagaccacagtaaagaatgaattctttccttctgaggccaagggcagggcaaagtccatgctcttgtcactggactcagcattggagtggagggcttagctagttcacaaagacaagaaatataaataaaaggcatgcccatcagaaaggaggatgtaaatctgcctttgttcatgggaaataaccatctatgtggaaaatcccaagaagttaaaaacaagctatcagaatgaataagtgcatttaacaggagtgtatcttacatggtcaatatgcacaaataattgtttcaatatactagctatagatgattaaaaatgaagtttaaaaataccattgtgaacaatattaaaaacattaaatagtgattaattttggaagactatagataagagctatacactaaagagtagaaaatattactggattaaagacttgcattaatataaagatgccacataatagatagcaaatctctatattattaacatattaattttcactaagctgatttatagattaaatgaacccaagtgaaactctaagtaggagtttttgttttgctttgtttttgagatgggagtctcatgtctcatacagcgcagcctcacctcaaattctctgtgtaagaaaggatgtgacaagaactcctgatcctcctgcttctgcctcgcaagtacagggcctggcttgcaccggaccccagcagaacctttgtgtccattgcatgtgtggtatttgtgtgtgtgtgtgtgtgtgtgtgtgtgtgtgtgtgtgtgtgtgtgttgacgcacgtgcatgtgcatgtcagtggttaatgtcaagtatctttctccgctattctccacccttatttagattcaggctctctcaccgaaccttagctgaactcggactcaactaagctaacggtcagtgagttcaggagactcacctgtccctgcttccccatctctagtgttatagatgattggggccaggcctggcatgaacgtgggtgctggcgatctaagttaaggcccttgcatttatgtggaaaatgctttacaagctgaatctcctccccagccacaattgttttttaaaagaggacactgagatgctgaatattcccatgtgctggtggggatgtgaaacagtgtgtaccttccattctattcctgggtgtttactcagaaataataacagaaataaagtataagtccacgcacacacttgtaaacagaggctctctggtggtgctatttgtaagagccctaaactgcaaacagccctgtgaccattaacagcttaaaatagacttgttttaaaaggtggcatgcctcctacacaatagagaaactacccagcaatagagaggggcacgctattctatatatgaaagtgcacacgagtcaaaacattattatgactcctggttaaagaagtcaggccaataccaaggggaggacatcctataactccatttgtatgaggttctaaaatatgcaaactaacctgacagagaagtgacatctggggtttcctaggcaagaggatgaaggaagggtgagggacccaaaggaggcctgagagatctgtttgtcttcttggttgtgtggatggtgtgggttcacaggtgtactcctcaaggctcatcacacgaacactgtgtgtacagacgactgcacatgctcacactggagtgatgccatggaatgtcgaaggaaggaagtgggggaggggggaggagagctgagggggaagagctgagaagcactagcagggtggacgc

SEQ ID NO: 665 - DNA, 2350 bp, Mus musculus
atggatatatctgcacgaaagacagactaagagataatgaagaaactggtcgaggccaataggtttgataatagacacatttagaggggctggggaggggcaaaacaagatgaagaactaagaactacgcagagggaaaggtgtcttcctgaatgaatttcctggaagctaagtatcacagaacagaaccatatatgccatatatgtacatgtatatgaagggtgggtaccacttatcaatgctcacataaggactgagattttcctcatttgtacaattgtaataatatttacttactcagtgccctgtggggtaaatgagtccatatgtgtagatcttttagaataatgcctgacacaacagtttaatacaagcactggtaaaatagacccctgaagctggaggctgtgtggaggccgccagagtgtgaatgggaactaggagaggagattctccctttgcagacttgcctggataaaggatgctggcatgggtccggagcatcttggccagtgaagggtggggtacaatggctatgattgaaggcctgaatgtggacttactgacttgagttcactcctgtttttcaccacctatgtcattttgaaccagtgactttctgcttctattgtggctctctttcctcccctatattatgagggattctgcagtgataaaagagccatcgtatggggatttgctgagttgttttgtcagtgtttttagatacaaggttgcctttagatacaaggttgccgtggaagtgtctgtgatgaaaggcagggaagtggcctgggggaagctgttgcacctgctacaggaggctgtgttctcttgggagggagacaggaaatgctagggtgaggctgacagtttcttctggccgggctggagcacttcctaaaggcaaatgtcaccactggatgagcagaggggtcaggctgcagcaagtcggcaccctgggctaattaaaagcactctgcaaatggaaactattttgggatgcacttgaagaaaacaaccatcattgcttatcaaagctaattgactctagcaaggatgaagggggttcatcacaccacttctagcttctcccaggtgtcacctccagccactttcttgctcaggatcatcttgatggccatctttcccaggactcataaaggggtatgggaccccagtggaccagaatcagcagaagacaggccatatgcaatgcttttctctcatttcccacttgtctgtcctagcctgaagcagccccctcagagtgtggttcctgtcccacagtcctgggaggatgtgctatcagaattgtgggaggaagcgaggatgctggctgcaggaacaaggaggctgatgaatgtgcatggctggagaggctagcaaaccatccctcgatggctctgaggagctgcaggctgactggcaccaaggagaagctaggcactgagtcactgaggatgatcagcttccagcacctctgagtggagtgatgtctggaactgagtcatactcctaagggaagaaggaaggaggaaggacccctgagccatgctccctattctccaaccccacccccataacctggtcagccattctcctctcagcacacctaggggtcattactgatgggtgggtgattctccctagcctgacacatctcagatggaggatgtcttcaccattctcccctagaaatagctatgagagagtaacagccttcagttaattcctgtgtctaactcatctgaagtatcacctttcctcagcctgggactcttagagctcagctaagtgatggacatacattcagagtctgaagccatggagatacaagatgaagctaagatatgacagcctcaacaagagactgtgaagaacaaggcagagagatgcacagttctaacacacaactgagacatggagatggttaaatcggttccctccatctctccctccctccctccagccatccacccacctatccatctatccctccatctcccctccccctttcatcattcattcattcattcattcattcattcattcaactgatacaaggtgagtaacccaactcctagactcttatctgccaggcacttcagaaaatgccagccatagagggatcaatacactataattcatgctctcataaagctgtgtgatcagaggcaggttaaatctgagcgtgcaatttaatacacacattgatctcagacagtaattacatgcttcaaaggagccatatagcagtggtgttacaggtgggggactgtctacttgagttccagtggtgtgaaagcacaccctggatgggacagttatcaaagcaaatgaaatatg

SEQ ID NO: 666 - DNA, 1825 bp, Mus musculus
gctggccagctcccctcagcattactagctccgtggccctccagatctttttcatagctgaggtccatccattatgaatggatctttgtgaatcatcatatattttttatgaatattgttctccatacaaggctaccctttttctacagagcctatattcatattcttccttctcaggaataccccaccctgttgaagttaatggctggcctccccttgtccagtgctaacttccctttgagctcccagagggaaggtattatgtgtttgactgcatcatccatcactcaacagttaatgtttgttgaattaatgaaaatagaatagaaaaattgagactctgagaaaattggactcattattgttttttatcaaaaatagaaatttcctgttagactagcagagtgttctagaatattgccaactttctttggatcatagcccatagtcctatcatcacacgtgctttttatagccatgtataaaatatttagtttctttggaaatagtggctgaaagtggtaggattcaggtggctgcacctccccacagagtcctagcctctcaggatggattttgtgtctcgtattccagcagctgctcactgatgaaagcaccattttgtgtccttcagagagctgggtgttccctggaagcctgggggctcatccctttttgattttccccaagagctcctgtttagctgcacccctttccttacatctggatgctaagaggcagttctagcagctccacacaatcaaagccccaggttgctgcattgcatccaaaccataaatgagatgttcctgggaagtgctgtgcagaaaggagcagctcgctgcgccacgcagataggatcttccacctcggaaggttctcagggccttattaccgcaggtgcgcaggacacctggtcacttgatacatggcatggcttaacgcagcaaacagtcattaaccgtttatatgttggcgctttccttttatccagcatctgtaaggggactttctcacaggccatccatttaattctttcagcaaaatgctacagggatgtaattagtaaccattgtatagatgaggggaatgaagtcacaggaagggtgggtaagatgtccaggttcacatggccccacaaacagtaaattccttttttttctagcaaaagattgctttctgttaaatatcctccactgtgttccctgaatcttctttcgttcaaaacatttttgagtgtccactgtggctctagccatcctgaagacccaaagttggggggagcttgtggcagacacagactgtgccacacaaagataaactgggaagcccagaggagagccaggccagtctggccttacagatgcaccatggccttctgcagaactggctctatgtctcctaccaagcccggcagtcctccatgaaatagctccgtgctcaggagcccatggttcaggactgggcttgaatttcctgttgatcaaaggtttccttttccgagctgggggtggggagggctctgcattatgtcacactcacaaaagtctaggattgtatactttaaacactgaagacaatatttttctattacagacatcaatgaagccaagggcaccttttgaatcttttctttcctttctcttccctttgagtgttgtgtcctgtatctgcatagtacatagtctaaagagtgagtgagtgaatgaatgaatgaatgaatgaatgaagcagtgcaagtcatttggttccatgtgtcttcctctgctcagccagtgagcaagtaactgaagttattcccaggaagagccaggttggggattac

SEQ ID NO: 667 - DNA, 3475 bp, Mus musculus
ttggtttaacctaagtaactccatattggtttggtctatagggccagtaccggaccttggtacagatcaatggcctcctataaattgcatttgccaactgctctggcttttggctttccccaccacctttccttctccttacaaaggggttctctccaaagatacataagcagggaacatttgctcggggcagatgaggatctaccatggaacctaccatgctgcctacaagtggggcagagaactccagggagcagtgttcgttagtccttgtccaggctgcactgagaactgccagatggactgtccttaaagctccacagaggccacattcacattccctatgggatggctcttaagatccttttcacattgcaggtcccatgagagggcacgtgggaaaagcaactggtccttccctgtccccatgcagctaggcctggcattagtaagctgtagagaggctttgctctcatccctcagccggggtcttagtggaaccagcaggaccattacttattgagccaatctcttgctctcatgcggacccacccccactctcgcctcgagagaacaaaattaaaagagatttgtcctcaagcagcgacagctcatcttgctagctccggctccacgatcagcagcccccttaggctgtggctcagctttctctgcaggagcggcaggggcaggtgggagtcatttgtccctggcctgggtgggtccccagctctcaacagccctccatgtttgacctctctgctaacttcccctgtcctgctttctctgggggacattttatagggattccgctgaaaacttcagagacaatcctgtccctcatttttaaggttctcagcctgagcatgaggcacatctgtcccctctttcattcaaccgaggctccatttgtctccgttttcctgaggcccgtagattgttcctggctgaattatggagcctggttaggaagcctcagattgaacatgtccctgaggccattgtcctcacggagaaagtctgctggtctctctgtcctgcccacctgccacagtccctctaaattggtgtcttcccatccctggaatggcacacagagtgagccaaaaaagagctatgactataatctccagtaccaccatgtgccaaatacaaagaatgatgtagttaagggaggatacagatatagaaacaaaataaaacaaaaaagccccccgtaaccatggctccaggggtacacatctcccgcatcgcacagtgctacttacatccacactgaccacagatgggttgggctcctggtcagacaaggggcctagctccccttggcctcctgcccattcccatcaccatccaggacaccggaaccagaggaaaaatgaagattcagtaccagctgtgctctttaagagatgagtgtgggattgtgggaattccctcttgtgttttcctatagatgatgaagggctagcaccaatcagaaagcgaaagtgaaccgttagcataaccccttgctgcctttgtgctcattagtgaaaaaccattgtcccagttgcttcagactgtgatggttagctttgcttgtcaacttgactgcatctgcaacaactaaaacacaagctgttgggcacccctaggaggtatttttgatctgattatttaaagcagaaagactcacctaaacgtgggtggcaccttatgctggcagcccagataaaaggatacaaaagaaggaagcgttgctttttgcctgcttgccttcattcttaccatcaagcgtgtctcctctgacgcggcaacatttcttcactggtaatagaaccaacttcttcagtgttccgagaataagtcctggaaccctccaggccctcgatactgagttgagactgctaagatggccagtcttgtggactattctcagaatcttggcctcttagatgtgagatgccaacaaaagtcacagcccctgccatgggaaccttgtaaaccccttctaggtccttgccagcaactgcagcagaggtggctgaccaaaactcatgtacagaaggcctggactcaaagaaccttctttaaaggggaatcactaagaggcaggaaaaaagggcccctgagtagggtcagcagattcttaaaggaccagctaatatgtcacatggtctttattgaaatcactccatcttttcaaggcaaaagcagccttgaacagcagccgaacaaatgggcaggattgtattccattagggatttatttgtaaagaggcaaccatctgctggaatgccaacacacacacaccttcagtaaaacagatgcagggttttatgtatgcccagctctgccatgctataatccagtagcctaagcattatgctctcaggattcacactgttcatattccagggaacgacttctctctgtctttgggtctcagttcttaaagtcaagacgactgactgtattcaaatgcagaaaaaggctgccaggacctgctactggtgacatcagctccactccagcatgtggagagggcctgagccacagaagcccagatgtaagaaagtagagtaatgaattagctttccaaacccttgcttgctgatagcaggagcgtaatccagtcttgaaaaacaaagcatcattttcaagaagtgccaagtatccattttctggcggccttcctgctctaatgagtggttctggaagtagccacgggttatcaaattattatttgtagcactgctccccttgacatcacagccaagaaacattttgcagcattagcaattcatatatcatatgggatgggcataggtctacaggtctagacataggaaacaggatttgctaaagtaaccaaaaaaatcccactttccatgcaaaacttgtgaacattttcatcttactaaaatatttaataatatttaagtctttaaattttttaaataaatgccagctgtatataaatgacttttacttagttggttgatattaattccttgtaatataaattatgccttttaattttaataattcatttgaaattctattttgaaatcatatgtgagagagatctgatttttaaaaattttttttaccattacttgatcttaaatgcttaatgaaaatatattcaaattgtagacacaggataaatggtgttctgttccctaatactttatgtgagggatccgctgcagctctattgtctacatatgaaccatcaagaacttgaactatgttcagtttgcaatgagatgtgctgtaaatataaagtatgcaccatattcaagaaatctggtgctttaccaaaggacatacaggctggagagatggctcaaccgttaagaacgcttgctgctcttgcagaggactgggattcagttcccagcaccccgataggttggcttactaagttccctacttacccattggggagcttcaactccagttccaggggatcagaacaccctcttc

SEQ ID NO: 668 - DNA, 2125 bp, Mus musculus
acccagcgtctgctctcttaagcagaactccactcaattctgccgacctccacttagcttcttagaaatctgctctgggctttgttagttatcccaatattgatgcacagaaactaatcttgttccatataaccccattttgtttttacagcaacttgcttggctccgtggaattcagtctctttccttggaactgggcttagctgtgtcaaagctttggtgaatttatagagatctggattcacagaactctcctctactaccaagaaccctgctgtgggagggccacctggacactctgaggcaactcaacagcactaggcagcacctttaacagaactctttcctgagacttaccagagtatgacagtctcgtctatgtctagagagattgcatataggagaatccagtgtcactgactagggaatttagacccctgtgtttatagacagaaacttcaggccttgtcctgaaatcatctttgtctttctacaggtttcttgatttctttcacaaaatctaatatcttggctgtatcttctctgagtacctggcacctatccacaccttagtagggtgcagtgaggacaagcagcccatgaatcctccccaaatcaccctctgcttaggtgagcataggagaatttgaaccctgcagccctgacaaatcaataccagaaaccctcaacaccacccaggaagaattcaagtcccagcttcgaagtatgaaagaagctttggtcaagccctcaagaaggggagtctcatatcacccttcccccatgctggccctggtcgcctgagcacaaatctacttggacagaaataatcagccgaattaatttagctttaaatagcagcactgagaatgtttccacaaaatcttctcggaggagagctaagcagaattaatgatggcacaatatcagggagaaatgttatttattaaggcctaatcatcacagagagaggggaggtagcccatagactaatatggaaatcagacagcagagcccccacacacaacccagccatctgtggtcagccagggagcccaggcagggtcctgagatccatggtccaaagctgtctgcagaacacacagggaccaaaatgtatccccaataggacttacagtcacacatctcttctatctagaatgaatgtactgtggctcctttgctgaccagactctgtactgcaaccatgcaaaagtcatagcacaagagcttcttacaaggagtacccacctctggccctcttcaagattccttgatcatttgttgtttcaactaatatttatcaaacacctacagctaagaaccacatctgtctccgtgttggggagaaagcaatggatgataagcctcatgacatgtgtcatcctatgctgaggaagagtgggtcacacagaccagggtgcaatattagccttcctggcttgctgtgagtgtagcagccatctctcagaggacacagcagaccagaagtgacacttgggaagccactgcccaggtagctgagtggttgctgctcatcagctctgccttagtctttcccaagctgacacagcaaggggtcacagaccaagtgacgtcaatgccaagatgtttttgtttttacaggaagttcaagatccagcatcagtctggttgggatcttgtgagcttgctcctaacctacaaatgactgccctctccctgtgtgtgctgacatatctttgccttcctgtatgtacaaggaacaaggagaaaggccaggaaaggttgggaagggaaagagaaagggagatagaggagaagaaggaaaaggagaaggagagggagagggagagagagagggagagggagagggagagggagagggagagggagagggagagggagagggagagggagagggagagggagagggagagggagagggagagggagagggagagggagaggctcatactagtggctctccttctatggcacttactctatggggctgtggccccaccctatgacatcacagcctcagtcattctccaatcactccatctccagtgcagtcacactgagcctggagctttcagcataggaatctaggaggacaaaagacaattcaatcttcctgccc

SEQ ID NO: 669 - DNA, 1675 bp, Mus musculus
acaaaaaacgctaggaagaatctgttcgtaactcgtggaatgaaacaaaaaaggaaagattccactaaagggctggagaagtctatctaggaaattactagaacttatatcagaaagaataaacgtgaaagacaggataaaggtgattggaaattcaggaaatgatgatccagaggaggcaaaagtgtgaccattatcacaaagacaattaggaaaacatctacacaccctaggttccgttgggtggcacctaatactagagacactttgttgggaaatctcagaacaaagaggatttaaaaaaaaaaaaaaaggtatgaaacccacaggaaagactcctcttttacacaaatgccctgggagcagcttggcattcaactttctctaagtaatcgcaggtatgccggctcccacacaagggcactaagcaagggaaagtaagtgttgaataggagccaagcggaaggcagggggcgaggaatgaacgcccagatttctgtggtcctggtaggtgagacagggaaagaaaccaaaaccaaaggaccacgtgatccgctgaacacacctagacctggcacccaagtctcccgcggtgaggactacaggctcagaagaagggcaccaaatgccttctaaccccaaactagctaagtcccttctcatcacccctaagccagagcaggttgtagcttagcctaagcctcagctggttgctatggaaatgattggcccttaagcggagcaaataccttggtactcatttctttccaaaacgaggcagcggaagctgttgagatgttgctgtgggtcaaaagcggagcgattgttagggtttagagaaggtgtggatttacatactcagagagagggggtggggctgaggtgtgaagcttaacttccaaagatgagaagcctgggatttaatcattcaatctctctcgcgccctcgccctcgccctctccccctccccatttccccctctctctccccctctccctctctcccccccccccgctctctctccctctctccctcccccttcccctctctcttccccttcccctctctccccctccatttccccttctctcccctcccctccccctccccctccctctctcccctgataataaaaagaagtgtcacaggcaggagagatggctcatcaggtaagagcactgactgctcttccaaaggtcctgagttcaattcccggcaaccatatggtagctcacaaccatctgcaatgtgtctgaagacaactacaacgtactcatatacataaaataaataaataaatctttagaagaagaagaagagaaggaggaggaggaggaggaggaagaagaagaagaagtggtgtcacacaaagagatggagtactagccctctggcttcacagagtgaggtcctgagcacacagcagactaaaccagaactatagaccacccaaggctttccatactcctctcccttccagaaccttttccatagtcatctacctgtcattcttcaagagtaaagccaagcacctatttagtgccaggcattgcaaatttttacataaaatccatcttggagctgaaaagatcattcaacagttagaagccagtacttctttcagaaggccagagttcaagttcacagcaccaacacatctgaaactccaggtcc

SEQ ID NO: 670 - DNA, 1925 bp, Mus musculus
ttaaaaaatatataggactgtgctttgccccattccaggtccattctgctactctaaaatatccatcccgtgcaagcactgaatgacactggaaaacaggtaccattgggccccgggagactatttccacgatctcacctgttcacattcatttccatcccacacgggaaagcgtaggctccagaaatggctcagcaggtacaggtgccaagcctgaagatccctcccggtaagagagaactgactctggtcagttactatcccctgactcctccatgtgtgcctcccctccacacacaataatcaaacagacaactgtgagcttgctgaggggagtctcgaacttctgatcctcctgccccaacatcctgaatgctgggatcacaggcacatactaccacatcaaggttgtgtattgcaagcagccccaacgttcctgaaaattcacagcaaaagggatggaccattgtactctgagaaatttccagagtaggtttaggccggtcctgtctgcccttgcttaaagctccgggattctgtttggcaactttttacagaacctaattcactgactcatccatgggactggaaactaccatgggaatgggtcagagggaacctggtaaaattcaggttgcaatcacaagggcgggtggaaacacagtgtacaaactctaatcgtcaagcaaccatcatttccttttccgttcctctgcaaagtagttgatagattgagggtttctctgcagcggccactaggagcatttaatttgctgtccaaactaggtctcttgtttttggagggctaagaaccaaactccagctgtgttagtgctcggctgatacgctgaccctgtgataaagctatcagacatgctggccagtcctctgacctcctcctcctgagcacccagcttcccagtcaaacactcctgcttgtgcctggctcttcctttcctaccctccgttcatcttcctggaattctctatttcctcattggggcagtacatttctgaccctcccgtaactcccagtaaatgtttcccttcttcggagaaatgtttcctgtcaggcaacagtaagcacacatattctttattccacatgcttgctaatccacattgctctgaattttatagtaatttgcatctgccccctactagctaaacccggtccctttatacacccaatgtccctggtattcatctcagctgagatttgtaagcaagggctttgatacttttttagggaagacagcttttattcctgttaactctggatttgtttgtttgtttgtttgtttgtttgttcttccttacagtcttgctatatgctcttgaactcatggtcttctgtgtcctgggaatttcagcccagccagaattacagagagagcctgtctccaacaaaaccctgtctccaagtgctgagatgaagtatatgccaccacatccagctttgaaatgaatgctaataccgcttaacccatttatagttcatttggtaacagtgcgattttgcaagtactctatgggctgaggtagtttacaaaaatagccatgaatttctgtggaaatgagacagctcataaaaatgagcaggatttcgtggaaacagacagctttccgctggatcccagcagtgattgctcatagatgggagtgagcatcaagctgtaggaagctcaatgacttaagaaatatagtgaggtccggcagtggtggcacacgcctttaatctcagcacttgggaggcagaagcaggcggatttctgagttcgaggccagcctggtctacagagtgagttccaggacagccagggctatacagagaaaccctgtcttgaaaaatcaaaaaaaaaaaaaagaaagaaagaaaaagaaagagagagagagagagagagagagagagagagagagagaga

SEQ ID NO: 671 - DNA, 3050 bp, Mus musculus
gtcatgagccgtgacagaaaaataaacaaataaatataaagccaaaaaaccctttgagcagctacactgtgtagaatccccccgggaaggctaaaggaggccagaataaatgataatgtaagtgccaggttgtagtgaggctatggtggtgtatgaacagggaggtactgggggcggggaagacacatccacacacatacaagagcacacactccagtggaaaaattggcaatattagtagcctcaaggtgcaatttcctggagcagttaggactgacaggccagtgctaaatgctgttaatttaactaacttcagattaatggtagagcctgctatgactgaagccctcaaacacagtctcattataggcttgctgggaaggccctaaatataggcattgacagtttaaaacaaattcgtatacatttgtgtatttttagacatggttaggcgtcagagtttgtgtcagagttttcaagttgattaatggacccagtaactgcaccctctccccgccccctcctccttccactccaaattacagagaaaatgggggaattgtccttgttaagttattcagtgggtcttttattgtaagcccgatgtttgaattgcatgcatgcgtcaacactccggtgataggcacatgatttataaaaataaatttttctaatactacgaaatcccccctattaattttttatatccacaaccgttattacgggtgggaatcccaggtggcatttcagatggacagcttctcttgaggtctgtgcatggctctccctgcacacaccccccccacaaccccttccccacctcgacatttttcctgcattccctggcgtaacactttttagtcctgcgccctctgctactcctagactttggccctcttcctcgctagaagcagttttgctcttttagagtctaccaagagccctttaagccttcaaagccaagtgcacggtccatccataaggggctacaacccagtgctccgcaaagtggggcagctctgtggagacagtgggcagggtaggaattggaggacatctctggaacctcagtattccagtggctgggtttttctagaacattggtgtctacgtgcagaattgagtgaaagcaaattgcttagaagcaagagttgtgtttattatggaggagaaggggggaccctaaaaactggagattttttatttgaaaaagagaaagtattctgaaattgcccctcccccaggctcaatcccaggtgtccccaagactgagcttactggcctccgttgttacaggtaattatgtggacagatcttaaaggcatgaggctgagcctcggttctcaaaccatctcaccaggcagatctttatgttttttttcctatggatttttaatagcttaataaaacactcttttgaaagtttttttttcttgctaccaaaccagctgacttataaagcagtcatgtttctgcctattattaatgacccatttaactgccaatagcagcatctgttcagatgagataatcaagctaactgggttaatttactttaggcaaaagcaagtgaatatgataattatatcgggctgggtagtttttatcatgagcggaagtatgataggctaggttttgacaccttagagattgttctgggaaccttatgtttttattgattgattgattgactgttttattggttgattgattgatatgatttgtcttgagaatgagaacattttcaatctccctattttaaagacgaagaagctgaaacccagggaagcaggttgtcttcttaaccatcgtcaataactcagagaactctcactgcatcaaatggaatatgaaccaatgtattattgatatattgcagtttcccagtcactccccagcttgtaattagctttcccatcttggctggctggttgggcttaggtggtgggggtggggtggcctgttttctggcggattcttcctgcctgtccacttctctctatcttgggtctctccattcctcgttcgcttctacccacgagctgtttccttctctagcctgtcgtgctactgatcgctgcaagctttagccttttctgtctcctggcagtcaatcccttctccaacccagcgactgtccctccaagcagccttagccagcacaatagagggtctgtgggtgtgtggcaagccatccggctgggttaagaccacttcacggctcctgaaacaggctccctgctattgtggtgtttaattatcaactatttctaccacccagtgcttcagagtgggaatttgttataagacctgcccagctaattaactatgagatgggggtggggtgggggtgggggcgggaggtggggcaggagcttggtgttcaaagaatacaattagggttactgtttaaatcctgagatagcgatggggactgaatagagtttgtcaagtgcctgagtctagctagcttaggtactgcagatccttaagggtttcatcattttactcctcactcacaactttggaattggggcctggcagacaattacataaactttgaaactatgaatgagggcaacatgcaagttaatttgaatattttaaaattttgttttattatgtgtctctctctgtgtgtgtgtgtgtatgtgcctggagatgcagggtgctttgaagttggagtcacagggctctgtgagccacgtaatgtcagtgcggggactcagcttaggtcccctgaaggagcaatactcactcttcacagctgagctgttctccggcccctaattttaatttttcatagagatttgagggaataatttgttttttttttattttcttgaaaataaaagaatacattcctctttcatggcgatatgatgttttgcaacttaacacacctttttattgtcaggtattcttctttcttgctctatcctgcagaccagcctgtccttctgcctctgcctcccaagtgctgagattaaagtcatgtacccctaccacccagaattctcctctttcttactggtgatataaatacactc

SEQ ID NO: 672 - DNA, 1925 bp, Mus musculus
aaaatgtttatattttctcaaagagtaaaacaaactaaaacactctgaaagaccttttccaattgaacagaattctgaagttcaagctggcttttccaaacatgaaccactgctcatgagcaccacaaacactatgaatgtaccagtgctggggaaggttagaagaaatccattaccagaaatatacggtcctgcatccgctcctcggatgagaagggaaccaggactcgtgctcctcctttgcagactgcaaagttgctgaacatacttttctttcttaaactaacactaaaaatgcatctgaaattaatttactcaatttcaatgaatattttatcctcaaatggaattcactataacatctctttacagtggccagcagctgtcaattcctatcaacaccttcatgattagatttccctttggacattttcacagtacatgaagtgaacattctgcctaaatgcagtacagaggaagcttatataccgaaaaccatttcctcctctatcaggcagacagtaactcctgggacaattctgtatgggaaaggcaatgctttctctgttactaacatgtgagagaatgaacaaggggaaaaggtaaagctttagtcaaatggttgctgtacccctgccaattcctagctcgacctggaaaatgtttgcttcaccttaatagccaatgcatccttgaccctggacagagagcctttcaagtagtgacaagacgctgactagtgtagggaaaacccaggaggccacaccacacagggagtcttgtggaagcttgggctggcagaggagagtaagcatttcatttcttttctcttctttttcccccaagatagggtttctttgtgtagccctgactgttctagatttgtagaccaggctggcctcaaactcacacagatctgcctgcctctgcctccccagtgccgagactaaaggcatgcacaccccccacccccacaaaagagcaagcacctcttcttctcttttcctcctctacttgctctctagggtcaaacaacagcttcaaatcctctctgcctgccttgcctcacacataagacccccttacccacaacgtactgaggacagaacccagagccctaacagtgatcaatatccccagaagcaatcctatttcaaaatgcaggtaatttcagtggataaacacatctcactgattataagtctgctgactcatttactactcactcatacagacaacaatggagtgcatcagtgtgtccaggctgtgaaggaagctgggatacatacaaagagtgtgctagaatctacctgctaagagctgtgagaaaggcaattacttaggtctgccatagtctcaaagcacgggcacgggcacacgcacgcacacacgcgcacacgcacacacacacacacacacacacacacgagagggaactcagtgtgcaaaagcacacacttctgtcatgccacattctgtgctattatggtcagagggaagggggtgggtacaaatggtgaagtatggagaagaaagcagaagtcagaatgagccatgccagtgggaaggcttaaaggaaagctgctgcaccaggcaatggtgacacatgcctttaatcccagcacttgggaggcagaggcaggcggatttctgagttcgagaccagcctggtctacagagtgagttccaggacagccaggggggctacacagagaaaccctgtctcagaaaaaacaaaacaaaacaaaacaaaacccaaacaaacaaaaaaagaaagcaaagcagggaagcttcccgctctcttagggctcctcggtaaggcccactttcctcccttccctgctgcagtaatcagcaggtccctccatcactcaggataataccagcatagatgggcacgttagcaggaccctctggcagcttta

SEQ ID NO: 673 - DNA, 1800 bp, Mus musculus
aggagattcaggtttggttctctgtaattccaggggtctgacgcccacttctggcctctataggcacatgcccacttgtggcatacatacaaagaaatacacataaataaaaatgaaaaattaaaatacatacttatggtccttgagagatagacaatcatacaggcaaataaccaaggcaaccattttccatgataaattttacttctagaattctccgctgggatggatagtttgatgtcaatttgatgcaggctggggtcatttgcgaagagggaacctcaattaagaaaatgcctccagctgggcggtggtggcgctcgcctttaatcccggctcttgggaggcagaggcaggtggagctccgagtttgaggctagcctgcactacatagtcacttccaagatagccagggctacacagagaaaccctgtctcaatcaatcaatcaatcaatcaatgtgcctccataagatccagctgtgaggcattttcttaattagtaattgacggggagggcccagcctagtgtggatggagtcatccctgagctggtggtcctgagttctataagaaagcaggctgagcaagccatggggagcaggtcagtaagcagccccctccatggcctctacaccagctgctgcctccaggttcctgccctgttggagttcctgccctgaccccaagttgctttggtcagggtgtaccattacaccacacaggcatgctctcctttgggaacctccagccccaacttctacaccccacattcctgactcaggtctagatccactcacctcacagcccagcagcccagcattggccctgctctcaaagctgaggcagatgaagctgaggtcctgacaaggctgagtgccagggggctgcccaaacccaaggctggggctgcaggcttcaccaaagtgcccaccctccaccccattctggggagccccaggataacttgtggctgcaccctcagtcccagaactggtagagcaagtcagccaaaggtaaacaaaggctaaaggagaggccctggagctggggtttgctggacctcagcctcaccagtcctggtggcctggagccagaacgcagtgggaaaggacatttcagaggaaaggcctgtggagatcctcctcatcaggagcacctctgaaagcctctaatactcagctcacctctcagggagtcagcatcccttaaaggggccgaagcccccgctgaatacaaatggagctgaccactgacctagttcattagacaaccatcacctcggaactgaaatccaaacgagacataagagggccttagaggtctaacctagaagcagaggggggaaaaaaccttcataaacaagcatttatctttctatctacccccacctttttcatgtagccggggctagcctgtagtcactctcattatggagactgaacataggacctcatgattgttagcctcagcttgcacttcctcccctgatcccactgggtcttaggcatttgcattggctgagggaccagctgtagctttaacattttttttactttattttttatttatgtgcatatgtgtctctctctgcgtgtacacatacatgaggctgcccctagaggccagaaggtgttggatctccccagagctcacaggtagttgtgagccaccccaacgtgggtgctgtgaaccaaactcttcatctgaaagagtagctggagccctcttaaccactgaaccatctctccagccccaagctggggttgtcacagtctccttctagggtgggagtggtaag

SEQ ID NO: 674 - DNA, 4750 bp, Mus musculus
atgtcttagtggcagctgtgaccctgcactgcccccttgagcttcctgataaaagcatgttctttgggggtgggtctgatgacagatcaatccaggtaaacgtttacatcctggcttagttggttttgcttatttcttagtaagccaggttacacactacttatctttggaatgttttggaggcagcacaggctagattctacacaatgcatccggagcgaatctatcagtaaatcctctataacatcaatttggttacttgcagtttcttctgcatgtgtagtatacacttgtaaagaggcaggcaagacctccagtcaccaactctcatctcgtcgtccttgaagaatggtgtgcgcagacagccaaggatacaaatgggagccacttcactgtcaatcaggattaaaataaattaaaacagatggcccacctgccaccaccaacagtaatcgagtattggggggaggggcaaggacagttgcttaaggatccctccttgcctgggactggagagatggctcttgcagaagacctgggttcaattccaagcaccattagatggcagctaagaactgtaactccatttccagggcatccttctggtctctgcaacatcagccgtgcaatactggtacacagacatacatgcaggcaaagtacccatacacatgaaataaaaataaagacagaaaagttcctcaccaagttcaccaatattagtagaactgccaaacacattgctcaggtgccaaacagaaccccatatttaagcacggggtggcggtagcagatgtcttcaggtcgaggcaggagaatcaggagctcaggctcaccctcagctacatagtgaatccaacactagcctggtctacatgagacccaatccatgttaacgtttatagcttacccttgactgcatggcccccctgactgaaactgctccctgcctccgttgctgaccgagaagctgagagagcctctcagctgcctcctgctttgcaagttgacttcagcctcaagacactaaattctggactcctcacagccaaatccaaactctccatctctgccccaaacagacacccctgctctaggatcaagcaggtctttggcaaggaattccctttcccacctgcctctcaacccttggctcaggcactgcccacttgtagaagtctccctggattccttacttccctgccattcgtttggaatatcctgtggacatcttgtctgtccctaccatgacttgcaagagccagaggccatcgtgtctctggaaatagcatgtttcaggaacactgtagataaatgttttggaagagacaaaattcaaagcaagatatttttagatgagacaactgaactatctttgaatcataaaagagagcccaggagagatgctgtaaaggaaggaacaagcttcacggttgtttttctcactgtgtggtcctggctgtcctcgaacttgctctgcagaccaggctggcctcggactcacagagatttgcctgctgggattaaagatgcgagccaccctccccagagggacacatttgttttatatctatattctaaatttatagaattagatttaacttgaaaaaaagatgtattgatagagtagtaatgttgcccaaaagttacttagtctgctccctgccttgaaagtcagtgcaaagtggacccactccctccctccaaatcatggcccttgcatgttggaagatgtcttcaaacaccacgacaggaactggggcaatggctccatgggtaaagtccctgttgggtcagcatgagaacctgactgtagatctcaaacacccatataaaagctagattctgtggaacatgtctgtaaccacagcactggggaggggataagatcccaggtgttcctaatgtcagccagtctaactgaaatgcaagccccaggttcagagagatccctggcttcaaaatataagatagagaaacaactgagaaagacaccctgatgtcaacctctggccttcacaggtgagtgcatgtgtgcacgtgcacacgcacacataccacaccactccacaccacaccaaaataaatgaaaaaaaaagcaaaatctaacatcccctatggcgatttgaatatgaatgccctccatgagcccacatacttgaaagccacatcgccacccggttggtggaactctttgggaaggatttggaggtgtggctttgtgttggagacctcagaaacccatgccatacccagttagagctctctctgcctcctgattgtggaccagatataagctctcagctactgcctgagcaccatgcctgcttgccttgccatacacggcaatggacgctaacccccgagaaccgtgagatcccaaattaaatgctttcttttataagttgccttgatctctcttcatggcaatagaaaagtaactaagccgggcgtggtggtgcacgcctttaatcccagcacttgggaggcagaagcaggtggatttctgagtttgaggccagcctggtctacagagtgagttccaggacagccagggctacacagagaaaccctttctcgaaaaaccaaaaaaaaaaaaaaaaaaaaaaaaagagagagagagagagagagaccctccctccatcctaaacactgctggtgtctctgcatgtgagacagctatgccaaattgcattattaactctgccagcttagctgtaggctccctgcagtcccagcaagctaaggggtcaccttgtccctgagttgccatagcaactgacttttcccataagcagaatcatccatgtgaccttccactgccttgaagttgccattcatgggcaatggtaccaaccaggcacaacatgctctttgcttaaggtcggaactcaccctgcctgagcctgtgctccatcctggagtgccaccagagccccaccccattcagatggaccttactgcccacagccttttccctgtagcacccacacatcctacagtgtggcatgcactgacagcctggaccctggccactgacctagagcatcctcactttatatgaacagtccttagagtcccagatccttagggacaacagtggcacttgccatcttccctacctgcgcagacaggaacaggttcagggtggtcattgcctattagtactgttgttccatttaaggcaaataaaagcctacactgctaggttcaatcactgggggtgggcgtggggatagagaacgtttcttatgctactgttactgattgtgatctgaagtggatacctcacctcggcatttgtcaaccttgtaacaaccaccaccaccaccaacaacaacaaaatgcagtaaagcaactttcctaaatggtagtgtttctcagcaaggcaggcagaggccaggagggcacccctgaggacctcagcaagctcaaaggttgctgtgggactcttctccacagccaggacaaagctgtttgtgttttcccttttgttttgtgctatcgatgtgtatctatttagtgccctcccaccatactgggtgggaatccgagcttcagtcattccggggtccctttctctttgagatacatcagtccacccagaggcttaatgggggttccggttgtcaattcattagacaggtaccacctgggctcctaggtccttacattttgtccctttggactaccccgggcccctggccagcttgttcccaggctggtagggtccttttccaggatgtggctgggtaggatccactctctccgtaagtatgctgtccccagggattgctgctgcccagacctccacatgcacgctccttgtcagacatctgtaatacatgccacacatccacagtcttcacggccacatgctccctgcactcgattctctccagttcatgctcacacatacctcatgcccactcacacactcacaacattttgtctctcagcaacccttcacagatgcccacttctcacggggcaatgaccctgccctccaccactgagctctgcccccaacctttttatttcactctctttttttttttctttttaaactttttatttgtcctctgtgagttttacatcatacacgccagtcccactcatctccccacgccctcatatctaccctttgcccctgcaaactttccccaaaataacacacacacagcatagaaaacatttcattgtggaagctgtagtgtgtcacagtgtgtcccacagtgtatccctctgtccacataccttcacttgcaaatattcactgcaatgagtcactggtctggtttgagatctctggcttctgggacaccatcgatattggatcctcaggaggtctcctctggttgtcctgctgttgcccagtgtcatggagatcctgcagttttgcatcggcaggattggcttttccatgcttcccaaccatttgcagatgataaagatttgggggtgggccagtttggagccggggacctgggcctgggtggtagctgagctggtcagtgtgctggctctccctcacctgcagcaccagggcaaggtctccagcactgctctggctaggccacccaaagccaccatcggaaggaggcagggccagctctcctgctcatccgtacccacgcctccagagtcagctccagtgtgctgccagtcaagatgtggggcccactctctcaggtgctgcagcctgggagggactaggccagtgctcccactctcaaacccctcataacct

SEQ ID NO: 675 - DNA, 1975 bp, Mus musculus
ctgccaccaggtcatcactcagacaagaacaccgcaaactgccactgttcaaggcgacacactcagtatgtatctcgacttacactgcagacccaggccattcatattccaaagtctgtacactttcccaaccagacccagtgaatcaaaatttgatgcgtttcgcgaacggacaggcctgtaaggaagccgagatcaactcagcgcctgcttggtgcgctcggctcagccctttgaacctcggggtaaagatgcagccagcggtgtcaggcgaaggctccctcgttaggctggttgggatgggcaccctggactccatcctcacgactaccattgcacagagaagcattcagagcacccctaaacttcagctccccttaattaagaagctgctctcggggaaccagtagacgcaggaggtgcttgccacacagttagaactacgctctttgatgaagcccagcaaatctccttacccctggggccagcgtcatggcaggaaggagcttatgattgcctgcgggcagacctgctccggctgcgggcaagttcacaagcatgtcacatgtcagctccctcgccttccaccattagctctgtgaggagttttctaggagtgcaagttaagattagcacttggcctttttctggaaatgtctttttctttctaaacccctctttctaaaacaattgtcacagggattgggacaaaatcttcagcaggtcgttagccaacccgtttcgagagttgcctgcctgccgctggtaagtttatgagttctcccgtgctccatctctgcgctgtcagctggagccctttcggcattgaagcccaattcctgccccgagtgaaataaacgcattccaagcgcgacagatcctgaggcctcaggtgctatttgcttaaccagcggccaagaaggagcttgggacatggcattgagaagcgggccagcatggatcatcaaaactccaacacagaggaggctgctaatcaactgttaaaatccaggacacagaactgctgagggcgtgagccaggaaaaccccactaaacaaaaacagcaaccgctccgttctgggtttgcaatcagggcctccgcactcggcctccgctctccacaagcgctgagacatggcgtgcaccccaatgtggggtgtttttgttgttggcctaatgaggtttcattgggaggtttcatatgaggagtcgcgctttggaacctggccctgtaaggagggagggtggagtgggagcaaggaagggaagccacccactggattttggctcttccagagagaatgcagatttaattacaggcaggttgttgatttccaggtgacctacttcccacatggcttcccctgcttttcttccctaacacaaaagttttgacatatatgagccagaaaggaggaaaagtcacacaatgtcaccaagacagaaaggggctcaggctctgtggtccttggcaagggggaggggaagcagaaggctgaggtgttggggctgtaaagaggcagagggggtgggagaggaagaacacgggaagccagtgactgagatgagaccctgcttagcgaggtcctcttggttggcccaggtggggatgacccaggacacacacatgcatggatacacaggcatatatacatatatagacatacttgtatatacatatccctgaatacaatcacgcatgtacacacatgcataatatacatttacatgcgtgcagtacatgatacacaaatgcacatgcacatgtatacatatctatgcctacacatatgcacatacatgcacatgtagatacatgcatgtatacacacatatagtcacatgcctatacacatacagctcttggatctactgcttctgcttagcctgaagacccagtcagggggctgccaggtaggcggggatggccggtgacatcctgtgtccagctagagaagcttatggctcctgaga

SEQ ID NO: 676 - DNA, 1850 bp, Mus musculus
gaattacttctttgggctcagagcaatcacaatgtcccccagagtaagcaatcccctgctttgtagactcagggaattctatgtgttttgaaggtgtactgataaaaccaactgcacaggtctacaggggacatctgacgtatatccctctgaaatccaagcatgctcctagggccacctcagaagtccccccccaccccctgccctgcgcccagccacccatctgcttcctgcctaatctgcataacacaggtaagcctaaattttctgtactttatatacataaaatgacaggcatctgctactcttctgtcactcaacacaatcccaaaaaagggtctgtacagccgcgtgcatcaaagacgcgctccttttcactaaggggtaatattcaccatgtggataggttgtcacttgcttacctgtttgtgtatatttcagttattttatttatggaatcagtatgcattgagttgtttctggtttgggggtatttcagcgcaacctactgtgaacattcatgtggacaaacctctttatgtgtgcggtgtatccgtctcacacatgtgctcccctgtgtgcgcgtgtgtgattctccgaggcttctctcttgctctccaccttactcttcgagacaatgtctcccacagaacctggagatgcacagcctgggaggagagtggggagctcctatctgtggctgctctggagaaagatgcgctaatgaataattgatgggaaattgctcattatgtaaacagaacaggaacacgctacagttgtggagacagtgatgacaatctacatccggggcaatatgtggcatctgcatgagaccagacagaggatgtggagggtggaagcacagagaggccttggccaggggtgaaggggacaagaagcttccctgggctggtccttcatacaagtaactgtccccctaccccaacccagtcagagatacttccctgtctagtgctctttgcacttctccctcagccagggttggattcacagatcatctttctggcctggccaacacaccatgtgagctaaaaacatctctgtctcttctgctagagagcatgtggctccccagtcgcctcaggactactgctctggtattaaatcagtattaagaccctcggtgcaggggactctcctgccaccaggcccgaccacctgagttgatccccaggtaacacatgatagaagaagagagttgactcccacagactgcactctgatttctacatggtataccatggcacacacatgatggggatgcttgggccccaagggctataacgctagcagcaacaaccctgacaatgaagctggtccctctctgtctcagaccacactcagggtggcagctgggtgtattcctgtggttgtattgtgacagaaaaggaaatggcgtggcaacctccaggtcctttgctaaagggacaggacactctctatatcttctcccctaagaggtttgtgaattgaaaaccattttagaccaaatgtggaaataacatccaaaggatgaggaaccataggagagaatgctggcagccacgtgaccctgtggaactcagccacttgacttgaactgtcaattcaaagaaattcacttccaggagggacaaccctagagagatagttcagtacatgaagggcttgtcatataagcatagggaactggtccccaccacccacatacaaagccaggcatggcagtggcgcacagaaccctggaacttgctgaccagtctggttggctgcattgatgaggttcaggaagaccatgtcttagttagggtttcattgctgtgaagagacaccatgaccaaggcaac

SEQ ID NO: 677 - DNA, 2825 bp, Mus musculus
tccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagctttggaaatgtaaatgagctaaatacctaataaaaaatggaaaaaaaaaaaaaaaaaaaaaatcccacaaggagttatattttctatctaaatcatcatttaatatcattcattgtgctgtacatacatgtgtcgataatttctaattatagttccttacataaaaatttgtttatggaagcccttagccgcaaactgtttgctaaacatataatcccaaggtatgccatagggtccctcccagcatatccacacctttcagggacagcatagagccaggctatcttttgagacaatcattgcaagctgttcccaagttaagctggccccaaactagtcctgtttcctacagaggtcagaggttttaacaaagacttgtcctcttctggcctaagtgcgcgcacacgtacacacacgcgcacacacgcacgcacgcacacacacacacacacacacacacacacacacaccctgtatcaacccatgcagcacctatttgacaagtgtgagagtagttccttctccatgtcaaacaaggagatctcatgctccgccaatacccaccaggctctgcctgcttcctgccatgaagtcccctgatctgggaaagggtcacctgtctttccctacacatgtgatcacaaggtcaggatggtctccatgttctgtgcttctgctatgtctgacaatagtcccaaagatgtgggcctactgaggggggtcttgggcctctaaagagacagtttcttgatggagacagggaaggaggcaggaatcaaacccaatcaaactaaatcaccatttccaaaaatacatgcttgcccctacaagaaataacctgcaacaactcacacataattagcccatctggaattcatcttcaaatctaattaagctctaatatgcagaaacatttttccagcacctgttcactttaatcttcccctccagggaattttcttgttaaaaacccccaccctttctttgtgctattctcgttcaaacttaactacccaactgtaccttttctgctcaccacaaaaataaaggtgttgtagctcccatttttccctaggggaaaacagggtaacttgtatctgcacaccccgcccccacgccttcactcgccagccaatccctagtcccaaacacaattttaaaggcaattactttttatgggccttagcaaatgtcaggcagaacacactggaaggtagacatcttcattctaaatttgacagctgccatagtgccagcagtttacctatccacacctgagcgagacaagggagaatgagaagtcatggtcccccacacctcactgcctactgcagtccacatctgcaagcactggtgtcatggtgccatagaaacatagataccgatgtccttgttatcctggccaacacaggtttggcttggtgagtgactcactgaccagctggtatccccctgcgttagatagatggatgaacccttagcctgctgctgctgctccattaacaactggtaggacaggtaactagcagcaggatctgagaggcactcagagcacaagagcagtgggcccgggagctccactcacagcacacctgcaggacgcctgccagagacagacagaagcagcacatggtgcttctcaggcacctgccaggttagatagattctgcatgtcctggtctcgctgcccctcccactcccaactacacgtgtcacaggcactatccttgccccagtgcatgagaaatgataggctgctgtgactgactagcccagtaagtagcagatagtagagccagtgtatataacagtgaggaaagttttggagaatacaggactcatttaactgaaaatttcatctcaagatttaagtagtagtgtgcatgaggaactagttataagaggattgctcatgtgggttccactgtggagtatacagcacccaaccttagaatggagctcatggttgtcagcagtgttctctcttctccctgtgaaggaatgatgcagcccaagtcactcatcagcacactcacagcatcactccttccagagagcaccacctttgggtcccttcacaaccagcgctgtcagggcagtcccgcagatttgcccaatatgctcctttggttttcctgacagtcccaacttctctcacctgtgtctgggaactataatctgtacttcctatgcagacacatttgaacttggcattattcgttgttcttcttgcctgagcttttctcagccttaccgacagctgacaactagctactatgccagtacagagcagcttcaaaactctctgtcagctgggcacggcagcgcacatctaccacacaggaggccgaggcaagaggatcctaagcttctggttatacagaaacacctt

SEQ ID NO: 678 - DNA, 2675 bp, Mus musculus
cacacagatggtccccaattgtcccatagaatggaatacttactctccagggtagatagaaaatttggggcaagtatagttaaagtgcctatcactttgcttagcgtataatagaagtgcaatatatgtcaacagttctaattcatgtctgggttgatcttgaggtaacaaagctctggatgttggtattgcatgagtgtgaatatactggctcagtatctggcctgctagcttttgtatgtgcaggcacaatgtcaatgagccaatacacaataaatatagcaagtactgtaccttctgggtgagcgctacagaatggaaggcatgcgtagtataggtgggaaggaaggcttcctgtgacctgaaacggcaaatggggagggctagaaaggaggatgtggagaagagatcttagggctttcataggtgatgcatttgactagaaaagagatggagtctcttattgctgtttttgttctttcacaaagaacaagggagactagactggctttgtccttgggttgatagattttatccaaagctcccagtcccgtcccttcctctccacacttagatgcccaccccctaccacccctccaccagggctgaaagcagtttctctactgagcagaaaatgtctctttacccctcttcaccgctgcaactcgtcctgaaggctggtgggaaggatccagggaccttggtgtgatccgaggtcatctggagaggctcctacagaagagaccttgtgctcagagttagaaaacgggcagcactgggggcagttttctaaattcctgagtgctcccaaaacccttcccaagaaagcagctgaacagggacctcccttgtcctaggacactgcctcaggctgctgctgaagggaggccaactcaactcgtctctgcccctggagttgtacagtgttggtgacttgagaaaagatgtgtatctttatatcctcctcatatatatccttctctagggtcaaaggtccctggtgtagttttgctgaggcccttgacctgtgtcctgaataaagtcctgagggataatggaacagtatctggcatgttgtggtggactggaagacgggtgtaagtgccctctggcactgggttgggccacctgatgcatggataaccagatttgactgcaaaatccagagtcatctggggtgctttgtggctgtctgagtcatttggaacctgccccagttttttctgatattagcacattgctcttcagtaagtatcccttttcacacaatttatataaagccttctgcaaacatgtagagtgcccttgctaatttctgcagtcactgagtgctgtgtgtaggttttggaggaggtaaaacaaggtaatcctgagaccaattgtgcaaaatgtgaaggaagcaaatgcattagtcagcgttctaccaagggatgaagttgatagaatgaatatatatcacaaagggaactttttagattggcttgcaggatgccagctaggcagttcaacacagaagagagttcagtagcgctcagtccatcctgctgggtacttccagcctggcactgaagcccagggcttattagggggtcacggctctttcgtccatgttttacagaggccgaaaagtctggatcttaatgtaggtgaagtgtggaagatgagcatcagcagagaagacaaccttggagacagccaggagtggaagttcacaggctaaaatcatcccctgctcttccctccggcctcattagatctaggccatagccagagctactgcctcccctggggcatggtcatccttagtcctaactcagtcactctttccagggagcactgtcaaggacccacccagcagtgtgtctcttagttgattccatgtgcagacaagctgacaaccaagatcagcgtcttctgtcttctccctaagcctgtaggcagctcagtctctaccttgtactccagagcctgcttcccacctaatcccatctgtcgtttaaactccagggtgacttccacatctgctagtaatccttcgtaattcttcttcttgtacaatccatttattattataactgaggcaaaactcccaccatgtgaaatgtattagtcagggctcaaccattaaaaatagattagtgatgtttagaacattcgcaatgttatataactactacttttgccctgttccataataaatattgttatcatccttgacaataaacatttagtatatactctctactttccatttttttggctcctagcaacaaaaagaatgccccactctctctatgaacttacctagtctgtatatttacaagacatacagtggctttttgtgtttcatgtgtttcacttagagaaatggttagggggtattcaggtgtcttattagatcatataatgactatttttcttttactggcaaagtaatatgccattatatggatatactacaatatattcattcattcattcattcattcattcattcatgtgaggatggacattgagctagttttaccttctggttattgtgctgctctgaatgcttatgtatcatctcttcctctctgcccaaccccgttttgggcaagtgcatcctgaagagtagaatcactgactcatatggtaagtctatgtttagttttttaggaaccactgtgtcttac

SEQ ID NO: 679 - DNA, 1775 bp, Mus musculus
tcctgcctcagcaccctgaatactgagattgcaggtctactcaagccaagaggattattgtgagtttgagactcatgtggtgagtcccgggccacctgagctatagattgagaccctgtttcaaaacaaaataaaaaataatttttttaaaaagtagacatatttagcagcaaaccatctcagccaaatagcagtatatgctattataaagagcaaggaatactttttttttaatttatttataattttatatttttatcatgacatttttcaaactttaaaaaaatcctaattataaaaattaaaatacttgaaattttcagaactaaaataattatgtaatgaatttacaagaacccatcatccgcagttggttagctcctaatgtcagtttgttttcacctcactgtttccatgagtgtctgagcaatggcagtcgtgggtgctcactcatatgtctagttcatcgtgtggcttaggaaacaacatagcttcttaaaatccccacatcattggataatatcactcctaccagaattaatagtaatctttgcaacatcagttgcaatccatgttttaattttctttatattcagaatttgtttttacagtattcctttttaaaacttattttctcattataaaagtgaaggtatcttcaaatttcagaaagataggaaaaacagtttaaagcagagtacccacccatgaggacgcattcagagagacttccctcacggagccactcactggctgtttctcccgtgcagcaagtggccttggagtgaactaaaacaagtgaacatggccgaggggaaagcattctgcagtgtctgcgggaagaggtactagtttgcctggtcctttgggccagcgagatggcttagtgagtaaaaaggtctgctgccaagactgacagcgtgagcctcatttctggaaaccacgtgagagagggagaggactccagaagctgtgctctgaccttcacatgtgttctgtgatgtgcatctgcacacagacacaggtacatacatacatacatacatacatacatacatatttaaagctaacatagcccttatccctgtgcttaggaccaagaaaatactttagtaccctcctgtttatttttatttaatagagaaatgaaagaaaatttgaactcttttttaacattcttttaggatataaattttgtttcaaatatgcaattcccttgtggctatttacaagtaatgtttttaagtctcattaccatggtcattatatcataatgaggaatgttctttaatcctttcagcaacttaaagaggcttttattatcctgttcatgggggagaaaaagagactctgaaggaccctgataattaactcaggtccaggcagccagtgaggagcagtgctaggatctgaacccaccatgttattatgtaacacttagtaactgacatcttattgtaaagggtttctagaaatccataaaaagaattctaagctctcaaataaagatgcaaaagatagcaacagataatgggctgaaaagtgtaacagctgtgaagatgcacaatgtgtggcgtggtacttaaccagttagtgtctgtagaattatagttctgccagtgtctggtgactgaagctctgcagttatcagatggacagccattgtggagcccaggacatgggtcctctgcgtacagtctacagtctgaacagagaggctcccggtgacttatgctctctctcactggagtgttgagtctttgctttcactgttt

SEQ ID NO: 680 - DNA, 2850 bp, Mus musculus
cacagccacttaagactgctattccttggtgtgtgcatctgtaaagtgggtttaatagtatctgtcccctgaagacttcagagagtgtttgtggagcttaatgagtgaggtccattaaagccctcaaaagaaaggtggagctaaatacaaagcagtattgtaattaccctgcatgttctctgagccaggtcacatcttgttttaagagggttaccatgacgatgggtttgctttaaaaacttgagtttcaaaggcatagctgtaagtctccagtaaggagtgaatttcatttcattactttttgtcatggggtgggacagaatctcacagctatttagggactgtcatggtgtgacagctactgttgctgctgagtggcaaagaccttgcttgttacccgtcctgagcacctggcgagtcttaatgaaggttattccgtcagtaaatccccagcacacccaacatgccacaggcaggctgagggtggctgttggctgtgtgggggtgacacatgttttgctagaaacagaatttgctagaaagttgttacctggagttctgagaggctgaggaccctccatggtctgcagttggcaagctgagatccaggacagctaatcatgatagacgctgcagttcactggtcacggttgcagacctatgaagagctgatgttttagacccactctgcctacaaaaagggccagtgctgtcccagctggagggcattcagcaacttccctcaatccactcaggccctcagtgggttgggtgagagggagccacaggtcatagacatctctatccagtgtgtggacggggccctgtcaagctgacatagacttcctatcacactgacgtgtgccaaatccagtaacatgataggcctggagctaaatggtttccatgccatcttgtctgatgctactcattgatctgaggctaagttctttcctgtctggacccccatgtcctcacctgtaggatgggactaggaactgtatccacctcacaagtcaccctcagtcaaggtgtcaacagcaagccagctcaccacccttgtgtgtcacaggaggtccagacctttgcccaaggcccgtttctcctccacaaatcaagacccacaggcccctctaagaccctattggattatctctgcagtagtcacctaagggtctgggtcacctaaggccagatgagttgccctgccttctagaatactgcaacagcatccctactgtcactgctgtggtgactacggtaacagagactgggatggaggagggtggagcagtgagcacacagctggtgggtctgaactgaggtaggtggcccagcagcctgcacagttggtgttaatggaatgtgggtgtatggaaatcagagactggaggtgtggctcaactctgtttgatttctaatatctaaatatactaaaataaaatgaaagtaaggaatttagggaaattttggccagtcaaaagcagctggtgtgagtttggtggacagttaccacccgtcaggtaccacacccgtcagtggtggcagttaagagtcctcccagcctacccctaagagtcctcccagcttatccctgtgttttaggccaagactgaaaatatgtgagagcaaacaaactctaggtgtcatttgccttctctgagcattgttttcctcgaatcaaacctgaagtgacagtcctacatcacagggtatctggcgagtggcctgcttatcctgagcagcaagatgtcagcccccttctccacctttcctcaggacccaggggagagtgtcacgcagtaagttcttcctctactgaggctcatagaacctgtctgtggatcagtgagcatttggccctgaggagcctgccctctggcttcagcagttaccagcgcagtgtttcggtgtgtcagtgaagaaggtttgggaaccagcggtaagactcaggaatcaacactgaatttagaaatgaaatttcagattagagaacagccctctgagccgggcggtggtggctcacacctttaatcccagcacttggggggcagagacaggcggatttctgagttcgaggccagcctggtctacagagtgagttccaggacagccaaggctacacagaggaaaccctatctaaaaaacaaacaaacaaaagagagagagagagaagagagagaagagaagagagagagagcagccctcttaattagtgacactgatgaggatggtgaggtcaggatcagagataagcaagggctgctcctgcccacgcagctcctggtgtggtgtgtagtgagattttcttaccttgttgctatggaatcgattctgtgtacctgaacttaatggggcctcatagagtcctcccaagcctcaaaagctagaccaaaagccttgaccaaaagccagtctggagcactcactataagtggagcactcaccacagcagagcactcaccacagcagagcactcatcacaaacagagcactcatcacaagcagagtactcaactacagcagagcactcaccacaagaggagcactcatcacagagcactcatcacaagcagagtactcaaccacagcagagcactcaccacaagaggagcactcatcacagagcactcatcacaaacagagtactcaaccacagcagagcactcaccacaagaggagcactcatcacaaacagagcactcatcacaagcagagtactcaaccacagcagagcactcaccacaagaggagcactcatcacaaacagagcactcatcacaagcagagtactcaaccacagcagagcactcaccacaagaggagcactcatcacaaacagagcactca

SEQ ID NO: 681 - DNA, 2250 bp, Mus musculus
acggggatatatattacagataaaacccatctatttatttcggatggcactgatatgggctacagtaacattttcagagccctggagatgaggtatctgcaacatcgtgcgcagaatgcacaaagctttaccgttgctcaagtcccagcctgtgagattgctcttccttttgcatcagagaaatatccattgtttgcattctgaaatgacctgtactcaacgtcttgtgtttttcttttcttgtgtgtgtgagagagtgtatggtaaaattgaatgtagaatctttgaattattactgtcatcagctaaattcaatttggttctacataagcaagccaacaaaaatggacactaaaataaaggttatttcaaggtggaagatgattttctatattaaaacatgaaagtattctgcgtcgagtgtagatgggtacagagcaaggtgtgttggggaatgcaatgcataaccaaggaaaataagagtaaatgcaagcccaggcctcagcattttggaagggtgggggtcatgtgggagctttcctcatagttcctggtgttcaccagccctaccccacagcccttgtgtgtatacttcaaacacaagctggagttggcttgcttggaccagtggacagaagagcatccctatctctaccctcgacagccagtcaaaatcacaacaatgcaccaagcactaagctcaaccccagcactcccaagccaacctcttctgaaccagtccccaaaaagtgaatagccatgcttgtgcaaaggccccaagagaagctaggaggtaacacatggaggggcaggtgaagaggacaggttggggggcacgggggatacttggagggggcatgtggaaaggatgggagagatggtgtgtggaggtgagatgtgaaactcttgattttttttctgagaatgtcataaaaacacagccacaggaaagcatgtgaggtccttcaataacatgagaaagtcagtcctactgcaagctaaagccttggatttgccccagtaaggctgacacaatagggctgcatctgtagagagaatggggagcagacagctcacacaggagaattagccaggtctcttcatttgaggggatgactgatgagatgctgcagagaaatgagaggttcggaagggaggcccccaagggtttccctagagagtcgcagacaggcacaagagagggaaccagccagtgggacaggtggagaatgcagccctgagagaaagcagcaggcatgctcctagcactacctgccctctgatgcctgagaacactgcagacttcagccaaagcattctgggggacacccaccacagaggggcttcacctgacacagagcagggaagggtatagggtgcacggatatgagggctgcaaaatggaagtcactaatagaagtaatttctcaggtttatgcaaaatagttcagatccagacacatgcacccagagcacagacaggcacatggcacaccatctagggagagcggaagaaaagtaaaaacatcacagcaactggtagagagggaaacaaaatgttctaatccctgctattttcagcagtcctcttctccagctctactctcttgggaacagcaagtttgcatagagaatcaggtcagcaacagagactgagttccatgatctaaaagtccccagcatgtgggagccatgactgacacttagatttggggaaggagcctgtgtggaggccaggtgtggggatctggggctgataaacaccagagtggacaaaggagagggggcacacattaacatagctagggggcaggcataaggtagtttgtgcagaatctaaataacaacgatggcttgccctatttaaaaaaatcaacaagtatctgtaacactttgcagtctacaaagcacaggtccaaggtccagatttatcccagctaagtgccccaaccatgggggcagacaaccatggggatgggggatcaggcacggactttataaaacctacaaagtacagtgatttatccgcaacgacttaaaccttccgaatgcttctcataggctaaaggagaaataaatcaaatgattctattatctcaaactcagagttcagaagttcctgctctgtgagatgacaacgtgcgactttttcctgaggcttttagcaaaccgccatctcctctttctgcgaggagacagtctcctttgcacatggtgtaattaaaatagctgacttgctcaaacatagcc

SEQ ID NO: 682 - DNA, 2725 bp, Mus musculus
tgtggccaagacatccaactaattgtgtgtgtgtgtgtgtgtgtgtgtgtgtgtgtgtgtggtgtatgtctgtgatgtatgtgtatgatgtgtgtgtgtgtgtgtgtgtgtgtgtgtgtgtgtgtgtgtgtagacaacacacatacttggaggcacctgaaagaggcaagaagaaggagtcagatcccctggcgctggagttacaggctgttctgagcatataacttcaggtgctaactcaggtctctgcaagagcagcaacccctcgattgctgagccattccttccagccccatcaccacagcttttaaatttgtaattttcttgtcattgcagcaaagactttgagtcaaattgtggctctgaagattcctagacgccaatagcatcaaacagataagaagctatgaaagaccgaagtcctctgacccttactcctaaatcttagaggccccgcccacttcatcattcagaaggttttattttttaattgttttagaaaactgctattggcaaggaaagagatgaatctgagcaaatggttgtcctgggagaaatgtctagccttgctagacaagatgaactgttccacaaagctgctgaaactcacagacaagacagcaaagcagtggcgagagcctgagcaccctgagcttaaaagcgtgggaattaaggttcagagtgctgagtgaaccaagcttcacacgtgtcctcaggcggtgcttaaaacaaacacataggacggggagaacgcctcaagatcagtctagaaataaacttaagtcaggtgagcatgagaactggcagcagcatacgggcaaggcatttcttcaagagaactgtgtgagcccgcactcccttcatagaagtcgggaaatccagatgtaaaaggacaggtggcaggcactctggaagaaatcacacacagctgcacagcagggccagccgtccccccagtgacacacctgtcccactgctcacctgcaaccgcttctctacatcaacagcccagcagaactagcgggagctggagcactagctgatgaacttgccaagacacgctaaccacttaacgccaagaaggcgcaaccctgcctctgagaaatagtctcctcaaatcctgagaagtaaccaggcactcaacgtgccactgccaggccagaccagggaagcttctagacttacattacagtctaagtatctcaatgttgacatcaagatttcaagctttcaaacaattgcacacacgtgttttaggtatacaagtatagcaaagggcatatttgataccagccatgaacccacatgttgcttggtgattttccacatttgtttccagaggcaccaaaatacaaatgcttaaagagaggggaaaaaaaaaacctacttttccagaaaactaaaaataccctggccatgatgttcaaccagctttggcattaacctaagcatatgcatttgaagaggctcagccttgtcatcaaacttataaaatatatctctaaagggagctaatgtggatgctaataatctcatgctaggcactatctttcagccagcaaaacttattttaatctcaattatttataatagattttaaagcttcataaaaaacatgcacaattatctttccatctcctttgttctttgtacctgaacttgtcactatggcaaccatggatgctcagacatcaaaaagaatccagtagtcatattgtatgataaaaacaagaacctttatgcccagggccctccagtgtttggcaatgtgctctagaaagttcttaacagacaaaatatagaacagagtgcagtagaaggatctattacctagactggtgacatagaacgtcatctcctgttgtcatgtctgtttcctttttcctttatagctttctctcttggttttaattgtaactacaaaaatatgccatgtaagaaatcaaattgagtgttcagtacaaaaactgaaactgccccttttaatcttcatctaaaatgtcaaaacagatgacaccagagaacaacacttgtaaggtgccctgagggagctcggcaggcacaaggtccactgtaagtctgtcacagatgctgatctttctgacatgaactgagcctccctcagtttagcaaacctaagcccatctcaaaccagtaagaacattgcaaagtatatcaggaacaaaattctaaacactgaaaattggctcaatattagttcacagaattaatctgtcttatttgtattaagtattaattagggagggatgtcttctttggtttctcaatttttttgtggagggaggggtgttttgtttagttgtttagtctgggtttttgttgttgaagtatcttcactatgccgcctattctggcatggaagtccctgcctcagccttccaagtgttaggattaaaggcgtgtacttccaagtccagcccccatttgttaaaatagctttggggggatcttttataaaacaccacattaaaaccagaaagaaagagagagagagagagagagagagagagagagagagagagagagagagagagagaaagaaagaaagaaagaaagaaagaaagaaagaaagaaagaaagaaagaaagaaagaaagaaagaaagaaagaaagaaagaaagaaagaaagaaagaaaagaaagtagagggggagggaggggagggaagggaaaggaaagaaaaagaaaagaaggagaggaggggag

SEQ ID NO: 683 - DNA, 1825 bp, Mus musculus
aggggcaaatctaaccaatggatagtgttaggaaaccacttgtgggctggtttcatgcgggacttcccccacacagcctacacctgcacacacacagttgaggcgtcggagttagaaggaatgcagtggggacaactacactggggactgtgtaagaaacacacagacactatgcaaggtatgcatgggatctgaactccctcagttttggtacctccctggggttcctgaaaaccatctctgagggataccaagggatgactgtagcagatactgaatttcctcatgctaagttttattatgccacattgtatgttggtttctgtttaacacattagaaagtcaattagaatttgtgtgtaggcaaaaataggtacatgagaaaaatctgttcacatattttaaaaacaattcttatgcagtaaaggcttctatctcattttataaccactctgtatggatatccaccataagtaaaacacttaaatgtgcaatacaattatttgtaaggaatttacagataggcagtcctccctaaatgattaaaaatagtgaaatgtcttaaaaaccccatggagcccactgtgattccatacactgagttgtttcccctctctctcaaactagacctgctaataaaaatggaaaacaacccagcatcttaattatttatcttttaagtaaatataaattttctggaagtagcttcttccctggatgagcggactgcagaagcattaccttgttgccagcccctcccagcgtaaggtcccgacagaagctgactagagacaactgctacaactagactacacacgtcatgcatttaaatctgaaaaagcttacattaacacgacagccaaacccagtgagtcacaaggttccacttcctcctcaccttaacacacaacagcccagggcagcagcctgacagccctgccaccttcattcctcaggagtctcaggggctgtaaggcatttgggaacatgaacttgtggtagagagtcaaggtccagggttagatttggaacttgcaggcagaaagggctcctggtaacttaggaccaatcactagttgtgatttggatgtctagcctgggtcaaccaggcacgagggaaacaggaagggatgtttccctcagactgctatttaaacagaaagtcaccaagagctgagtgaggaaaccatacaccacacgttagtagatctagctcccagcttcaattctctgcctcccccagtctttatttactgacgagagaatatagaatactcatttggctcaagtttactttgtgttccagacactgtcaggcccaggaatatcttgtcaccaagggacctaagtatgactatggtcatatcttctcactaatctgccattagatcctttgggagccagccaggacagaggagtcactgctgagtgagagagggatgtcccatgggtgtggaagagccaaaaagtagcaagggacaagatctctcaagacctgttaacacaggggacaacttgcaaaaggtgctgggagcatatggcaggtgctaagtgagctgagtagatttccaacagaaaaagcttacagtttgcctgactttcccattcatggctgaggtgtcatgttgtcacatatgaatataaaccctctaggcaagcttgtgtaatttgcttttattgttcaatattgctttcaaacttatctgtattgatgaatgtggctgtggctcatttatttcaattgctccagagtgtttaactgactgtatataacatgattttctttgttgttacaaatatgtaacaaatgcacttttgtgtgtgc

SEQ ID NO: 684 - DNA, 1875 bp, Mus musculus
gtaaactatcagtttgccattttgctccagaaatccctggtctccacaacctgagctttggggttatagatgggctgccctgtgcacctgacatctacacggactctggggacccaattgatcccctgtgcagaaagcaatttacaagctgagcagtctccctagcccatgttagtgattttaaagatcttttggagtatttcaacatttgttttattccttactctcactcttgtggatagactttgtaaccctttctttgtctgagatgctctgcagataaaacggggattggttatgcattacaaagaactgcttgaaatggccctggaggggaaaggcttcattgtttacaagtctgcattgtttacaagtctgctgcttcacctaagaacattccaggaggactacttagtaacaggccaatgctccaaagagacttgataatttttgtacgtctggagagacagcaagcggaaaacaattctactattaatatacttcgttgacatctagcccaccagttggcttaatttggagtactgcttttaattagcaacacgaaggcagccagccttttgcacagatttgttacagtcagctgttccttactgtaactccacaaagtacatctctcagaggccttatttcacccagtcaaactaacatgtttatacaaccttgctgtgagttcttttttccacctgatggcttttatatttcagaatcccactaagaggtcttaggtgctcaagaacactgttgtgaacacacagtatatcgctgaacctggacagttaggatcagctgcttaacgggaccccagatggacattattgaatgcctctcgttggctctggaccacataaacacccacgagcatgtgctgaacgagccttcatccttagtggagtcgctgtatcatactgcactcatcgtcagctcttcctttattaggcttgggttcatggcggccattcaaacatgctggcagcagcgtgaacagaaacagttctgaaagtgattttccagggagtggtacctgttctcccatcagagctccagtgactggacttaggcatcaggtattgtagtcacctcagtattccacattctaacaagaaagatgctcttagacttccagctcaacagggaagctgctgtgctgggagataccatttggttgtctttctggccatttactcagcacaaacacataggagaaacaacagaatagccctgggtcatatataagattagctttttttctcacttctacgggcatgcactaaggtagaattatatggaatgaggaaggtgactgctttgcatgagacaggcacacagaactgctcagcacacctcagtagtcatgtggtcccagagtgacccaagggggttcactatacttctaaaagctggtctggaggaatgaagaaacttagtttttgatttgggggtggggggaacctctgacaagagctgcatcactggagacagctaaaccatcccggaagtgggcttgtcattgctgtggtcagtgaaacatgttgggacctctcagatggaaatgtgcttttctataccttcttcaagagtttaaatttttctcttctggagccactgtacccatgtctgagagtactaccggataccagcaccaacttctccctttcctttaaggttaatgagtttgattggggctcactgataccccacataatccagaagattgttttgatttggaatatctagtttgcaccttgttaagtgacatcttcccttttgaatcttaaagtatgacttggactctgcatgggttcatgtctgtaacagctattgtgtgaagcagcaaaactatcaatgcatagactt

SEQ ID NO: 685 - DNA, 2525 bp, Mus musculus
gaattgtatccaaaacaaaagcaatacattgcatgcttcaggatcgttgggaagtttggatgttggttgtgttcttaattaattaaaaaaaaattaagatgtggatgtgctgccatgatagaggcattatgactgtgtagctattatagctgtgttttgattggtgcagtagtacagtatgtctcagccttgcgttagaattctttagagaaaaaagttaggcagcatggtagtaaaacaaattagtaaaattctaactggataacatctggacagtgttcctgtgagatttgttttacttttctctgcattgtgagtacattggaatctttagaaagacaaaagtagcttttgaaatgtctataaatggtaaagatatttctgtaacagaataagaaatgcccaagcaaatagtgatcaacaaataagtaggtactaggggtgatctccactctggaggtcagtgaatgccaggctcagggaagagtaaaaacaaagttggaaggatgcacaaggtaacagtccatcaatacctatgtatctgtcgtctctgaactgaataaaggagagtcttaaggtcaagaaagacaatatactaacaggcttatagctcaattgacacaatgtttgcttagcatgtgtaggagcctggatttattcctagcagcccagtaaaataacaaataaatacattgttttaaaacacgaaggaaaaaaaaacaaccagaaaaccaaagttgccaccatagtgtctccgcctttttctactaactctcaattagaaggccataaaagccaagtgcacttgggaggcagaagcaggtggatttctgagttcgaggccagcctggtctctacaaagtgagttccaggacagccagagctacacagagaaaccctgtctcgaaaaacaaaataaaacaaaacaaaacaaaaagccaactgatttgagtttatgttgaatttctgtgggtcactcccctttgcccacatactcggaagctgtgcagagatttggtgtatctatacagtgtggaggtagcccaaggcttatcagaattactcagactttaaggcagcttttatgtgatggctttaagtagctggccctgtagccaggtcctggggcaagctcttggtcaagcatcacacctgaaccctcagggctccccagcctccccacatgcacgcattggcaacacctccatttcttgcattttctcccttaccaggacagctcgaataaacaatgaatgcagacttttacagatgacagggagagtgctcgcatccagattctgttttctgccttgacaaaaataaccaagaaaaggaattgcaaaccagctgccagctacctgcctgaaatgtgggtgtcagaaggggatgggggaagcggatagcagtgcctgcgtttccattgtagagcattcatttttggaagaaaatattacaaatttacatgaatgaggaagtttctcctgagatattcttgctgtgttaaggaaaacaaagcagtcttttgggaaagggaaaggattatctgggtcggaaatgcaggtaggaatatgtaagagaaagttacaagtgccttccatatgcattatgggtatggatgagatacttagggagatggctcagtgggtagaggcacctgccgccaagcctgagagcctgagttacgatgacctggaattaaatggtgaatggtgggagcagacacttgagagctgacctttgacctccacatgttgcatgcaaacacacacgccaattaactaatttaataataataataaagtaaagatggtaaaaaaacaaaaacaaaaaacagttaccattgatgaaacctcagtgatacgtgatgggctgtattgtgacttcactgatataaaaaggactttctatatgggcagggctgaaagattgtatccaggactgggtttctattctcaaagcccttcttaaagcatttatcatttattattttatatttatttgtttcattttgtgaatgaatattttgtctgcacttatgtatgtgtgctgtgtgtgtgcctggtgcctgagttcagaagatggcatcagatacccaggaactggagttatggatgcttgtgagccaccatgtttgtggagaactgagcatacaccttctatacgatctaatctcttaactactgcaccatctctccagcccctggttaagcactttaattctcactgaaactaaagacaaggcaaagtcaataccactcccaattgtgatgaattgtgatgaaccctgaccatgtgaggtccatgtgggactcctgttcccaaagaaaggacctgacaagtgccccaggattctatgtgttaataatagagatcatgaggatctctgacctatagggcattccagacacaggaaagggtaaggacattgattggagacgtttcaaacacattattactactgttagaaaagttcttaatatgaagccctctaggtatctccaagaaaggaagtagttcaaactagt

SEQ ID NO: 686 - DNA, 1925 bp, Mus musculus
caatggcaggggaggcccttgctcctgtggaggtttgatgccccagcataggaggatgctagagtgctgaggaaggagtaggtggaggagcaccctcatagaggcaaaggggacaggggaagggaagagaaacagagaaggagggacatcatttgaaatgtaaaggaataaaatgattaataaaaaaaattcatgaataggatgaaggagacctgcctcttcctctcatggagccacagcttcaggcttatagcgtgcaccataataatttgctcagccatattgctatacatgactgcaaaggcttcaggaaaacctggattttagtgagaagctcacagcctctgtcactgtacttcactgtggggcaatgggctatacacagacggcctagtcaccagtcaagctgaggtctgaaccccgatagaacctggtggtgataattcacctacatgggacagtaggcattccctcatgtctcctagaaccctggctcctgtcgaagttaccacccctacatccttcacaagagaagctgtggctaatagtcacttacacaatgtcccaagcttctgaccttcaggctagactcctcccagttacctagcaacaacaagataacagcccaccataagaggggctgcttagcccaacctcactctctcctcatgctctcctttttctctcttactctctctcctttctctttctccttttcccctttctctcctcttggccagggccagtctccctctctcttttaccttctctctttgccttgccattctacaataaagctctaaaaccatagactgtctctgttcatcaaggcccgctgtgcttggacaatgggataggctttcttctaatgagctatttctaatctcccgatggaagacttcctgtgctccagtcaaggcccagactaaagactctcgcctgcgtgggaacctctctccctctgccctctctcctgtaactccacggccgaggatgtagcccctcagcctctggtatggggggggggggcaatgccccttgtccaccccccatcgagtggggtcagtggcttagatgcccactgggactgagtggaaaatgtctggcaaccctcccgcatctgcctgcccagagcacaggagctttggccggacacaggctttctcccgcccctcctcccctcctccagatagctcatacttcacagcttttccttccacatagaagcttctccttgccatgcatgtgtgtgcatgtgttcatgtgtgcatagttatgcttctgtagagaaaacttggatcacaactgtataataaatgcctgagactttgataccaatacagttgataccctgcttctgaaggaaattgaaaaatctggaattaggagccatacaaaagagctatgcaagaaactctgcttgcagcatgagcatccttgaggtcattaacaggcccacgtatacagcatgctcacatcccagctcaagtgttagtaagctgtaacagctctcttctaaaggacaacaaagtgctaagttttgcctggaggctttacgcgattctgtttctgcccaagatcttaggctcagcacttttcatcttagttaaatctctcatattttaggcttggcacttcagcagtagaaagtagttttcctcggagttataattcacaaaaaagaatatttctctgcaaaggtattttacatattgaacaatgaggaaaaaaacacacaattaaaatgtagacacctaggcaactggctaagcactcctagattcattacctacccacatgaatctccaaacataaccaacgtaaactcatcctttgcaaaatgaggaatcaacacaggtcatagactcttactatctctcagatgttaaactacccgtgctgaatggtctgttctatgaaatata

SEQ ID NO: 687 - DNA, 3125 bp, Mus musculus
caaatcttctacggtggttactgcatcctcttagtatttattttctgttcatacctgttggtttcccaaatggtctatcacaacctcctcatgcgacttcaggctctcgctagccttcgcttgactgacagtacaatgcacactgttcccagagcactcggaactctctcttccctaccctttttttctcctcccactcatcctcccttctccctctctcccattgcagaagttctcttctttctctggactggtaatatctcttagctttaaggattttcagccggcatttccagcatgcacaactctaagctctagtggcatacagcacacatgctccgcaccctttatttttaacaccgaaaatcactgagagagcagattgcttaactcggtcctttcctattctttctgtagaagcagcttcctcagaatatctccagtgggaacacctaagagtcagtggatgcttcagtcatatccacaagctcttcccttgcttccaacccaggaagtcctccaccgaagacaagaacttcatgttaactttgaacgaatattcggaagtaacacagctaaaatgtcacatacacatagatagatagatagatgatagatagatagatagatagatagatagatagatagatagatagagatagagagatagatagatagagatagatagatatcccattcccactattagagtcattcaataactatttaatatacctgaaaaaagtaccgagctataataaaatactggatatatatatatacatgtaatattgtctttgtggggctacatgataaacaaaggcaaaacattccagggcagagaggagagagcaacctttgagaatctaaacgctgtgctcttaacccgtgggcttggacagggagtgctgtcctggctgccagtggtctgctccactccctgaccttgcatctgatgagatgaagctgctcccacctcaaagcacagttgtgctttccagcgaggaaaggcacagtgcagccgcatgttggctgccaccttgctacaggctcctctcgatacctccattttaaaatacagagcctggccaacgtgcgtgcctgagacggagacttagccagaatgctaagaagataaacacggtagtccaactggatactggttaccagttaccactccatgagtaggctacacagaagattccatgtatataaaatagtatattaaagtaaacttacaaaagcaaagagcaatcactgcaactataattttttttcttcttctttgggaattctaattttaaaagcattaaaggagacagctgctcatgctgtgatatgcactaaacagcctgaaggataaaaaaaatatatttgtagctcataataactattgacctttctgatatacaatgttccctgcgttagctattcggttctatcaacagtgaagattgaacatgactttttaatagaaaacatggggtttgagctgccttcgcaaaggtgtttatgtattattttgtatcgcactacaaagactgagtccagatgccctttgtctggtatcagaggtgctgtaaagaaaaggagaacagagaagagtgtgtaaagagaggcagggaaatactgggatgatacggaagggaaaggagaaggtgcttgctggtgaggatcttatgtatgaagaattggctcgtaacccttttactatggcgataaaagccttgccacactcgatcccatacacagcattcgtaatggaatccacgctgtgtcccaggaggaaatgctctatttttcttccagaatagatccctcaagtggcaacatttataggaagtttccgggaagatttaaaacactggctcgcagtactggtgccgtgtgtcctttggcacacacagacactacggtttgggtacagtggctttcacgttctctctaaggtgatcttcacaatacctggcatcctgcccccgccctccccaaaccctcctgcccagtagctgtgtacagaaacacccactggtagcagcttggcgctgacactgtgtatctttttccagagaggtatcactcaaacaacaagtgatagctgcaggcagctgccacacatgctccctcggaggacagcctccaacagcagccctgccaggcacaaggagcctgaaaagctacccagtgttaggattccatctcctgtcaggccagagagtgccaggggtcctgataggtggcaggggttggcaggctattagacttaactctctcttgatctctctctcagtcttctctcccttctctcctctcctccctctcccctctctcctttcaatctctctgcctctcagtcacactttcttctctcccccctccacagactactttttaatgttactttgaaaagcatttattacatcattatcgaacctcagctatgtcacagctctgctctggagtttccattgatgatctgcaagtttcaaaacaaagctgcaggctcacaggagttagagcagaaagtggccctagtgagactggcataaagggggcttgctttaactcaatccagagcaagcgcccctgcagacaagaggtcactgagccagaggataccaccactgcactgcctatgagagaaaggacatcccagagcacagaaaacagagggcactaactggccttgccaccagggccaccaaatccactgtggtatcctgagggctgtagtactgggacatggcaaagacaggcccgtgggatgaaaaacaactctcaaaagacaaactattctctacctgaagatgcagccagctctctcttactactgaaataatgggttttttttggggggtggggtggggtgggaatcaattctgtagcgacaagcagagggaaaagagaccttgattccctctcctcacagtgtcctgtgacagtataacctagcctgggagagtggcagaggtcaagttggaattcttgaaagaaagcaggtgagaatgctactttgtctcagcacaggtaacccagacggataaggagggctggaaagacaatcccacctggggacatgtcacagtcatggccctattgttagaaccttttgaaaattaccaact

SEQ ID NO: 688 - DNA, 1950 bp, Mus musculus
ggccccaggagtctggctgcccgctaagctctttgtactaagtcaagattcttcataataaaacagtctctttcagacccaaactgggctgtaggccaggtttggggcaccaattttttccaagttatagaaaacacactgaaagttacaaatgagaacaaatagccattttcagaataaaagaagcttggtcccaaccctgaggactgcatttcttgtcgcaggcacatggaagaaatgcctgtcagaaatgaccaagaatgactccatatggagattctcagtcttccggaagtcagagccccacaaccaaagcctttacgcagagccccaggccaccttctaataactgacaagttgatattttttttctttccctattaaatgatgttttaaatcttggttctgaaataattgggagcatgtgcaggagactggcactcttcctgcctcctcgacccccacccacacatgccaattcccttgtagttgtaagttcctcctggtgatctacatggaaaagagccagccagtgagcatctcacagcatctctgggccttacaagtaaccaaggtccagaaaggtgatgggatttccccaaggtagagtcaggggctgcaggtcaggctttctgcacctcgagatagccttgagttcatttttaataattagcaatggcctgtgatgccctttacagggggatcatagcacagcaaatcctccctctaaggcctacatcattttacatgtctaggatgagttggtccttaccatagtggggaaaagaaatgcaactccatattctcttttaatcctgtgcattgtcccactactgagctcagtcttaagttccactgaggctacctcgggctcagtctctccccgtgcctgggtcaaattctccagtgactctcgagtgagccacaaaggctttcttaaggctgccctgcctctcccaccacattgatttttttttcccagtctttgatgagctagaaatcctccttctgctgtgcagagccaactccctatgctctcacagaggccctgctcattcctggggaatggcacagagctcgccctctgtccctgcggttcactcctcggcctgccaaccttctgctcttttccagcctttgagacacctcagcccctcagcatcccctctgctccctcacacctggagtcccgagtatggtctctccaagaaggttggcctgttaagaaaaaaagagagaagaggcacagacttcaagcagctactgggttttggtcctgcaaaaatccctcaggcagaaaagagtaggaggagaaatatctaattagaattcagtagagggataaaatattcagcaaacaaaattcaagtgaagatctccaaacattgctctggcctccctagcacagactcttgccagctctggctccctgatgctattgtattaaattttaaaagaagaacaggaaagatctttagcaagacacctgttctaagttttaatgcccaccctttgtatatgggcatacatacacatacttaattttggaataaaataatgcttgtgtttgtgttacctgtataattttgaaagatgtttctctactctcatagctatttagagaatttccccaaggataatgctgaattacttttaaaataccatgtgattccataaactctatgctgttatgttctgtctcattctgctcacatctctttaagtcttagatgctaaaggcacttagttccactagtcaggaacaaatggtttagggtgtcagctaaacacctcagcaaaaacatcatgattctagaagtagtggccacaggcttcatgtcctccttcctcgccaacattagacattttattaactaatccaatagttgttcaaattggatcctttatcagaaatgttgggcttttctgtttcccagatttggggctatt

SEQ ID NO: 689 - DNA, 2800 bp, Mus musculus
tcaaaatatataatgttcagaacaagaaaaaatcttatcttgaacagaaaagaagtataacttaagtgaaaatcaggtttccttttaactactggatggatgagtgctgattaagtccagaaagcccagtaaaacagatgtcaaagtaaccccgtccaaaccacctacctgccccaatctattcttctaccaatcgaatgtggacacagcttacattaggggaaggattgaaggaactggaggggatggcaatcctataggaagaccaacagtatcaaccaacctggacccctgagagctcccagagactgagccatcaaccaaagagcatacagaggctgatcaagggtcatatgtagcagagagattagttgtctggcttcagtgggagaggatatgcctaatcctataggaatgtgatgccccagggtgtgaggatatggggtggggactggggcaccctcccagaggcaaaggggagggaaaatgggtgaagaatgctgtgaagggggactgggaggggggcaacatttggagtgtaaataaataaaataattaatgaataaataaaaggaagtccccaccctgtctttggtaagatttatgatgtacaatatcacatttactttaaccatttaaaatgctttttatgtataatctcagaaaatcactgacacattaatgagtagcctatgacaatatcccctttagagttgtagcagtggaaggtcaaataattcacccaaggttgtataaatgagtcttgcaagaacttaagacctacccaccaacttctgaaagccatgcttgtgatgtttatgctgtgctttcagactgatctccaatcatttattaaactctggatgtgctgcatcacactctgattgaacctgtaacgtttacagtgcggcattgggaagacagattctgcttcagaatctcctcaaccccttctacagccacacaggggataagggccgtgcctttccccaaccatccaggtttcctacctccagtacagaagaacactcttcaaattcgcaaatttgtgttggttggtgtcctcccaggctgaggcagagccaataacatttactgcaaagggcttagggtgggtgattctgggagtccagagcctctgggcacattgaaaagcccaggtcactcctctgtctggagtgctctctttcaccctcttccttttctttctcacattgcagggattgatcgttttttcctttccactggctgttgtgacaaaccaaggcttctgtcagctctaaccttctgcaaaacagaaaccagtctccgaattttatccttcgtatcagagaaaaggcaaatcgcaagttccccattcatcccacccttccttatgaaaggtggaagctcacatttgcatgtaattttcagtgaccagactgagatattcaggtgaaagggaggtgaatataaccagttgctatgacaacagcaagatataaaatggcacagcaattcttaggacaagcttttaaaagtacataaatttgaataataacaaagaaaccattcaaaagtacatatataaaaatgacccaccaattgaaagaatggtgtacaccacagaaatatactatactgaattaatcgggcaattaaagagacacacacatatgtatataattctaatcctcaagggactatgaggaaaatgcagggttgataacaactctgctgcctcctgaaagttatttgtgaaacggatgcagctgtatttatggtaaattttctccatgtgcaccacaataccaagactcaggtctcactccctagattgtgttggcaacaggagaaaatgcatgtgttcttaccacctaacgttattgatggcctcctgcttcaagttctccggtttcctgatgtttctcattcctttcttccactcaaggattattctctccagttttcccagggttcattgaatggcacccattactctgatgcctaaccagacatctgactggtgactcccacatctacacccctacttctaaaccatctccagatttgcagcctccatccccacacatttccaagcatgtctcaaaatcaccatttctgtacataacctgaaaggccattttttcctcttcctgaattctctggtaagactagtgtcagaaccagagagatctctccagttattgtctctctgtcctctctcacattcagacaagaacacttctaaattcttcctctgtgatagcagtagagcctgtttgatctatatacccaagatgggtctcaccaagactaaacaatccaaacctctctacacaaaccacaccagtcttcagtcttcctttctgcttgcaggcttcccttgttcctggtcatagaatcacctttgtgttgttgttcttgttgttgttgttgttgctgctgctgctgctgctgctgctgctgctgctgttgctgctgttatggttgctgctgctgctgttattgttgctgctgctgctgttgctgctgttgctgtttcagtagagatttccaggtcttcctccagatccaccaagtcagagcatacaacagacaactttgggaatttattactttctagatgttctcagatagctcttgatttcaggccagtctagactactcattgctaccagaatgatttaattgccaattttttctgtacatattgctggtaaatgacatccaaattcctcactgaacattcatgaaacattctttgagcgatcatccccaacattacctctcacagaccctatgcctcaaatttctatct

SEQ ID NO: 690 - DNA, 2875 bp, Mus musculus
atactgaaaggagggtgaaactggggtgaaaaacagctgcttttagtaaagagttacagagatagttcttaagaaatggcctcagcacagcaagagacaagcttgtccttagatgcaaggtgaccagacagacatgtctgaggaggataatggtgtccgaaggggtcaagggcagtggaaaattacaagaacaattgccagtaagaaacaaaagcaaagccagggtaatagaaaaacggaggtgtggggtgcagtctatgtgctatggtgatctgtctcacatgcctcggcagtaaagtcagagaagaatggagggtatcccaaatcgaatggcttagaatctagccacaggaggcagattgggtaaaagcaatgtcaagtctcagggaggaatcccttttaaataaactctgatggattccaatgaaatgagagagtgacttaggataagaagacagagaagaatctagaaaatagagggtcagtgaaggctggattaatatgaatgagaggtcagcataggtcagaaagacgtttccagactaaggtcatagcaatgaagagttctgagagctgagcaggctagcaatcacctgcagcccagttagttcctaggtaccggtatctggatgagagtgagcggtctttggcttgaggcacgagtacctttcaattctactctcctcttacaaaaagggagaataacaagactcggagaactattacccacgttaaaaacacagccgactggcagagaagacagctctatcagtgcagagcttgccttccaggcacaaggtcttggttcgggctgtacttcagatgacgcagctcctctccgtgagctgtccacccttctccccctcagccatgacgaacattttccttggtaagccagccttggcctcagcagaactgtgacattagtgtggcttggctgtgcttctgccagctaagcctgaatctgcttgcctttccgtaagacacgccggctggcacggctggcacggtgcttcaccacagcaccgcggtggcttcatgggccctgtcagcgtttcttccccttgcctccatgatctccgttatttgaagttgggaacagaagtctgtggtcgagtcaacaccagcagagatgtggaaagtaggaacagctctgggcttctgggacccctcacaacaccattcagaactccggaaagtcttcagggagaggactcactcagggataaattagtttagcagagctgatagggtgggatgagacctaattactctctctccccgatcttgcagcccgcttggcagtggagagaaagtcaagtttgctgggccgtgtcatcgggacttcctttggcacctacgtagtactgtcacagacactggaactgcaacgagcgattgcattagctctcagcaacgtgtttatttgtgactggcctacttagaaagacaactgggatggaaaaaggaatattttaaggtaaaaagaaacacaagatgttggaaggtaagcaatagcggcccacactccaggcccgagcggatgggccagcccaatctgcggcgtcacaggatggaactcattctggctctgccctgtgtttctcattctcagtgatgtttctaaaaagcatagaaccaaaggggcatctgaggagggctttgtgtgtctgagggaaggaggggtgggagcccctttgggtgaggaagggtttgcaggggagaaaggtagggcgggagggtggagtggggggtaaggggtgggggctaggggctgcgtgtgggggacttggcctgtaagacacagcggaatgagtcactgctgagcaggcgtgggaaacggctgtcgtttgtactggaacaattctgaaaatctgtaggtatggaactgcacatctggtttattcccctttaagtttgctgtaaaagaccttcgaggttaatgagctctccctaatccacttcaaaagggtcaaatccttctcttttatttgaccccataatgctactggtcattgtctaggggccttgtggatgaggaagctgtagcctgcctatcccccaatttaaccccacccccacccctgatcaactgccttatgtttctaggtcagttgtgagttcggcggtgtgtgtgtcctaacactgtacacagacactgatattaagggctgctttgactctggagtcctttgaggaaaagccttaattgttcaatgctatagccgatgagaaaatattatgttaacttttccacatccatgagtttgtgtaatgtttacatctctgcagagtaggtgttattattatcattttacggaggaataagttgatgcttagaagtaaggcaacccctctgtgtttgataagtaactgagaaagggtcctcgcctctgtcctagggtagagcccaatggtattgtgaaagagaatctcaagcctgaggtccatgccctggacaaccctagtccacgtgagctcatgtgtctatataaggaagaatcttggctctatcagtgtgtgaaaggcctgtggtgccatgaagctaagagctccactctcaactctcagagccggtggactgtcagctgactctggcattgggtcaatattcagttgaaccagtcagggtccagatgaaccaggactcctgccctgtgtttctaccattttcttagctttacctaatattgtatttgccctcagagcaatgttcaggtcctcgaggacttggcattccacacctcttctggctccaggagatggaggagagttgactcaaaccttccgctcaaacactccagcaaaccgggacttctgtgtaacatcagtgtcctcttaccatatgtccaaagggagtgcatgtctttctcct

SEQ ID NO: 691 - DNA, 4850 bp, Mus musculus
agaaattaacagccatattggtctagaaatgttaaacttaaattcttccatttgtaaaggggtaatgaactgtattaaatgtgtgaaatcttatctatgtgcgtctgattatagaaattaataatgtattctctaaataattgagggtggaaaaggatccctcaaaggccctggagcaactggagcaagtagctcagccagaggccagacaaagtcagggactagacaaagctgggaatgggggatgagtgggtagcaggcacaggctactagcaacaaggacagcctgggaggcagagctacctgtgggccacgttccagctgcttgcatattcttctgccctcgagagagccaacccccaaacaccaccctaaagcgccagccaagatcatcttggagtgtgaatgctaagcacagacagtcctagtttcttggcagagacagttcccctaacacaagctgccctcaaccccttttccagtaagcaagctttcctggctcattataatgctggcattgccatccacaagatgaaagttgcctacaacaaaaataaacataaaacggttatgatatacacatctctgaggaccaaagtgtccatcatcacagatggcttattcatctctgtgtaatgaaatcaagatcataattgtatatttccagcctgttcactctccctgcttgctaaagaggggtctggctttgtctgtctgatcagcttctgcctgctcttgccctctgcccttctgtagttagaatctagagaagagcacgagggatctgaacatggttgaaagacagatgagcttggtgtttgaatagctaagagtagtgagcgagtatttataacatgtgagaaaaatgaatggaagagtaaaggattctaaaaagagaaatgttttctgagactacgattcctttttaaactgaccaagaatagcaagttaaaaaaaatacggttatttggaaatttctttttagttgatggacttttttgatggtattggatcattggggtctctgctttagtgagcatcattagtatccacagtgtctagaacaggacactgggtagtgtggtcaaataaatagcacatacccatgaaattcccaagacactccctgcaaagctgaaatatagcagcaatgagattagacaatgcacagagctatgtgaggccaagtgccctgtgagcagttagcacttgctgcgccttctgaattctttgtgatgccacccatggcctcttctcctagttcagactccatataaccttcttccattccttcttcttcctcaagtacctgtggttcccatcctaatcagagatctagtaaaccactgggtaccactcgtcttactgcctaatggtttctctttctttgtcttcacatgccactatctcagaccaggaccttatccaaaagaaaattagttttaattttgagggaaatcaaatacagttctgagaacaaccaacattgttctaattgaaaacaaaactgaaggcctttttctgttactttatgcatccttctcctcatgcagaaccagggatatttttctgactcaggcaggcattgaccctgagggacacatgcatgcacaacccctgtcgtgtgagcatgcgtgctcatgcacacatgcacatgcatacaccagcatcctgagtgtgtcaaaaggaaaaccttttgttggtaatattttgatcttgagtctatattaaaacaatctgttgtcataagagaactttgggtatcatcatcaatcccttttcttcaaaattctagaaacagtgatgtcaaaatgcattattttttctggaacgaggcaggaggtactctatggatttgcactgagttagaaatcagaacaaccccagcaagcaggcagctcacagagctgccaaactaaggcgtcatcagtgagacacaaagtcccagtccaccctactgcttcactgatggcaacaaaacaggaagctcgtggcttcatacggtaaatcccagcaggacaaggtaattctaggcctgcattcggggcctggtagcaggaccctgtggaatatgaaacattcaatgcacctgttatttttaatgtcatttcacacagggaggtggagagatccttaaaggaagaccaggacctaatcttgatagtattaaaacaattatagattaattattttcaatagagttcaaaaccattgactgagcaccaaagagcaaacatgctttcttatatattgtctcatatacggtttttggtacgttttaattttagtgtctttaccaaaaataggaatctgtttgctgagaaaacagagggggtttgagatcactcttgtccattcctcttctctgggagaactataagatgatatctcacatatgtcctctgaggtgggcttttaggaataaatgaagcaaactttaataattgttgaatctaatttagatgctatgtgacctttccttttcctatttcccctaagtttggaggttttcaaaagttcctatgaaacgataaaaccatccttccttgggacaggcagactctcaacccctctcacaagttctttctcttcccacggagccattagggcactgctagtgaggctgccatgataagctctggaagccctggagcagccacaggacattacacatttcgtctgaagagatctctccccagggtatgcattcactcctggcgcagtctgatttgcctgggtgatgtatgcagttgtgattcaggcctaccagtcatctagagaggcaatccttcttcagaggacagccgagggcatgtgagatgcagcctgtgacaggtacgatgacaggaagattcatctgccagatggagaaatgtttcgtaatgtttttcagcttcaggacgggatccagactcagcaacaaagcttctcaaagtctgagcctgcagcagaggggatttgtccactctctgcaaactggcagccagacctgtaggttcagcagagccacaggttgaggcccagcaaggcattcaccactcttgggacaagatcctataacaatgtgctgtatgcaaatagacatgagaaaacatcaatgctgcaaaattgctgagggaaataagctggacttacagtattttataacattttagatgtcagatagagtgttagatttacattctgatatcgaacaaagccactgacagcttgtgactatgggtaatatttaataaccagcctgctttcttttgtcgctggtgaaagataggtataaacttgtagaaacactatacagaaattaccaagacagacttaggaaacagtaagttctcagtgctctaagagccacccacgggagaaaatacgtgtgggctgtagaaattacaaaaggaaaaaaaactctttaaagtggagaaattacaaaaatagttggaaactaatggaaagctaagagaaccgtctggacaatgccggtttctcttaggtagatgttgatctctctgaacttgcccctcattttacaagacattaaattatttaagtcaaatcaaagtctcctgaatattcaacaatctcatttcactagtttgaaaggctcttagcaatgacacacaccacccctgcagagctggggcagaggcaactccatgtagacctccacccccacgcacatataaagaagcagacaacatggtggcttaaagcgttactaaaaaacaaaccatttccctaaattatgcttcttctgttccctcaactctgttaaaacattacagctcattagtgttgtggggtttcaggaccccaagtctataattctcggttagtgctgtcccatatgccatagcaggaagacacgattaaaccaatcctacttaaatccgtgccagctcagagactttgggcccaaaccagagatgcagcttcaacgtggatgtttaacatctgcctgatttacgacctccttgctttatgaagagagctggtgaaagctgtgggggagcgtttcgatgccactaacactcatttgcagcagtaaattgtgacagcattgtaagagcaaatgtatcagtcggtcagaacctattctgacgcaaggccatcagcaggctgggaaaatcactacatacacaggatgcaaaaggctagcttcaagtagcgtttagggcatatttctaagtagtcagaaaattaggaatatagacattaagagtcccacagctatactaattgggccacatgattatctaaccatcaggttgtatatgacttagaccaggactggcgggtgtcacaattagactccaaagtctatcagccatctgcagtgtggaattgtcaaccctaatggtctgattatacttcctgtttgtactatgactttttttttttcagattaaacattttctcctaacttgttaaatggcgttaaagtcagttgtgatccttctcctcttcccccccccccccagccccctgctctttcctctagttactttctttaggaatcctccctataaaacagttttaattactctttgacaattttatacctgtctgtgatttattttgatcatatcaacccctccattacccactcttctcccactccaaccccctctagaacccttgtttgtcccaacaattcatattttgcttttgtaagcaatctactgggatggatcagagttggacctaggtgggagtttatttacttaagccagggtgagttaccagtgacaataccactgaagaaaaatgacactcccttcaccaggagccattacctgtcaatagctccttacctcagggtgggcgccttagatgagcccatcccattcacaatg

SEQ ID NO: 692 - DNA, 2450 bp, Mus musculus
tggtgctgctgctgctggtgaacgcctttaatcccaacacaatggaggcagaagcaggaagacaatgtgagtttgaggccagcctgctctacacagctagttctaggacagccagagctatacaaagaaaccctgtctagaaaagaaaggggaaaaaaaggagtcggatattcgcaggacttagggatgtaaatcattttgtgtgttcctttttcctgtaaggaggggaaaaaggaacgataagaaagagtgaaagaggaagggaaggaagaagggagggaagagaactgagcatgggagtttgagaccgtgagagatggagtctgaggtagtgttgtacagcacctgtgaacctgcacctgagaagttcaaatctggggtgatgagatgactccgtgggtaaagacagcttgctgaacgaacccgagttcgatcctcaggacccttgcaaagtgaagggaaagaaatgaccccacaagctgtcctctgactgccacacaagtgcctggagggctggggaaaataatggtgtagaaactatgccaccaccaaatccaatcctcccatggcacagatgggcaaactgagggccttggtgaacctttactatctgcaaagcaagaaataacccctgctctgcctagctagtgtgtacatgttccagaagattcaaggtaggttggtgaagccagagcgaaaaagagttggtcagtcccatatgctaaggaagtcactactatacctgctggtgatggtttgaataaaaatggttcccataggctcataaggagtaacactagtaggagatgtggaggaagtgtgtcccagagttccttgatggaggaagtgtgtcccagagtgagtgacaatgggctttgaggcttccgttgctcaagccagctccaatgtcaacgctctcttcctgctgcctgcaatccaaaagtataactcccagctacctctctggcaccatgtctgcaggcatggcaccgtgcttcccgcagtgacagtaatgtattaaacctctgaacctgtaagccagaccccattaaatgtcttcctttatgagagttgctgtggtcatggtgtctcttcccagcaacagaaacctaaccctgctattgactagtggagctgagccactttgctggctgctgcctgtcatagccacatcttccgttcctcgttccttgttcctcgtggcggggggtcggggggggtgggggggtgcgggggcgggccaccaggcggtcctgtggcagtgacaaataatgaactgaatggctggccccacctgggagctggttttgcaacaccagccccgttctgtgtcccttctcacattgcatttgtgctgccctaatttctaagaataaagacactccttcagggaccactaagacagtttcctctgctgaaactgcacaaggactctggcatctgacgaatctgagtttgactctatgaatctctccacttactgggagaggaatggtaaacaaacccgggctcatggaggttgggtttccttgtccgtaaagctgggagaaccgtcctgcttgctggctcgtcctgaggattaaattaatccaatcatttctccataaatcattactgaatgcctgcctgtgtcgggagttgaggatgcaggtatgaattcaagatagacaggcaggggtgtgcctcagggggcatacaggcagagaagaacaaagagggacccccccccccaaacccacgttaccaaatctggtgggtgttaggaaggaaaagtgttagtgaggaagtggtgtgagcatgttttatgctcaactgctctctcattttacagggttgggatttgaactctggattctcatgcctttgtgcacagtagacatgaactctgcaactgagtccaactgagggagggattgttttgtttgctttgtttttgagacaggaatgaattggcttttttgttttttggggttttttttgttttgttttgttttttgttttttcgagacagggtttctctgtggccctggctgtcctggaactcactttgtagaccaggctggcctcaaactcagaaatccacctgcctctgcctcccgagtgctgggattaatggcgtgtgccaccacgcccggcttttttttttttttttaaggtatgaggtatatgtgtgtacgtgtgacatatgccatacgtgtctgttggggtgtggaaagcctgcagaggccagaagaaggccttggatacccaggcactggagttactgacagatgtttagccaccagatttggaggctgggaacgaaccaaattctgggcctttggaagaacagaaagtgctcttaatctttgagccctttctcctgcgcctcagtgagctttgcttcaagaataactacttgtgattattagattttaaatcctcctgactgtctacattactgctatagt

SEQ ID NO: 693 - DNA, 2125 bp, Mus musculus
tactaaattcttagactttcatcaacgagcactgctatcagaaacagctagatctatgttcacgctttgagttttaggaggacacaactacaggaaactaaaggaaagtgaaatgttctccataaacaatcaaacgcccaacaaggtgaagcacaggcaacgaatgaactgcagtttcccccatgagggaaccgcaacttggattgtcacaatcaagtgcgaccacaaacagccaccatgatctcacgctatcaacaataactacttattccaaagcacagtttgaatcaaaccaaaaacaacaacaaaaaaaaaaaaaaaagactatgattcacagggaattaacaagtcttattttggcatgtgtgacaacaaccaatactttttgtctctcaaagaaaaatgtgttccataaactttcaagatgtattttatttactgtggaaatgcatgaaaaataattgcagcctcagaataacgtacaataaatgtgattaacaacaagcaccaccaggaagtggaactggtgggagtcaggggctctcgtttatcttctcttatggatgtactcggtactgaaattcgcacggggaacctgcacggcgctggcaagtctatttaaacttaactctagaggagagaacagctgcagcttctgaggcttgacagctcacagagcaaacctgcatcctctctgacagcatgccatcctgacttcacacatacagcccaatatgtcaaacagttctagactgtaaacgccaaccttggctggaataaatgagtcacaaaatctaaatcaagctttatacaaacatcaggtggccttcagaaggcctgctaaaattcaataatattgttttaagctttgagtaagacggctacttataatcaggactgcataccaactgaggttagtgcaacccttagtcaagcctttacataccagaagaccttacttaacagcacagtgcagaaacaaactgtggtaacagaaccggataagagcgggcaggtaagtacacaatcaggcatttccaactttctgcactaaaagagggctctacctgagaggaggggcacacactgggtggctgggcggctgcttttgtggcaccagctgtatctggcctggactgagttcctggtgcacagcaatgatgatactgtggggttaattaaatggaccgccactcactggtgtaaatcattatgcccttatattttggtataaataaagctctagaatatgtaaaagacaatatttggcaatttgattgctttgtgggtgtaattcaaatgaaatgataactgcttgctttagatcttttaccccacagaagaaacttaagaaaatgtgcactaccagcatcccaaattcaaaccaacaactatgcaatgctttaaaaagaacagcgtcatggcgtaaagggacatgaccacggttcacacaggtatggggagctcagcagaatacagagatatctgagtgcagtccgacctgcttatagggactagggcaaggggtcggtgggactgggaactcactaagtaagcaagtatgaggacctaagttctaaagtccccaaaaacccacacaaaaaatcaggtatgactacgggggacaaagatcaaagggtgactgggcttgataaatggcaatataaccaaagaacagtaaactccaggttcattaaaaacccacagaataacaaaacaagcttaactcaatagaaagttgagcaaaaaatataatctggtatttcattagcaaaaattttcaagagcctgaaaacatttgaaaatgagattaggaaaagccaaaagcaagccacaataagacaagactcctgtcacagtgcctgcttaaaaggcctagctagctggccagcgtcgggaagcatggagccacacaacttcacaaatcatggtggggacagacaagtcagtgccaccatctcagaaatctatttcctgatgtctactaaacttgaaagcacctaacaaaggcactccatgctacagatgtgccaaccaacatgcaggcacatgaacaagaaagtaatagctgtgactgctgtatttatccataacagctcaaactctacatgaacccaaatgttca

SEQ ID NO: 694 - DNA, 2175 bp, Mus musculus
aggagcaggaggaggaggaggaggagcaggaggagcaggaggaggaggaggagcaggaggaggaggaggagcaggaggagaaggaggagcaggaggaggaggaggagcaggaggaggaggaggagcaggaggaggaggaggagcaggaggaggaggaggaggagcacgaggaggagcaggaggaggaggaggagcaggaggaggaggagcaggaggaggaggaggagcaggaggaggaggagcaggaggaggaggaggagcaggaggaggaggagcaggaggaggaggagcaggaggaggaggagcaggaggaggaggaggaggaggagttatcaccatagaggaaaggtagatggtacagtaagatttcctgctgctgacatggcacatcgtactggagccaccactgtgaagacagaagccatccgtctcctgacaggcacagctactacactcagacttcaaaacgaactccacctgtctccagggacctctaaacacaactgaagacatgcactctgcttaaactagaaacttaaatttgaataaaatattccaggagaaaaaaattctgtgaactttttttaatcttagaaaaacaaagagcgagaagtgcgagctgctgcggggttgacaagtctgtgaacgcgtgagtaacattcgctattaatattgttctcaaaaaaataaataaataaataaactgaagcagggaaaaaaatgatttgttttatttttaaaactgggtctcaatatgtagcccaggccaaactagactcaaggataaggatttgattaaaaataaataggtgaacaataaaagttggccattagaaaatttaaaaatctcaccacattaagccaaagagtatatttattacgtttattgtcgctgttacgaaagaccttgcagctcagctcatggaaggactgctcacactttcagaaagctcaatagaacacagaagacagtggcagagcagaacggctcccagcatggcagtcaagagtcagagaaaggagggccctggagctcggcaggctttctctttgcttccctctcattctgtctaggccccagcctgctgcacggtctccccccattcaagggaaggctctccctaagctagtcctcccgggaacaacctcaaaggatgagccagcgtgtgcctctccaagcttcaggagcttatgaatccagtcacgctgaccacggtgacttactgtcatcgcgaacaaggctgtcccaaagcaatggggactacagtcacggatggtctgagctacttcaacagctgcacatcactacacaaagcttctgtacttctccaatgctcaaggaaagctgtggaggagccgctgagcagaacttcgttttctctcaaatactcattaaaaagttcacaatttcaaaatttagaaatcccttctacctgttatctactactattaccagatttcaaatttaaattcattaaatacacaaacgcttcataagaggcccaggaacataatttttttaatagaatgacatattatatccaaaaagttactttactaaagattttgaccagtctggccaccatcctcccatttatctacaagtgaaaataaactttggtttgggagtttggttttggttttgtaatttttttatcagtgtattgctatgcattcagaccactctagaatcgccacactctccgaactggcttcaaacgtgtggtcctcttcctcagcctaagtactagaattacaaatacactccagcactcacagcttacgaataaaatgttataaaggaagacatctcaccacgtctggcttctggacttcattaagcttcccagtcaattcttctaacacccttttggtttcagcgtcagacctaagcaaagaaagaagcaggcttcaagttaaataatcattttaaagttatagtgttgtttatcgacgttgtcattgtttcgagctgggaatcaaacccagggccttgcacttcctaggcaagtgctttaacactcagctaaacccccacccctcacagtaattgttattccataattctcaactgactcctcctccaaagcttattaaaacatgccaacagggccctacccacaaagtttctgaatcagtaaatagggcccgagaatgtgcattgctacaaattcc

SEQ ID NO: 695 - DNA, 2100 bp, Mus musculus
ttgcctcaattaaccaagtcttgattctctctcctggccgatccaaatgcttgtctagtcagtgattatagaccctgtcaagatgcaaatatatgaatcaccacagctaaaagtgctgcactatactcctcagtgatgggaaatttctaaatattctcctatctgtatattttattcatctttgagagttccctgaattttttttttttcactctgcatcagcatttgtggaaaagttgttctgtggtccagtatctttttcgttttgttattcatcaaacttttcttgatgatgttttatttctgttttttcttcaagcaatttttagcaccagcttctttctgtaaagaacaaagtaacagtgaaatgacagcttccctagaagccatctaagtgacttcctacgctcgggtttgtttgttctccttagaaaaatcagagaacacaaagcatgggctagatatgacaggatgctgagtcgaactcagttttttttttttttttttttttttttaagcaggtgtcatgctgtttcaagcagttatgcaggcagaatagattaaatcagagggaagaaattgatgatatagtatcatatcacttgttaaaaacacatcaatgttgttcaaaaagtaatatctggcaatatagtagagatgtgggctactgtgttgaacaatttgggggatatcatgttttgttgagctggacactggtgctatgaatagaagatggaccagctagctgatgaaggatgggaagtttatgtgtgtgtagcattgcttagagttggaaaagaagactagaaaaatagtgttagagattagtttttcccatgaaatgggtctcaagttgagccagtcattgtttggccattccctctgtctctgatatatctttgtccctgcacatcttataggcaagatgcactttgggtcaaagattttgtgactgatttgtgtcctcttctctccactgggaatccttcctagctactggaggtagccacttcaggctgcatatcccccactgctaggagtctcaggtagagtccccccactgagtccctggggtttctctgtccccactcctgtaccaggtctctggaaagtcccacaaatgcccccattctctgctcttcctacacatgatgcccttgtcctcttcccctcaccatcccctctctgtcatgcacactgttttatacacccaccacatttattttgtttccctttctgaataagatttaagcattctcccttgtgccttccttattatttggcttttttgggtcactcatttttttttttatcaactttactttttattttttaggaaactatacaacctgtttttataggaattctataatatttgccaattgatcaataaattgacattgttaagatactttatgctggggccaaaataacaattgaatcagatcaattgtgaaaatatgtgagaaatttaaatagtttaaagttaaatctgcacatatttcagttgatggcattaatagctatgtaacctgagttgtattctgtgctgcttcatgacagctgcatcatttggcttctcttctgcttccggaatgttatctatccatgagccagtcaaggacaggatggacttgcaccttaaagccttttaagctccaggcatttaaataatataaacattacaaattggggaaataggaaatgtagaaatgcagtaattaattttgtacacttgatatttagcaatatcaagaaataaatcattttctctccttcacttttgcctctactgtatgcttaataaaccatgacaagactgcctaagttcatctctaatttctaccaactatatgctagacggctatgagcactttcttcaatcctgaagtcatgccaatctaaatacagtattgcctttacttccttaacaacttgaattgctttatgaaaggagcaatttgcctaaatacctgagcatctggaagcctgtcttttatttacaatttgcctagcagaaaagtcattaagaatttccagaaaatgccagcttggtttttaagatagaatgtaagttatgattcagaaaagccatttggc

SEQ ID NO: 696 - DNA, 3150 bp, Mus musculus
tacagttttgaacatgtaggtcccaaagctgcctccttgaccttgggagtaagaattcacaggactgaaatggaaccccttaccctaaattctccagacaactggggatgggactatctcaggatctgctgtattattgggttacctggagaggagaacagagcttcaggcatatctacttatcctacattgaatctggctttgctgctcaggtcatgggtgatctgcagttctctggtctgggggagggtactctggcaccctcctgacaaaaagacaccagtctagagagacagcacactattcctaaaggctgtggctgtcacataccatcaaggtcacttaataagtgagtattgaaggtttctgttatgtggcatgtgtaaagtcagatacacttaccaatagagactttggaagactgccactcaatatccctgcgaacttcagctgccacccagctctgggcagtggggacagctgagaatcctgtactttggagaagactgcatcactggctctcagtggtgtagtatccggtgggatgggcttccaggcactgctctttcagggcttccagtgcactgaattcagcagcaggtgtatccatgcagacgttaatgggacaattgactaacctggcagtgtggacaatccatcagcaatggaggagctttaacttcctagtaactagactcggacattacagacactgtgacccatttaagccatccataatactgggcaaaaccagacctctggcttccttcagatttccttataagtgacatggcatattgtcccacagtctctttcccactggaaattgggagggggcaatgacattgggctctctggttcttttcaaatgagtcccctggcaacaatacgtgagaaccatgcatctggagattcaactcttagcgcggggggggggggggggagcttcacctgcagaatcaggagccctgtgtggctttgtttaaccagctagatagacatgcaaggtagtttcttattttttaagaaaaggccaggcacacagtcagtggccacctgcccagtaatgtgatatttcatttacaacagcccaagagcgtagcttgtacgtgttaatattggctcgtagttagctggctcctcacttcactgtttccatagcaacactcctcaaacaccacttcctactctgaatacacaatgtaaacaatctgctgttgaacatttcccaatttaggggattggagccaaagctgagaggcctgtgattagagaggaaggtgagctgctgagaagtgggattctggtatccactcagcggggtgcccataacagcttgtggggatcaagatctcagacaggtacagataactccattctttcagtgaagggacatttagtacaggaagagttcacaggactccgatattatcagttagggacgaggagcctcaggatcccagaagtgacaataagttgctcctattgtcgcacagcttgtgatggaacatagtaagagttagggcttgtctgagaaacacaaatgctttcccttcacgtgtctcccagcagcccctgtcctgagcccatggcagggtggtgtatctgggcattctcctgcaaagcctgcacactgagcgactcttcctaaggtcagcactgtgtctattgaccagttggactgtttgccacgccgcaaagcccctgctgggcctgcattcatagggtcttaggacttcaggagttgtatttctctgatgaggaaaataggaactcagcctgtccccaaatcagcctaggaccctgctcaaggcactgctatttttttttttatcaaaggatttttgataaaaaatttgatatttttgtttccagtctcacccacacatagtagtgtccacgacttccacatcctcagagcaaggcaagactgtttgttctttcttctttttttctttccccaagtggggaggggggctggggggggactcaggccattttcttccaacttcttagcaacccttagcattctttgacttctgagcaaatgatcacatggtttctgtgtctttagcaatgagccaaaggacactcatggcctcaggaagttcaagaaaggctcacagagtatgttggagaaaatgccaacacccggctgggggatgggtactgttggaaagcggtggagaggttacccacctagctgctagcaagactttagagcagggggaggtatggagaagtccatcactggaagatttttaaacaagtgacaatcacttatagttactggtataaacatctgtcacccttgcagggtcctgggggacccatggcttgctccattcactgccaccagaacattgctgccctggggtagggcttgtctgctgtctctcctcctaagggctatcccatcaggtctccccatagacaccagctagagtcactagcttcaagagggtccccaagaggtagacctgcccttgctgcttgttctgagcaggtctgactgaagtctccatcagacttctcaggccctcagaatgtttcacgcaagatgagatttacaagtctgtcagggcttgaagttatgaagacccaagacagcagggaatattaaacccaggtagtaggtgatgacccacccttagtctctcagacacagggctgtgccttctgctcagaaaaacaaacaaatacaaaccaaaccaaagccagaccaaaactcttaggggggcaagggtggagataaagagagctctgagacaggagatcaagctctgacgtcccactttccaactgcctcactgtgaccctgagaaagtcatgctccttccttgagcctcagtttccctgtctgtagggttcagggactagtttgtattcatatacaaaccagttctatagggatactgggtgataggaggagcaaaagggaccccaggtgatacaggttagaaatctgccaaatgcagcaaagggcaagatgcttctcctatgaatcttctcagcaccattagcacactgccagcatcccccaaggggacagaacgtagtgtgcacaaaattgtgaaaatgaaatttggttctgtagaatttggagatgaggacatcccagatgagactataatgtcttgatgggaatca

SEQ ID NO: 697 - DNA, 2375 bp, Mus musculus
ccagatgccagacgggctggagtgttcaggcctgtgctactaggcccagctcaatatatatttgttaattaattatgtcataccacaccctaatggtcctggaaaatttacatttttaagaagacatgataaatctaagtatcagacaggataatggaataaaaaagacagtctagatttctgtctgtctgtctgtctgtctgtctgtctgtctgtctgtctacctgatgaatcatctatcttggctacctgttaaatatcatctgaatttaataaatgttaaagacagccccacaaattataaaggaaatcaaattatgccataatttataactttatactgtatccccaaataattccttacttcaatgtaaaaattactttggggaatataaaaatcacaaagaatgaataaaatataaatgtttatataattttggcctgggaaaggagctttctaagtatgaaaccaaaagcaaactcataaaagaaaagattaatagatttgaccacttataaattgaacagcctgactccaaaaaacgccataaataaaatccaatgtcgaggcacagtgagaaaatattctccgcagcccgcgctgtactgcaaggattaatatccttaatgtacaaagcagtgctgcgaattgatatgaaaaaggcaaatgttgtcataaaaatgggcacaaaagacataaaatctgacgtcttaattattttagcgctgtgtttcaacaactcacaaaagaagcagaagcttagaggccaaaagccaggcactcgctgaccatggctgaagatcaacaaggggcagaagaaggaagctgtaacttttcttggccaactgaaaatgaagccgtccataggctctttgagatttggggactgggagtgaccctgcacccaggctcctgtagggagcagcattagctgagtgcagctttctgtaaggtttgatgtgtaccaaacgccttcagaacagtgagtcaccgcttttctgctgcctccacaaacactcccttctgctctatcatgctaaaaactaattaaaaaaaaaaaaagatacccttctggcttctagccatccagaaggaagttggtcagagtaaaagcagagaaaggactccctacaacttccttccagggtctacctcctgcccacagcagtacaaggcagaatcctttgtttctaaggttctctgaggcctctaagctactgccttggagaccagtgcaggcccttccctcacaagcctggtacctgtggcaggtgccctctgagatgtcaaatgctggccttgaaatatcaactgggtgtccaagaacatctcctagtagagagggtcctaggtgaagttctatctctccagtccttgatgtggaaacctgatccctaaagttatagccaacagcagtgaaagctggggtggggggtagatgggggggtctttcagaggctgcaacagatctctgaccaaagcagcttaaagaaaggtagggtatgtgtagaaacagctccaggagatacagccaatcttcaccaggcaagtatgtctgcaggaacctggctaggcacatggcatccacagtcaggaagcaaagagagaggggaaagcgggtactggctgtactggctggttttgcatgtcaccttgacacaagctggagccatcacagagaaaggaaccttccttgaggaaatgcctccatgagatccagctgtaaggcattttctcaattaagcggggagggcccattgtgagtggtaccatctctgggctggtaatcttgggttctataagaaagcaagctgagcaagccagggggaagcaatccagtaagtaacatccctccatgtcctctgcatcagcccctgcttcctggcctgcttgagttccagttctgacctcctttggtgatgaacagcaatgtggaagtataagctgaataaatccttttttccccaacttgcttcttgatcatgacgtttgtgcaggaatagaaaccctataagacactgggttctctttctcttttatattcagtatgatcccccagcccatagaatggtgctaccttcatttagggtaggtcttcccacctcgattattctaagctggataagccctcaaggacatgcccagagatttgtttctatggtggctttgaatcccagaactgtgagagactaagccagcatcttattctgcctctcagtgtgaagcccttcaccttgtccctagggttacatgctccatggtttcacgtcatggagatttgttactgtgaccaggataataaaggaggaacagaagattctaatccattaaattaatccatagacttagattagctttcaactctgccatccca

SEQ ID NO: 698 - DNA, 2200 bp, Mus musculus
aaaaaacaaaaacaaaaacccaaaccacaacaagccatttccagctctgctctgagtctcccaagacagctctttgaacgtgagtttctggttggttttgcaaactccttgcttggggttcacaggctttcaggggaaccggagcgggggcaacatttgtggcatttgctgcatagaaaatgaacttttggattttaagattaaaaaaaaaaatgtcgttcctgcattagcagatgagacgcaatattgtaatttgacacttatttccggcagctctcaatgtgaagtgaagaccacgtccaatttttctaccggaaaaactcaggtggaaaaagaaacaccacttgtatttcacggccgtcaggtgattcttgtgggggagtttatctgaattcctggaacattctccacccttcctttctggtgaagttactaaaagcagatttcaaaaagaggctcgaagtaccccgcccccccccgagtttccattccgctccaaacatgtcccctacctaatataactctctcgtgtcatcaaacacaaagggaggcacttttcatgccaaacgtcagaggcatgctctcttttctataccccacgagtaacagcagtgaggtgttcatttgaaattccattcatgtaggttctaataaaagccattataaaacacaactgtgtggagacaaagggagagatattatcactatggctcaatataaaatttaagtaattaagacgtgaaaactattacacaatttactacaaatgtggcaagaataataaaatgtttaaccctttccatcctgagctctctcctggttcctgtctctggaatgtctaacagatgaactcaggcacccccaaaagatgcgtggaaacgtggttgcagtgcaggcctttggaggaggtgtcggtgacaatggagggcagtgacttttagtcctgtgtgtgcgttggggggaggggaacatgtccctgtgcatacatgtgtttctcaggcacatctgcctgtgcactggaacgaagggcagaggagatgcccatgattctcatctgtctctccccacagtgctccctgagggtgctccctgagctttgactgggcttcttggccagccgccccaggcaccttccctctctgtggtggataccggtctccacacacaaacacacacacacacacacacacacacacacacacacacacctttttaatgtgggatctgaactcagaacctcattcttgtacagcaagctctctcactccccgagccagctccccagctcttgagggactcttgagagggggatatgctttctactgtatgacaggaattgaatgtctctggaggaaatacgcgaaagcctgtctagccaatcaggctcaccctgacgtgacgaaccgatagccgcaaatgagaagatagcgtggggccgagctggctcaagtggatctgcgttcacggctcgccactcccactgagcttgttaggagcactcaggcttatagttttcctcctccacagaaaaaatcccgtgtcttctctgacctcccagggtcgctctctaatcagtcagtggaagccaccacagttaaggctctaggatgtagctatgttacagtaaaacccacaacaatatgaaggagagggtctgctgtttgggtctcccccaaaggcagctggaagaggatagcaggatgtgctgggtcttggtcacctctttcctcacttttaaagttcctgaaagagcaagagtttctgtggctcccgcagggattggctgcatcaccagcaccttctgtgtgtacttctgtgatgaatatggaagagggacgtcccttgctaggaaccggcctctggagagggtatctcaaaagatggtggtgactcagttctttgatctctatgtgttttcacgcctgtttgttggcgaaggtgtggcttttctcttaggatggtgctatacattttctttgcaaaatccatgcaggtgaacagaaaagggcaagacacagtggttggctgaggtaagacaggtgtcactgcactgcctggcctgtgggaggtgcccaagaaacactcgtaggtctgagaaggatccaacggtgcactgatattaatgacactggagggatggaaataggcaactgctttctgtcatgggctcacacacatgcacacacacacacacacacac

SEQ ID NO: 699 - DNA, 1975 bp, Mus musculus
caggcagttctgtctcttgactcataggagccatgagacacccaacaacttgtgtggcggttctcagcggagtcgtggaaaatgagcacacacacacacacacacacacacacacacacacacacacacacacacacacacggtggcagagcacgtgtaagcagtaagaagtaatgctacatatgccaacatatcatgctgtctagtcctccgagtttgaagaatgctttgaagtcaggcatgctggagcaagaaagtgggcggtgagtgaggggtgagatcggctcaagaaaggggctctaagatgtgaagggcagcattgcctgaagcggctcccagagccagtctacctgggaaatgcagagtcgctgggaacctcgggagcctcccacagcggtatacaagacaggaagtggacatccatgcaggaaagcattcctgctatcgcacacccatggcctaaaggatgagcattgcttgtgcaccagtcagtacccaccagagggcttgcagtagatgagagacaagaaactcaatctttcttcatctttaacttggaaacattcacatacacactcctatacatatgcacacacaaacacacatgcacatacatactcacaggcatacacatgcccacacatatctgcacactcacacacaggcacacacatgcacactcacacacaggcacacacatgcacactcacacacatgtgcacacatacacactcaagggtgcactggaatgttgactggcttgaacttgttcagctcttatacatgtgccacagctgctctgagttcacaagcacaggagtcctgtcatgtccagaagtccctgtgtcaccccaggcctccccaacctcaggctcttacagtctttctgtcacatcttctaaagtggtccctgaggcttggagggagagccatgataaaggtgccctctctgttcttgagccctccaatgacatttgctcctgacactttggccaggccgagttcctgcactcaccaccatctcccgcagagaaggcgtctagaatgacacctaagagctgtgtgtgtgctctcttatcagtgaagagaaacggctgggagcagtggcagcctggccccgtcaggcctggaaactccgttacgctgaactctggaggcggtggagcctagaaaccttgctttccttcttgaagtgtctgttcagatattctgtgtatttttattaggttgtctgccttttaactcttgatttgtaggagatttttatagctcctggaagccagtcctttgccgataccatatgtgttgcaaatatttcctcacagtgtgtggcttaccctctctttccctcagtgagaaatattttaataagtcccagttgtttctgtgaagatacatacatataccactgttccaagttcacaaaaatatcctgctggtatgggtgtgtgtgtgtgtgtgtgtgtgtgtgtgtgtgtgtgtgtatgatactcacacataccactgtcccaagttcacaaaaatagattcctgatatgtgtgtcctgtcttttatgtgcagaactaggctccatcttgaattgcttttcatgcagtatatgaaatgtaatattccatatggccaaccatcgggcccaacacttttgttaataggacttctctgctgaactgctctgtgcttttgtggaagatcaattgaccatgtaactatgcatctatttctggactcggcctcatcaatggatccagctctcggctgacaccacactgttttgattactgtggcttttattgttcatcaaagaaacaaaaattaaaactgtagagagaaataagagtgcggacttctgagtggttgaaagactggtgacaccagccaggggctggtggtaagaagcaaagaaggcaagaaaaattctaccattgagaactgctggcttggtgctaagctaagagctacactcttcccgtgacc

SEQ ID NO: 700 - DNA, 2300 bp, Mus musculus
taggctgcctttcagtagggctgaccctgtcactcagtcttttaacaagaacacccctcgcttgtccttccgaagactacaaatcttcacggtctgcaaagagaaaagaaaagtgagaggaagaaagtatatacactgtaggcaaacatctggaaacagagagaagtattgttcaggtctaagagttcaaggaggttactggaagtcaccttcactgtgccacctgtccctttgtcccagagccttgagtctcctcagagactggagtcttcctgaaagtccagtgtggtgcttctgggccctcagtcctatgcactgcctctttaggacaccccattttcaatgatgaggggtctgggagcatgctgaagctctctgtagaattttgggtttcagggatctgggcagcaccatgtggacaaagaatccttcttcatttctctcatctaaaaacactcattttggcttttgggtttggcttgtgctatttaagacaggatcttgctatatagtattggctactcttaaactcgagatcctcctgcctcaggaccctgggaaccagggttatagtcagcactactctgactaacaggagtctttctttctcaaaggccagcaaagggttcttgaacccatgactatgacgacccacccccacccccaccccctggactcaggacaggatcgtagggcaggtattttgccaagtggtcttcaaatgatagttcatggaaccctgagcacagatttgggggacagaggctgggagatgtgggtatatttcttaagatacatggctcattcatactggatgggatccttctcggtggtttgagctccaaatccagggtcggttgcttatctatctcatgttctacgttaggaaatggtttggggcccctcgctgactctcaagctttgggtaacagggtatagagtacactggatgattggactggctgagtcatcaatcatttcacttgttggaaccagagcgggcatgtgactggttcacagtcacacagtaggatgctaagtctggagcccaggacctaatgcagagctcccacccacacgcaagttctccctcaccttcctcccccgtctttcacgtgacctgtgagtatgaaacggaaaaccacctcagtggagagcccgtggatagcttccactcggtttgccggctagcaagacttctttcctgctttgcagctttagacaatttacgcttccattctcaaaacagatttttatcctaataaaggcttttattaccgttatccacctgtcattacacagcattagacaattacagagcacagaccagctctccctccgagaaccttcccctccgctctcggcagggggctgaagggggcgcacacaaacagaacatttcattaaaaaaaaaaatacagatgaatcttttgatttttttttcaagcactgccaagacttctacctacgctttttaaaactttgttatgaaaagtcagcggcgtgagagagagggggcttagaaaagtgtgggctagaaatggtctccagccccattttgattgccagacgattgacaaaataatttgtacccgtcgatgctcatgaaggggatttttacaatggatttgccaagcagatttttaattttaatcagtaatgaaaaaatgacaacgcggatcacaacaaaccatcactgccgcgcgggtttcgcagtccctgtcaggcggccccgtcacacagccgcacctccgtgaacatcaatcatttgcttcaaactcctgtgcatcttcggggcttaattagacatttaggttctttacccgcaatttgcaaaactgtcaccaaaaatgcaaggcactaaaaaagcgttcagccccggagtctgggcagagactgtttattgccttctggggaacaaaccagaagtttgaaagtttgcgtgtcccctagtagtgtcccctaaaaaccactttctcactcagcggctgtctgaatcacaactacagacgttttgagacaagaaagaaaatcaaggccctcggttgtagttaagatgagcccagatttgtagaagggcgtaggaaggtgaggtgggctggagggcacatggctgttagtgatgaacttgtcctgtgactcccctagcactgcagaggacatagaatcacagtggccaatcatggtgaccttccaactccatcacagagtaatgagctgtgtggcctcgggacaaccgtttcactcccctgagcctttgtttcctttaaacccagaaacagatgagccagtgtccatct

SEQ ID NO: 701 - DNA, 3000 bp, Mus musculus
agccaccccataaagttccatacattttccctatcttatatctaagaaaaggaagactcagagaggtatagtatgaggcttagggccacacagctggtaacaggcagagctaagatttgagttcagcatagtcagtcttctaaattgtagttacttcaagcacctctcttgaggcctgtgctttctggctcgtgatcaggttaccctgctctgagacagcccagcagtgtggcatggagcagtgggccagagccttcttgggcactttctgactgtgtcctaggaaggtgccacttctcctcttgccctttacttgctggtgatgtatggcatgacatcatcttgggtggttgctggttataagtagcatgtgtaagccatggctgtcatgcattgactcaggcagatactctcaacatggaggctctgcctgggcatccctggctggtcaggttcatccacgggtcccatctcacatgtatatcacatggctggctgccaataggattgagtgaatggcagcctggcacagtatgtaccaccattgtagccattcatgagatcttaatgcttaggaaggagctaggcctgccagcagttgagggaagctgtcagaataaaggtttgcctgtctcatgaaagcgaacttgtaaacctaatgactgctgggctgtggaagaagtgtgtcatctgggtttctcacttgcaacagaactctctggaaggacagttggcatctccccgttgccgtgtgggggtggacacgttttatgtgacagcaaggcaagaaagctaacagtgatctctgaggagttatgctcagcttaaccctttgaattgctacagctttaacatcagctccgggaatactcgcagatatctctcgctgtccgtgttctctctgaaaatacaaatgacttgaatgtctgaggatttggtaaagcattggtgttaacagggatagtcagagtgtgctcaggtgctggggggaaggtgggaagtttgtcccagggctcagatccatgtctccgagacaggactccgtgtgaagagctgtatgtagaaagctgtcctgtcctgttcctgtcacgctactctttgatagaatgtttaattgaggcaggttttctgagagcattgtttgaagtaactcaggggtagaaggtagtgtttccccccgggattccacttcctgctgcacattgaaggcagttgttgtaggcagtgttctgatgcatttgctcctgcccagtagagcactccaggattccttggctgcgaacccctcctactccagtggagaccagcagcactcagccagcccttttggctgtgggcagcagggtggcgctagacacctggcttttagtccccaggaggcttgcctctccaggctgttctgagctcctgttttgtgttagctgtagaatggggccccataatgaggttggggggtgggagcagggagaggctgatgagcctgatgcagaagctgtgccctgtggggacctgtactgagctccacaggagaagaactccactgcacagacaggcgtgctgcgtgctgcccgtgtgggggagcctggcgcttccccagcaggtgtcctccttcagatggacttggagccttgtccctaatgtttattgcctttcttctttagggatagcgatctgcaggtcaggcttatttgcgagatccatattacttctgattatttatgaatggattggccagggggaggcaaccaactcgattaattcatcagtgaggcagctggaaggacctgtgacaaatagtgcaggctgtcatttggccaaagattgtctgtgctgggattgttcccccaggataaccatgatgacaaacataattgacattttttattaaccctgaaatgattaaagatgctgttgctgaatttgtgtcaaagtacccagtccctggcattttgagaggactcggtgtggggccagtaaacagcctgtgcttacttcctgttcatcactttaatcagccaaggcagacagacagagccctgcctgatttggtcctgaaaccaggccagagacaagactctgttttccagaactctctggcatcaccgtcatgaacacacaggaggcactctgttcaacagtctacttagtcattggttagcagattctgacattccaaggtgtgggcttgggggactttccctaggagctgcagtggcaggtggaggcacaggcagatttggatggggggctatgtgctgtttgggggcaggatagactgtcagactgagtgggcgagggagccgtgtggggggcaagtgtaaagagtaaattttggttaatgtataaatgaatggatttaattacattttatatgtgtatatcattgtacttagctcctatctgatccctccctcatttcccctggtctctgggtctcccccccctccctccccctctccctctctccctccccctccccctcacacacatactttaagtgaggtacagtggtgtgctctttaatcctagctgtcaggaagcagaagcaggtggatctctgagttccggtcagccaggactatatggtaagattctatctaaacaaacaaacaaacaaacaaacaaaccagaagcaccaccactactaccaccaagaacaacaacaacaacaaaaaacccatcaacaacaaaactacaaagaaaacaaaagccaacccccccccaaagcagaccgtgtttgcctgagtgaaagacatgcaccatgcgtgctctcgcccccctgcttgctatcctgtttgcttagattcctccccacacgtgcctctgtttactcttattttaacctacattttatttgtgaggaaacatgcaaggtctgtctgtctttctgattctgtctactttagtttaatgtgacaattcccagttccatccggtttcctgtgacagaattacactctcctcctctctttagtgaggcaggatctctctgtgtagcct

SEQ ID NO: 702 - DNA, 3025 bp, Mus musculus
aatagaataagcataacaaaaataccagtgtatgctttgcccagggaaagagggaagtgtcctgcaacttgcttggggtggggtggggggtagcaaaggcagagagcaagggagggggggaggagaggaagaaagggaaggaggaggagagagggggagggagagagaaagacaaggaaagagcgaggagagagagagagagagagagagagagagagagagagagagagagagagaaagagaccctgatgtgaaatgcaagcgagtcaactcttgggaagtcaaaaatggaagtgttttcaagccctgacctgagtctcagccctcttccttgaggtcaagagcagcatttgtgacccaccaggggtgtttccttgaagggtccattttgcataaccactattgtgcatgccactcagggatgcatcttccataactgggtttgataaccgcccacccaccccacatgcttctctcaggcccttccctccagcagcccccaccactgacaatccatctggtctgagcaggtctgtgcctgcagactctgactggattcatcctggcatctaactgcccctcccccaggaggcagtactctgctccgtcctcaagaaatgctgaacttcatgttcgttgaggatgggggcggtggcaatgcataggtttctgactgtcctcttcccccctcccccctgccagcctctttgctgcctcagattcccagaggtccagggcaagttaaagatatagtccagcctccaacagaaaggaagagaggaagctgttaaagaggtcataaaaggcgggtctcacttgccttgtaagggcaggggtcttcccaagaatgtgtggaaagaggggctggcatccttgggagaaaaagcccagccaaggagcttgaagtccatccacacagagagatgtctgctgcatggctgcagagtgggaggggtgccttagctttgagcctttggggacaggaacttcagacagggaaaagggcacttgttagaagggagaagttaagttggggtagggcatatctctccacccgccatagagggatgctgggctccgagagaagctggcatctccatttcctcagctctactctgggccgacctgaaggaagagagtatatagggaagtaaaggagtaggtgggtaccaaaggccaggcccctctcctcctctacccacgagggggtttcctcagggctgggcacaaagccaacgcttctgaagaccttctggttggtgacatgatgaatgtgaccacagccccatttcctggatgaagaaagtgaggcccagtgtgccgggccaggcaggatgtctgggcctggactgttaccttcttctacattcctatactaaagacctcaccttctgattcttagaacatgaccttatttggagatcaggcctagaaagaggtgattatgttaaaatgaggtcattagggtgggccctaatccaacctgatgaagttctcctaagattaggatatagaggaacacagaggaaaggccatataaggacagggtaagaagggtccattaaccagccaaagccagtttccttgactcctatcccagctgtggcacattgctccagctgccccagggttagaagtggctttgaccaaggttttcatcccccacacctagggtttaacccctggctcctccccacaggggctgaggccaggtggggctgaagatctgctcctccttcatcagacccccagggccacgagtctgggttggggcgctgagtttaatgttctttttaaaatatctgcaaagacgagtgtgcacacagctctagaaaacgctacccgaggtaggcacagtactccactctgtgtgggcggaatcctgactgttttcttgctttcttcttattgcttatctgtagcctgtgatttttctgtagtgaactcctattgctcttatgacagaaaaattcaactaaaaacagcaggaatgggagctgtcgcctgggtccaggaaggaagggcatggggaaggcacaggtgtggctggtgatggtgggtgcaggcctggggaaggggtgcccatgggaggcaggcaggccagtaggctagaaggaaagggaggattcaaggaagggagggggagggggagggggagggagggagggagggagggagggagggagggagggagggaaggagggagatgaataacaaacagggcacacagttaaatttaaattttagctaaacaaaaaaacagtagtttagccaagtgtacatcccatactggagtatacttatactaaaaatgattccttacttcaatgtttacctgatatcaaaatgaaatgggacatctcaagttggttgtttcacatcacagtccagaagatctctacctccagtctcccagaagcaagcgactagatcctgtcaattggcagagaacaccaaactctctggagactgcgtgtgggaatgtgaacccaggaaagaatgaccacggcagatacagagtcccctgcaaaacagcaagaccccctgccctttaaacagagtgtcaccgacaatccaaactttgtcctccctcacaaagtgcctcaacttgtcatggtggttatttgctattttatgtcattatacagaaacaaaaggcaacgttttactccttgtgaaatgtattgccattaaccagacagtgttactattacattaatgtcatgggatataaatgtatctatatttgtatattagcattagtctgggttctgaaaaacagagccaacagagctagactgacacagagtatagaataagaactcggctcctagagaagaccctgaagccagaggcagcagaagaagaaaaagcaaaggagacggtttaaataaaaagctagtgcaaagaaagctgtcagcagaaggaagaggcgggaggagcatttataagctgcacaaaggcttatgaagcaaaaactgaggctggcgaaaaggctcaatggttaacaacacttgctgctctt

SEQ ID NO: 703 - DNA, 1725 bp, Mus musculus
atttttagagaccatctcaacacgtaactggctaggctagcctgaactcatagcaaaccacctctgcctcctgagtactgggattaagggcatgatagtgtctagatcatatctgcctggacaggttttaggttttaaggtaaactttatgctctctgtggcagccaggtgacagtgaatttcgctgcagaagttggttacatcctgtgacctctggacttgtgtcagattttagcttgtttgatgatccgaggcagagaagtggggagatcagcagtgtctgagattcccgttctccaacttataggaaatatttaactaagaaaatggaaactgagagcagcatagtctgaagttgcagtatttctatttctgtccacttctggacttgtgtttgtcacatggaatctgctcgcttgccttaaatcatgttgacgatcttctttttatttggtttatacaaagccatcagccactcggctgtgaacatgtctgctccctgctctcctgtccacccggggcagtgtcagtgagagcgaggcttgctctgggctgggtctgctttagtcagtgacctaaaactgtcaggggagatccggtgctacgtgaagaaaggctgtggtttagacacggtgccaggggctttgggttttttccttcttgtaaatgttctctcttaaagtagcaaccttcaaaatggatgtagtgaagtccagtgagtctgaccatgctgtcagagcagcaagactcctttagagacacagtgaaccagactcaagggttcttagcagaaatacagacctgcctccgtttcctgctgtcctgagtcctccccactctccatctgtggatgcttgtccctcagcctctttctcacttctccccggctgcttgcctgtccctccatcccctctctgtccgtcctcataacggtggtggcttctttcttctgtgaccacaggaaagcaaggactcagtcttagaatcttggggacacaggcgtccctgagatcatagtggcattttccagctcaggttctcctaggattggaggccactgcctggcctgtgagggtgatggggttcggttgtcttcatctttcaaataaaatagtttaacataaaaaaagcctcagggaaaagcagtgtgtggtagctcgtgcatgtaatttcagtattcaggagatagaggcaggagaatggggttcaaggtcatctttaactacatagagagttcaaggccagtttgggctacatgagatccagtctcaaaaatacaaagcaaacatatcatacctatccccaaaccaaccaaccaaccaaaataacaacaacaaacataccatacccacccccaaaccaatcaaggaaccaaaataataacaacaaacaagcaaacccaacctggcccatgccagaaactgggagccatcgtgagtgaaactaagtcccaatgtggagagacttcatttctgtgagcttgtcagtgtgtagagaaggtggtcggaggcctgcacggaggaggcctagggatgtcttaggacgaggactgtttccctggaaggaagagttggtcattgacacatgtgacagatctggatgtgctggctctgaacttatggacgagcatgaattcagatgcaggaaaggctggggtcagggggagagcagatgggaggatcagggtttgagatctaatgtcaccctccaaaatttaaatgtgtg

SEQ ID NO: 704 - DNA, 1900 bp, Mus musculus
tattcgttttctgagacatctgataatttgtgactgttgaatgtgatgaggagttgtacagtagttaaacatcccaaggtgctatgtagacattgggttaccttggtctgtgtgctggagagagagagacaaagagggaaaaaaagagttagcagagccactgtgagcagtctgctggctgttgaggtaactgttcttggcttctgcagtggaactgagctgccctttggtcagggtgtgtggctgcggctgctgttcttgttaaaatctgattaggattaataaaaataaccttgtgtagaaaaaaatcattacttcacattcaccctacatattttatgaatattatcatatcttgtgcattctgcatcatctaaaacttctcccctttcaggaaatttcttgctttaatcttgatggacacttggatttaattagtgtgcagtgtcttagaatagcttttcccagattaaatttcagagaggttttcttaacctctgtcagttgtaaattggaaagcttgcttgcttgtctgtggtgctcagaggtctggcttgaagtcacagtcagaccaaggcagagcagcagatcaggttagctcacactcacaagctggatttgtctatgtctatttggggggtaaggagatgaaccatcaatcaggttaaaaactggtcatgatctgaattctagatcctctataccatttttaagttcaggagattgagttgaaagaggcattgattggaaagcaaagcagtgaattatgggccatcaggaacacaattagtagaattggcatagccttggtctgagcctctaggggaaacttagtggacagggctcccacactggcacgtcttagcacaaacttaggggatgggattctcacactggagcttcttacaacccaccatcctctgcagaagctggccccacctccctttctgctgctgtgatcaaattctctgtgcaaaacacagtagaggatgaaaggagcgtctccgacttacatttccatgtcacagttcaccctcgaggggaggcagggcatggattcaagcaatcaagaacttgaagcagaagctgtggaggaatgccaggacttgtgcttaggtagctttcttaatcagcaagaccacctgcccaaggaatagcactgcccacattgggctgggccctccaatattaattgacaatcaagacagttctcctacagatgtgcccgtgagttgttctaatttgggcaatccctcaattgaggctcctttctcaagtaatgctaagctgtgtcaagttgatgtgtcagctaagaaggataaaccttaataaccttatagaacagtcagatagctccatcccatcctgcaatagatgaaaccccctcttaatttaccactgcattttcctcttaaggtattactctaaagataaattagaagtacccaaaaattttacggggctgggggggtgggtgggaaacaggattagtttaaactttctggatctctgtttggagccttgtagttgtatcaacatcattatatgcattacatgcatagctctgatttagctcatgatttattgcctatcctcatttggcaaactatcaaatgttgaaaggcattgctgctttttgtaaatatgacaatttacaaagcaacaataaaaacatgcattcccaaaagtccccagattaaaggccttagctaggagactgttgataatgttttgaaagaataataaacacaaagtcgagtactcttcctttgagtctagtacaaatccaaggactgaacacctgctgccctgcccccaaatgctgggaaactgcataagctaaatgtgccttcctgtgagaagtcagcctgtgtggtacgggtggggctggggaatagaa

SEQ ID NO: 705 - DNA, 2000 bp, Mus musculus
tatggtggtcagaggacaacctgaaggagtttgttctgtccttctaagatgtttgtctgggagactgagctcaagtcttcatccttggcaacaagaacctttatttactgggccatcttgccgggcctaacttcttccatacattaatcttgatgtctcttgctctatgtcttactctcctgtcacaatattttaaaaataattcggaatgtggaagaattgtctaatatagtctaacacctaaagctacactaagattattgatttgtgctaaataaaacgaaagtaattaatcatatctgcaataatcaaaataaaaatgaaaacttaggagaaataaacaataaagacttcttttccatggagtttttctcattaatataaagagttcctacaaatcaattataaaatgccaaccactcaataaacaaaaggcaaacttaagattcaataatttaatgatggaatacaagtagatcttaaataagtgcagacatcctcaagatctcttataaaaatagatttgcacattaaaaccttatggtgttattgtgtgggagcaacattactaaaaacagagtttaataaacattcttttcgcagagatattaactctcctccatcagggaataagtatgcatagatatagcatagcaaatgtaatttagcaatggcataaatattacaaatgttttgtcctgcataccttcttttaatatttctttactagatgtacacatatacatatgaagaactccataattatttgttagatagtgactattgatgacagcaaaaggctaaaattaacttgaaaatgtatatccaggtcagtggttaaataatgtatgaaaatactgtggagctaatgacaaggagctggtcacggtggctcagccctgcaatcccagccatcgggaggctgagcctggcagactggaagttcaaggttacttgggctgtagagtgagttagttccaaggccagtctgagaaacttagtgagggtgcctctaaatgagttattaaaagcaaagacctgggggggggggtagctaagtggtggagagcttgtctagaacatgcagggacttggcttctatgtcaaataccacaaagaaaaagaaagagtaaagtcattccccatagacaaagatattgttgctcactgttaaattaaaagtatgttgagagaaagcaaatatttcaccattgggcaacaaacaaacaaacaaacaaaacaaaacagagcaaaactgcatgtgttcttttatctcaatagctggctctataatgttcagacaaaatccgatcatatcaattgcttgtggagcccagaatgggtggaatatcagtgtttttctgagattataggagtgtgtgtgtgtgtgtgtgtgtgtgtgtgtgtgtttgcccgtgtatgtgcataggttcatgtgcctaaaaataaaaaaattctagtatagatttttcaaaggtttctatgacaatggtatctccaggcccatattctaggtttgatcaaaatattcacaaggaggaatggttttctgcgtattgggatacttaaggctttgatggagccttatgtcctcatagctggagcttcagactgagagatgatctgatctttttaggtgggagtcaatgagaggaggaagaactctgaactctttgcagaataagtaagacaaatctctagagaacaaagccatggtgagcaaagcaagcccagcagcctggctggtaggcagaagccatggtgagcaaagcaagcccagcagcctggctggtaggcagaagccatggtgagcaaagcaagcccagcagcctggctggtaggcagaagcagaagcagaaagcgcagctcacaccgagttaaggtgtggtggagaggaatggaaaggtgctgaaggggacctggaatgttttaaaaagtttgagtgtgtatctagagcgagcagagaccacagaatgcttttagctcacgactagtgtgaa

SEQ ID NO: 706 - DNA, 2975 bp, Mus musculus
atgatgatgataaattatgtgactagttatcacaagtcatatacaaaggtacatgcaaacatacctataaaaatgaatagtcaaagacttaaaggtaaaggactgccatatatctcttcaaagtgcacctaaatggtagcatttcttggttattgtccctcaggagtgtcgtaggaaagggttggtatgttatggattttcattcctatgtggcccctctgtaccatgaaaagcctcctcaaagacttatcaaataagtctcctcccccactttcagctcaagtacaccctgtatagattgaatttgaagtgtcccattaaagcagaggtgttaaaaggcttgtttggcaagtgatgggctttgggaaagtgataggatcaggagcatgagcactctaacctcagcagcagttgcaaagctagaaaagaaaaagaggaaaggaaaactaagtaagatgcaggaaaagaaacttgtgtcttcagtcaagattttattaactcccagacaactgttagaaacactcctccgctcagtccaacaccagctactgaatcttgggctcctgagttaaacaattactattctaagccactgaaatttataatgagtgagcaatactttgacaataatcaactgatctgtctgttcataaaagagaaaagtgtcctgatatttactgctaaatataacaagaaagaagtcaatgttctgaaaatccacatgggaaagttaatgcatctaccaaatggaaatggatttgtggcagccatggatgtaaatttcattaatagaacccaggatacattaacattccaatgttttgatgaattagaatatgttgaaattaagcattcctgtgaattaaaaacactgttaagagtccaaagacaacagcttttgcctatatgtggaatatgttcttctagctaggctcccttgtctgacatcagtgggagagcatgtgcctagcctagcagagacttaatgtgccagggtgggaagataccaaaggggtccacacctgctcagagaagaaggggagagaagaatgggaaggattgtgggaggggattactgggagaggtgcagtaagcaagatgtaaaatgaatgtttcacacacacacacacacacacacacacacacacacacacacacacacaaatcacaaacacacttaatgttgcaataaaatcttttaaaataaatgtagaaaggttacagaggaaaccatcctttgctatgaagaatgaaagcaaaagtctaagccaaatttatactttcttgtccccctcctatattaagcatgtaagcaagtacatgctaacagtttgttgtctaagcctttctgccttattcatatcttcaagatcctggtttccaaactatacgtgcaaatgaagagcgaccacacattgctctatttagctgttttcagtatgcacacagaagtgtaatattgtattttgcttctaaagcaaccatggagtgcagcttggcaaaaagagtaaattttagtgggtggactggagaaatatgaagaaataaataagaccagctgcatagagtggaggtggtagctggtgccaataactgattcattttctctctgcatgcactcattacgtgtagaagtgcttttcttcgcaggctatgtaatgagtatgtccgcccccaaccatgtaagccctggagctgcagtaaagaggtcataggcaatcgggaggccagagctctcattcacattggctcttaatttttttatgaggtatgttaatcgccacctccctccctacactttataattggaatgacacttacactttcaccttactaagtgtttctgaaaggctttcagatttaggttatgagtgttattatgactatattattaaatttgaacgattgctacacagcattctatgtaaataagttccaggggacttggcttctgtctacctagcaacgtattttgtggctggtataatctaataggaggctttcagaagagatgcaaatttgctataaagtaacactccttctctttttaattaaagcaaggctaagaataactgtttgtttgatcgaatatagctgtgaagccaaccaagtacatgtcaagttgccaagtcatgtcagttgctgaaattctacatccattctccaggtctctcgatcatcataggttttatttttaaaaaatctccaacattcccatcctacctttgacctgctgtttgactccatgcctacatgtagagcaactagaaaagatatcacccagaaaaccagcagcactttgtttcatagatctacttctgtatcctaatctttggctttccttgaagtacctaactctccttaaaattaaagattacctcaccattagtggccatatttgcatccgttcttttcctgggtaacattatttgtgtatttatgtacacaaagtagtccagtgatatatattttaaaattctgaaacagagcctaacttactgatcagtattcacctataatctgtgggaagaaagaatctgggatatgattctgcttttctgcatggtgatctgtgggcaattttgatcagctttttcttagactgagtgttaggaaggcataaagtcagatccattggtgcttaccctgttattcatctacataatgtttcttggcttttaggttcctttcatgccccccacacccccacacacagacaccttacaactgtctccatttgcacctataaataccatgttttgctgagtccagccaaggttggtcctggaaacattactacggtgacaagaaaatgaaaaaatgacacagaaacacagacagaaaagctgagattggctgagatgtgcttgctctgctggagtggtaccaaatacaaagtcttggatgttataaacaacaggacaaggagcagtttgttattcttggtgggagcaatctcagactgtattcatcta

SEQ ID NO: 707 - DNA, 2600 bp, Mus musculus
aggaagatttatagttgtggttcatccagaatttccttacttggaagatctgatattcttgtgtattaatcccatagggagcaaatggcacttggataccttagcaacatctgcttccttgaataaatgttctctttggtatgttaaaattcttgccagtcccatggaatccaacctcttgttcttgtctgtttagaaccttttgtggtcactccatctctcttgacagttttaaagctcacggggttacataaacatgagtcaatatggagaagaggctgcaacaatggtaacaacaattaatgaactatttctgtctttaacaagcttcttttttctcctaaattagtctataaaatgaaatgctaggtcatctgtattcagcaggcatatactgtagccagtgttaaaagcaggggacagaaggtgagtgagcccctgtagacatgtacttatgtggctccactctggctctttctcctctgcaaactagataagcagcagtagcagctgcctaagatgaagtacttttaaaagcctgctgtttgatttatccttgatatagtttcctttgatgagaacccatggcttgtaaacataaaacgaagttcctgtttcatcatcgagcacgccatgacttcccatcatctcccagactcttccaaacgcttgaaagaatcttgcaaacccatttgtgctttgtactgggattgtttagccttcccaggttccctgaggatcagaaagtgaatttatggcagatgttacaattccagaaacctccttgatcttccagaggtctgcttgttggtctgagacaatctgacacagctatgtgttgttgccttgcccgatccctcagtgagttgcaaagcatcaggggtaactgcagatgctggcaatgtcctttgattgcatcactctttgatcccttttgtcttgagttgttctcatcattcctgttcactcctttgattgattcatcagtagttattaaatatcaaaacacagagttccaacccctggtctaatgagggcagtcacagtgggattctttcctaatataacccaagaccctggaaacaactctgagggggacatctccaggctgtcactcttcaaaaagaaggtcactcagaggggcctgggcccttccactttctctcacattactaaggattccttgtgggaaaaatagaattgttgatctttctggttgagttatctatgttggtgtgacttctaacaaacctgattttgtatctatcaaatcaggttttctttttcaaaagctgacctcatgtagccttaaaattgtatataattacagggcagtaatgcaaagtctatagtttttatgctgatcagaaaatgcaggtggcaggaaaagagcagttgactctagacttgtttatatttggtaagcaaggaagcttgggtcgatataaaggcgagcataacagtaaaaagctcagggctgcttcagatgggaggagggtgtgtgcatggacattttgcactaagggctgctgtcagtgagactgccatgagctggagagtcacagggtcagagccagatcatggcagttgcaggaagtccacagttctacacggctaggctactcagagcccccgagaggggaatgattctgcatctcatagccatcatcaagaaaactatgaagtatgtgggagatgcactctacacttcagtacagcacagcatgtgagatgtttatggctgtttcacaatcctcagctactgtagggaatctgggaaggaggattagtgactggtggccttttctcctgtcctttttctgagctgagacactgcactgatatataaaaagatacactctctcctcttaagtgattcttaaaaatatcttctacataaagtttcacagggaagaaaggaaaaagaaattgctgttgagcaaaagcagtgagcaagaagcagaaaaacagtttgaaccaatagaatctggggcaaagggaggtggagaatttgggtttgtttgttttaataaagccacatcataagataaacgcaaaggtggtacagagaacatgcgtttttgctttgattcactactacaagttaatttgttacattttctatcatcaatacatttgttatcattactaatagccacattaagtaaagtcatactcagtttgtatgtaattcatttttcctggtcttggatcagtcactgatttacattcagtcccaggttgtcctgtgagtctgtggatcaattggttattctttccacagatctttattgatcctgctagtaaagcattcacagcctcaccctgattaataatagcacctttatcccagagttcagctgcaaatcctagcaacacatagcacagaggcggcagagctcataacagtattaactgtatttgtgcacaataatcatagctttatttttaaaatgtatacgtgctgcatttatacctattttacatgtattttaaccattctgttaccattaaatattttgatgcttaaattcaaaattagtttgtatccatagcagctgatatttaactgaaattcaagaattaaccttggaaataaa

SEQ ID NO: 708 - DNA, 2050 bp, Mus musculus
aataccaagcacagggtcactggaatcagtaactaggtcttgagaaaagcagttgctcactcagaaggaggacagatggtgacacaccttttcaggacctaccttcacagaatgctagatttgcagtcatctgtcctagccagtatgcaaacacaaggacactttattatgctctgacaattcttaaaacctaaatggagaactgaagagttgattaaatgaaggccaagtggctctaaattactaccacttcagcggagccaagtgagtctgattcagtgcttgaccatgactgttggagaggaggatgtcggctctgcccagagtgagcactgccctgctctgccttcctgtgcttgcaaagctctgctccatgtgctgtcacagatgtgactttgatacccctcttgtctaggagactggaaagcaccaggtctccctggaattgttggtaaacataactgcagcacagtgataacgagctgatagaaaaccttagcgttgcaaaaagaagctgagggaccagcctgtagctatagcctctgctagcagcaggtaggaatcaggatacagtttgtctctgagggggatctgtttggtttattgctatgatctgctagatggggaacttatcgtggggttggatgaaatgtaagtcaacttaaaatgagttaacatgactcaagatagacaaagtcaccccagagaacgaggaggatcgctgtgcatgtttagtttctttctttctttaatcattttaacaaatgcatattgggcaatccctccatggtcagctcagcccagggtgctgagaagcactaaggtgcctcagtatccagacttcacaagttgggggaatggtgcggttgatcccagactgctaggtgttataggaagcacatctaaatttccacaaagatcacaggaactgcatccatgtcagctcagtgcttagggtaccaaagctggtaagcctgtctagttcaagccctaagtttgcaaacaggggcatcagccaggctagaacatgggcaccaggccactgctcttcactggctctctagcatctcctccattgcattctgtcctgcccttggctgcctgagcatcacacataacacactaccaaacctcagctccatgaaaacctcatcaaccttgccttgataaaaaatggtcatgtatcccaagaaggaaaaaaggaaactctacccaaacaaatgtttggtgaagagctagggctgaagaagcagcctggattatttcctggttcctgatgaatgatttccaagagtagctatgtttttgtttgccacttaacagagaagataaatctattctcattattggtacaggctaataaatatacagagcttaaacactccagaaataggtcatgtaggactgagttagaagaagagaggagacgaggacagagcagtaaagcaggcaagtaaaatgtgctgaaacctggagctcagacaccagctcagttctcagtgaagccattggcagctgtgtcacattgggaagttgcacagtccattctaagcctgcctattccctctccaagcagtgaacaccatccttttgttaggctgctacaaggattcacatgactatgtgtatatgaaaaggatttcatatgtatgtgaaaactgaccagcacatgcttagtttatgctatgcactgagtgaatgatcactcttattacaaaacacagaacttagcaaattgtcatgttagtagtgtacataaatagaaaacctaaaccctgagtgcatttgtatatttgtcacagtggctaaaaatatacaagagaaatgaatcagaaaaaaagacctagaagtaaggctgatatatacatacacacagacacacatacacacaaaccgcacctttcctaaagactaaaaaccccaaatggttccagcaaagtcctaaccattatggttctagatgcctccctagaatcacctcctaaagaccagctaaccagcctagtgcttcactcaaagccgtttctagtaggtcagtttatataggtat

SEQ ID NO: 709 - DNA, 2350 bp, Mus musculus
cactcccactttttggccctggcattcccctgtactggggcatataaagtttgcaagtccaatgggcctctctttgcagtgatggccgactaggccatcttttgatacatatgcagctagagacaagagctccggggtactgcttagttcatattgttgttccacctatagggttgcagctccctttagctccttgggtactttctctagctcctccattgggggccctgtgttccatcttatagatgactgtgagcatccatttctgtacttgccaggcactggcatagcctcacatgagacagctatatcagggtcctaccagcaaaattttgctggcatatgcaatagtgtctgggtttggtggctgattatgggatggaacactgggtggggtagtctctggatggtccatccttttgtcttagctccaaactttgtctctgtaactccttccatgggtgttttgttccctattctaaggaggaatgaagtatccacactttggtcttcctccttcttgattttcttgtgttttgcaaattgtattctaagtttctgggctaatatccacttattaatgagtgcatatcaagtgacttcttttgtgattgggttacctcactaaggatgatatcctccagatacatccatttgcccaagaatttcataaattcattgtttttaatagctgagtagtactccattgtgtaaatgtatcatattttctgtatccattcctctgttgagggacatctgggttctttccagtttctggctattataaataaggctgctatgggggcacgggaaggggggttgagaagagagtagagctagagaaagagagggcacagagaaggagagagagagagacagagagagagagagagagagagagagagagcaagctcaggctggctaggaatatgtggagagagaggggaggggaaagggagagaggcagagggggtcagagagaaaaaaaagtgcagagagagggtgaagccaaacagtcccttttatagaaagccaggcctacctggctgttgctaggtaactgttgggcagattgtagaaggaatgccaacatcatggaattataataaatatttagaaagtgctttaaatagtgcttggcgggtacacagtaagtgctatttaaaatattcgtttaaaaaacacttccaagccacctttgctcatagttcagtgtgaggaaggctcggcaggctgggtgaagcagcccaccctggctgcttgaacccatccttggggggacacagacacagacacacagacacacacacacacacacatggacacacagacacacacacacatggacacagctgtacacatgttggaagtgcgcacagtggcctccatccaaaaggcagcacttccagctgcgctcctttctgtgaacccaaggtcagtggatgtctcttgtcaccttgcttgatccttttccagtctaatgaggtgcaagggtgctaccttctcttcccaggccaatatggtgacagatgatgtgggactttccatgtattggtttattctccatagtagacctgtgaactaaccccagtgtataagataaggaactcaaggaaccttccttctacatttattagttgctatatcttgaaaataaaatgttttctcctcaatcccttaatctcattacaaccatctcaagattcttctaaaattcaactctacaattaaattcagtatttagtacttagagtgtttctaacttgatcagtttcaaaattgttctacaagctttgataagccccagcattttgtccattttactttctcagataagatattctaagtacagatcatactaatgagacccaggagaaagacgtctcctccaaaaggaacaattcgccccagggctaaatcattctgcaccaaggttcagtgtattgtaaggaagaaggaatataggaaggagataacatctgttcaaagaaggtgttcatggacatagtactaccgggagatccagcaatacctctcctgggcatatacccagaagatgttccaactggtaataaggttttctgctatacctgtcaaatggctggtaaggggagggagatgcctgagcatggacttgctgagttaccccctcccaatgcaccatactgcactctataaaacatatccttggttttataaaacatgtcatttggtgctgagacttagatttacaaattcacagtttgacatttcctgctgccacatggactttccagccatcggattgctagacctttccatccaaacaccggagcttcccttctgtcttagttagggttttactgctgtg

SEQ ID NO: 710 - DNA, 1900 bp, Mus musculus
gtgtgtgtgtgtgtgtacatattcattcccctttgagaacagtatttatctcagtctcccacccttccactcaatgtgagggtgtacacttatgtccagaatacaaaccctgaaggaaacaaggccttccagaactacctttgtggtggacagagtagtaaccctacagggctgcaaaaagtcttagaaagtgctctgagcaccctagggaggaagtcctaactctgccccagtctagcacctcagaaaaacacctccctgggtgtccatccaccatcaatcccccttaattcccctcccgtggcacctcagctgactctcccagagcacgtgcggtccactgatgggagtgattccatccacacagagtcgattttcatccctagacacactcttccttcagccacaactacccacgtattagtcttccattataaaataatgccctgctttcagactccctctctattttggtacatctttttaaagcaaatggcacgccattaaaatgcatttgttccattgagtcagattttcagactcattatgatgctcactgttgacacaatagctccttcagacacacaacaatctgtcataaaagacccatacttggatggatgacagaagtgttttgcaaaagctggcttctcaaagcagttgctgtcagacatacattaatatcatcctagttaaagcgtatttattctagaaagtgcagaccatttaaagagaaaattacttcatgagctatttctgcaagttcagtcacttctgagatggtggtgattttagacattcactaatgcacttgtgggggaaccagcaaaggattataacctggacgccctaccaggcagggcattcctcgctcagtgttccttcctgtgacttagagctccaaaatcaagcatgtgtattttagtctcatcctcaataagcatggggctggggtggcagaagaagtggtccaggtcagtaacgctctcccagtgcaagcaagacacctgagtctgccatcagcacccatgtaaaatctgggcatggtggtataagcttgggagctcagagctatggacagggagacaggcagattcctggtgttcactggacaagacagccagtttagatgaatcagttgcacacacttaaaccaccatacacacacacacacacacacacacacacacacacacacacaatttaggtgttcaaaacatgtttcagatttcatgtcacatttaagtgaaggttctccttgcatcccagcaaggaaacagttgatgtgcaaaagtctgccaggttcaaaataccaaagctgggtcatttgttataaaataagacttaaaataaaaacgcgatctcctcctccgaagtgttaaaatgaacagctaaaatagaaggatgacatatcttcaaggggtgaggtcatgctttattcttaatcactcttgagagatacaatgccaacatccaaggccaaattaacactacgcttggtaaacagaaagaggaggaaagaccaaactatatttcaaattttcacttctgtaacatttcaattgctgtgatgtctccccccgcccccacccaccagtttattttttgtttttcctgtagtgctaggttggaaacaaaggctgccatatccaccagcctatgctatcatgtaaatccaggggcgagcacgagtgcatgtgttcatgtgtacgtgcatatgagtgtgtgtgtgtgtgtgtgtgtgtgtgtgtgtgtgtgtgtgtgagagagagagagagagagagagagagacttgctaatgtgcacactcaaatatgatgaggttcaaatatttcgagcgcctctcatatgcttagaaattcaaaacaagaaagaaccttagagggaaagtctcaggaag

SEQ ID NO: 711 - DNA, 3375 bp, Mus musculus
ccatggaagcatacctagggcagcctccctgggactgagagccttgggtcagagttgacttttggattacttccccagtaaggtgacccacagaggtcctgctccccacatactgctctcctcgagaagaaaaaggtcatgcatgtggtctttctccattgggtgacccttcaacgagctccttcctagagagtatattggaaataggaactaactgttcaacctctccagacctcactgtccccctcctatgaagctttgagaaggatgacacattctcaggagttttccttgggtcttccagtctctgtcctgtgtctctgaccggtctcactatcactgaaagcaaggggctaagcaggcctctgacataaggttagttgcccccccctacggggggggggagggggctctaggtaacacagaaggagcatagtctttccatccactataaatgttcaaaatcttgagtcaggcccgggaaggagagctgtcattcttggcatatcataacactgtgagaaggacatttgggcacacacccaagtgtctaatccagatgaacaggtcactaagaccgtcacttatgctcaaataaaaacggaagacagcgttaaaggaatagaagtgggaagtttgggagatcaggttttcttttagcataagcccaagactagcatgctttaacagggcatgcggcctctcattcactattacatcccagcctaacctaagggacagtgctgcctcttcttggctgtaggagccctggattctgtatgtcatgaatattcatgaaatgccgctgtccagggctctcctttgaggtatagcctgggctctgaagcagagactctgtggtgtagaggttaatactgagaaactcctgcttgcagctgagacaggggtgcagctgggcttgaggagctgggcttcaggttgggagaatgggtctgagcgaacaggacttttctgaggtgaggcctatggggaggaaaaacatggggtctaacacagatcagaggccaaggcgaggtagacattaggtagggtttctaaatctatttgtaagatgtgggggtcttccttgggaccctgagcaggtggctgtatttgttcctgggctgctggtggaggaggggaggacagagccgtgagtgcggctgagaagaaactgggtaagagcttgaaggttatggtggagaagcgattctgagctaaggaagttggaaatctcagagacgatagacttccaccaaatgctggacagttttgcattctgtttgtttaaatgcatctggcagttgtggtgtgcgtgcatgtgtgtgtgtgtgtgtgtgtgtgtgtgtgtgtgtgtgtgtgataaagagccaggtgaataagcattccacagggactacactaatgatgacacattctggtaaaaagtgaagcctttctcctctttgttagtcaccaaggggttcaaatcacctcttgtttggcctccagtctgggacacagaagagaagtaaacaccaactgaactcacaagcaaagaagtgagggtggaggagagctaatatcactttccaaaaatagggacttgaatcagtgtaattaagattgagaaaacaagcttttcccagataatattttaactcgaaagaagaggagcgtgatgatttaattaggaggccagcaacaaatctacagcaggacttgagaacagaagcttgcctgagggaagctacgtgagggtctaaaccaggcagtcctggccccaaaagttccttgacagcatcctttcccacatgtctcatggtcctcacccccttctcagtagccagtaaagccgcttcagttagactccctgggttcaactcccgctccactagtacctagtagctgcctgatctctgacaaagcagtccagagctctgtgccatggtttgctcatctgcaaacaaggagcaccatagcatcccttgggagtgcactgctgtgaagatgtgtccatgagcacaacacacagaggatggaatggtaagaacgagctgatcttttactgtgatctaaataccgtttactgtcactgctactgagaaagggggcctaggatggccctctgaaaagccagcattcaatactcttcaagtagaccagccatggcttgcatccttcactccagggacttctgaggtttggttgaccagacttttcctgcctgagctaaaggacttggtagaccacatctcacccagcaagtggttgtggctcagcctttgtgtcctgggcacagggaaagataggtatgctacccttgttgggcccccatatcttcatccagtaagaagcccactgggtgaagcccacctaagattgaggtggctcacaacctcttcagtggaaatgggaacctgcaaggtacattctcctgcatggcacacctgtctgaaagccaggtttacatcatcactttgactgcagtctccactctccatccttcttctgctttagtgctcctgctaaatgtacattacgacctccccgctgtatgcaccctgtcaatgtgctccttaagagtcaggccttctccatagatgtgtgtgccatcaggtgcttaatagacatctttgtcatgagcgagtggatggtaatcagatgattctcattacagtcaagtcattcattctctcatcctttctcctttcctctccctgccccgccccccactatgcattacatttctaggggatttttacaaagcatataggtcttgaggttaacatggtaggtcaaagctgttgtttccaaagggactttctagggcccttgcattagagtctctttcagagctcactaatagtgcatattcccttgagtttctttcagatctacaaggtcagtatcttggcgtgtcagggaggattcaggaacctggctgtgaagaacttcctggtgccatttacaggctcccagcttgaaagctccacttagcttctgctgatgccctgattcacaaaaattctatgggtctgaaccacagtacaaaaatagtgagtgcttccatttcttcccttgaccaacaaataggtcacggccataaatagacaatggcagccctttgaagatcatactcaagaagagaggtcactaacaccatccataccccgagccaaggctttaaacctggtaggcaatcagggaaaggaggcactgggtcccacaaagccaatagagctgatacagatcaggtgtgtatcctgcttctggctttgtatgggctgtaaggaacatgatagtgtgttcaacttgattttgaaagaaaccagctcccagaaagtgaagagaatttctgtttatttccactcctaggctgtagcagccaccgtt

SEQ ID NO: 712 - DNA, 2025 bp, Mus musculus
tagctaggatctggtaggtctgtggtagctctcagcagagatggtgcccatctgtcatctttttttttttttaaaatcagatttgcattcaggagtgagtgaattctatttaccctgcattgtggaggagcagtgggactttacctcaaagtagggtgcagtttaataaacagccatgcagagtgagttgcctgtcttagcacccttgactacattctcagtattcaaaatgctgatggccatctgtctcttcatggtgagttggagaaatgaatccaacttaaagaacctagctctaatctaaggggatcctaggaagagagcacccagggtaattcccttaaacactgcttcccaacacaaaggggaccatagctgtgggatcagccatgccatcaccagtggtggcgagttactagcctttagttttccctcctgttatgtacatttattagcacaaggtcactgtggcccacacaccactggcccctggtgtgtgcttggagagatctccaccaaaggactttatgacatggtgatttgccttggctttgttaggaatgactttgttccacttagcagtctgcagtattggactccctagcaagtgactatgtggacgtgggggatgtacgtggtatactaagtagctagagtggggaaattggcagggttgtgaggccctgggtggggatgaaggctatgccatggatgaggttttgttgctttggaaatggaatttacactcttattcccacaaggatgcttcagagattaaatgtgcctcctcttcctcataacctctagcaacacatttgctaattctggaagtcattcttcctttgctaggggagagacaagggctgcatggagatagctagtggctgagaaggcagcaggaaccggagtgtcctgtgcacactggctgtctcacgtgcctcaggtggctcaggcaggtggtcctttattagcagctccctagatcctcatctgggtccagaactccagtttacaccaccgttaattctatttctaggcttctgtaaaaagcattgagataatgttagtgtaaaatattatgtaacatctgtagaggacaactcggcaatgtttattcgagttatagaagtacttattcttgggcctaggagggtgttttcttatagcattgcttgactgtcatctatgcactaagcatatatcagtcaggggtgtctgtgaacagcagtactttggaggaatgagggaggaaatgagtgagcactctgtcttcatgcagagaggccctagacatacccagggtctagacagtgtgtgtgagtgacctggtttggattctgtttttatatctaaggaaacaaggaaagtggaaatacatatttgtatttgcttacacctggcagtttaaaaaaaaaaaaatgtttcctctaaggattcaggagagccaaagagatgaagacagaaattgtgagggaggcgcctcactgcaggcctgctctgtagctggatttatcctgctagagtgttttgattctgaactctgtcaatatattatgtaacccccctcccctccccaaaagatctttttttattattttttaaaacaagaaagttgttaaaatagaaccctgctgataagtctaaaaagcatggcctgcatgctccttatcatacctctggtcaaggactgtggaattcctgggaagtagccaacgagttgccaagtgcctttgccagggaggctgagttatttctctggctacaatgtcattttccagcatactgtcaatttttaaagtagtttttcattacatttatttatttatttgtctatatatttatttggaggtgtatgtgtgtttcctagtgcatatgtataggctagagaacaacttcaaagagcattatcttcttccattatggaggtcttgaggatcaaactcaggtcgttgggcttggtggccagtgtctctatctgctgagccattttgccaacccagtgccactttttaagaacttacttcc

SEQ ID NO: 713 - DNA, 1800 bp, Mus musculus
tctcctcctgacttcctgttgtctgacatttcttccctcgttttctagagttagacctctactttttcagaactcagggcagtgagactcaatttttccatcacttcctggaaagtaagacaaatgtgcttccacacagagtgtgtgagttatcccccggctcccgattagtctctatacatgaccataatcaggaaggtagcttgggggtgtcctgttctctaatttgtattatcactcagaatacagaaaatctgacccccaacccaatggtttttcaatttcagttagatttttttctttctttttttggggtagtggtggtggtggtggtggtggtggtggtggttggtggtggttggtggtggttggtggtggttggtggtggttggtggtggtttttcaggtcaggttttctgtgtagccctggctctcctggaagtagctctatagacaaagctggccttgaactcagagttccacctgcttctgcctctacctccggagtgctgggattaagtacatgtgccaccacctcccggctaatgatttctttaaaacaatagacaaagcagttcttttaggagtgagcatgaataattaaagaattgcctgagacgagactaaagatacacacaaaatgagtcaaatagcatatggctaaacccctgaatatgtcagctagtgagtcactggcacgtaactgtataatgaagaaaactttgctgaaacacctcccttgtattttataaaacagtgtttaaatatttgacatagttcagcaatgttctgaaaagacagtctacctagcttgggtgacacttcagtttgccataaggaaattccatggattggggggtatctgttacctttcttatcgttcagtatctgacagaagcaacttaagggaggaagggcttgggctcacagtgtaaagggatacagtctgccatggcagagaaagggctgtatctgaggcaatgggagcttgtggtatggcttgttatacctcgatgggtcagaaaacagagccagctcagacagaaggtaggagcagaccgtgtccctcaaggccagacccatcaacagctcatgtctcacagctagggtccaccacagcctcccaaaacagtgactctaactggagatcaagtgttcacatatgaatcagaagtcacttcttacatacacagcaccttcatttcctcgaagctatggggttgaatgccccagattgagcagtggttttgtctgggtctttctccatgtcttatagatgaccacttcctctctgtgtcttcttgtcattgtccctcctgtctgctgcctttctctttagggaagctctcaggagtctatcttaagtcaaacttggagtcatgtctcctagtatggtcacatgttgaagtacagggtttggctccaggacatgaattctggagccacaattcaacattgctcactttggcacagtgatgcaacggttacctagtgacgagtggtgtgtcctccacccgaagatgggggccaggagccagatctgagtccagcagggacagttctcactccctgtgttttgataacacccaagccttaaagagcagctcctgacaggagggagaacccatgactctctcctggtgtctgcacccacgggctccgttttggctggagcagctgttttactcttctttgtggtggtttccgtgtcttgttttgtttggagctctgtctatgtgtctcaacctgacctggaactcttggtcttcttacctctgactccccagagctggaattacc

SEQ ID NO: 714 - DNA, 1825 bp, Mus musculus
tatcctctgtggttggctgcattctctctctctccctccctccctccctccctccctccctccctcccactgtgtgtgtgtgtctgtctgtctgtctgtctgtctgtctgtctctgtctctctatatctgcctgtctgtgtgtgtatgtttgtgtctgtgtgtctgtgtgtttgtgtgtgtgtatgcttgtgtgtgtgtctgtgtttctgtgtatgtgtgtgtgtttgtatgtgtgtctgtgtttgggtatctgtgtttgtgtgtgtgtgcctgtgtatttgtgtgtctgtgtttgtgtgtctgtgtgtgtgtctgtgtttgtgtgcctgtgtgtgtgtgtgtctgtcactgtgtgtgtgtctgtgtgtttgtgagtgtgtctgtatgtttgtgtatctgtgtctgtgtgtgtgtctgtacctgtgtgtgtgtgtgtcatattttgtgtgtgtgtgtgtgtgtgtgtgtgtgtgtgtgtgtatcactgccatctaggtcatatttgcatagacaggctcacagagctagaatgagttttagaacacacctccatgtaagcatccaccactccataccgattccctcctcctcatgcacgataaaagtcctcaggcccctctacacctgttgactcccttgatggacaacctagacaagcagggacgaccggcttgcactcttctgagggataatataagccatgctgttgccatgcttacaccagcgggtccattcagcactgactccacctctaacaacagagtcccatcccttaagaaatccaagggccccagtgagtggatgagtgcacggtgcacatacatgtacagtcccatgctgacatactcggcaggctgattctcagtgtctgtctgtggaaaagctaagagaggtgaccctttccatgcaaaagatggcagtaaagcacgctggctttagagagctcagctctgcaaggtccgtgcagaacgcatactgcctgctcagccgtgactccacccagcagcaaataagatgtgtctttcctccccaacctcgacacaaaaaaaatgacacgttctctaaaaatgaagttcttgggctgtaaaggaacaagttaagaagccacaaaatcatgaacacttgaatatgaaagtaaggagataatgacacttgtcagcagacattaagacttggcaataaaggggcctgttcatagagaaagcggttctaaatacaaaatggtcagactgatacttcgaaggctggctattaatagagagaatcttagagaggtttcattatgtaaatggctcatatgtctgccagaagtgtatccataatactttgcatttcctctgaagcagaaatttcaaggtacctcacattggaccacgtggcttttagcacacagtgagaagaaagtttacctcttctctaagttgatcattaaaataagtcataggtacttgcgtgcaccaggcacaatgctggctcttttcaatacagcagtgctttgaagcaggatttttatcgacattgcaccgttgggatctcagagggtgaaatcaacttgcccaggatcttacacatcacaggtatcagaacctgggtttgaactcatgtctgcttgataccagtccattcttcttctcactgtagcactgatctagtggtctagtaccctgagcacaatgcctcagagagttgatagttatgagtaggaatgggtttagaaaaatgggtgctttgagtcacccatgggcacaaatcttaataccaaatgatatccacatttgttccagaaaaggcagtcttgctgctgctgctgctgctgctactact

SEQ ID NO: 715 - DNA, 2875 bp, Mus musculus
ctttaattatatttaacctgctgtgtgactaatttctatcttaatttttaaaatttcaatgaccttttaataatatacagatatctggggctggtgagatggctcagtggttaagagtgccgactgagttcaaatcccagcaaccacatggtggctcacaaccacccataatgaaatctgatgacctcttctggaatgtctgaagacagctacagtgtaattacatataataaataaatattttaaaaaatatatacagatatcaatttgttcttctaattttgtaaaaagaaaataccactttcctaaaggttttctgtttattataattcactttgacaactttttatttgtaactttatcaagattgtccatagttttcacttaatagaggcttattttttcaagtaataaaaagttctttcatgtgttcctttctagtggtgccattttttcctatggaatgtttgttaaatttgtgaaattcatgaatgtaattgacttacaaatgaaaaggctaaaggaaatcaagttgaaaggagtttaggtaaattgataaagaacatgaggagagggctagagaggtggctcagtagtgaagggcattagtagccaaggcttacacccatgcagacctgagtgtgctgtgtttccacacagagttgggtattgtctctccagtgcctctaactccactgccatgtggggaaaagatgggggtctcactgtggccagcagacccaaaaaccattacctcatctcgagacttagggaaagactttgtttcaaagggttatggcagagagtgatagaggagggccagcttcctctggcctctgtgtgtgcccacgggtacaagtgtacatgctaccagggccttgttcagacaaaataaaatcaacacagatggtaaacatctgaatggcacctcataaagtgggtggggctgattctggtggtggtggtcggggggcgggggggcaagcataggtcctgagacagtttgaagtagaagcagctacaatgatgtgctcagtctcggattcacatctcactcagcatgaaaccatcacagggcttgtgagggggtcaagatgacaaactaagaaggcaccaggtgcaagacagcttctggtcacagcttagtgctcagctgttgcgaacgctccactccttctcctggaggaaagaagctattttcagcaagtaaacatttaaattcacttctgttctgaattatagacaccaaatggcataccatcataaacagatgatggcacagctcctgcagctcatatgctggtgatttcatagtgaaaatattgtttgtttcactaaagcctgcttgaaattagtcagtttaaatgcaaaaccaactattaactaatgaaaacagagtaaatatgctataactaatgcttttaaactaccctccaaagaaaaagcacctctctataattttagaaagaaagaaagaaagaaaaaaaagactgccaagaataaaatcaaactcagctctttaaagcttgtatatagctggattggtggtacacacttcaatttcagcacttggaagggagaggcaggcagatatctaagttccagggtagccagagctatacagaaaccctgtgtcaacaaaacaaaataaaaaacaaaacacttgcatataattaaagcaaaattctcatgctagagaactgaaaacggtggaaggttcctgtaatcagttccagatactggttgtggtggtttgaatacgctcagcatcatggcaagtggcactattaggaggtgtggtcttgttggaggaagtgcatcactgtgggggtgggctttgaagcttggcccagtgcagtcagtttccccggctgtagtcagatcaagatgcaaaattctcagctcatgcttcagccccattcctgcctgcctggatgctgccatgcttcctggcttgatgatagtggacttaacctctaaacctgtaagccagccccagttaaatgtttgcctttataagagttgtcttggtcatggtgtctttttacagtcataaaaccctaactaagacactgacataaataaatgtaccaggcaaagagagaataatgaagtccccacagtgacaggctaataggagtaaaactggttctaggttgaacagtgaagcacattccaacattataaaggtgatcttctcaggatgtttattcaagaaagttctattcaacaataacaactttccccttcatcacaaagctaacagtttacctagacagtcttttgctgaatttatagttaacttcataaagcccagtatcaccactactcagcaatatctatctgccaacacagcaaacgctgctctgcaggagacagcatttgtgaaagagaatgaaacaatgttacagagagtgtagggataagacagcacaggaccctagaaagaaagaaggattgagaatctgcagaccatgcagacctgaaaggctcccattcccactcccagaccctaaagagtttctgcagttctccatgacctaagacaagcacatttcttcagtgttcctctgctgtgccctcttaatgtacatcttgggcttattggaagatagtttctgctatttttcaacaaagagaattggagccaattctcttagcaacaacgatgggtttggaatgggaaggaaatagttacttttttttataaagactaaggatcaacaattagtattcattttacttgttgtttgactgtggtcaagttctagagcttttgcatacttgcacttttgagatgggggtctcactatgtagccaggctgggtctcgtctactttctatgttacgtctgttaattttctgttttgttcct

SEQ ID NO: 716 - DNA, 2975 bp, Mus musculus
gaaatggctgaagtcctgagctcagcaagaagaggaccttgtttccaccatacgggatgactttctggagagacttagaactcagacaacagtgggcaggagatcaccctactgggtctgttcactgatccacatctttttctgcctgtttctacctttctcctgtttcaggacatcaaagactgacttgtgggacttgaatctctttccccctcttcctggtgttgccacactgaatacatctcctctatctacttttctatattaatttagctcctttaattggcttattaagggagatgggccaaatatggcttattggggcacatctgtgctccctgagcctggtaacacatccagtgttctcttcaccccctctcaggactcccaccactgtcaagtccgggtcctccctcattatggccttctgtaagatctcactcagcttgggccctcaggtagcctttcactacaaagcatcactcaacacgattaagtggttttgtttgatgggccacacttctccagtaggcagtactctgaaaggatcagacctttctggtctggtgcccagagcaataaaagttactccatgtgaacaagaatgctgtggaatactgtcctctgagcaagacatggtctgcctttgaattgagctgggcccatcagtgttttaccagcgcagaggggttcacgaggccccactcctctctgtgaatatcagaaaatataatcaccactaggagaaatcttttcttcagtggtatagccacttgtaagctctccaaggttctggaagtaacccctcccccgtgttcttgtaagcaatcccaattaaacttactgagtcatcaaaccagacttggatgggtactcaggcaggtcccaggaagagtacacagatgacattctgccccggcattttcataagacaaatctaatgagtgaagtaaacacgagagaaggcactggccccaagaccacaatctttatagtgagggaggtgaagatatttgaatagcttacagcaccctggtgcacaccagtcatcccagcaatgggaggcctgaggcagggttacaggttcaagattatccaaggctacatagcaagagaccctgtctcagaggagagaaagaaaataccttaatgagaggtaagtttccctgtttcacttgaagctgtaaaacaaatcctctaccatcacccactgaaaccagcttgtgctcagcatgggctctctcagtgacttcatttttttctgtcattttacagctatacttctgaagagtacccccttccatcaaccaatcatgttctctcctgacacccatccaccgcagcagctgatccttttgaggtagtctgccactccccaaagcagagacagctgacactttccagaatatctcccagaaatcaaaggcaccgccccccagtggctttctctgcttctgaatcaccctccctcactgcctaggatttcctgacaatacaagctcggacgcccctaatccctggggacattcccagcaggtatctgtctgcatctgttttctgccccgaaaccaaaactcactcatcttccatcttctgatgcctcgggctcgacacaccctggagacagatgctcagggttttgagaaagattaagaacgcagagttcctcttgtgcgtgtagtgagcacctgaagagactagttaagatatgacttcttttttaaaaaaaaaaaaaagcttgatcatgctttgaagtcacagagttgagtttttgagttccgtttcgatgagagaaacaagcacgtttaaacgctgatctcttcagccctacgtttatttttaagtttaaaaaccaaatgagccgtgagtaaggtgaagagctaggtagatgtgttaaatatgagaatggaggctgggaagacagcctagtcgagcaggcaagctgccttccatgcagctgtgaagacctggactggatccccagcacacacctaaaggctgtgtaggtgcatttctgctggggaggtacagccgtgtagattccagcagctccctggacaatggcctaggtcaaaagggggtcctcagttcccagtgagagacactgtctcaagacacaagatggccgagtactgaggactgacacctgaggtggtcttctggcctctgcatgcacaggcacacacacaaacacatatgcacaatatacaaaagctgtgcgtgtgtgtgcgtgtgtgtgcgtgtgtgtgtgtgtgtgtgtgtgtgtgtgtgtgtgtgaaaggcagagagacagagtcagagagacaggcacaggcacacacatatacacacacacacacacacacacacagagagagagagagagagaacaaaagcagtaaggatacacacaagtgaaaagacgcactctggacttaccagcacgagtctagatgtagatttacataaatgacatcatttcttcgagcacctgtgtgacagggaaggtcaaggacaattttggatgagacaatcaaccttgaggactgtgagaacatcctctctgcttattagtcatcaatccgtaatcagttgacgggcatctaggctggctccatttcctggctattgtgaattgatcagcaatcaagctgagcgtggaggcatgcctgtagcaggagatgcagtcctgtgaggagtctattcccaggagtggtccagcctggtgatgtcagaggatactgttaactttctgaggtgcctccacatgagtgtccatcatgattgcattagtctatattctcctagctgtggataagggttcctctctctcaatagcctcaccagcatcgagtgtcatttgttcttggtgacaaccactctaagtgggtgacgtgcagtctcaatgtaattttatttttcatattggcaatgactgtaaagtggagagtgttcaatttttaaaagaaattctgtatataatctagatctctctc

SEQ ID NO: 717 - DNA, 2800 bp, Mus musculus
gcctggtttccttggtgtccttttccccttctggatcttacactcttcctgcctccttttctgacaggttccctgacctctgaggggttccctgacctctgaggggagggatttgatggcaacatcccatttaaggctcagggttgcaaggtctctctcagagtgtgtaatgtctggctgtgggtctctgtatttctttccatctgctacaaagggaagaaccttctctgataatggctgagcaaggcactgctctatgaatatattagaaagctattaggagtcattttatcactacatttccccccagttttttagagcagtgttatttggttctaacataggtccctgggctatctagtctcagatgctggaccccagtcagggttgagcacgggtcccctctggtggaaggggccataagtcaattcagttattggttggttactcccacaagctttgtaccattgccctagcctgtcttgcatacagtacactaggatagataaaggttctgcttggtgtttatgtttctcttttgagagcatgcagagcaccttcctgccccaagacactggaatgtaggggtgaaagttctatgtaggaatcagcttgctatcagtaagttgtgtaacattgtcttcagtagtggggccttgctgtcagcttatgaagagtagcctacagtcttggcaacagcgtggattgtatgtgggttcccatggggcccctttggccaacaactcaattagacctaacccaaatcttggtactggaagttagccagctggcacaacttcttcacaggctctgctatcttggtctctccatgttgcagggtagatgatatttatcttctggcttgataagaattgatccggtaatggttgcaaaatgactcagagtcagaattaaccaataggcaagggtttcttagcataaaacaagccaaatgcaaaccaaggctggatggaaattgagatgatctcgtctttttagtgagggtatatttccctattatttgagttcaggtgctctagtacacagtaggtgcagaataatacatttccagttgctggctctcctcagataagtttgagcttatctgcatcctctgggttatactttctctgtcttgaggcaaagggagcgatctctaagatgacttcatcctgagtgactgcgatctagtggtttgactggtctgtaggtgggtggggacacatacgcatggtgtgtcacttatgaaactcaacactggagtctctattcatagccctgaactacttaacagagaacaaattgtgtttgcctgcaatgcagatctcattgctgataatgactgaatttttaacggagtcttctagacctgaattctttaatgaatgctgaaggggaagtacaaatgataaatcagagcaggcatgtgaggatctgttagaattctgtaaaatgcaaatcagactggctgtgtctaagttcccaaatcaagttacaacagcctcgacactccccaactacagctgtgacacgcaatcagggtggcaacagcaaccacctcgaaagtaccatagatttcattttgacttctctgttcacatcactgtccagcatcttagatgctcctggtccaatgtttaaggaagctcaccattcagataggctgtgaatggtctctgggattcatgaagcatttgtcgagaggtaagcaaaagcaggtattggccatagaggctgtcgaaaagcattggaagagccctggagacctaggcagggttcactggggtctagtgagagcccagacacttggtcctctttaagcccattctcccaaacacccagagcagggttcccaactcactcactccccaataaaaaaccttccagggatctgctgcctttagaatcaaggcagatacttcggttggcctacaatacactgcaggatcctccttaatctcgctttcatcccaactccccagattcttctctgaacaccccagaatttcagtgtcccagactctcatagctgtgggaccactttagatacctgttccctccaatcacgtgttactctgggtacttacttatggtccgctgccttctctgttagatagccagttcatttccttacttactgttctgtctcctgagccctgcaaagatcccagttcctggggaacagtacaaatgtgacagccctgggtgggctatttaacctctccaggggccttagattcttttgcaaacctaggcttgctgtgagaagacagggtgatgtcaccagctcacactgaaattgtggtgcatgcccagcacaacagggcaaggactggcccctctctgcttccttctcctctcagaaaaggtactactcacaccagcgacaagataaagtccagctggcagctatggaatctatgccctgtgaggtttaaggaaggttttttctggaattcactgggacaaaaaacattgctagtatgtctttgttcctatggaatgccacttactgtgtttaattaacattttagatttccattatggaaagatagcataaacatacattcgccatcttaactatttgaaatgtgcagttcgatggtaccaagttttgcgtatttttatttctgagagtgggcttcactgttgtcagttcaggtcctttctttccctcagctggaccgtggggcttactgaccagctatttcccgttttctgcttgtgtcagccaccactctcccctctgtctctataaatttgagagtccaggagcattatataaatggagtcacaaagt

SEQ ID NO: 718 - DNA, 2600 bp, Mus musculus
gatcctgaggactcaccggatgtgtgagcactatgttcggaactgctttggtgcagtcttcacgcagtcacacgttcactttagcaggtatttagagaaacttgcttgcaggcactgtccattgggccgacgcagaggcaagctacccagggacagatgggcagagcactagttcctaagaagatcaggaactgggggaagagtgcaaggggaatggaagaagccacactatgccccttggaggcactcttctggactcactgggccacctgtgtcatagagccgtgtggcatgcattgtcacctcatttaactcgcttcggtctacataggattgctttgaccattgagtgtcagtgcttaagcaatgcttagagatatattaaattctcaatagatgtaagaaataaaaatgatgatggtggtggtgatggcttggtaatgttgaggaatatggtggtggtggtggtggtggtggtggtgatgatgatgatggtgatggtgggtgtggagaggttgagacaatgtattgcaggtaaagcctttttagcatgtgtttattttaaaactatatttatttatcttgtatgagtattttgcctacatgtacgtatgtgtgtcttatagaggccagaagattttgtcagatctggaacaagagttgcaggtgagtaaccctgtgagtgctgggaactgaacttgggtcctctataagagcagccagtgctcttaactgctgagtcatctctccagatcccaaggcctctctctctctctcttacatggtgcatacatgatttcaaagagggcagggagagaaggcacagtcttagcccagacaacagcgggtatcaagttatggaggcataacacggctacagtaactagttatgactacagtaactagttagaggaaagtcttacctcaatcatggcttccctttgcttcacagaagaacagtcgagcttgacctgaggtgctctaaggtgaatatcttaccaatgcccatctcctaccacacacagagagacagattctgagagatttgttcctatgtagcatgaaattcaccttcctcttggaccgggaagctgaactggcctctagtaaatatttatgttgggatatttggagactgtacaaaatgtgcagatattttcatcctttctttcgcggcttacatagtgtgccacctgcctctatgtcttgaaaatgaaaggcgatttttttttttaaagaaaatgggttggaatgagaggctaaagtcatgcattatataaaagctcagtgctgagtgaacagaaaggcaggctgctgaaccctgagtgggctaagcatcaagtatagctacagtctccatgcatgagagcagagacattgcaagtcagaatatatggaaaattaaacaattaaacaatattctttagtaaaagtttccatagccgtcatgactgtcaaagagaggaagacaaccaactcattaccttgtacagagcaaccatgcctcacacttcatcttcctgtgggtacctcacatgtaggcttctgcttcctcaactctgcttgccaaatctcacttgttaactgggtgctgtcagggcacagatatgcccaagctcctgggtcagcccatgggagacaatggctggacgtggtccaattgagttttatacatgaataatctaaagatcttcccaggccatacctgcaatggaaattgcaggtggacctggaagtcagggaatgatgcctgcctgctgctatccagctatccttctccacttacacagaccaggatcccagccagggactggtgatgcccatagtgggcaggcctttccatctcagtgagtggaaccccctacaggcatccccagaggaccatctccaagtgattctagattctgttatcttgataaccatcactcccagagactgatctgtatatatttataactgcattcatagaggttctgcgttcatcagatgttaccatacaggtgccctcattccaccagcacctgtggtccagtacaatttattgatcttatggcactaacaggcatgagtcccacagaacttcacgatgagttatccttaaatatcaagcactgtgcagaatacaacccttctgaagtaagctgagaaactgaaatgtattctttccactactaaatagtgcatctctgtttacttaattcccacatttgttatattttgagagtcaggccgtggaccctgtcctgggaacaaacaaattaataaaatatgacccccatttcccccaaatgttcccatctatgccatcttctcactacatatgaacagaaatgtctatactaaactgaggttctgaaatgaagcgagtctctttgtacagaaaacctgtaagcttgctgtactgatggtgttaatgagagattgtaaaaatactatgaagaccagtgcttaaaaaaaaatagcggtacaactaccgaccactcatcaatcctacttcctgtcacttaatgtgtgtatatacggacacatgcttcagtatattgaacacaaggtcttggagagttatctgcacacttgtaattatagcaatattgttcaca

SEQ ID NO: 719 - DNA, 3525 bp, Mus musculus
cccttgagttcttcatctggaatcccgctcaagtgtctcttaccagggatgctttggtggggttggtgacttttgaaggagacacaatgactcactcggtcttccttactgtggctctggctgagatttgcacatctagttagttcattaccaagtctttctgctgcacacatgctgcagtagcaattgggttggcggttggtagttactcgccagggtgggtgatgcacggagctcagttgtgggggtgttagctgatccatgggtggtgtctgaggtgtacaacctctggcctcatgaatgggggacgtgggggactcacgagtcgagttgggaacatatttcagtgtgacctctgagcttgagggataatggccatagtgtcgatgggctgaagaagattgttggattgagggttttgttttattttgttttgttttgttttgcatctttgaactcacatggggcaatttaaaatctccatggatctagaagtatcatggagatgtggagccatgagtctctaaccttacttaaccaggttaagcccccttgggtcttccttcacattgggttggtagaaattcttgtgggttgagtcccacaggaattccaacaggagtctggaaatgggttgaggggatggggcaccaggttgtagatctctgacctcacacagggtaatttggaagcaccatgattcccagaaaaagcctagaaaccagagcgggaataggattgtgcatcatgagtgtgactgtacatagggtcaatagttctcccatgtgtcctggcaggagcctggagatggtggctagggatctgggtcacagatctcagactacactctgggacagtcagtgttcccatgggtacagatggaaacgtggagatggatggggacacaggtaacctggatatgtacctctgacttcacgctgaatcagagttccctcgggtcccagcaggaggcgaaggcagctaggagggcaggttgtatatctcacacttcatactagcgcagttggaatgtcctgtcaagatcgcagaaaccgcaaggggataggagaatgggttgtctatctctgctttactctgggtcagtcacttcctgcctttcttggcaggagcctagtgagagagagggaacatggaactgggctatggaagtgggtcacatgcttctgacttcacactgggtcaatcagacttcccacaggctctggatggattgtgagggaaggtagggggtagagggaactgggctaatcgctatgttttttaaaagaacttttattacattaccaaacctctactctgcaattaactctaattacataagcaattaagttgaaagtaagactattttgtgatttaaacctatttatacttgtatgactctcccttaattaattctcatctcctggttacaactgccatttaattaacagattttttttaaccctgagcattatttgaagacaatttctctatgttcatgaaagtaagcagaatgtggcttcttggctgtgatggacatcccactccgtctcttgtatacagcccttattacattgaggtgcgcctcatttattcccagttctttcaagggcttttttcttgatcccatgtttagctttgtcaaatgccttttttttgtctgcatctattaaaatgaacatgtgatttctagtcttgggcctatttaaaagatgtactataatctatttgcatatgctgaaccaatctctggcatccttgagatgaaatcaattggtcacatcatagaatctgtcttagcattcttggatttgctttgcagatattcttgttaattctttaaggattttgtacagtgtactttgatcatattcactctcttccccaactccagcccctcccagattcatcctctcttctctctctcctgagctttgtgtccttgatctcttttttaacccttggagccctgttgggatgctcctaaactcttggatgtttcacagtccacgggaggtgaccacacactcaagagtacatagcattgcaaatactttgttgagaaatttggcatctatagtcatcaaggaaattggtctgaatttttcctttttcctttctctctctgtgtgtgtgtgtgtgtgtgtgtgtgtgtgtgtgtgtgtgtgtgcgcgcgcgcgcgcgcatttgccaatatctctctcctttccattggaggaatggcttgagaagcatcggtattagatccccttaacaggttagtagaacttggcagtgaatctgttcagtcttggcttttactttgtggtaagactgtacatttttattgtgtgcctctgtatgtatgacatatgtggtgggcatgtgtgccatggtgtatgtgtttaggtcagaagactttcttatgaagtaaattctttccatccgctgtcatgtagactctggggattgaactcatgtcaccacggtttcacagcaagttcctttacccactgagccatctcagcagtggagagatggacaagcattgctctactctcaatgctttgcatgggtctcagttgactacaaaatagaactgccataagcctattcttgtacatacacccctaaagtctctatatcctcccacagagatgctcacacatccgtattcactcacaacagcaaggaaatggaatctgcctggatgttcatcaacagatcaatggataatgcaaagtgatacacacacaagagaatacttttagaatttgactttacaaacattatctcatgcaactctttgttctccttttaatacttagccttcatccacttgagtccctcgtgacttccccttgcacatccaagatggagatctctaatcctccctcagaaatctccctttaggttctgattgacattgccagatactggactggaattcttatgctcaaaattcatctgttgtgtataaaaaattcaagtttcaactttgtgttccagttctttgcttgctaaatatggcaccccttgcctgacccacttactctgctgaaggagaaggtggttcccttccaaagtgtctttgtaggtggtcctgccatattttaaaggatcttagttaaataataatgtgcaaagcactttaaaatataaccatccaacctctcctaatatgactcacccttcactatccataaaagctgaagctcctgcatattagttgtttgggtttggtagcaaaacctttttattgaaggtttgtattaaaatgctaacgaagtttttcatatttctgaagacactggagtttctatttcctggcagaagagaggacagtgagtcacttcctgacaattgagtgcaaaaccttgtgtttcaataatatgctccctttatagctatgaattgattaagactgtatcaaaggccctgtgatttgaaatgtatgactcccattcattccctaaaagaaaaacaagaagattttaaaaagtggcatcataaaatttgcagtcaaatggatgcaactagaaaaaa

SEQ ID NO: 720 - DNA, 3025 bp, Mus musculus
tgtgtataaaaaattcaagtttcaactttgtgttccagttctttgcttgctaaatatggcaccccttgcctgacccacttactctgctgaaggagaaggtggttcccttccaaagtgtctttgtaggtggtcctgccatattttaaaggatcttagttaaataataatgtgcaaagcactttaaaatataaccatccaacctctcctaatatgactcacccttcactatccataaaagctgaagctcctgcatattagttgtttgggtttggtagcaaaacctttttattgaaggtttgtattaaaatgctaacgaagtttttcatatttctgaagacactggagtttctatttcctggcagaagagaggacagtgagtcacttcctgacaattgagtgcaaaaccttgtgtttcaataatatgctccctttatagctatgaattgattaagactgtatcaaaggccctgtgatttgaaatgtatgactcccattcattccctaaaagaaaaacaagaagattttaaaaagtggcatcataaaatttgcagtcaaatggatgcaactagaaaaaaaaatcatctcaaatgaggaaaaccagacccagaaggacaagtgtggtctgtaatcatttataagtggacatcagctattaacctacaattcacagactcagagaggttgaataaagacttgggctttgggggcggggcatggatctctctgggaagaggaaatagaatagattctgtgggcggacagtggcaggtggagatagaaacagaagggatcaacttggggggagtgaagggtggggggagtgaagggagagacactggaattagtgggttttggggagacagtgtgaaagcctagtacagtggaaacttcctggcatctgtgagggtggcccctgttcagatgcagagtatgaactggctatctttttaaccaggcaaggcttccagtggtgggactggttggttgagttgctggctaagaaggtccgaaggagatccctaaccaatccaggctgatgctaggactgaaggttgctctctgcaaacaggggtcccattgccaaggacaacttctgctcagctcactgaatctagagaggtcaagcaggtttaggcttggagtcttaaaccctgcgttctagtctctttggtgtgagaaggtactccgaaggctaaggaaagagaaacctgggtagcaacccagccacaaaacccacgacctacaatcttctcctgcctacaagatgtgctgtggcaatgatggcagagaagttgtagagttgccaaccaatgtttgctttaagttgaggcccataccatgagaaggaacccttgtcctacatttcctggatggccaggaaatggagactggatagctcagagacctatgatagaacctatactcatgaattgatgctttgaccactcatcagagagactgctggcagcaaatgggaataagcacagagacccatagccagacattatgcagagagagggaaagtctaaggtccctccccttgaagatcaagaaaccctgggggtcgggggagaaaaaaggaaccctgtggaataggggaggaaaaattgtagggggacgaggggatggaggacaatgggagaacatggcccacagaatcagctaagcagggtgtgtaagagcaatctcttgtgtaatagatggaagcttcctctgtcaataaaatgatgttgacccattagcttaggcaggaaatggggaaatggaagttcctgtatagagagaggatttctggaacagagacagatgggaaaaggagatttgccccccagaacactgatggagatcgacacatgagactgaaggacaggtagcttgtcatgtggcgcccataaactagaataaagggggttattgagatatgagctgttagcattagaagcagttttacagtcagcttctgaatccagcaatgaggcaaaccctaggcgacaaggaccctttgcattcgttgccacggcaactgccaccctcccagtgtatgcctcacatgtgcgcattattcattacctggcatctacatcatggtccgaataaaagactgagaccctgatcccttatctcccttttcctctttttttctcttccttgcctaccccatcccccaatccaataaaaatctcttcttgtgggactatgctggcctggcatggtctgcctggaagtgagccaccttctgactaacatgagctagttggggaacaaagctattggcctaggcatgtattcatataactcattcccagaattgttatttcagggaacaaagaagcatggtggaaagcccatggttacaagggctcctcctacgtgggtctgcactaggtcctctgtgtatatcctatgtgttagcttggtggtggtgtgggactcctaacagtggaaatgcatctctgactcttttgcctgctcttggaactctttgccttgtccatccgttaaatgagggctttcgccttctcttattgtatcttttaatcctgtttggttgttgtctcttggaggcctgctcttttctgaaggggaaatagaggagtgggtttggggaagatgggaggtgtgtgtgggagtgaagaggaatgggaggaggggaaactgtggttggaatgtataatatgaaaggagaacctattttctctttttttccccataacttaaaaaaatatctatttattcactttacatcctaatatcatcccccttgtcctcccagtaccccctcacacaggccggtccttcccccactaccccctcccgtctcctctgagaagggggagtcccctcataacccctaactcagcacattaagtcactgcaggactaggtgcatcctatctccctgagtccagacaaagtggcacagttagaggaacaggatccacaggcaggcaacagatttagggacagtccctgtcccagttgttggggatccacatctattttctagatgtgttagtaggggttc

SEQ ID NO: 721 - DNA, 3075 bp, Mus musculus
ccaagagttcaaggctagccttgtctacctggcaaattccagaccagccaggactacatagagaaaccctgcctcagagagagaggaaaggaggaagagaaagggagagggagaagaggagggggaaggggagaggagggagagggagaaggagagggagaaggggagggggaaggatagagggagggagagggagagggaaagggggagagagagagagagagagagagagagagagagagagagagagagagaacattttttacttaattttaaactctacctaattgttaggtcttgtaaactacacccttttgagcaatgtaagaaccttagtaagtcataaaatcacataccgctcctcttgtgacgccaatatcaatattttagatgtgtactgtccttttaaattatttttctcccgaattttcccctcccctgtcttacacgcgttctcacgaccggccaggaagaacacaacaaaccagaatcttctgcggcaaaactttattgcttacatcttcaggagcaagcgtgcaagccccaagcccaaaaacgaaagcgaaaccccttccctcttaaggagagttatccttcgcctaggacgtatcactccctgattggctgcagcccatggccgagttgtagtcacggggaaggcagagtacatggggtggagaactacctttggcacatgcgcagattatttgtttaccacttagaacacagctgtcagcgccatcttgtaacggcgaatgtgggggcggcttcccacacccctgctctgtctacatttaaatttgaaacacgaaacatccattgtcttcacttgatatactctctgggcgttgcttcacggacacagcatagaattctctgctgcatcctgagaaagaactggccttccctgcattaggggccttatgaggggaacatttcttacaactctcacatacaaaccacgctctgattccgtttggggatgagaagaaactgggccttttgaagccaggcacacctgtgcctatgctgtgacttgaggcaagtaaatggggaccataaaaatgtatgggtttttctacttacgatgggatggtgctggtgtggaggtgtggagccattgcaggtccatggctcctcctgtccctaacaccaagtgtgagtaaggcgtgtgacaccagggcactaatagagtgtgtgtgccatataggaagcactagcatggaaagttgtagacagttaaatgcagatgccacatgatatggaataaagtggcccagctgaattctgggtttgccactgagagcagagctcagtaaacactttttataaagaatcagctgggaggtatttaaactctgtggctctactgtgtaacagatgtggttgctgagtcaccgcttattgtgttacaaaacactttccactgcaagacttctgagcatctggggttttgagtggagaggcctgtgagctgagaccacagtttgaatctcaaggctgcctccaaagtctccttgtgctcagccttctccacgcctgtgattttcagaaactctgcaaacagctgtgagttttcaacactgcccacaattggatccataaagcaaactctctcccacaacaaggatcgagagaggagttattaaagatgcatggggggggggggcggttaacatgcaaacatcatgggaactgacagccagtcaacaaggaatcacatgctctctctctctctctctctctctctctctctctctctctctctcttgtctcaaggtatagctaaggtagcacacggagtgtctgaagatcacaggtgtctgtctccatgctagtgatttttattttatttaaaattaactgatgcatcagcattgccctgctagcaggaaaagattgtttgtagcacatttatatcccagtctgagatgtgttcagcctggttgttggtagctatgctcccattgttcagcatctttctcccttgacaaatctctgtctggtggccagggaaaaataaagaaatgatgcaaagctcgtgagatgcatcaagggtcaactctaccttcatgagcaaactggtgttttgaacaggaccggaggagggatgggcagcactacattcagctgttgaaacaaagaagctgatttttaatattaaaagaggggaaatgtgggagaatggtcatgcacaacgaatgtcttgggacacatgagggtcgtatgaagggggcctggtgttatctgcagagccggccaatctacgggcaagtcctgttggagtcagagggttagaagaatataagctcatctcaaccttacatctcaacctcctgtacgatgggaagatactggactggaaagatggctcagccatgaaaggcaaggcttacaaccgcgagaggaaaatactgtttcatgttagcttcctgtggggctttcaagaccagttctaggactagatctcagcgctcaggaggcagaggcaggtagatccgtgtgagcctgaagccagcctgctttacacaatcagttccaactaggcctagggctacacagggagaccctgtctctaaaaggtgtgtgtgtgtgtgtgtgtgtgtgtgtgtgtgtgtgtgtgtgtgtgtgtggtgtagtggatagggaggaatgaaaggccacttcctagcacaggtccatagctctttctgtttaatttcatttcaacaaacgtctagtcggtacatacactgtgttggatgctcagccaggcatatgagcctcagatgaatgaggtacgaacacactcctgactctacaaggcttgcagcatgctgaagcaagggacaggagacacaaaagaaaatgtcaccagagattataagccgtacaaagtggatataaaaacaacagcacaggtcaccatgagagaaagcgagccctcagagggacctcactagacagctcagcccaggtctgtagaccagcatccatgaagttcctgagataaggaacagggaagggcctacactgtgaagcaggaggcagctgggcatcccagagcccgagggtcagcggtatggctcaggagcc

SEQ ID NO: 722 - DNA, 1700 bp, Mus musculus
tttgttcaaagccctatttctcaagaactgaagtctcagacatataacacgaaccaaaccttagctaattaagctactttctttcttaactggcaaaatagaagaatctctgtaaaacctgcaaaatattaagtgtacaaaggtctccgagtaggtgtgtgtggtctctgtctctcttatcagaaagaaaaccccgccagcatgtaacagcagccttagattgtgtatactccccagtctgcaggatctccctctaggaatgaatctcacgcaaataattaagacatctgcaaaattaatacactatgatgttcataagagcagagtttataatagtaaattagaaagaagcttaaatgttcgataatacaggactagttagaaaaattacattacacttatgtaatcaaataccatgcagacattaaaagcaaagttttaaaagaataattgatggtatggggttattattaagcactattaagctcatggtagagatctttaaatagtgtgtgattacattcagtttgggagactgagtcatttttaaaaatttattcgttatcgtttgcagtgttttaatgatgttctataacaaacatgattatctcccgtctttaatcctaaatgctgtctgtgcctgctgtctcctgtcacatgctctctcctccagctgggcagttactctgcactcctccctgcacagagcaaaggtcagtgtgctcggtcggtgtgcaccttgctgctcctttttcttcatagaggtgagggtcagcggctggcattgcacacatgcaggttaccacctcctgctccaggccaacagtcacggagttctttgtgcccatgacccatagggaacccccttgtcactctggaaaatggcactgcagctctctcaggtgtcctccatccctaaatcccgactctctgggagctcctggccccacaccaacaccgagtgcctctacaaacatggtctgtagtggacatgctctaaacactagtgtgtgcagttaactgtacataactgtgccaacggtggcgttcagtcacatggcattactctgtgacacaagctaagggaaatggagtcaccacggtaccattccagcttcactgtactgtcaccagggacctaggctcctagttctactgtgttttgttctatgtgtaggctgcctccctgggccttggcatcttatggttacaagtgtttcagctgctccctgaacacctcacgagtaaagagggatcaatgccacatctaaccagatggccaccaagccaaaagcattctcagaaagctctagaacacttaaatttaatgggccagcctcaactggaaaaacctgggaaaataagaatatagcttaatagatattttttcttaacaaccaacagcactaccaccatgattgaatagataacaggtaagagagctgattgtgtctgctataggtcaacaaggctgaccttgaaattcaaacatctagaaggcagtgcattgccaatgtgcatgtaaaatagacccaaatcagaggtctatgcatgtgcctatattatgaacaataataaaaacaaataacaaacaaccattgaaagcctttcagaatcagctgttttcaaagatacctccctggattacttccatcattatactaattccccaagataagccaaatcactttgttttattg

SEQ ID NO: 723 - DNA, 3300 bp, Mus musculus
tagcagattctacaagggagatgtgaacaagggagatgagcatccttccagcatcacagggtaccaggagctctttcctggcctaggaccaaatgacaggggctggaaacttttcctatggtatgtgcaaagcaggagccaaactctgatacaactgtcgctgttgattgctgtgccacaaggaattgggcaggtagcctctctaccagttccttctacaccagccctgaggggatagaggacctaggcagtcagggtgagccaagttcaacttttacagcatagcgcagcgggtaataaaccaaacaaggctagaaagcatgacattcttgggagccagtaagagtatatatagcattacttttctgcctcttaggaaaacaactgtttttgaaagtgtaaaacaaaggaaattggtagaagcaaatcctctggactggagagcccctctcctctcagctccttacagcactcacaatagccaaagctggaggtgtacctgggagacctccttgagacagactgaaagacacccattgggatcacagttgagtcggtacttcctacaggaaagctattcctctagacctacccaccctaaagaggacatagcagcacagaccctctgctgctgtctgtagtcaaccctagtcaccctctagaagctatacacctcccactagggcctaactccatcccgcatgcaaactgggtccaaatgactctcagacctggacctctgctacagtgggggtgggggggacttcatagacagccaaatgaaaacagcttcactggggcctgaagccagtattttgggtatccatataaggaagggatatgtggacactgagttacccaggtaaggatggtgatgtgttgagacacaggagagagagagagctatctctaagccaaggacctccagagacaccccctgctcctgaggcaccaaagaccaagagagcaactcctctctgcctcaggatgagccagccattgttagttattttgatctcaaatgcccggcctcctgggctatgagaggggaacactgtcccttacacagctcagtttctaggtctttgcctgatagccaaactgactggtaacactttgtgtcttgtgttttaagaagagagagagagagagactccaggacaaggagatgctctgttttagaattaaaaacgtaagtcttcgtgccaacatggcttaggtctattagtaaggcgtaagaccaaaccaaaccattccagagcagtagtgtcaggatgtgagaagtcagctgccctgtgtcccttctgactctgtgatggaggtgtggacatatgaaaaattcaagccttatactcatcttatgatatggtggttatctgaatcattagccacagttctacaaaggaatggagttgagaaactaggaaatcaggtaaggccatttaagcacagattagcctccatattcacactatcacagatataaatacaaccagcccccatattcacactatcacagatataaatacaaccagcccccggatgcttctagacctttaacctgctgtgccgtaagtgccctccccaactacctgagaagcggagaaagacaacactgaagaagtctgtacaggtgctccaaacactgacctacttaaaacacatgtgctagcacatttcccagccaatcctcgcttctgttttgcaacaacacaccaacccgttggtgtgagtgaacgactcctgcaaatggccggtgaatctttctctcctgtgatttgtaaagcagagctaataacttctctctagttcactgctcacgcaggactccacactcttcccggggccttgcatgcttggggtattattatttttaacgttttatttaaattgctttctccgctgcatttcgtcaatccgtcttctatttttaaaccagactgttgacggttcacagttgacaattctgttcacagttgatgaattctgatttgttttcattcgcccaaaatcatgtcacagtagagggagggaaataatccccaggctttgctggctctaataattgggcgtgaactgagtgagcggccactgcctgcaagcgtcagacgttagagggtccctccagctattccctccagctgtgccagcctcgctgatttttctcaaatggagtcagatctctctacctctaccttgctacctttctctgtagctctttccccattcactttgtttctccattcagttcctgactacccacttaatattcctaaccccgccccccagatacattatctgtctccccctcctctgccatatcaataccatggggacagtactttcccctgctggcttagagcctagactgtctctggctgatggaaagatggccagcctcctgtcagtgcccaggacttgaacggctggggactctctggaaggagtcaggtggagaaacaagagatggatctttggctccattcagaaccttcccaaacatgcaagcaggtgcaccttcctctactagcagttaaaagacacgactttgacatctggttaagagcacctgttgcttaagcaaaggactctagtttggttcccatcactcacacggtggctcatgatctgtcactccagttccaagggatctgattggcacactcttctgacctctgcctgcaccaggcacacgctgtggttcatttacatacatgtgggcaaaacacgctcatacacatagaacaaataaatctaaaaataattattttaaatactgtagccacaattgtgggacttgaaccaagttggggggtggggggaccaaaaggccccaaccagaggacctctgacaagaaagctgcctagaaaaccataccttgggatgaggtagggtagggcagggtggacagccactgtctgggttagaagaataatagcaaacatgatagttgcctccttagtacttaggtgcaaagctataagagtcttttgggggagaaagcataatgattttaatgtgaatcacagttttaggtgatgctttaaaattatttttccatgagtgcaatggtaaatgttttctaaggtggatacatagaaggacgcccctatctgttgacaggggttactcatcagaatgtctggaaactgctaaatgcttcaagggaaaggatacaggtgtatatggaaaacataacggcaaggatgttaacagctactgtatcttggtgatagtgggcagaggttactcattctgtcttaagctctttatatacccagtggttacagaagcaatag

SEQ ID NO: 724 - DNA, 2875 bp, Mus musculus
cacaaggacacatgctcaactatgttcagagcagctttatttataatagccaaacactggaaacaacctagttgtccctcaactaaagaacggataaagaaaatgttgtacatatacacaatggaatactactcaactcttaaaagattacattatgaaccttgcaaggcaaacagaactagaaaaggtcatcctgagtgaggtaatccagacccagaaagacaagcatggtatgtactcatttataagtaggtttagctgttaagtcaaggataatcatgctacagtccccagacccagagaagctaagtaacaggtgttcaagttggggatggatggatctctctgggaagggggaatagattttgagggtggacgggggcaggtggggacaagaataggagggataggtggggtgtggtggagagagagagtacttggagagatgactggaattcgggaacatttggggggcaatgtggaaaccaagtacagtggaaatcccctataatctatgaggatgactctaatgagggctcctagtagtggggagtacagaacctcaactggccatgttctgtaatcaggcaaagctcccagtggtggggctcagccacaaaaccttcaacctacaatttgtcctgcctgcaagacgtgctggagcaacggtggcatagaaattgtcggagtggccaaccaatttctagttcaacttgagcagcccatgtcacaagagagagcccatgcctgacactgcctggatgtcccatgcctgacactgcctggatgtctagcaaccagaggctggacagcccaaagacctaggagagaaccaaacaggactgaaaaaaaaagtcagcaaaatgcttcctgatggtattcctctatactcatagatcagcgcctagcccaggcatcctcagagaggcctcccccagcatctgatgggagcagatgccgaaacccatcaacaaacatcagggagagcttaggaaaccccctggaagaggaaaagaaaggattgtaggatccagaggcatcgaggataacacaccaccacagaatcaactaagcagggctctgagaggctcacagagactcaagtgacacgcactgtccctgcatgggcctgagcggggtcctctgcacatacctatgattatgtggcttgctgttcttgtgggactcctcagagtgggagtggaggggatgtcgctgactcttttgcctgctcttgggactgttttctcctactaagttgccttgtccatccttcatatatgtgaggtacgtgcctagtattattgtaagttgttctttcctgttccattgatatccctgctcttttctgaaggcaaatgaaggaggagtggatctgtgggggaggagagactggggaaggagaactgggaagagtggagggaggtaaaactacagtcaggatgtaatgtatgggagaagaataaagataaataaataaaatgccataataaaatctgtcctgtattactggtaggaatacaaaatgctgctgctgctgttgctatggaaaccagccaggtcagctcctcagacagctgagagaacttcaaaagacagtaaataccatgtcaatgctctcggtagcattacacacaacactataaactacaacccaagcgtccatggatgggcaagaattaaaaaatggacaaggctgggtgtcctagccttttaagtcccagcactcaggaggcagaggtaggaagatttctgagtttaaggccagcctggtctacattgagttccagcccagctagggaaaccttgtgccaaaaaaaaaaaaagaaaagaaaaaagaaaaagaaaatgttgcagctgtttgtttgtttttaagatagtcttgctaggcttcccaggatgtcttcaaactgttggatgcaagaaatccccctgtctcagcttcaggagctaggagtacagatgttactacacccggtttcacagtgaggagctcaagactgaccaatcctaaacacagatggaccctggaaacactacaggtaaaggagccagatacccaaggatgcattatcccacttacaagacacacatagaaaattccagtccacagagacaagcttgagggaggtgctgactgagagttattaatagctatagagtttcatggggctagaagatggctcagtggttaagagtaccggctgttcttccagggaacctgggttcaattgccagcacccacatggcagctcataattgtctataatgccagttccagggaatttgacatcctcacacaggtaaacacataggcaaaacgccagtgtacataaaatacaagtaagtaaattataaaaatagttgcagtttccttttgaagccctaaaaagtttaaaaataaatatgatggctgtacctcactgtgaatataattaatgcccagaattaagaagtgataagggttagaggtgttatattatacatatattgccagaggtgttatattgtacatatagttcgaggtgttttctattgtacatactgtcagaggtgttatacatatatgtcacactttattaagactggtgaggctaacaagctgtctcagtaaatgcagtgcttgtcatcaacctgaaggcacaggtaaggggagcggaaggaaagacagaccctgcacctgctcctgacccctacccatgcattctgtggcccacgcacacccacattttcatacggagaaaaacgaatgcaaaaactaaaatggaaaaataataagaaaaataaaatttaatgatatcaaatccattgtatggtaaagaaattatatctgaataaaaattttataataacaaaaacctgtaagaatgggcga

SEQ ID NO: 725 - DNA, 1825 bp, Mus musculus
atgaagggaagccatgaatccaaatggcacacattgcttaagcatcactccaaaggctgggaccagcactgagaacaaacgcagggcttctggaaggcagccacagatctgcacatggctcaactctacggagctcaggctaccggaatagaaagcttggtggtatcttctgtgatgcctcagactccaagtcattctaaaccaagttgtcacgtgaagtttggacaaagaatgctggtcaaacttgtgtaaacccttaacatgagttgacgtgagatgtgtatgtggctacacaaggaatgagtgtccattgggtctgcttattgtttcctcatcaaaaattttaataaaatattttcttaattgaaaaaaaaaaagaaagcttggtggtttcctttgtatctgattctcccagtggtcagtcgcatgcctcctctcccactgttccctgtttaattggcatttttatagagtcctgtaaacgcatgcccccttcccaagagctgtttttctgtaacagcctaaaccttcaaaagtgcaaaggaaacaccaccgccaccctggaatcctgtgcagcagaagagagaagatctacccttcaacaggcatcaaattagcagaagtctctctgtgtcacaaacatttgcagcaaacagcccctgggggacagcaggagggtgcagcacagctatttttaacacacagacaagagaacaacagcatctaatttggggctgctcctcagtcttgatgctgggggctgactttgaatggaaggaaaacacaaaagggaaatgccaccccatggccactgcaaagcagggtcagaggtagtggtcaaggggctgtgtcacatgtgtgcctattccaggaggtcatggctgggctgcgactgcccacctgccttcttcagaggtgacatggaaaaagaagtgtgtatgttgggtggcacttggggggaggaccactcggaccagtaaaaggaagagccttgccaggaggaggaaatggctgtgaagccagaatgctgggagaaatgggtccacagcccctctatgagaagccaggccttgaaaatgctttaaaggaaggctgtgacatgcaaatgcttacattacttgtaaagtataaacagatgacattgccagcctcacaagtacaatggaagctgttctttcctgaagacaagcctgcaaattagcaattgtccaacgagaccgatgataccttccatagcatcataggcgtgtctgccttacccatgagcacagccatcctgtaaggaggaagacatgtcagccatgtcacaggaacacttcagtgaggtctgtgagcaagcaagcaacagtctgaagaagctcgagtcgaaagtatctcccttttttacccccttgctaactcttctttcccagtattctgaagatgccagggtatatgacccactggcaaatctccagaggaaacagagccactccaaaattcctcaactctggctttcctccctggaagaatgagatgccttggaggtctgtggccattgtctccatcctcaacaaagaaagggagttctcctgaccattgtcaacaggaattggacttaggctccgtcgctgccttatgggaattgagacttgcatttgcagaataaaaaaattaattctctggcaattatttctacctgcacaagaaagatcccttttccaaccatgagtttcatgccttcaaccggcaaccataaatttcttcaagctgaccctgagtttgcaaacagtgcaacactttgagctgacaatttgggatgatcctacttagggttaccattgct

SEQ ID NO: 726 - DNA, 3700 bp, Mus musculus
gattgccaggtacccgctgctgccagctctgagggtctctgttcccatgctggggccacagcaagtcatttgtcattatcccaaatgttttgtctcctctgagaacccttctgctcctagactctgatttcaggtcccagggccaaggggcatctacaggctgtgagtaattgtttcaaggttgaggggtgaagtggtggctatgatcctatgcccaaggagaagccagccaatgggaaggggcctttactccaaattcacacaggctgtcattctaacccctcttaccctctgtgtctgcaggagagaggacctgacaacgggcacaaacaaaatttcaacgaaaacctgacaggatggcagaaagagacagagtcgacgagttgcactttgtggatcatgtttgaaagacagacttccccaacttcttgcaaaatggatttcaatacatccaaggctctgctttatgtctgtgaatcgggcgatgggggatgggggtcaccaccgtgtgaaagaagccatctgcacagtagaactttgttgcgaacacacagcgacacttcttcctcagattaaaactaagcgtcttttttatgtcgcaataattgccgcatttacttcatttaaataaagaaaaatatcacactgtgattgaatttaaactacgaagaaactttcatctctgaacaattatataataactaacgtattaagatgcaattaccagggctggaatccttccagagcaccggcttgtaatatttcctgaataatttctttaaagcgttccttctgattgcacttttctcttgctcctgtgattattttaaggtggaaaccgtttctggtgggtaactggattttgtggacatggagcaccaggtcattcacaaagtgggagaattgaggagagcttggattgcaacaagtctcacagaaacggagcacttggcgtgttaatgctttcggctctgacccttggttaatttaagtacgttgaaagcagcaatggcgagaaagggacaaagtatgacacgctagaaacgacagtccacagctcatgcatttgtaacggggagaggaagggcctccgagtcatttcaagagttccgggttatgggctcgagccacagaccccagtgccaggatgtgaaggcggggcaagtgagagtttgaggctagcctgggccttaacggcgggagggcaggggggggggggatttcagtgtttaaactctgtggctgcaggaaagggctggcatccatacaggttcacaacctgttaaaatggggatgcctgtgttcaacggcagcactgagcaaaccccacgcagccaccaatttagggaagctgcgtggggtgccattcggatgtgtttgtggtgttaatattgaaatcatcctaaaagtttaatgaggaagagactaagtccttaacactcctccaacagggaaaccagcagcttcaatgtcctgccgccttctgcctccttagctctgcctttctctgcccaatgggagccatccccttgaagaaagccaggaggcaggctcagcccagctctccctgggcatgcatcctgtatgccaggaaagacagaaggtttgtctacacacagcctcccgcttcatcccctttggagctgtgggaatagaatcctataaaccccacggatctggtactggctgtaagcaacactcctaagtcctgggaatccggggcagagaggcacctcttttgttcattccaatgtcttggcatccttatctctcctctttttctctctgctcactccctcccacaggctctctgcactctgctgcacaggcctgcctcgcctcttttgtccactcattttcctctcttctattttctctaccctactcttgagaaaggctggggcagccggcctgagctccagccagggctgatcttttcttacattgcacatttacaaggttgcttccacgggatacgagccgtgtatcctacatataattctcctcacgtgcgaaaccagaggctcagaaaagtcaaggattttcaaataggtcacacagctactgtaccaccctcaatttctatcacttcttacatacacaccgcctccattttctattttaaaacaaaatatttttacgctgtgcatatttgcaactcctcctcaccccgtatattttaccttcaaatggaaggctggaaaggaagaagggtatggtgcccgaggaagctttcttattccaagcatgaagcagctgaaatgtcagtgctgatgaagatacagtgaatggccactggaaggacccatctttcaggctaaaagctctgaagcccctcagcagcaatactgatggagcaacttaatcttagctcatgccctggaggctaggggacatgactaggaacaggccagtcctccagcatctcagtttggggatgacgtgtgtttgttttgcttaaagagagactttctttactgaaaggctataaaagccacagaggttccaccacgatgtgggtggaaatgcctctgaattttttaagaaataaacatgacacaaatcccagtgcttagatttgtcccatttcgggataatgtgatttaggcaggctaagagggtttaagttactgggaaataacttacacaatgtctccagaagcgtttagaacttggcaaggtttcttcactcctcatgcgtatgcacatatggaaaggtgaggatgccaatggtagcaagagctcagatccaccttggagacccccaagagaaagaagtgctgtccagcttgacggttcctggacactccccagtctgccgtgttctacccaaacatgagtttcaattagcaggtttcttgtcaaggtgaaacccagaaggtttatggagatcagcccagccaatccctctagcactgtgagataatgcacaaaaacgctattgcctgttgcagacttctttggcagagacagctcatgggcactggagttaccacagtggagttcgggagcaggatgtgatatagccacattgagatgggtccttaggaggaccttgtgggacagtggagggcagaaaggtttgaggcagctggtcttgccaaagaaggggaaagacaatgagacccccctctgtatacgagctatggatctaatgtttgtcaatgaaacatatctgatgaattttaatttcacaagtacatagtttgtaacaaatgtcaaagtgtaaatgcttaattagtgccaatgtagcagtagagtgttgtgtgaatgagaagccatcctgagggaaatcaaatgctgattggtccattagcactttgggtggaaggtggacatggaatcattgtacacagtgatttctgctcactgaagtccaaggtcacaatggatctgtcatagagacatggaagaacttggctcatcgcgagagagaattctcagggaggtttgtgttcaggagaataggaacaagatgaaggaagagtggctccagtgaccaagaacctcttcttcatcatctctgggagccagaagttgaggctggagcacccctacccagaagttgccctgtttgttccatgtctcaagatgaaaacttccatcgttgctcatttccctcagctcagtataattaccgtggccagcattagcatggacgtgaagatttattcaggagcacttaccataagtacgattt

SEQ ID NO: 727 - DNA, 2050 bp, Mus musculus
aagagcagatatgaaaagcaagtcacatttacatgggtccttgattgacaggcccagattcaggtttgtcttggtttttgtccttccctcaatagagactggaatattacaggcatgagaacttatagcacaccccatgacctaaaatcatctcggagagagaactgattgccagctactatacagttcctaactctgctcccatactatctagaagtcaaaagaaagaaagaaaattcaatgccatgcataccttgactagtatcaaacatctattaagaccatggttagaatgctcagtcaactttggagaaaaaaaaaaaaaaaaacaatatggcacaaggcgtgctcttttgacccgtgaagaatttagtcctgcaagctgtttcatttattacacagacactaagaatttgtacagaggaaaggtcattgtctagacaacttttcctcttactctcaactcaccaccaaaaatttagttcatcttattagaaaactacaaataggaatccaccaccatctggtatacaactacgtattctcaatatctgaggaaatgtttctatataacacctgacgataagtgccttggtcacatttggtggacacagaatgggatgcagttctgtggttagtaacttccttggtatgcatagggccttggcattcatcccagaccttcagagctttgaggatttcttttttgagtcagaatcttactaagccctgactggccttaacacatgctatagactaagctgacctcaaaggtgctgggattaaatgtatgtgacatcacatctggccattgatggttcattattaaccatactggtgacagtcactagcattctctttctaggtattgtttgagctcagtgatagaaatagtgacctgtagtagtgcacactgatcttcttattgctgaagtgagtgatgaggcctgcgtgagtgcacccctgtggcaatgggaagctgtctacagacaacagtggtgtttgtatatgtaaccatgcagctactgtccctgctttatgccttcgccactgtgcagcactacctcgtgactatgtcctctgcccccaagcactggcttggttccctgtatcttcttctagtttaggaacacaggaaaagggaattttctttacttaccccaaaatcttactcctataaaaaaaaaaaaaaaaaacaaccagttcttgtatacatgttctaccagacttctagtttgaaagctctatagactatgattttccccattacataatgcagatgttaataagaatgagattaacgccaggctatgctatttaagaaaatgtccatgaaaacactcccttcctcacagctagcaaaggtaaggcagtgcacactccatgtatttgatcgctgcctacgcagcacttccctgatatattaatacttctgcaaagaaatacagaaatagttcaaccaagtggaagaaatgtgaacagcttcactttaacacagaaagcaatgccatgcattgagttttaactgtaaagacttttgataattacttttctggctgtcagaatttggaataagataccaagacctgtcttccctagaattatttctctggactacactaacagatacatgcattatatcttaagacagctctagtgcaaccatcaagaaaattcaaaaggaaagaaaataacctaggcatttaagggatactcagtacgaatggcagaagtaacttttgcattcaatgcaaatgtactgtgagtgattcatggaaatctttgaattggctctatctagtgacatcatggttgggagacaagcaaatatttgatatttatatgctactaatcttacctcctccatccaagtttaacaactcaactttaaaagatttttccagttcagggatggaattatcagtgatgttgacaaatatatatttatatctttctcctgattgaaattctaatgtgccagcagtgctctgaaacataaatgagagttatcaaccacattacaattattgtgtatgtaaaactgcaaaag

SEQ ID NO: 728 - DNA, 2825 bp, Mus musculus
cacacgcgcacacgcacacgcgcacacacaaacgcacacacacaagcacacgcacacatactcacacacacacaaattgaagtgaatcgactgattttgaattgtacttgtttttgtgaaattttctcgtttttagtttttttttttaattagatttttttaacttacatttcaaatgttatcccctttcctagtttcccctccgaaaatcccctatccactccccctccccctgctctccaacccacctactcccattcctggtcctggcattcctctatactggggcatacagccttcacaggaccaaaggggggaaaaaaacagctagtagttttctaaatacaaatactaacaaatttgctcactgcaatgcttatagctgccttcgctattgttataagatatgaaagacttaattgcttgtagttcttttaaagttgattaaaaataaaaataaaaattgcagtcatacatttcaatgaggatcatgatttaaaaaaaaaaaaaagtacaattgatccataggccaggctattacaatattaccctaaaatagtgtaaaatttttatcaaggatattccaatccaccactgcagctgattttctgttctttgaactgaattcaactatcgcactattcttcaaaagcaaaacaaactttacacatgatttttgactgcatgttgcttcctccactggacaggttgaaaaaataaaatggagtacagtgtcataaatttaaggtattcggagtaaccaaatagaaaccggatagaaataatagagatgcaaaaattataggatttttctagttctagttgcctggctaactcttccgtagttaaatagactagaatgtcggggtcataatgctgattttgcttcaggacactggagttagccaagtcacctgtgcaaccacagaggagccctcgtagtgcacacattgtgtgtggttttaaggagaattcagatgccagaatacagtagctgtggatagcatttatatttagtaagactgcaatgtactcatttgaagttggaagatgagtatttattgaagcagctggcaaatcagcaggaaaatgctgattttgaaaaaacgattcttcttctgtggaatcagacctactgtatttagcaacactattataattgaacacaaaaactgcattaaagtaccattaagatggagacagaaacccagaaaaaaaaatgagagaattctgagttaaaggctgtcacagcattcctgaaccagctcttttaagtataaatgcagcaacgttctttcaaggatgacatgaaatggtcacagtcaaatgcaatcaggattctttcccagggtgacctaatacagcccatctatctctgtactaaggagtatcagtttcacccttcatggaattaaaacacctgaaaattagatgaaatacaaatctcagcttaccaggagcagagtctaacctttccttgaaatagtctttgggttgatgggaatactctctaatttcaatgaccctttagctatcacttagaagcacagaaatggacttttataaggatataagggaattaggtgtttctgtaaatattattgttcaaatgagaacattgcaaagttataattcatacaacttgcctaaagttacacaagtatttctggggaaaatcatatcttggggccttgaacccagtatccttccaggcacacctctgtactgcatactactgaggtcttccccgcacacccctggactgcatactactgtagtcttccccgcacacccctggactgcatactactatagtcttccccgcacacccctggactgcatactactgtagtcttcccagcacacccctgtactgcatactacggtagtcttcccagcacacccctgtactgcatactactgtagtcttcccagcacacccctgtactgcatactactgtagtcttccccacacacccctgtactgcatactactgtagtctggcaggggctcatgttctgatgcatgaaataaagacagactttgtaccaattctaggctgatttaaaggcaaccaggagggaagtagctataaacagtgggacattttgtgaagcacttaatggttactattttctcctcctgaattttataatgacagcagtcaagtaggatttatccacctcccaagcacagccaaggagccctgtgtcaggccactcttcagagtttccagggcaacaggccactactgtaccttctgctgccctagacaggtcagggaaaaaaataccatgtaaaaaggacaagtgtagacccatctaaagtctcctcgtttatattagttctgtaccttaatccagaagtctatctgaccatttctttagaaacagactaatagttttcctcatgaaagagtaagaaaatccctggaaatatacctgggcttccattagtcaaatagcctaaggtgaattatgtgcttgctccaataggttctggaacaagtattgtacaaagtgtatgaacttagctattaatagctttctgctggcttggatgacgtgaggagagttgactttcagtttgcctggtgggtgtgtcagtgtgtagacacagcaattagatcttagcaccagccagagctcagaaggtaaagaagaaagggcaaatgttccaacgggctccatgcttgcctacacctctgttctttgaggaccgtttcatttcttatactgcagtcactttatgtctttaaagagctttaaattcattggctataacctttttcattgcccttacaagttttgtaggtaaaacaaga

SEQ ID NO: 729 - DNA, 1925 bp, Mus musculus
acgctcttgaggttttggagttctcatctcaccatttactttcttttaaatatgaaataaacaaaacaaaaaatacatctaagattcttttaactgatatcctaaaacatcgaaatctataatgttcactatgagactataaaatcctagctcccttttcaaagtcaagtttaaactaaaaccttggcacctataactgaatgtgtgtgaaccatcttctctacgtacagtatcgaaacagctggcaaactaaggagaaaagtgagccttaacaacccagctcagaccatcacaatcaaaatgcctattaaagctaaaaccgtaaacttgaactatataaacctttacaaaaagaaaatataaaagtcttcatgcttctagaataggcagaactcagatacagaagacctcactaaagggaatattgatattaaaatcttttgttcttctgtgttcatgaaaaattaaaagctaagccaaaagcttggaaaaaacatcagaggggggagagggagaaggaagagagaagaagaggtagagagagagagagggagagagaaaaagggagagggacaaagacagagaatgtgtatgtacgcaggcatgtgtggtaaacatttgacctagaataattcctacaccgcaacacaagcaatccaagagataaaatggacagagaggacacatggatgaacatccagtaaatacatgaaatcactctatccagagagaactaaattaaaacccaaatgtgaaatcacaatttgctcattacagtgactcaaagtgaaaagacacaatgggacaatagatgcgaatgacaagccacagcactcacacactgcaacagacaagctacagcgcccacacactgcaacagacaagcaacagcgcccacacactgcagcagacaagctacagcgcccacacactgcaacagacaagcaacagcgcccacacactgcaacagacaagctacagtgctcacacactgcagcagacaacacacactgcagcagacaagctacagcgcccacacactgcagcagacaagctacagcgctcacacactgcagcagacaagctacagtactcacacactgcagcagagaagcaaaactatggaattactataaagaatattttttgttttgttttgttttgttttgctttgctttgtttttcgagacagggtttctctgtatagccctggctgtcctggaactcactttgtagaccaagctggcctcgaactcagaaatccacctacctctgcctcccaagtgctaggattaaaggcgtgcgccatcacgcccagctataaagaatatttttgttttccacagggatgaatatatatgtttacctacctaacctagcaattccactcctaggtctatccaaaaaagtatgtctgtgagaagatagagcacagagggtagtcttaacagctttcctgaaaataaccacaagctggaaacaacccaaggatttggcaagtgaaaaatcaacaaaccctggtatattcgtctaaaataaaactgcacaccaattaaagagaacaaactttcctcccatacattcaacacaactacacatttctttgagcaaaggtaagaaagtagacatcaaagagtccacactgtaatgattccagttgtgtgaaaccctaaaacagcctgccctgccctgctctctgaccccagtgatcatatcatcaatgttgtagtgaaggttggagataaagagaggagccagagagaggcagaggaagtctggagagaaggcggagctttacccgggatgatggctgcaggatgttacactagcagtgactgaaacaaacttacaatgtgcaaagcttactgcatgtaaaccacaactgattaaagctgactacaaataaaacttttgaatctgctgta

SEQ ID NO: 730 - DNA, 3275 bp, Mus musculus
acaaatcccaaagaaggctgtcttctcaatctcacagaatacaccatcaagggttgcatggccagtgtctactcatctatgaagtccaatgaaaacacccttacaccacccacgatgtctcccctccacatccattttcatgaaaaatgtctcctctccgcatccccgtttgctcacctatccagctccagccctctgccaagtggattcccatcactgctcctctcctgctaaggccagcagtgaccccaagaagacaaacggtcttgtgtcatcatctatggcttctcagcacctggtagaaagagaacttcagatgctttgtcccttggggtctcactatgccaagtgcacttcctgaatctccttgggagcctttgggagccgctcctccaatggaacacctaaggacagatcccttcacaggtctttttctcttccgtaggatccccacagagatgatttcattcactgacgccttccattagtatcaccatgtgctaatgattcccagatccctcttctgagcccagtccatctaattaatctttttccctgaagtctcacaacagcatgcagtagttagcacagtatgtgctgcaaaactgaaactcagcaactaaaactaacggattaacatgcttacaaatcctactgaaaacataaatgtacagagtttcctttcctttagaaacttagtaattttgctcatagtacggaatctaataacattgttccctgtgggagaaaccaagcattagcaaaaccccatctcaaaagctcagtgttgttttggatccagtctagttctgcttccagcactcactgtaccaggagactggatcatttgctcaaggtgggcactatgctgccttttcctcaactgtgacccttccactgcacgtattgagactatgaaacttaattgaccttgtccctagttaacctcagaccctcgacccccagctctcacactgtaacttcttcctaggtgttatataatctgcttctttagccttgctcttcagagtgcgacacctcgctcatctctagataagttcacctcgatccaggaggctccctgccctgcaggagctcactcttgctacagagtcaggttttctttgctgtgacctctgcatcacctgtgctactccaccttttccacttcctccagatgttttgtcctcaaatcccattctccatgaacttacccatcccacctaatataaatgtgtattaccttgtctgccaaccctagaacttaaataagttattccagctttatatatgttttcttaaggcctacaaatgaccctccatatctgggactcctatacctatagattcatcatacagcagattgaaaatatagaggaaaattttctttaaataaaatgtctgacataataataaaataataatagaagcatcaaaccagaaagtttagttgccatgacaaccacattcccaatttgatgctaaggctggcaaaaactgaaactagaaaagaaaaaaataaaatgtcatggatttatggcataagtgataaaaaattatgcattctggaatccaacagtttgttttgattctaactgtggttcgtaaccttcaaagttaactcctcaattctgctctcttcctatctccattcccaaagcaagatacatagaaataatatttaaccaagaccaagcactgggctggagagatggctcagcagttaagagcactgactgcaggccgggcggtggtagcgcacgcctttaatcccagcacttgggaggcagaggcaggtggatttctgagttcgaagccagcctggtttacagagtgagttccaggacagccaggactgcacagagaaacaaaaagagcactgactgctcttccagaggtcctgagttcaattcccagcaaccacaaggtggctcacaaccatctacagtaggatccaatgccctcctctggtgtgtttgaaaaaagcaacagtgtattttatgtgtatgcataaaataaataaaccatatatatataaaaggaacaaattccaaaaacaaattagaagttgccatcactataccaaagtagtttgagggcaactcaacaggaaaggagccttgcaggggtctggacttacatctacctaaggaaagtacagatatgcatgtgtccttctcacagatgcagaccataatgtgcctctgtgaattgggctttccctggtggtcgaacttgacccttgaacaccaccacagctacaactcacagctaagcttaggtattaaccagcctggatctcactctgcaagaagagccagacactgacaggtgctagatatgggggatctgtgcaggcttgagttccttatttgggtgagataagccagacgggaactgttggcaggacttggtcctagacaattttcgtcttcccctttgctcagggagccgctagcctttcatggttagctgcagaaacatggcgcccatccatctcctaaagggatacccagaatcctcacccctgaaatggtaagacctctcttacacagcatccccgagactgaactcctgatgtcctccttcctcctgtccagcctactgtcgagtcactccttgctgtttctgctactgtcccggacttacgctaaccttcctttcctctgctgtggcctctcaactgacctccagcttctgttcccatctctctcaaactcattctccacccagaagccagagtcattagtaatacaaagagggccatcggactcctgtctgcaacctgacaagggcctggcataaacatccaagcatcttggatttcccagagtccatcactcatcctactgtcaattattaaagagtccttcccctggccttgaacggcaatgacagacacatttattatgcatgttagtatgcacttataggatatctattttagtcttgatttaccatgctataggaacttcatgcaacttctgatttttatattaagatctatttgagcttattttcattaactcaatagagaattttcatgcagattttcacttgataagttttcaggagtattttttacaagatttattatttttttattaggtattttcctcgtttacatttccaatgctatcccaaaagtcccccatacccaccccccccaatcccctacccacccactccccctttttggccctggcattcccctgtactggggcatataaagtttgcaagtccaaagggcctctctttccagtgatggctgacta

SEQ ID NO: 731 - DNA, 2900 bp, Mus musculus
taaagaaaaggatatgggcgaagggatttttgcgttttgcttgcgtcctggttctctgccagattcttctgtcctgttgcggtagcattccttcacagatactagaagcaaccacctaggccttccgacataaacagcacagctctccaggactcctccggccttctgcgctcaagggggactgctgagacatccagcttcatattttgaacaaggactggccttccagtgtgagacggcagttgctggactacccagaccatggtgtggaaggtaatccaatgaataccctttcaaagtgtatattcattctatcaattctgtccctatacgagaaccctgactaatacaacatggtttttgcactatggaactcactgtggctgtgattacccacacaagattggttccatcagcagcctgtcttgcaaaggggtggggcttgccaggctccacccctttctgagaatttatgcacagctgacagttgagacaggacaggcattttcttcaaccatttaaccacagaggaggtgcctctgctctcatcaacaaactcctccccacagtcctataaccaaccttaataagatgcattggatcaccaaaattctgtcttatttattcctctctctctgtctctctgtctctctctctgtctctctctctctgcctctctctctctctctctctctctctctctctctctctctctcgtgtgtgtgtgtgtgtgtgtgtgtgtgtgtgtgtatgtgtgcgcgcgcgcgtgtgagagagactagaataaaatgtgctatgcatgggtataaaaatataatgaatccattatcatgtataattaacatgtattaataagatccttcttttaaatcctagtattcaagagataaaggccaaagagcaaaacagtctttaaaacaaacagacaaacaccagcagcacaaagcccccgcccctgtttgccatgagttagagggttgcagagagcccccgccccacgcttcagcccagcttaggttcccatgcctccatcagacacctcctactgcaccagcagaggttggcacacaagcacagtgatgaggagaagtgatgggggagggggggacggggcactctgccttaaatgagcagctgtgtcaacctctcaagaggggacagaaagaatgggcgggcccaccaacacctccccatggatggaggagaggatgatgaagccacactctcctcaaggtactgtccaaaattgacagtagttgaaggaagggtgtcggtgttttcaatggtatagcccttgctccactgaaaaaaatctcccacccacgtttggacaacaaactaattaaactcagtgagccacacacacaaagaagacatgcaagtgggaggggaggcacgagaaaaagggaaaatgaaaataatttgcctttattatataaatacatgagattgctaaacaatttttaaaattatagtcctcttatttccctaggtaaaaagagagcaaggaacttttctttcagtatgggggactcctaagactggacacacagtatggctcctttccttgtggagagagacaagccaccactggtttcagactgagccctcacccccttcctgtgtggagagggaggtggccctctgcagagaatggcgggcctgggagtctggccagtgagggaggacaggcttggctccgcaggggatcagtggcctccggcttagctgcatgcgtcataacatcatccaggccatgccccagacttgccctctcccaatgagctttgctgatgacactggagcaaagcctacacacacacacacacacacacacacacacacacacgagagagagagagagagagagagagagagagagagagagagagagagagagagagagagagagagagagaaattgtgcccagttctctgctaaggaacaggtagggggaggctgcctggccactccctgctgcccagacattcaaagagtccattgtttttaacctaaagcaaagcacctgcctggggacatttttttgattattcaggcacaaacacagtttgtaaagaagcaatattttcagttaataaaagtgcctactgaactcaggcctggctcaagatttgtaggtccctgaagccccaaccctgcttgagacaaaagcaaaagactgtctggtgtaggtggtgcagtttctagttattatgagttgaggggagttgaggggggaagggtgacagggcccagacttggccggtcacttcttggataaccactgagctccgaggtgggcccagccccatgttctgcaaaaaaacaactcagttcccattgactgctttcacctctcacaagttcaaaacctcccagagcagctgagtaagcccctatccccaccccctgttcctcagctccccccacgctacaagtctgcaatgctagttttaatagatttttctcctgattttcaatagagactggaaaacagggtgaaatctttttcacatttaagtaccgattaacatcttaaaaaaataagccttccccacatctgtataccacttctgcctcaggctcagtgagggcagtaactaagggtaaggtatctaggagccctacagaataagcctgccctacccctgcatgctgtgtgacactggctacttatctaacctgtctttgtcttactccctcatgcttaaaaagggcatgctaaagcacactgcacacttagatgagaagatgtctatggcttcataactacaggctactatctttattggacacctggtctgctctcccaggagtcttttttgacagtgtcactgagagaggaacagtcaggcaatcaatgcctgtgctggctgcaacaggaagttcatggcctctt

SEQ ID NO: 732 - DNA, 2000 bp, Mus musculus
aacgtgccgcaggttagctcatctgtgtagggagcttcacctgaagcactgtcctcttcagacctgtgtttctccttgaaatctactcacacgcttggaattacctcaccctgctccccccacccccattctggacacatagtttccccacgggtatcaggttcatctaactgatcttaggggcctgtgacatagactggggtccctccggaagagaatggacattctccatcatcctcactttcctgatcaagggacaatggctctgcccatctaatcaagcaggatgttacccttgtaatttgtcctcaatctccctggccaatcttcaactattccctgttgactttatctaccaaatatctttcatttctacagatgcctccagagtttataattatccatcttcctctgacctagtataatctttgatttgcccatctcaccaaaatcctttctctttctttctttctttctttctttctttccttccttccttctttcttttttttttcttcaagtcagggtttctctgtataatcctggctgtcctggaactcactttgtagaccaggctggtctcgaactcagaaatctgcctgcctctgcctcccaagtgctaggattaaaggcatgtgccaccactggccagcactcaaaatccattctttttttttttttcccccaaaatcctttcttaatttaacagccgaagtgatttttcttaattattaagagattccccaggtagcaacttatgttagcgcccatctcaagactgctgaaatatcttatcttgagatgatgttgaattgtatcaaatgactttgacagggaacttacaagatcacctaagttactgaaaggaaatggctgactgggaaaaagaacagaggaaggcagggttatctgaaacaactgggtatctcctggcccagtgcaaggggccattgactcctgatgcagaggcacctgggcatgtactgcatcccttgacgctaggggtgcaatctctgtgtgaggctgacaacaggcacccattcgccagcctgcagcatcttggagtttctctagagagctgatgcttttctccattccctctgcctggttgccatgacaatataaacatgacacaccaacacaaagctgagctgcacatacccattgtcgctggcagcccttgtaatgagctatgaagttccaggtgccaagcccccatagcaaatttattcagagaagagttaattggacttgacgctctcattatgaaccggtgtttccctgccctttcatttaggccacgggttgcaggtgacaggtgtcacttcataacttgactgtcagtggcatcttctattttgatcctatagcacttggctctactttaaaatagctcttgattttgcagaattaatcttaaggacaaaagactgccggtttaacaattaaaggcattgtgacgtaacaaaggcagtaaagtatggtcatttccattttctcagctttgcaccatatttccattctttttttttcaaaatttatttatttattttatgtatatgagtacaccattgctctcttcaaatacacctgaagaggtcagcagaccccattgcagatggttgtgagccaccatatggttgctgggaattgaactcaggacatctggaagaggagtcagtgctcttaactgctgagccatctctccagcccccatgtttccattcttgttgccttcacccaccataccatctatgtgaaaggatgttcaaacatcaggatgtgtcatacaaatcgtgagcacccagctcccagtatgacttgcaggctcattcagagattctgatgatgccactggctcatgcacacctttgcagtctgacctctgacactatgtatctgtcagtaaaaggacagacagtgtaagacaggagtcttcttcctgagaccccagctcaggcagagaggcaggtaagctgagcactcatcagagacttggg

SEQ ID NO: 733 - DNA, 3050 bp, Mus musculus
aggacacacctctctgtaagctcatctaatttgattgccataattcctagtaaagtcatgttcttaggtactggagattaatatgtctctttaggggaggtattcggcctggaattctgatggaatatatatcacagaaaactcacagctttaaagtacatcccaactttgtgcaataactacctgaacctaaaatatttccatcactccaaaggaaacattttatcactcctttgcccgtgaagcagctagtcctagtcacgtctcagccatttggtggacaccatgtgaagccgttgtttttcaccacctctccccagcccctggcagccttggctctaccttctgtttctgtgaatttatttattcttttcttatctgttattacatatgttgtatacattaatatgctgttttgtttttgttgttgatctataaaaataatttttatattctgcatactagacccttaccaaatacataatttgcagatgtttccaattaagatttactgtgtaggtttttccccattttataatgataatgtcttttaatatataaaagttttaaatttgcttaaattctaattaatctgtttttctctcattatcatatctaagactccattgctaagcacatgctgagaagacttcccctgtctttcctctgaaggcttgtgatgaggtcactgacacctttggaattgttggtagtactgtgcgtattactagatgttgagtcctcgaactgagaagtcccccacctcagtaatatgctctgttaaaatttactttgtaaatgtaagaggaagccgtaggagacagtcaggtagatgcttcctagaggagtctgcctttcagcacatggaagggttcatccaaacacagggctgactatagctcagagtcctcaggctttcaagagcaggaagtagttgatggttactcctaagccagcagttgtacttccatcttagaaccctgctctgcactgtattcagtactcagtactcagtacagccaccagaactagcagtggcctaaggtacagtttgctctacttgtcttcaggctgcagcagacagtggattagtgggcagctgacgggacagcaaggaagtgatggatgagggtatccagttcttgttcgccttcacggtgtggatattgcttatggtgattgcattacatcaccacttatgaaactcaaatactagactctcagccatcagctgctcagtagttcagctttttaaaactcctgttcttgaaccaacatgatggctcagtgggtaaaagtgcttgccactaaacctcaggacttgagttcagtccgcaggatccacacagtagacggagagaactgacttcaagttgcccctggcttccacacgttatggtatgtctgcatacatggctgcacacccatataaataaatacatgcagtaaacattttttaaaaatatgcttcttatcataatatagtacaaaaatgcaggacaactcctggtgcactcagttggtggtggggttttgttttgtttttcatgaatctctgggaggtttttttttgttttgttttagctgtttcagtcaatttttgatcagcgttattgtcacaacatgaagtagttttcaggaacatatgcaagatgccacttaagtgtagatgatttagttaattatagcaggaaatagcctgaaacttggcattttgttgtcctggaaacagcccagcatttcatgcatattttgagtgacctaattacttagaacatcctgaataactacttcacccttacttcaaatgctcttacctggtacatttttttattatgtaatgatttttactctttttcaaccagtacccatttgcagtttttagcacaaaaataaaaatggacaaaatataatgtctggtagctgtagcacagtggtgaccctctcctctggttacaagtggtaagcttttctccgtggtccatgttgtacagctgtcacccagaccccagcagctaaaaagagaatgtgataatcttgaaggcctgggtctgtaactaaggcaacaaggaaactggaggctggtgcctgcggacagggtggtggtgcctgggggggggggggggtgatgcctgtggacggggtgtggtttaggaggtgggtagtgggcgggtcttggaaggcaatcttggatcttccagcgtgggttacacgggaccaaaggcttagatttaacagtgaaatcatccaggatgtagacatgcaacaaggacagagtttctagaatctagaatctttgtcttttttaacataatgtgaatgtcaaagataaccttagtaagaactaggtttgtcctaggaattataaattcaaatgtagcaaaatgacttacagctaggtcaaataataagaaaaaaatgaggaactacttaattatagtattggtttttcattaataatattaagaaatagttgtaaactgtcgatcatagggatataagcattgcaatgggggaggcaattctaaagaaaggccagtagctaatagtgtgtgaagtagttcagccttgcctgtgactgtgtgagtaaggagtgtaatggtaaagactcagcaatgcatagttctcttctcgtggaggtaactgttcctctgccccaaacacaccaccggctaaacactgaaattgttaagttttaaaaggaatttgccctataaagaaatagatgcataactcaagaaaattaactgtagttttgtttacataataaaaaaaactgggaacaccataaatcattaaataactggtcaagtgagcaatgtaacaccagctctgagcccacttattttttacttctattttttttctgtaatgattagatttacataaaattattagatttatttgctcctcgcagggcatgagagcagaagaccccctccacactgtctgatggtgctgtgagttcgttggtgagctgagcctcccatcagactctccctccctgaaacaccggggcttaagagttgagttccaaacccggcatggtt

SEQ ID NO: 734 - DNA, 2850 bp, Mus musculus
agatttgattttccagatatgacaggacaggtgcacatatgacctcagcaattgtggcagcttgcataaggcttttgaaagctccagccagacaaaatcccaatatacatagggaaggcagacttgtaatcctgtgattaactgaagaactatcaacgtttaatagctattgggaggagagttagttttctttaatgattgcagtttctccttttaaaacggagcctccatgtcttggttaggaagtgaatacttggggagaaatgagaatcctggttaggggtttgctgtgagttcggttgacttctgctgcaagaatcttcacactaactgtgtgctttttttggggaggaattttagacatctactatttttaatttaaaggatgttgttctttggtgtctaaatggtgtcggagttctcagggccttgctcatgctagccaagtacttcagcttattttttaagcagtaagtttctagcccaacatgccatgaaatgctatagcatatcagcatttatgaacaaccgttgaagcaaacaggaaaggccctttgttgacagtggtggccagataagtgacagagaagaacagggagaaaggagtaaccatagaataggaagcagtaaaccgtgccctcagtttatgaagcattccaggagcagttagtccagtgtgcaggcagcccgggggcccaccgtgggctgggctaggtagccaggcttgcattgctaacagggggcagcgggtccagggaataggctttttagagctttgcttattttacagcttggtgagttattcacctctgcgtttcatgaggaaagtgcttctgcctttggaacgtgtgagtctgagctttctttgcaggctttacccggctctcctggaacatcgtgcactgggtggctgtactggctggttttgtgtgtcaacttgacacagctggagttatcacagagaaaggagcttcagttgaggaaatgcctctatgagatccagctgtaaggcattttctcaattagtgatcaagggggaaaggccccttgtgggtgggaccatctctgggctggtagtcttggttctataagacagcaggctgagcaagccaggggaagcaagccagtaaggaacatccctccatggcctctgctttctgacctgcttgagttccagtcctgacttccttggtgatgaacagcagtatggaagtataagctaaataaaccttttcctccccaacttgcttcttggtcatgatgtttgtgcaggaatagagaccctgactaagagtggccaagactctagacaccctgtggtcagttacagttctccccctcccctatgtgggctcttctctagcagttcccacagaggttgctttgcagagtcatctgagaaagaagttgtggctgtcagtggtggttaaacactgctatcaaagtttgcatgcattgtatgttccctgtgtcctggtcccttctgtaaacgttgtcttcatggccccctgaaggagcagaagagtgaccttgaagccgagtctctctccaccattcagatgccctctccaccattcaggatggctctgctcagagggtgaggacattgcagaaagggaagctctctccaagggcaggactttttcgtggaggcacgtgtgttaggggaaccaaggcctctcctaggtggcattggcataccttggctaagatttctttggaggaaacaaacaatacagagtcagcaaagggaggcagcgcttgggtggagcccagtggtaactgggtcagctctcgagtgctttcccagtgaagtcaagagtcagttggcccagtgagtaacaacatgtgacaacatgagacaacacatgcaaagcagattctatcacgaagctcattagttgctgagtggtcaagctatcttcagggactcgtcaggtaggcaagcactctctgcctggtaaaaatccaaatcccagactcccagaaaagcaggagtccatcacagaccacgtgacactaacagtttagacatggtgagccccagttatcatttggggagtattttgagccagggtagcaaactggttaatcggctgttcattcctgtgaactcttacgagcaaagatagggctcgtgtacttggataacccatctgtatgcatatgaggggaaagagtcttcctggccaaggaatattccagaacaaatataatcaatctgaagtaagcctggcatgaaaaccccagagcggtgggtgggaggaaaagaataataaatattagctccgtgttgagagttgatttctgagcataaggatccctcagcatgacgcaggtttgttcttttggtttccagagatactagtaggtggcagccagcatttctgagccacacccctccatccctcacgagtcaggcgcagctataaatgtaccacttaactgatgaaatgattcctcatttaatccttttcatgattcttgtaatcaaaggagggttgcaataaatatttgaggcaaggaaaatttaaggcacttgacaaatgacaaagttagcaaaagtaggatttgagcctgggtggtctgagctcagagtccacacctgctacccatagtgggaatgatcaggaggttataggtcctatggtaccaaaacaatattttaaaatcatgttaagtgaaatagaatgtgtaataccaaattatcttgtgtctaacacacacacatacacaccccacatggacagtatgtaaaatgtgttaattactttggctaattgaaaggcactgcaagccatgaaactaacaaagctagatgtttatatatatggaaaaatgccccctcca

SEQ ID NO: 735 - DNA, 1925 bp, Mus musculus
tcaattctcatattaaagtctccaaggtcacatggctgtgctctctgctccttcatctcctccgcctggtatatgtgaagtggtctcgcagagatttcctgctaacagcctttggggaggaagagtccctgtagaagccatggggatgataaaacaaattggactttcttgttttcttttttttacttcctggaggttgtgatgcttgagttacataaatgttgaggggagggccagggagatggctcggtaggtaaaggggtttgtagtttaggcctgaattcaatcctgaaatccacagaacggtgaaaagagaaccaacttcacaaagttgtcctctgaccttcacatgtgtaccatgcctctctctctctctcacacacacacacactaataataataataataataataataataataataataataataataataatgttctaaggagaaattgggatataattttctatcacttattttcccagaattctctttaaaacattctttttataattcatattttacagaggacaaagctaggctgtggacagccccggtagccaggtctccaactactgtctatccctctagggacctcagaaaccctggtgtgcttagctgctttgcaacatgaagctgggtatcactgctgctctatgctgaaaggaaaagagcactggacagcaccggctgcagaaagaaatcactagaagtatagcatgaaaattcataggcgggggggggtgggggggtggggaggacaaaggtcacagtcagctgtcttacccatgctagcatgaaattttaagctggtggggacggcgacaaagcaaaaacactttaggcacagtgagcagagcaggactctcttcgagaacaaaagtctctgccagacaatcctcccatttaaacctgatctgccaaaccggctccttctctccagttccaattagcagctaccctccctgcaccagacatgctgaatcactctccagtgccacgccatgcctcataaagctttgtgcacatctaatcctctaatagcctggggtggtattagtgtcacagtagcaaattcactccaatttggagctttgttacttcactgtaagaaagtcagcagccttgctgaagggaccacagactatctgttaaccctttctgatctcaacttccacagctgaccgaggaaaatcagacttctcatgaacaaagtatccatggatatatatatatatatatatatatatatatatatatatatatatatatatcttcttgcaatctcagacacagcctgaatacagtgtggtccaggggtctgcagagaaccagttacttccaggaatcagtatgggctctcaaacctagggacgctcaagtcacttatataagcaaaataacatttgcatacaacttctacatgtcttcctatatgcttcaagccatctctggagaatgtatagcccttcatacaatgaaaacgccacagaaatataactgccggcacactctattgttcaggaaatagtgacaaaaaggaagtcacctcgtgtgttccagtcaagaacaatctctttcctcaagactttgcaattctggttggtttcagctacagatgcagaccaggcagacagaaaaggcaggctacccagtcactcactcatcaagcgcactgtgaatgcatccgaaggcatccaaggcactctgacaagttcaagctagggagaggtgaggcccacagcttggatccccaggatgcacctgcatgtatccataaccccagggcttccaggggtggaaacagaaaacaggaagattattgtgatttgctagttgtcagtcaaggtgaaatattgcaagttccaggttctgttacagactctgactcaagggaatatggtggagggtgatagagg

SEQ ID NO: 736 - DNA, 3100 bp, Mus musculus
ggcacttctagtcctccctgtagctgataaacaccccccttcagcattcttgagttaatatattttaaaatctatatttcatctgggctatcccagacgcaactgagaagtggcctctagggccacttttctggattcttataccagtgggcctttaagtttcatccttttccttccctgtcatgggaatttttaaaaaaagatttacttattttatttatatgaatacactgtagctgtcttcagacacaccagaagaaggcatcagaatccattacagatggttgtgagccaccatgtggttgctgggaattgaacttaggacctctgaaagagcagtcagtgctcttaactgctgagccatctctccagcccttattcattatcaatcaaaggcagttgagagcagggtctggaatcatggtttttgagagctgaaataagacagggcattagaaccaatctccaacagtgtacagctttcatcttgttctactgaactttctagatatcccatcttaggacccaactgtcccgttggaaataactagtggagaggccacaagtaggtcttccagtcagtagtcccagccaaagtctagccttcatctgtcctctactgaacactaaaaacatgtaagaagaaacttccagatcattgcaattgccagacttttagtcattccccactcatgtgaatcttcccagctgaagccacaggtatcatagagctaagtcacagaaaaaaacaaaaacaaaaacaaaaactcgtgagtatgaggctgtggttctggtcttctatcttttaaatttggagtgttttgtaatgcagcattggtagcaagaacacatgttaaagaagacataataggcagctttgttacgggataaagacctgtgagatatcggttccgaccctcaaagccaactttttaggggggatcaaggcaggagagggacagggtactctgttcatgatggctcatttctaccctttctaggtgtggatgtcacactcggctgtggttttctgctggggtctttgttatttggggattggttgttattgaaagagtcctcaactgatacatagactggtattttgccaagagaaacagtcacagcttgtaggacaattcaatctagggttagcaaaatatagcagctggctcccaccagagccacctatctgattcaaattcacctaccttgtctcttaagtggtgtctactctgtagtgcccagcggtcacatctgtggccatttccagcactaaccaaccctcctcccctaaagccatactggcaactctccagtcccgaatttcccaggtaccagtgaatattcttttcaaccaagagatggaaatggaacctgaagtgaagcaaatgttcacttttgtgggctttaaagaacaccacgaattcaattgaaaattgaaattgctcagcacaataataaatgcttaccgagtgttgttattttgcacatcaggtggtaaaactgtaactgtgaagaaattacttatagtaagactccttccccctcccatactgctggagcagcagatgagctaataaatatgtaacactttgtaatgacatttgcagtcttggagagtaagcctcccctgccttcacacaaacagaatgtacaatcatccaatattacacattttaatgcgaaaatttaagtcctataatgtcactggcatttaacattcaatgactttcctagctaagccaaaatgtgaaagaacctattccctggtatttgtgttttctctttgccagatgttttcattctctgaaatatttctgactgaaaatacagagcaattttttctttgagccagagtgttaacatgcagcccagtaatgccatgctgttctctggcttcagcctctaggatgctgggatgacaggagtgtgttaccatgcctggggtacagagcatatccttacatctttattgtcaatgggggggggtaccatagtgaatacttgattatagtctttggctgcagggagtgggccaaggtggtaggcaaggctttgtattttggtgacctccaccagatcaattctgtggctctcagtgcatttgctgggcaaattatagatggtaattttttcatgagaactagcattagaagtaggtagtctgaataatgcctagtacattgagtttttatgaatcttttgttaactttgtgtgtgtgtgtgtgtgtgtgtgtgtgtgtgtgtgtgtgtgtgtgtgtgtatgtgtttagtaagggcaataggtatatgaatgttagtatcttctaacagaagaggtgtgtactccagaggcacagacattttattttaatcctaaaatgggtaaggggtagaacttgactgactcgtcttgaaatcaacatgtgggatgcatgttgaggatcagctgtgcttctgagtcatcctttgtttcttccctcagggtgtctaggctccacttcacactgggctggaaggatagagtcaggaatgggtggagtctacaggattctggtcctactgggaataggtgcaggggtgggggacttctctgaggatttaatttagtgttatagctctcaattaaacagctgtcttagacaatcttcagtgaaacagctgtgtgcatacactttattctgggtgaccaaggactatatatgaaccttgaagagggggacagacttttcagggtgaatgtaaatcatgggctggagtttgaagtcttgtgaatgcatggagaggtactccaggaatcccaggtactttctggtcaagttcttatggtgaaggggaatggggagaagctgaacttgaaagtttgccaaggacaatgggagcttccccaggtagagggtatatctggggaggttgggctccccagatgaggtcaggcagagaagaggatgtcctcctggaaaagtgagtcctccatcatgaattttgcaggaaaattgatggaactagaaaatatctcaagtgaggttacctagaccctaaaaaggcatgcatagtatgtatttactgataagtagatattagccaaaaactacagaatacccatgatacaacccaagac

SEQ ID NO: 737 - DNA, 3025 bp, Mus musculus
ctgctgtagatccttactctccttctcccctcccctgaagctctccctttcatctctaagggtccccttcccacttccatgacctatactctctcctccatacacatatatacatggctgtaaaaacttaaaatccaggatccacatatgagagaaagagtacattatttatcttcctgacactgagttactttgcttaacataattttagttctgtgtagtttcctacaaatggcatgatttaatttttttttatggttgagtacaatttcatatctttatgtgttgccatcagttgatacagagttggagagataatgaatggagcagatatggtacattttgagtgtatggatttagaaaatttatttatataaatgggaacttgatgtaattggtctattcataaggtaaatacatttttaaaaaagtagttcattggccgggagatggcaataaagtacctgccttgaaaacacaaggacctgtgtttgagccccagaacccaggtgaaaaaaaccatgtgttgtggtacacacttctaatcccaggacacagagatgggtggatttgtgaggactgtggaccagctagcctcagtgctgaggcccagggttcagtgagacaccaaaacaaaaaacaaattggataccacccaagaaacaactcctgaagctgccctgacttccacatgtgcatgaacccacagatacatgtgtgcatgtccccactctcccacccccacaaaaaagcaatttctagcaccatgacaaccagtgtggtttcacagtaggcggtgaatggtggccacccaagtgtcgttgtgagcttgcaaggctgtgtgtcactctgaaagaatgctcctgtacctcccagcttgagtggctcttgtagtagtgccatgacaggccctgattacagaaacagattatcttatatgaggaataatccagtcatatcctgttctgtataaaggagccagaggtgctggcaggggcagcaggggtggtggtgagagtaacctcaggaaagacgtttctgcagctctctttggctggttgtggctgtgtctctggttatttgttctcatcgtgtgaggcactgttgcaggtgtaagagttatatcctgactcccaggatcctccatgccagcaagcttctttttattagctgtgaatctgaaagctgagtcctacaacaccaccattcttgatagtttcacccctgtgaaaatgtgagcttaactcaagaaatgctccgggtcttgctaaactttcgcacgatctgttgtgttgtgagttggaagctgtatttcagaacaagttgggggggggtgattataaatgatcctttggtgccaatggaaggtggcagctgaggatgccaggttactatagaaacaccaggggaatagaaaggcaagatgaacgccatactaaggagaaatagattttcgaaatgatacctacatgccttatgaaacattttccttttattaaattcatagacactaggaagaaccttcccaacacacaaaatatcaataaacttgaaatgtggttaggtatttatgaaggtaaaatcccttatggacattctcttgaaaaatgtggagaggatttcaggtgcagcagacaaacaggaagaactgttcaagctgcaggtacagcgctaatgcctaagcgggaagcaggatgctaggatgcacacttggtttacgaatatactgtattagtaatatactgtgatgttagtctttaaaaacagttgctggtcagaagggctcctggtagctgagtcatgaagtttgctgtccccttggctcccagaaagaccttgagtttgttgaggcttcaacttcctagcttatgtactgggctggtacttatttctcagatgttatgaagatggatagagagaatgtgtccgcatgtgtgatggttagtcacctttatgaaatctagaattacctggaagaacggctttggggggcaagtctatgggggattatcttgattagaataatcgaagtaagagacccacccaacataggtagtgctacttcgaatatgtaaccctgggctgaagacaaaggcagaaatggcctgaatagaagcacttgctgttctctgcttctgactgtctatgcaatgagacaagttgcctcagattcccattgctgtggcttccctgcataacaaccttgaactgtgagacaaaccctctgtcccttgagttgctttgtcagggtacagagtagatattatatactactgtacatgttttatgctattatatgcattgcatattgtatcacagtaacaggaaaagaaaccaagattgcattgctcggcacagtgcttgggagcagagtgagaactcaatgaatggttgtgttgacaagtgttgtgggaaataataaaaaagaacagcaagttcccagtagctatacccagctactctctgcgctggcagcagtctcgctgcctctgtctctaagctagcccagcaccaattgatggcagtttctttagctctggttcacttgtctcagtgcctcccgtactttctcagccacaaactcaatgtggtcagctgccccacattccagtaacccagtaaaacaaaactcttgaaacttataattaatcagtcagatttatatatcaataaatttttagtatataagatgcccatgcaataaattcagggccaattgataattgtacaaactgcccacctagattagacaagctatcccagttattctatccctgtatgatatagctatctgtggctatctaaagccatgagtaatctcaatcatcctgtttgtcctccatcttgcttccttctccccttctcttgggttgctccctgtctctataactcttactgtaagaccccctaagctgggcctccgctcaagtccccggatgagctggccagcaccccagtgtcccgagagaaaaacacacctgatgcaaactgcaagaggttttattatcagctagctgaggacgaa

SEQ ID NO: 738 - DNA, 4150 bp, Mus musculus
gtgagaaagataagggtagtcacagagtaaaagaggtgtttaggacatttttctctttgttagctcatctctctaaggaccaaggacaagtgtgagcttgagatttcaaaggacttgggcagtgagcatgaaaaagatctgcagtgacagaggttcagtggaaaactgcatggttcatgggtgtgtgtgtgtgtgtttgagtgtatatgcactgaatggaggtgaatggctgttgtcatgctccaaggctctctatcttacattttgagacagtattcttccctgaactggaagctcactggattggctagactggctggccactgagcctcagagacccagccatcctcacctcccagtgctgggaatagaggtctgaactcccattcttgacttttatgtgagtgtagcaattggaactcaggtcctcgtacttgtgtggcaggcacatcacgaactgagccattgttccagtcccccaaaatgtttcttgaaggcataaataaaagcctattatattactgggatgggtactgaactgttataataacttaataatcagggggttcagggccatgtgttctacaccagcctagccacagcaataccctgacttcaaaaacaaaacaaaacacaaaaatctcatgatcttaaatgctcacaatataatcaggtggtggagggaggctgggcattttatcaggaaaatcagggcaagctgttacaatcactatcaggacactggtaaactggagttaggaccacaggcatatgttcacatgatgagcaaggctttgaagccactctacagcttatcgcatttgtaccacccaaaacatagccctttctggagccagacaccgaggtgggtgccaggcacaaaagattacaggaaacaggtttgttcttagggcatgtgtagtgaatgtgtgtcggtgagttccacaccaacagtcctagggctaagacaaactgatgcatctgccctgctgactgatacctcactggaggaggccttaatggtttggaaccagtttctcttgcagtagctccttagacaattacgactgtgttgaacaggcagggattagggtattcattttgcagacgaggaagctgaggcctacaaagggaataggccatctgaggttgcttggagggaatcagaggcagagtttgggacaaagccaagtaatacggcttaatctcagtgtcccttctcatatcccgttgcagaaatgaattgacaggctgttaatctgagtttgctcgagtgcccaggttcctacttattaagacaccaaagccccagctcaatgtaagaacaaacaaacagacttgtgccccgtggctgagaaattctctacctatcctcaagctggcttcctcctcagtctctcacaagcagcttcctcctcagtctctcacaagcagcttcctcctcagtctctcacaagcagcttcctgggctagctttccagggcacatatgaaagtttccttgtcttcttgctctcacttgagcctacttggttgcagattgatggtgaccaatgcatgagttcttgtctgctcaaatacactctttaaaatcttaatatgcccaaatttagcttttagcaccatgcttaatgtttttgtgaagggtgtggaatcacacatttaattgggaacttaaacatgagacagactagaaaaatgtaaaggtgtcctacattttcaaatatcaaatttggaagcagaacaaatctgacttctcgtgtttcaaaacctactgatgaatatgacagaggctattaaggggtcaggagtaaggaattcaataggctcagtgatgggggcattagccctgcctgccttaagatgaggagggccataggcatgagcagtctagaggacttggtgggctccaggaggaggccagagggctttggagaagcccattttggctcagaacaaggaggaattttcttagcattagaactgaccagtaagtggaaatgtcttctagggagggcaaaggctagggaaatagttgtataggattttgtcgatgcatctacatgctgcagaggtccagattcagagaccctacgatgagttcctatgaccttagcatcccagggtttacatccttcaagtgttatggactctgtcaccaaccacattggattaacagcagtagccaacatggctacttggcacaatttttagtgaacagatcgcagaaagacttttgctttccttttatttcttttgttgcctcaagaatggcctctgaggctctgcttttgttctgttctgtttttttccccttgtggagatgctgactgttgctttccaaagggtgtgacttaactatacccaacaaagcagccactaaaggttaacaaggggtaaacctgcttctccagaagagcttctccagaagagctaaaagtacctgtagtttccaaattctgtatccccagggaatggggatggctgcctgaatggtggtgagcttcagattcatttggacctctttgggccttgatttcatcatttataaactggtaatcacaatgtctgtgccatagggctttgtagaaatctaggttgcatatggtaatatgcatagcacagggcacacggcagttgcccacttaatggctattagtactatttaggatagtaatgagataaactctgaactattagctatatatattttagtaatttatatgtatcagtacagctaagcatgaaccaaaggctttgtagaggcaggaggtaagacacttagataatctgcagatggctctgcatcccaattctatgggacattgggaaaattcactgctgagtctccattctgtgtacattgagatattaatagtaactgccaggtttctagtggggatagcgcaagctcatactcaccatacaatgagttctcaacaaatgctataaacattgtgctggctgttttttttcccagtctgatgtatgtcagagccatttgaaaagagggaacctcaattgagaaaattcccccaccagactggcctgtggggaagtctgcagtgattttttttgattgacagctgatgtgggaggggcacgctcactgtgggcagtgcaaccctggcctggttgtccttcgagttataacaaagtaggctgatcaagccagtgagcagcacactcccatggcctctgcatcagctcctgcctccaggttcctgttctgacttccctcagagactgactcagtgtaagctgaaacagaccctttcctcctcgagttgcttttggtcatggtcagtaatcacagcagcagaacctagcaaggacactcatcattacagcggacatggtctatctgtgttggacgagaggggagcatgttccttatagcttacttggtcccccacactgtatttgcttgattcttacaagagaggaaggaaaggaggagggacagagggagggaaggagggaggaaggggggaagtggggagagagagagagagaacagtgagttagaatgacatcatatgtttctaaatgatttatataggacactaagacaaattcatctttgattaaaagtccttagagcaaaaaaaaaaaaaaaaaatcacttctgtttcaaagaggaaacccaaatgttctatcaaatataacatgaaaacatgaaagtcataagtcacaaggtcaacagtgcatcatgggtgcttatggatctgttatttaatttctggtctttactaacgcattggttagataaacctttgagtgcaagagaacaggggcctgtgcagtagttgttcactgtattctgtgcctgcactaaagacggtaacaatgcaagctagtgctgttaaacaggtcaaactcaatacattttacagctagctgaggatctttcaagatgagaataacctctgtgatgggcctttaatgcccaactgcaaaaaaaaaaaaaaaatcaaggaagggctgattcattagcagagatcttcctgtacaatgcagataaactaaagcagtaaatgctatatacatgcattcatctcgatacatacaaccacagaatggaagcttcatgcattagaaccataggcttaatatagttttgtgagttttagtgccaaaactttaaatgc

SEQ ID NO: 739 - DNA, 2300 bp, Mus musculus
ggaggaggagaagaagaagaagaagaagaagaagaagaagaagaagaagaagaagaagaagaagaagaagaagaagaaacactaagtgcattttgtgttgtttatttactcccaatggccagctcttcaaagaaagtggagtccttccccacccctccctggctagaagagctacacttaagtattcctatcacaaattttaagaattctcttcaatagcttcccatctagactgcttaattttttgggggggggtgaagttggggggaaactagatagcaaatattgtcacttttcaagtgtcattacatgcaattacataaggccagcactggcaaaccaagcgaagagcacatgagagaagccctgctgcacttgcatcaggcaggcgtactaagatggtttcggtgatgcaagcccatcgtcgtcacgttaggtgcatgtgtgctgttcacatctcacatttgttcatagaaaatataaatctgttaatttatttttcctggtgaatatctgcaatgatacaaaataaaagtggttgatttcattgctatgacagactgaccctgttttatcccatgggaaaacaggaggcttattcatagatattcttcaatcaccataagaagttaaaaaacgacaatgaaagccaatgaggacaggtgagtatgtcactaaacatggctggtagaagacaggtggtgggtttgtgtgtgtgtgtgtgtgtgtgtgtgtgtgtgtgtgtgtgtgtgtgtgtgattgaaatgcctcaagacccacaggaggttttggcatacttaaaacacaattaaaattaggcttggaaggagatgcaggcactgcggagagatgttggagggaagccatgcacacggcagcttgggaaaggccaggtgtgcttgttgtgagggcgctgctgtgacatcttagagggcactttttcctaatcaagaagctgctaattttaatagagaatagcctgaggcgttttaaggtcaaactagaaatatgttgatgatttaaaaatgcaagccaagtgtgttattatattacagctgcagtgttattgtagtttaaggatatccgtaaatcagcacaaacccacacgtatcgtttcctacacatttttcaccaagctgccttctgtctgtgagtaatcagctaatctcctcctcgcctcaccatccctccaagtgacagatccgttcctccctattacagaaggtcttcatttactgtgtgcctcgcccacagcactttctggctcgggcttgaatctggaaactcactctcagaatgcagagaccgtcatgtcatgtcaggatgcagaatgcagttgtcctcctttgtctcccacgtccgccattagtccaggaggtaaacatcagagccttttctgggctccaactatgcactaattgtatttgcagaatgaagtcagtttctgttttcagtaagagtgttgttaaagagtctatggggggagggcaagttgtgaaaaacaaggtaagtgtactctttgccaaaacaccaactacaccgccgtggaaatttcttttaattctagtggccaacaagtagtttcaacagttgtgagaagaaaagagtctagagttgagaaatgaatgccatgcacaagaggaggcattattagcagagtgtgtatctgccacacacgcaaactgaaaaacacaaggccatgtgagaggctagcttttaattgtgttcggtaagtaaggacaaagccacctgcagtttaccatttcgcttcacttgctactgagccatgtatccttgcgacaatccagcagttctgactattaactcaaaaatcaagagcaaagaagttattcatagcaaaatatgagaactatttccttataagtgtgtttaagaatggttcttttccctatgactatacatacccaacgcccaatagtgttttcttgtcctgagcaccacactgcatctgactcgccttaatggatagcaagggatataaagccttttaaaaatcaatgggcaagaaagagtcaatataacaataatgtttgtgttagttcaatcaaatcagctaagagttgtttgccttttcacctcggagtcatttgaaacaggccaaacatttgactcacatggggcttattatattgagtgggattttatgtgtaatgaacatcacaatataaagctataagtgacaataaacataatatattgctaaaatgagaaagcatgttttaacttcaatcaatttaaaaacataatgtttttcattaagagaaatgaaaagaaatgca

SEQ ID NO: 740 - DNA, 1875 bp, Mus musculus
ctttgaggtcctgtgctaaagctttacccagtgtgtagtggaccctcttcctgcctgcctggggaagaaagcctccttctagatgccttcagaccaagatggagaatatctgcttcctcggcactatgactgtctcaacactgccatacttcctgccatgatattaatggactgatcctctgaaactgtaacccagcaccaattaacaaccaccaccataacaacaaagtcctaactaaggtggcagataatatccattttatgaggatttgtaaaaatcagagacccctatatagctgttaactttctgtgccccgcgtcaccaggacaacattcccaggacaatattatatgcttcttttctaccagagatactgagtacagtgaatgagctcatagtaggcttacaaattggactacattttgtcacaaagcctatattttattaagtattttaatattctatatttctgcatcccactagtgtgttatcttaaaagtctgcttttaagtcttggtgagtcctgttaattaaaaatgttgagaaacttcctatagacttctaaaagtcttagcttatagcatcatccagttcgcttctgacagactcatgttaaatccataaaacatttctctgccttctctgtatacctctcttcctgtctggggctactccctgcagactcctcccgtggcccattttatgtgattttctgatcacagccttctgactccacacagctgcctgcctttgctcaatgcctttaaagctttcatttgctaggcaccgtcctgggtggattgctcctggatggagatatttctgtgatagacagtgttttattataaatgagtgcttctgctgcctgcatcttccggcttcacgtgtgagggatgcctgttcgggaaactctctttgcttttcacgggtctaggcttcatctctgcttcagtaaacattaatccttgattgcttccctggactacatttttccaatgaattgtgtttcttctaatgccccaaggagcctgggaaccagggcttccatttcctcaggaagtctctgaccctcgttcttttctgatgacttcctgctgatacccatctcaggtttgggtcttttgccaggtgcactctgcttcttaccactgtgctctgataaacctttatgctagagttatagagtctgatatgtatttggctcagaagaaacctttataggtgagatgacatttctgaaaaatgaatcccaaaagtgcgacttatgaaactattttttttccttgttggtgtaggttgtaagcgtgctaagagtcccttcccgtttccattgatttcctgtggcttgcagagaattttaggctaacacttatttttggaaatcagcagtcataattctcagggactaattttagctcttgaatgcctaataagtcttgctgttgatacataatcactacattggttttcagctgatacaatgggaagcgctatgcagcagatccctttacaagaatgttcacaaaccttgtcaaatgttgctaacacccaattttcctgtttgggtgttagggttgtgtgtatcacatggatctttgaactgatcagactgtgcagttaactaccatcagggttcttagcctactgatcataaagattgtgctcaaagcagaaaacagttctcagagagactgagagacatattcaagatgttcatgggtagtaagatgaccacaggtactttcacagtatttgtgaaatgattatacggtcataattagaatttaataagtgtttttgattttgtataatgctattgtgactcttggcatggttttgatgctacaactgaagacattgaagacacactttga

SEQ ID NO: 741 - DNA, 1775 bp, Mus musculus
cgctaataactctctcattacaccagctcagatatcttttgaaaattgtgaggatacaagtttcagataattaaatgtatcaggacacacatgcaggatgtgcattcagtctgtgtgtctgccatctgtatgagtagctgggtaaggatcctatgacagagaggacaatttgtatcattcgattgggattctgaggtgagcatcccagtatttctggagaagattctctctacataaaaactaagaaaagcagttgctgagtcaatctattgtcatctgtttctataatactgaatttaccaacaaaattttgcaaattatatagaatggcagcaagacacaaatccaaagactaaagattgtatttttctttaaggtctgcagtaaaaattggagacaagaaacagtactttggctgactcaataactggttggaagttgggtgttgattgagtctagttcctgcagagattccccttcgtgtaaagtaaggaaagtgggtcagagaggccagcgtgggtggaatgcacaacaagctgcagcgaggaagctgaaagatttaggaaagactttgtgtggaaaatgctggcaagtctgtttcctaccagctttcatcctgaagtcagtgagacacatgccacatctcagtgatgtcatgaaacccagagatttcccctcctgttctccatttcagggcagcaggtggttgtcccctgaacccaggagcttcaaatcccaggaatctctttcctgaatctttagagctgaagtagtcattccagggtcctcaaacctactatctatgctgaggagttagtcttcatcagaaaccctgaaaaaacagctccctaagatgaccgtggcaaggtagtgcattgtctttcaggttgctgactgccagcaccctctgcctcacacaggggatgcatatgagctagcttctggcatgtctcacaggggcatttatacctccatctgggctctcacgaccttagtggctctgaacgaccttgtttacaaatactgatgcactggaagtagagttgcccagatgtgcttgtgggtggacatcctgccaatagcctgtccacaataaacaacaaagcaatgattttatgttagggccaaacattgtgataaataatgatatgccaacagaacagaaaataatagatacaataaccttcattaaagaaacgtaagcctggaggagtgaatgctgatttagttagcttttcagggtaccaaggaagatgatgctaggcattatcctcatcatctcacttaatccttaaagcaaacctagagtgttggaatcaaagtctcatattctatacattaagaaattgaggattaagccaggagtggtggcacacgcctttaatcccagcactcgggaggcagaggcaggcagatttctgagttcaaggccagcctggtctacaaagtgagttccaggacagccagggctatacagagaaaccctgtcttgaaaaaccaaaaaaaaaaaaaaaaaaagaaaagaaaagaaagaaagaaaagaaagaaattgaggattagtatgataaggtatttcaaagattgtattatttttctgccaacaaaaatacaataaactttgattttccccacgtttctttaggtggctacaaacggaggtttagatagctttatttacattttcaggactggagggtcaagagtggcttaattcacagctctaggacattaatgggacaaagatatatctaggtccaggacaatggcccacattt

SEQ ID NO: 742 - DNA, 2825 bp, Mus musculus
tcctcatgaggttgtttagagaattacatgaattattaatatacaaacgcacatgtgacagtagttagcacattggccagagtcgtagggattttattgctacgatgaaacatcataacgaaagagcaagttgaggaagattggcttacacgtccatgttgctgttcatcactgagggacgtcaatgcaggaacccaatcaggacaggaacctaagacaggagctgatgcaaaggccatggggagatgctgcttactggattgcttcccatgacttatccagccccctttcttacaaaacgcagaagcatcactgcagggatggcaccgtctaccatgagctggcccctcccccactgataaataattgagaaaacgccttacagctggatctcatgatgacattttctcaactgaggctccatcctctctcaggactcttgcttggggcaagttgacacataaaactagccagtatatccagaatctacatagggctcagaagcagtctcaaaggcacagcttgccctgtgtccagaactttctactgtatgtaaagccttctgagtttgaaaattgtttaaaatgaggccacctgagttgctctgtgccttggagaggtggaaccccaaaacagaacaggcagcaggtgtcttgttcactcagctccaatggcatgattccttggcttcctctataggctgcaatcccacaggcctgaaaccctacggaaaagaagggagaggcagaggaactctggagccctgtgctggtctgaaactgcacaggccttggaacacaggctctgatgcactcccagccaggccaaaggacaaagcaaggaaaccagttatcagaacacccagctggctctcactggatgacttcctgcttcttgagttgaaaaggctgatggtgttcctagagacaagcaagagccagttgtcacaggagaagcagcatggcagtgtgattcaagctgtgacctttcagagactccaactgtgtctgggttttccatttgcaagcccatagctagaaactctacctcctcagcagaaagtgtcctcttcccagcagttctccactccggccagcagatggtgcagtttcccctgcgttccagacagtgtcttgctttaaatctgaaagacaaattgcctattttgctggtaatataaaaagtagaggtcaaaatatcttagagacgacaagttgaaagatctttaaaacctttgcttttgtagacactagatgaaatatgtgttgtgatttacaaaacttttatcttattatctcagccctccccccaaaaaagaaaaagatcaaaattgattttaacttccttttggaaaagggcttcagctgagtcctccctctgtgtttgactggcagactttaaattgaattattcgactctctactgttgtattgtattactagtgttttaatgatattgataatgagaaacaatagagttttacaggcactatcatgctttagccccacaacacaaactagatgccagaatacacactgattgtatagccaaaccctgaggctaaatcagcacgcacatgcttagtgtgtcagggcaagagctactaagagttagtttaatgaaaaggtcgttatcttaagtaaaagcatggttgccatcccatttaactgttaattctgctattttcccatgccctggttagctaaacttaacacaagacagattgtacactaaattaccaacaatggcagctacaacgctggcagcacttactctgcattgggtgctatgatgaaagaagctttaaaatcccacaacagggcgccatggggatggctctgtagtcaaagcccttgctctgcaagtgtgaagatgcaggttcagatccccagaacctatgcagatgccagttgagtatggcaatctgcctggaaggcagggtttcccagcacaagctggctaaggagaccaaccatataggaaagctctgggtctgactgagagatgctgcctcaaggtatggtagagagtatctacctcagtcctcaggccaacccccaccacacacacacacacacacacacacacacacacacacacacacacacacaaatggaaaaccagatttggttacttaaaatccacagcagtgttggtgggtaggaactgcctaacagtcatgtcactggtaagagaaatgaggcccagtgaggcttagtaatgtcacttgctaattccagcactcatatctgccactttcctattagtggcctcctgtctttcctgtcatggttgcctgactgaatttgcctctgtgtatttcttggtttcatggtggcatcttctttagcctgagattttcgcctggtagggcattttctgggtggtctgttctctgtctctctgcctttaaatgggttttgcctctgagcttatgcccacgctgccactgaacagtcccagttggttagtctccagattgatgctactaacagacttaatatcccaagatcacctcatatttccacagtattagagacatcgactatttggtggtacaaatgggcatgcaagatgattgtctcagtagagtgacctcctgtcttttttttttttttttttttttttttttgagcatgtctctgctctgtctcagaagcaaaggaaaccgtgtttctctctccagtcaggcagagacctctgaagcttcagcttctacttcagcaaggagcttcttcaggtccttactcccacctatgcagcttcatttctgtttgcagacaggactttgggcttctgtttggaggagatcagtacaactttgc

SEQ ID NO: 743 - DNA, 2475 bp, Mus musculus
gctgtagactagggcatccattgttcagcttattgacctgaatgatgccactttcactgtgaatggtataggcatcggtgtctggtaaatatttaatataactcccttaaaaacagaagtcacaaactgtcctagcctatggttaatttaaaactactaacatggtgatgttgactagtacccagaatcatgaaaccataacaataggctatggtggcgtagtacaagccagttccagcattactacatccacgtagtcaaccaaatgagaccataaatttacttcttccctctcttcactcatctgcattccattagatttgtttctcaggaaggtttattctgcatagtactgaatttcattgcagggtctgtgccagaagagctctatatacattgactttgaatgtgccctctcaacagccaatagtgcagcagaggaagggaatattctgagcgcccacgaggggttaagcaggcttcagcaaaccctcggggcatgtggatgaaggtgaacttatctgaactgggggaaattctagtctcctaaggagggaaaaaaattgtaggtaaatatcattaactccagctttcaattaagtctaattaaacatgcacctgaagtttactttttcagagtgtattatacaattaagacttcctagtgtgtgtccacatgcagtaaaaatttgggccaaagatataagatccatgaaaatgaaatgtatttggatgacaaataggctgctacaatatagagaagccgtcttcagtcctggctaaatacaaatagtgaagctaaataattgctgcataaatttattaatagaactgctaatgtcgtacatctcacatctacattttgacacacaatcttttatttttctgttaccgaggaagaaaaatgaaggagcggaactgttaatgctgcttgcaactaaattggattttccaccagaggaagctgtgcagcagaagctatttggaaaaagcaaaacagtgctcacaaaagagtattaatgagtccaaccaggggaaagcctcctgcaagacaaacaaagcatttcaaagccactctcaggacagcaagcctgctggatgctttgaattccctgttgttgttgttgttgttgtttttgtttgtttgttgttgtttttgtttgtttgttgttgtttttgttttgtttaggtttgttttgttttggttttggttttgttttttttgcagaaataatcttacctgtgaactgaacataagacctagtagagatttagaataagaacacttcaactgtgggtctttctgatttaagaaaagagaccccagtcagtggctttgggtttagaaggaaacctatgtatcctgccatcaaactgagacacagcgggaacaagatgtaagctccataggacctgtgcctccatctgtctccaacacagctggcatcacaatacacaggtgaaagtctgcccagcagaacacaaagaaaatgcaagcctgctctggctttaccctgggtggaccgttcccagcctgatggcagacttttaaaaatcttatttgtttagctattcaggagaaggaaataacattgaaatagagggaaaaaaaacttaattatatcttccttaagaaaaggaacccctttcacacttttttctttcccacccagtgaagccagctgcaaaactacggctgctgaagagtgctgcagggagagtggagcagttggtgaatggcatcagttaaacaaatccaggaccatttgtgcatggttttaggcctattgccatggtatttgagagcctagccgggccacaattaggacagcagaaaattgcagccaggggctctgactgactcagttgtcactaagcatcttcagtggtaaagtggcctctgtatagggagttaatatggaaactttccctttcatgccctacaccagattactggcaggaaatgaagccgtcaaatattgtctgttgtgcccaatggaaatgtctgaaatggtatcatttgatgatcatgttcgcaaggaatacggtattatctacaattgccgtagctagggagaaacaatgcaaacttccagccctttcagtggagcagtgtcatacagcattcctactgacaaggcctggagttgcatatcacatggcttgccatatgtgaacacattaacatatttgaaataggatcagttgactatgaacaggtcaaagatgaggcaagtgtttgaagatggggggaccctaaaccttctattgcattacatagtgaaaaataattgtaggcacatgggataacaggtgtgtgtctgaatattaaaagacgtctatgtagctattccattaatatatgcagcacctctggcctaaactcattaaattacttggaaaaatgtctactgtgtggtatagtttgtacccatgtgtgtgtaagcacatatgtgtgaaggatgtgcatagatc

SEQ ID NO: 744 - DNA, 2550 bp, Mus musculus
tatcttcttactgtcatttctgggcatgatccatttttctttactatataatagtattttatactgattgaacatgattcaacatggtcctgtttggtttagcagtaaatgagagcacacggctctcagctcagatctacaaatagtggttatgcatttttatataatacacatttcagttgctgtggacactggagccttcagatgatcttcagacacttttgttcaaacttaacttcattgtaaaactcaatattcatcatgagaatcctgaactctagatagttggtcagttagctgcttttcccagtagttggttctagtgggttaagaaggacagaaccaactgaaggactggctttgtttgtcaacagtgagctggtgaattgctgtgttgatgtttgaattgctgcctttcagcctttccctactctctttagcaacctggttttctgcttgtttgattttgtgtcttcagatctgttgttaagatcctttcagacctttgggaaatgagagtcactttgaagattgcctcgaaattctgtacagtcaagattagctacttggtggctcatgagtgagagaaaagagaacgaaagaacccttaattaaatatgtaggtgccttgaagggtgtctgtgttgctttctaacttaagaatttttctttttttgtttgagggtgatcatgaaggacacagccaaatacattttattacataaggattctgtgccaaacaccttgctaagtgcattgtgtatctgttctcatttgccctgacagcagctgttaaggaactagcagcttttatgcctggtctatgaataaaaacactgacgtttagatgctgagatgaatttctgtatgcatatatttgtgttgatgtgttcatgtgttcatgtgtgtatatatgcatacagaggtcagaggatgattgacagttgcctttcttgatctccatttagcttcttagttaattaattaattatatgtgtgtgagtgttttgcatgtatgaatgcccatacaacatgcatgcctggcgtccacaaaggtgctgggactggagtcccagacagttgtgagctgccatgtgggtattgggaattaaactgtgttctctggaagagcagccagtgccctaacaactgagccatctttccagcctgacatacattctttgagtccctttctcactgacttagctgaattggccagacagcaattcccaggaatcatcctgttgctgactcttctctacaaggattgcaaactggccatgctggtgtacaccttaaatcctagcatgtgagaggcagggacagaggcaggagtatctctgtgtgtttgagacaattgtgatctacaaagtgagttctaggccagccagggcttcatagagagatcctgtttaaaacagacagacagacagacagacagacagacagacagactgacagacagagccagggcttcatagagagatcctgtctaaaacagacagacagacaaacaagcaaacaagtacatgcaccatgcctggccttttagcttggtactctatctagacttagttccttcttctcgcagggccggcagccactttagcacttgaaccttatcttcagcccctgcagatttaaatccacatctgtggagctatgaatgcagtccatgtctccctcagcatgacggcctctggctcagcttctgtgagatctgccttctagcttggccttaatggctgctgtttgctttgattttgttttgtttattattaaaagaaatctcattgttttatttagtgtctcaattggctgcacccctgtctccagcggagccttgtagatggaatacattacaatggggataaccatttcccagtgtcatctctcatttgaactaatcagaggatacacgcttatatattggcaacattgtaggtacccagatgatgaggcttcattgtttcagtgaataaaagtagtttatccatcctttattgcaagtgcttattgagaaccagacggctgtatggtctcagtcattaccaagatgagagatacagcagaagtttattaggtcaagggaggtccatgcatccatctaataaatatttatgaagtgcctgttccatgctgggcacagttacaggcactggagacacagtggtaaataaatcacaccaggttcttgatgtaccacaaatatatgactcgcgtttggaaatgctagaatagacttctcattatgtccacctttgactcatcttgggttattttctttcctacattcaacaataacttgctatcttttggatgcgtaaaactaatagtgacaaatgaagaacttttgactgtagaagatgcatgcaagcctgaatgtttcttgcctgctgtcctatgataggtacaggactttcttgccaagcctcaattcttggcaacccataatggtggcccagtggtacatgtaagtggtacagaagcggtgctctgtgtaggaacgttgacttgctgctgttttctgtcctggtgagggtgcagagt

SEQ ID NO: 745 - DNA, 2075 bp, Mus musculus
tcaggcaccagtgagaatgcagtcagtgagagtgcagtcagtgctggggcagtgagaggagtggtcaggcaccagtgagaatgcagtcagtgagagtgcagtcagtgctggggcagtgagaggagtggtcaggcaccagtgagaatgcagtcagtgagagtgcagtcagtgctggggcagtgagaggagtggtcaggcacagtgagagtgcagtcagtgctggggcagtgagaggagtggtcaggcaccagtgagaatgtctgagctgaagcagagtggtccctctgtgcaatgtgtgtcctttatccctggtggtcaacattcatctgtcaaccctctaggctgacttaaatccaatgaccataacaggggtgttgttcacttttcgtcactgtgacagtacttgacacgagaaacttaaaggaggagtggtttatttatgttcctgtttccagaggtttctgtcccataatctgctacctccttccgggactgtggtaaatcagaaacatcctggggcaaaagctgcttacctcatggtacccaggaaacagaaagcacctaagaggaggggccagggatcgactccaaaggacacagcatagataccctctctctccaaagaggctgtacttcctaacagcccattcgtctgtgttttcttcagtcggtgactccagtgaggcagtaagtgcacctttggctctgtctcaggctggagaccaaacctcccacacctgagttttggagcaagcttttccatatgattaaagatcatatccttatatctaagtatcactagattgttgactactacctgtctaacagctgtgtgcctttgtctcttccacgaggcaggtgaaatgctttttattttgtccctagtaacataatattccacttgcaagtgaccatgatagttttttttttctgccaagagcataaggtagatggtgctggatgctacaagacctctgtcccttccatacagactaatataaagctgggctgcaggtcatgtcttcattctacaacacctggtgggggtggagtcaggagtgagaagtagtcctggctgcttctggggcagctgccttgttgtgacttgggaatcggctgggcttttcttcccacagaggaatgtttgcagtgaaagtgggaccttgaaaactagggcccaagttcacaggaggatcccactagagtttcagggcttcccagtgcttgcctggggaaacatcgttcttccagccaggcctcctctctcagcatgctgcttatgtttggaaagagatctggaccagatacccgcctggcctgaaaggttccctctggagatgagcagggtttcatgttaccatgctccattagcagcgggttttgatggcagccccttaggttgccaggcatggccacttaccccctgctctccagagctcacagccttccttcatggccatggggcacaccagcaggccgtgttgagcaacttggttgtctgaagtaagaatggttaaatgggtaattgatggaagcagaaagccaagggaagtctttgcctgctgggtaactgtgagtagctgcagctgatagccttttcagggggcatgtttcccttctttgtttaaaataactgctcattaatttgtcttttggggtttttttatatgaattataccctaagctttctaaatcttaatattactaccattctttcatgactcatcatgatattaaaaatggaggaattgggagttcaatggagtgaaatgaaggccccataaacacacactcacagagtttgataactggcagaaactagtcttagagcaggtcctgatgactttttaaaggaattccaaggtcagataagggactaaccaagtacttctagaacaactcagaccttcctggtcgctttgccaggttcctgctgagccgggatgtgaactctggaagtctgtgtgcattggctactctctcccagggaggctacacactcagagcctttcctgggcatctggagtggtaggtgcaacacaaatgatgacccattttaaggttagccacatccc

SEQ ID NO: 746 - DNA, 2150 bp, Mus musculus
aagttttgaggggagaatatctcatattcagggtaaccacactttgtgtagggttgtatttttttatcacacaccaccaccccccccaattagatttgccttttctttacttctcatgtatacactgtttcttcattgtgctttattcttcactcattccatactttcctgtttcccaccaggactgagtgggaaaccatggaaaacctgagcgcttccgatctggcaagcagaagtttgccgacagcatcctatggcctctattactgctgcgtttgcccagaacaccagaggactattgagttcattgactctcagtgcagtgtcccaggcataggcattccccactgccttcccccgactgccttccacgtgcatgtgtgacatttcctcagcttatcattgagtctagggaacttcaaggttgtgaatgcagaaggccttgagagtcaagtacagttagatacctctccctcctgtttcagtctgtgtggaatcacttctaaatctgctctgaatgcaaagatatgaaatggcttccatgacaggaggggtgcagccagttagtgtggctctaagaagtcaataccctgtgttgtacttgatattaatattagagtagaaattttgaaatatttttcttttttgaacatgttttttacgattttaaatttatactatgtgtgtgccatgttggcataggaatctggagaggctagaaaaggttgtctacccccaacctcccacagaaagcccgagttacaactgcttgtgagctgcctgatgtggaccagcgctgtttcatttggaaggaacttgagtcctctggaagagcaattgcccgtagctgctgagccatctctctaggccccctgaagtatttcttcatgacagcccatcttcaggaacccttggtgcactctgtgcatctcatctgagccgttctgttttcaccagcggaactacaccctgtctctccactttcccgttctgtttcaagtctacctagggttcagctgtacacgactgggtttccctgaggtctgtgaagtcatacaccccttttcctttctgcccttacttcatagttgaaaggaaatattagaattcagagttgctaacctattctttctatcatgtcggcactgcagactgcttaattatttttctccatctggagaggcttagtaattaaatgagatggcagcacctgggattatttatagacatggagaaggcagaagaagttcttggtgactcattgatccagagctggctccaatgtttctccagcccctgcctttcaccttccacttctgcacccatcagaggcagataggacttgtctttttttgacctgctgtgactcccagcctcacatcttatgtagaagctgttttgtttcatgtctcctctggcctctgtgccatgagctcattgtgggcccgaggccctattcatcattgcatcttttatataacttgcatgtgcaaatacttagttgaccttaatattgaggttcttcaggactgattgcagttgggtatccttacagtctgtcagtgagcaagtatttgaaatgctcactgggaggtgtggtacctgggaagtggggtgtaaactctgaaacagaagtctatggctgttcttcttcctgtttctaaccttacccaccttcccagggcctcataccaacattctgcctcagttgttgctcaataggattaaattagaggaacccccttagaagtttctcacaccatccgtgtgtttgagaaaaggcattgtccaggtggctcttagtgcttggcccataaagatgctcgttatatcagaagtgcatgattcttgataggtaaggaacatgaatgtgtcttgtgttcacgtaaactgatggtttccaatctgggtgtcactaagccatctaaggttatatagtattagtaaagatgcctttctacatttgtctgcaatcctgaaggagcaacaggtctcaaaatttttcaatattgaattcagaatcctaaaggaatatttattaccaaggctgaatgagatctatgtatctgtgcctgagaattgttttgcaatgcttcctaccaaagtgcttttatgtttgtcaacaatagatgaagaatatgtgagtcccg

SEQ ID NO: 747 - DNA, 1875 bp, Mus musculus
gatcagtaggctaggctggagcttcagcctgcggacagtgcttacctcatagtagctctggacagcattcataaaggcttcatcagctacgatttgggtctccccattgagaaaagcctggaaccggtctttgacagtctgtagctgctgtttgctgatctgtagagagagaaagagaaccttgaaggcttcatgtaaacagggatgtgactacttcacaagaaagatgcccatctatcagagtgtgggctggcctgataaatgagcaaactttctgaactcacatggaacacattcattgctaaaaatagtacaagccacagtttaatacattgctttacaaccacacaagaattctgttaccacagaaatcagcaagtgctgtcaagtaggtttgtttgtttgcttgtttgtttatttctaacttttgaaagagttggctgttaaaacatttcttagggagtgatgcttggttatattcagaaattgctatttttttcatttcttactttaatttgtgcctgtagttatttataggcacagtgcttgtaagatagaatctgtagataagtgggtcatgtctcttttcagatttacatttatggatgcatcattggctggtgttatgagccacatgggactaattatactgcagaaatcagcaaagaccactaagcaaacaagcaggtctgtttgtttatttatttataactttaaagaagaggctgccgttggaatgttgcctagcagacactctactctgcattgcaaacactccactgtgcataatggatacttactctacctgcagggtcttcagaggtctgaacacctagtaaggtgtaccctgcagaggctgtggaacttctggtagtgtgggtacacccttggccaggagtcaatagcactgaggttcagggagtgaggtggcatattgggcaattctttctgtacaactgccttcacaaccctaatcatcttgtatccaagaaaaatagtcctataagatccatgccaattatcctcctcttcttgtgaatgtcccatcttccatcaacatgatcagatctggcataagaagtactcaaaattccagctcagactaagaccttctcacacgtgactcaaaagcaaacatttatctttatgacttgtggttatgactaaatgtgttaagcccattttgctatctttttcactaagatttccctgcagcctccctagtgccttacatgtgacaagcagtcaattaatgttgatttaactgaatgaacaaagtgcaggaaagatattatctgtgggtagccttgaaacagctctactttctgttgacactatataaagttcataaactactcaaagttcaagttcctgacttctaaaaaggtaaaggctttgaaaaatgttgtttcaaaatgaaggatgacatgcttctgacagccacagttcttgtagaaaaataactttccagtagcaccataatgtcttgtggaaaagccacttaaattcagggctggccagggagttgaagcttctctagaatggggctggctttgaataagtgcatttggtctcactatctatttttccatttggatacagtaagcattttaactgcttactgcctcatgaggttgcagctcttccgtgaattgagtccttattgactagcaaggtaacaggctgactacaacaaatttagtatgtgtatgtatgtgggtgtatgtgagcatattcatgtgccaagagagagagacagagagatagagacagagatagacagacagacaaacagacacacagagagggagagacagagatagacagacagacagacagacagacagacagacacacacacacacacacagagag

SEQ ID NO: 748 - DNA, 3400 bp, Mus musculus
ctgaagttcaaatcccagcaaccacatggtggctcacaaccatctgtaacaagatctgacgccctcttctggagtgtctgaagacagctacagtgtacttacatataataaataaataaatcttttaaaaaaaaaaaaaagaaaatggcgtcttgcttacaacagctgtcctcccttattgtctcttctctctaggaaatgtcaatttgaatttcacttcctattataggatttctctctttcaaagcagggctaggaagtgagtctcagtgcttgcctaccattaataaggtcttagagatgaagaaaaattcaccaaactattctttcttgacctcttttaataacaatcttcatcatgactatgcaaataagtctcttcttttctactggaatctctttagtactatccctttcacattttcattactgcttttgttatacaacataactgtatgacattatttactcatctggaatcctttgatgactattcactttctctaacaaaaatttcaaggccggaaatacagcaatttggctccaaactattccttgttagacaaagggattgttggtctattttaaaacagtatctcattctgtagcccaggttagcctttgaactccagcgtggcctcaaagtttcagtgatcctccttcttttgccccccaagtgctaggatcacacatgagagccacaccatccagcccccagctactttcttatttctgccacctatttcaaacccacccacagagagggaatcatttcctcccatcatatagtgattgaatttagtgaaacttgcttaaactgctgctctacattcactaatttcattgtcacaactattgctttgtgggttcatgttttgcacagagaataaaggcatgaaaccaagaaactagtacatcacttcaaataaagaaagagcgagcctcagatatgtccccaaatcttactgcaaagccagtgctctaacccttcatagtctccaaactccagaagcatgcctctacagagagactgttttggtttggggaatttttgttgttcagtttgaggcttttttttttgttgttgttgttttttgttttttaggaaagtccttttcaatccccaaagtgttgtctacttatcgtcaatacatgggtcacctcctaaagtacaaacttgtccaactcaccaataagactctatctgtactctttttagcaaaatctctattagtgcatttaactcatgctactgcagtctcctcctccttgtacactggaacacattcacactaaacctgcaatgaacacgagagcaggagtgatacctagtcacactgtcccctaaggcatccaacatactgcttaataaatagatgctcaataatttttctattcaaaagaaagatgggggctggcgagatggctcagtggttaagagcgccgactgctcttctgaagttcaaatcccagcaaccacatggtggctcacaaccatccgtaacgaaatctgacaccctcttctggagtatctgaggacagctacagtgtacttacatataataaataaataaatctttaaaaaaaagatgaatgctttttaaaatacttggaatagccaaaaagcaatataaaatatgccaaattttataacctagacccttaagtacctctccaaggcaaaatgactaatataaatctcaaactgtgtatgtttattggttacttgtgaactaaaattagaaatggaaagcagtctaaaagaatgatcactgtgtgagaatcatttcctttgttgccatggtggctgctgcacagcaaatcctactcagttgttaatttcgcaagtagtcactgtgtctctaccagcagctatgaccatggctgcaaataccaagtcctacacagagatcacctcatttgcaagcattggtataagctgtatatcaagacttgaacctcccagaacttataaatattctcttttttaatctttaaacacattcatcctcaaacattatgtagtatttctgggttcattctttgaagaaatatcaagatataaatgttccctttaaatagagaaagccttacaccagaatttcattgagttccatgtatgacattaactgaagtatgtatgtgctatgcacactccagtgaagtttgcttggtaggccaagaggcctgggagcactcacgaggcaaagagtttcacggaaactcacctcccggaactttggcgttctcataacctgtatactcataccctatccccgcattagtctggtgtatggatccacgtgctctcttttagtattatttattataagtgccttttaagattgaattctgacatagctaagcctccaccagtgttccaatgtcctagaaaatgcttgaagctgaggagcttggaagagacagtgaaacaaattaggcattacaaagaacggaactagaatagctcagggcgaaagtctgcagagtgattacttagggcagtagtcagtctcacccatatacaatggcctagctaataggccattaacttttaccaagtaaaagttagggaatcccactgagacaggaatcttcactacagccaggtatagcaggctacattgcatattagaagcaagttggtgaattcttctgacaaatggagattctccacagatacttaaaagttacactcatacaagaatttatcagggcccaggaagtagaggggttgtggtattgcattattcatgagaaggtctgctagagcagaaccccctggtgctagctttcaaaaggctcaaagaagtagcacaaattatgactagggtgtgaaatccttagctgtcattaagctgcccctaagaagagctgcttgatctttactgtaaacctttacctggttcctgtaagtcctcttgaagtcattcctttgttttgtgtcaggcaacttcaatgtactgctgtgacatcctaccccctttattttctgtattatataagactggtgttcactttgtgacaatacattcagattctacacaatctcctgtgtgcatctgtctgtcattcaccgactccttgcccatctgcaccgagagactcgtcctacgcagacaaagggactgagagggtctgcagcatgtatgtgacttagttttaccttaaccatgattcttaatgtttccaacacagtgttacagaattaaggttctcttttccttactcaaactatcatgaacacctattgtactggctagttttgtgtcaacttgacacagctggagttatcacagagaaaggagcttcagttggggaaatgcctccatgagatccaactgtaaggcattttctcaattagtgatcaaggggaaagcccccttgtgggtgggaccat

SEQ ID NO: 749 - DNA, 3475 bp, Mus musculus
ggtttcagggggattgtaggtgtaaattggcccagtttcatagtcaattatcatttaagatcatcttgaactgtttaacagacagatcataagtaattttcacatacaaaaataggacatagtaattagcttctgtttcccatgtgtttaatatctcgagattagatctattactcgaagcaggtggatatgctggttccattgtgaggttccattcctagtcacttcccatcgtaggtgacggaccgatagtttaattctttacaaagcatggtgtctctgttaaccatagtcagctggatgttggtgtggagagcaggaggtctcattccctgtgagcacagtcttagatgttatgtcttcactcatatttggctaaattcataaaatgtagtcagccacaaaaacatgaatctgagctaatgtgagcaaaaccagggaatgagtgatgtctgtggagggaggtgaccttatcgaggagtggcacagctagagtaggaaagcccgtgaattacgtggattagggcgtggctccacccaaccagactttccgttttcttaactgtaaagacacttaacatcgccccttgagactgtccccttgcaagaatgtttgtggaccattcactaaaggagtattcagctggaggtgactttgccatctaggaagacatttgttggcatcttgttcccccccttcagtattaggggttgaccccagggcctcagatgtgcttgcaaatattctaccactgagctgcagtccaaacgtctagagacattttctaattgctgtgcttattgtgggtggagagctgttactgggcttggtcacaggcgcttgttaggtgccaagcttcccacagtcccacagtgcacaggacaacttccataaatattacctgaacgtggatgtcaacattgttagactttagtgcaatacgtggcccaaagtaaaaactcattaaaaaaaatagtttttattgtcattgtcttcatcatctttatcaccaactgctgatataaaactgttgctcattgcattttgggttctctttgaatgtgttccccatcctttctcttcttgtaggtgaatttatctcaaaattagacttctatcagcctttcaaccaaccatttccccccattatatcagaccaagatttcttggtcaactatttcttgtcctttaacatattttttctgttgttaagtccgtgtatgttctagagccagagtgctgggaactgaagtccatgtagcactgccttcttcaagtgtgaccttaatttatttattttttaagtttcaattttctggtgtgaaatggagattactaatgtacctttcatagagcttcagtgagcattaaaataaacgagctacgtgaaactcttggcttaatggagaacaggtgctcagtatgtattatttcataagtaaatacatgttgctgtgggttattttcctccttaaaaatagttatataattgggctttggcttaaatccatgaaagataagctgtcttgattactaataaaatagatccttcctgtatctactctgtcctgtccagactatagctacagccaccttagtttcttgtgcatcgcaaatatgggctgtctgaattgatatctgtttaaataggatatacaaacttagcagatttggcacaagaaaattatattataaaatgtctcagaaatgtttactgttgatcttgtcttcagatgaattatttttgatatattgggttaaataaaaaatattattggaactgatttagcatatattgcttttatgtttatgaaatatggctactggaatatgtagtttcatgtgtggcttgcatttatttctgttgtactgctcaaggctaacgtaagagtcaagcctccagcaatggaggctcatctgtctgaatcagtatccctgaatggtgtctggcacactctcaacaaggtaggattggttgagagtctgtcccttaggcccaatttgtctggcttgcttgctgactctgttagttactttatccactgctgtgacaaagtatccaacaggggtaatttaaggaagggtttattttagctcacagttgggagtgcatttgagcatggttggtaaggtgtgggggagaggctagagacacccatggctctgtggccagagtgtgaagaggagagagagagagagagacagagacagagacagagacagagacagagacagagagatgaatgcttgtgagctacccactttctcctttttattcagcctgaggcccaaagtccttgaagtgatacttatcacattcagtgagggcttctctctttcctcaaacccagaaagaccctcccagctgggctcagaggcaagcctcctgtgttatcccacatcacaccacgctggcaggcaagatgacctattacagaggcattctaaagtaatatgattaaagatggcatgcccagggctttgcactctctttggaacttggacttttgtggaggagatgctgtttgtttgtaaagctccagtcacccttggagaccccattccagggagctgccattcctacagtggaagcactgagcttcttggcctgggtgttctttgctgcttttgttgtctagtccagtgacttcacagatttgtgaagttcttacactcttgcaaaatctctttccatttgcttgattgcagtatagttttgttgtttgggttcccgaatgtattctaaaaactgcttagagctagtggtatggcagactgaagaacctcatgtgctccttcttaatacaatattttcttccacttggtacccttttttttttttttgagagctgatgtgtgaagtgattaattctatttaaagataaaagctgattgagactgtttgcataatgcttcgctgtaggtgttgatcttttaatttgtacttcagagtttccacacggtgcttcagaattcgattgccaagtttacaaattggtaagtgagatggtatctattgtaaataagactgaatgtggaagcttatggcagatatcacaagattatgtaattataaaagtacaggccctgacagatctgccttggggtggacaatctctgctatttcttgctttacattgcggagattgtgtagacatgtctatgtgttgttaaatgcacaaaaggagtctgaagggtcatagtattccactcaatgatggtcattttgatcctgtttgtatgcagacgttaatgtttcattttctgtgcatatttttaatcacaaaactgaggtttgttaatagtttgtgatatatattgaattcatgctacgtgaagccattataactagacagaaacaatccagtaactggtacagctactgggttggcattgcccatcaaccttgatccagtactctactggtagaaattacacagtgaaaagttcagttagagtccagatgttagggaa

SEQ ID NO: 750 - DNA, 2675 bp, Mus musculus
cttcatttacatttccaatgctatcccaaaagttccccataccctccccccacacactcccctacccaccccctcccacttcttggccctggtgttcccctgtactgaggcatataaagtttgcaagaccaatgggcctctctttccactgatggccggctaggccatcttctgatacatatgcagctagagacatgaactccagggggtactggttagttcatattgttgttccacctatagggttacagactcctttagctccttgggtactttctctagctcctccattgggggccctgtgatccatccaatagctgactgtgagcatccacttttgtgtttgctaggctctggcatagcctcacaagagacagctataccagggtcctttcagcaaaatcttgctagtgtatgcaatggtgtcagcatgccaaacccctctgctcctttggaaagtggcacctatgaccgacatcaaccaatactatgcaactgtgtttatttttgatgatggcactttctctaaggaaaaacatattacaagcagttgttagcttggggttcacacacaaatgggcaacaggtccgatttggctcatgtagctcagttttccagttcctgctttggtggaggatgacttacagggagagattctcctgtgagtcgtactccagcatcagcagtaaaaataacagcagctgggacttgactacccatttaggtcaaactggatatcagatattgttttaagctctttgggcaaattatcttccttactatcttagtgactctgcgtaataggtaactctgtgtaacagacaccgttatcattcccacctcgcggatgcgaaaataagccctaagaggcgctttgtgagagcagggatccccccagccttcctcaggagtccctggcggcatcattaatctcatttgggtcattagacacatccccatcagcacccaggctgcagtggctgaggctcacccagggagggaggctgcagatagcatgctcacctccctatactaattttagctacaaaggcaacatcataaagcttattatgaaaatctagggaccattggaaaagctaacaaaagagaacagatgcatgtttgccacacacagttcatctccctcagcagttaggtgccagcattccctgtctttcaccagtgttttatgtacaagttgcttatatttttaatacttttactgaggtatagtttacatgtaatatgattcggctcttccaagtatgcagcttaatgggtttcgttatacactattcattttttgtaaatctgttatttaaaaatcttaactgagctatttaataatgttactcatataattataatgctataattatatctgtacaagatttgccaccatttaaaaaatttttttcatcaccccatagaaatttatagccttttagtaataacttcccgttcttttctcctccctccagtccctggtaactgcaatctcctgttctcctatgaatttgaacattccaggccttccacaagagtagaatcatacagtacttgttctcctccagcctatttgcttagtctaagatgtgcacactgctttttcagtctatgccgtcagttaataacacattctgaagctgtttcgcataggcagagcctgggaagagtaggtgggccagtttgtctgtctgtctgtttgtctgtctgtctgttttgagacaggtcttcttcatgaagccctggctgtcctggacttgctttgtagaccaggctggccttgaattcacagagctccacctgcctctgcctcctgtgtgctgggatcaaaggtgtgcacaaccatgccagatcagtgggccacattttataagccatgcttaagcatttagattttattggataggcagcaagagtagtaaacttccctccctccctccctccctccctccctccctccctccctccctccctctgcccttcccttcttctttcttcctcctcacctctcccaccattgctcctttctcttccttccctccttttcgattttctcttccctttccccatttcctcttttctctcagtaggagatagattgttcaggttggatcttgacttacaagatcttgacttcctgagctctcttgatagctgggcttttaagctcttcctgtgccagtgggaagacatcttccttcctgcccaggtggtatgtgtaacatccatagagtttgggggagaaactgattgctggctctgcagtccaccatgggagcaacatgacatgttattctgaggataacaagacaagtgagttcttatggcaggcagaattgttccctgggttgtactttggcttccatgcccctcatatattacgtgtgatgcatctttttatgaaaagttcacaaaattttccctgtgagcatgatcttcatagttacagagatgttaaagtcagaacataattcagggatagaattgtaagtctttaagttagaaatgatggtagagtactttatctaattgacaaatatgatgttaattgtatatcatactttgtaatttatataattgtcatggttatgctcaacttatgtttgagagaagagcctttttttttattggacagaagaagtgagatgttggaaattgatcctaatgc

SEQ ID NO: 751 - DNA, 1925 bp, Mus musculus
tttgtccctctcagaataaaaccagctctaagatccgtagaacatcttgttttactcaaagcaagtgtagagaatagtgttaagtccctgtcccttattgctcttttaagttccccaaacactgtgcatcccagaaaacaactgtctttagaaaattagtggatatattatatattattctatgtcaatatgctatagtacattttatagacttctgggggaaactgttcactttctttaagattccttcaaactagtgtactcagatatcctcaggctttaaagttgtgtctttaagagttgaaataatgagatgctgggggaatcttccatttttgaacagccatcaaatgtttctagttgtattgccatctcttgggtctaaagagacactaaatttataactaaagatgaataataatggtgcatttaggaactaactgttttgaatgtattgatttataacccttataaaagaaacattacatcatgctctctgtgtaggcatcagttatatgcttataacagcattggagagctttgcttgaaactggagtcctggtgctgaaatgaatcataatttaggccaaattgttctaaaatttataacaaattggaattagcataacagcccagcagctcctccctctatcgccgcttctgaatgggaggcccgggcctgatttatttgtgttcccatgatcatccaagagtggtattttatgagagcaaagtggactggggaagtttgcttttctaaggagtttcagtggtctctagaattaaccttgctccacctttaatcctcatggccaggcttggttttatcaggcggtgaccttgtactttgaaggactggatccactcttagtttaaaggtctgatgtcagtacagtgaaatgcttaagattccccaatgaggggattctacggatccattttgcagtgagtcccacaaactccatagtcagggcagcatgactcagcatggatttctgccccctctgactggttgcaactctgtgcttccttgctctccccacctcacaccagttggtagagcaaccctatttccttatgcctaggatctacctggggggggatgccttcccagcaagttgtcctcatgggcaatcctgtggtgtgtgtttgcaataattgtccttgactatccccctcaacacatgtacttttaagtgtgcaaatgtgtgcaagaacctgaactctatcatctccctatttcacaaaatcagaaagggcagctgttccattctatattgctttccttagggaaaaaccccctggtgtgtcagccttagggatgaacaaataactcttcatctctattgataagggtgcttttttaaggatcttatgtagtactctttgtctgtgaacactcaaggagatgggacagtaggagaccaagttaaggttccctgagatctattgccacatttgctttgagttgattgagctcctgttatcttataattgagcaggcatttacttctcaaatcattagaaaggaatacctttctctgttgaaagcatatgtaaacttatgacctgattgatacaaatatggatgtaatttctggtgtgggatcattatgctagtaaatatattttgatacaaatgaagaattggagctgtgtgacatgatccacagataaaacgttcaaacataggcagagggttttacacactgaagcagttgtgcaaaggtcagtggaattcccagcatatcaatcctcagggaagatggaagaacagcggaagggatgctccactggagtggtggagtttgtacatttcttgattctctttgcatacagcagacctgtgcttgacctggagttggaaaaatggagtgaataggaccaagccttgcaagaagagccttgtctgtcctctttgtctg

SEQ ID NO: 752 - DNA, 2300 bp, Mus musculus
gatactggtttgtcctcagcagatgactcggttccttcacagaccacgaggaggctttgaggctggtgagaagcctgcatatgttactgcctcaattctctgagttgaaacccagcatttttattccctttaattttcttttgtttgttaacaggtatatacctatagggatggaaggaatttctagctctctggagaagtgggcaggtgttccgtgggatttgttgacatgtgatggaggtatctgttgcatatcaacagtatcaagcaatccctgagtgagcattattcttaggtgcttggactgatttgtgtgtgcttcttttaagaacacctctattagggatggagactttctaatgaagacaaggagggcccaccaatttaacaaagaatccattaatttgacatcaggctaggaaactgtggactagaatgagcaccattggtgctggctccagaggtctcatggcagagaggcaataaataggaggtagttgctagtcactccctagggttgagtttgtttgggcgaaaggagttactgggggtatggtgtgtctgggaacaagttatggcccagtggattatgggatcatgagcagtgggatgatcccccagggtttctcacataacccaagccaacttggccggcccactctgattgaaggtaaaatgaaagagaatggcagaattacactaatttcatctgatgtactttgcttgcttactctgctttcccctctaattaattatcattcaaaatgctacctcatgcatcaggaaccagcacgaagcccactgctggagagcttaacattggaaaagcttaattcggtgtagttggccagcagccctgccgctctcagctaatcaggtcccagttgtgctggtggtcagccaggctgtgctgtgctgtgggttctcagcttcctcaccagaactgtcgtctctgcacgcagcgattcagctttgcattagccggactgacatggccagcctttccccgaatgttcccagtggtgtatttgcagaaggctgctcccgggtgactcttctctctgttgtttattgccaggctcaggctccgcctggggagagcgtccacagattctgctgccagcttcccagcttctcactttcgtgctaattccttggccttcctgcttttccttccccctatgccactggcctgctgggaagcttgggagaagatagaccatgagctttgcagttatgtagatttggatctagtctctgatctagtttttaatggtgtgacattgatcaatttgcttggtccttgtagcctcagtttatgcatctggtaagacagtggtgaaagaggaggcagtaatgatcagcatttggtaccaagcttcttagcatccatcccttttatctgcacatacatgtatattttccttctccatggatctaggcgtttcttgtttctaggccccagaaggatttacactcaacgacaactggcctaaatatgttatttccaagtgattaattatgccaagtcctgtggtgcagggcatacttggcttggctttagccagttgtcttttctaatccttcagactgtgttcacaaatctttgtgtctctgggtggttggggtgagacttccaccagagtggcttcttccctcgtctggagactgagtgtgagggtaagctctggattttgagtcgaaggacacacctcctctgccttttctttcagctcctatagtgaaagtccaggatcattgtgatgcctttagaaatggatgacgccatgtcctcctgatgcccacagtgggcctggccccttgtgttcacttcctctttagagcacttggcaaatgaggaaaccaaaaagcagatgtcaagtaatttgtatgaagtcatttattttactaagagatggaaggagttccagtctaggtatggccagttccagagtctctcctccatgcttggtgacttcagaagacatggtgtgctacactttctgtcatggacacatgcgtctgtctgtgccagctctgtggaggaagatttgcctgaaagctttcctcgcgcctcatttctgagagccttactgtgtaaacatagatggcctctattgatctgaaggctggaggaggatagttctgtccagctgtctgggcatgcaaatcatccaaaagatgggaactcactcctgtacagtggccttggcattgcccagagccattgctcctcaggtagactgacccactttcccctttgttagtgcaggatagatgagtcccgcgagggtgaccca

SEQ ID NO: 753 - DNA, 2025 bp, Mus musculus
agactgtttagtcagcttgcaaggttggttataaacagtgtgcgagcctatgcaaagtcaagatcctaatattctgcttctctcggtgaacgcttgttagtgcaggcatcttacaagaatgcacctaagagttcctaagaggaaaaagggggaccttgcttcaggtgggcagagatggtcatctgatactttttcaaagacccacgtgtgattctccacaatactaccatccatcctctatccatcacttctgtccccatggtaacaagaaagtattctgctatgtacctcatagacagccaaacttgtctatataaacagttctttaacctggctgattagggatctcatcacaaatagatgttgtgtctgtcatgccttgtactggtgtgcttttctacctataacatataaataaataggcagagcaattgatcgtattaataaggaaatctgcatttagggtattttgacgaacaaataactacctcagctaggaggggagtatatgtgcccattgtgatttcattgtttttaaatatttaatgttggtctggagggagtaaaggggagtgcgtagaatctcgttgatctaaccccttttatgagacaaagatttatgagctgtgttctttgaactttcatgctaaaattttgaatggtaagcagtctgggatgtcaacacaatctcttccttggaactcacctatgctgcttttattttgaagacatagatattgagaatcataaaagaatgatttgttatatataaaaaaatttcctctcttctctttcttcactggaaatgtttcaaacagtttcaaaaggaagagtttgaatcagttacacacattctccttcagcctcggcccaggtccagaaggtttgcagttgtgcacctgggagcagaccaaatgcgctacaggcatcttctgtcattacccctcagagccaaggaaactaatcctattctccgtgtcagtttctgttttcctcctactcactgcccagagatgcattctgggctccagccccacccccatgacaaggctgtctattcaatcagagacacaaagttgccttgtgccaaccaggcatagaagacacaagggtgatttattctggctaataagatgggagaaaacatgtagaggccaattgtctgctgagaacaagaacagcttcatgtctgggagtgtataatgttgtagcagacactatcatttgtttttcttgcaaacagccaacctcctttattgcttagaaaaagaaagctgtttgctatagatagcaagcaggtgctatagggtttgttaacacacccactggatgaacaaatcacaatatcttgatgcactcatggtgccagccttcaacatcttcccagggatgagaatccctggggtccatgatcacatgtcatcttctcctacactggacaggtgattgtaaaaataaataaataagtcatgggagacactgcagcctttaccttgctcccttggatcactgaccataaagaaagatcactgtgacagcactttgttaaagtccaaatggccaagacctggtgtgttcccaaataacacaaattcgtagtccctgttcatgagctaactcctcagttaactggaatcccagccactgtctttcctataatttcattatacacatttttgtttgtttgtatttgttttttaaaatcagatccttactatacactgtaccaggttgaactttgacttataattctctctctcttcctctttgcctcccatgtgttggaactacagacatatggtgatgtgcccacccttataagatatttaattcagaagtattcagttaagtttaaccctaaatcatggcccgataatccgcaagatatagtatgtatttattattttaggctactatatttcaagttaattttctatgaggcagttcataattaatacaacaataatgtcaatttgtgctgcttttgttgtttatatgtagttagaagaccatgctgtaaatatc

SEQ ID NO: 754 - DNA, 2150 bp, Mus musculus
cctataagacatagtaagtctcctgaggtatgttaaagaggaagtgatgtgactaagggtagtgatggggaagagaaactcagggagaaaacaaagaaaagcaaatacatatgtacacacatacacacacacacacacacacacacacacacacacacacacacacaaaatgcagtgttctgccatttattctgctggaatctaaatatcccgaggtatgtggctaaagaaacatagctcttaacctgatgagcttattggacagaccaataaagatggacttgaccatggctggtagtggcaagctctgttcttcctcagacaggcaagataaagtttgatacaacttattgttaggtacgtaagatacaattgaagtgggttccatgaggtgggaatcttgtgggaagtcctcaagttatggtgttgaagggtctttatgggacacttatccaaaccgtagccatcagggtgctctgaagctgtatgtcaacttttgtgtatgtttcttggatagggtctataaccatcagttcatgttcaaagacacttaggacccaaagatatagggtgaaaatccaattattctaggtaaaatggtctactttttatgctgaactgctcctaagtgagataaaagctcaaataggttcctcgtttctttttaatgaagaagctatgttacctgacccctcacagtgtatacatacacacagcaagcctggtacagactcagccctagtgtggcaccacgcacggggtgtttttctaggtctacagatttagcactgaggaagaccagctgacccaaacaagggcatcaacccagtgccgagggcattccaatgacatcaccgctgctagggtgactgggttggccgtgggagggcagaagcttagatgtctgcagctcggagcccaggtggccggttgagactaaattatcctcctccaggcctttgttgctgcagctccacacagaaacaagcaaatgttcccttcccaccgtgccatgatttatgttgacagttgcttggtaaagcaggtgggcaggaaaggttctcccagcaggagaaggctgtctctgctgcttcaggaccagctcttctgcactaatgagctgggtgtagcgctgctgcagctgcagcgggtggctcatcctgaagcagctacatccaagagaagttaattcattgacagagaggggaatggcttgggggcagggtcagtgtcccccaaagtgggtgagtgagctcggcagatgattattaaaatatgactgtattcgtcagctgtatgttcctgggatggagtcatagatgccgttaactcacaaagagaaacacaaacttcgctcttagttttaaaatcccaagattgggtggactcacctcttggtaaggatggcagcatgtggcagataattgtgcgcatcactagccaggaaacagctgagaagagacctaagcatccccctgtaaggttcttaaaggttctgccagtcctcactagcaccacactgggtaccaagtacttgtgtactaaagaaagaaccgtgtacaaacaggtgacatcaaccctgcttcttaatacttccattggattatgaccctcccattacttagaggacagggtcctggtgtctacctaccatgttttacaagaaagctcttatgtgggtctgcattctgcctggccgctggagggtgtgaacgctgactgggcagacagaactcagaggtgttaggctactaagattggggccccagcctgggtgagaaacaaggcatgctgaagccaaggaggcaagggttcccaaactcctgggcatccagtcactaccaggaaccgcatggagtcgggaataaaggggactcacagaccagcgatgagccctgggccagggtgagggggaactctggcttagctcaggggtgagtgtgtctgtgtccggagggcagaggggaccttccgtgggagacttagatggcgcagctctgtatgacgaaggctctcctcatggtggttcttgatgagcgtcacagtatttgcgcatccaaactgtttattcatagttcatcgtggaaaatggatgcacaccacttactcagagtggaccagagattaaatatcttttgcaggaaggagtg

SEQ ID NO: 755 - DNA, 2375 bp, Mus musculus
attaaaccaacccgccaaaggagactgagcggattttagaccagtcaggcttaaggcacaggaagagaagccatccaccagaagttggctactgactgctccagcagacgccatctcacgggagaggtgagcgcctcttgtctatagtgtccctgatgcagctgatggatgctttgtaaggcaagctcgtttcagtagagctcttggtgggattctttgggctacaagagctgtgcccaccatgcttttgcttccctttctggacactgatctctgtgtgttctatcttcattgagaaggtcaggttaaaaacaagcctggttagcctctgtcaaatgatgtcatgcctcaagttccctgtctgtaaaatggggatgctagcactccttcctcctagatgtgaagaacaatcacttgggatgtttgaagtctttccaatagttcatggtacatagtaggcatcttatagagtgttagtgttttactttagctagagttctttcggtggtttctttcttaacattaaaactgtgttgtttcctttattgagctcacacaaagacatgagtaatccagaagtgattctttgggacattaaaagggtggcaaaataaaaataaaacactacagctaaaaataccataaatagaagttgtgaacagaaacccagcataattgcaaaatctaattcttaatgtccagggaccagcaaatttgacaggctgataatttcactcaaataacagaagaaagaaaactgtaaaccgtgccccatgaccctctgggagtaggagttgacctggcagttggttcacttgtccacagactccagtgtgccctctgctatgaagctgagccagagagctcagggtcttccagtcactcaggcaaagcgtattggcctctactaaagtctagccatccagaccaagtacaaaatagtgtttgggaatggaattgattactctgtcactcagggcccagaagagggctcaaaggtgtcactcagactgggattcctcatgcagaagcagctgtgctgagaggagtgccaggccaaccccaaggctgacagcaaacaagctcagagctgaacaacctctcagcaaaccccaccaagtgcgtggcgcttggttcagggttgtatgatatagaagagcaacagtgtatgagagtgagtgtttcagtgaccagcagagtcagagtctgtcctgagcatgggctgggagcacatttgagggagatgtgttcagtgactggatacattgtatcacatttgaaggagatgtgttaggtgactggatactgtgcatcatatttgagggagatgcgttcagtgactggatatgtcctgtcactggaaccctttgcttcaaatggcctggtttggttcattttcagttgatttgggttttgggtggtcatgccgatggaaaggttctttgccgtccctcatgacagggcaccaagtattcataagatgctgctaccctgagagtgctcagccatactccactctccccaccgagaagggagtgaacagactgtctcttggctttgtttcccagggctctgggaaacagttctcagcaaacacatatttcagctttgctctgttgagatttgttagctaatgagatctgttagagatagggtatgaaattaactctttccttttctgcatgtgtctgtgtgtggtgttgcaagtgtgtaggtgaacacatttgtgtgggtatacacataaagtgtgttcatttgcacattgagggcagaaatgacactaggaatcttcttcagtagctccatgctgtctatactgatgcatgtttttctgcttgagcctagagcttgctggttcgtgctctggccagccagcttactctggaggtcctgactctgtctcctaagccctggaactacagatgggcatcataccaacctgtcatttacaagggtgctaggaacccaaatgcccattcttacactgcatagcgaatggttttaccctgaaccatctttccagccctctcaaatgaagtattctttcagtcagtcagtcagtcagacagtcagccggccagccagccaatcaggaggcagagcctacacatgctctcacctttcccagctcagtctcttctttgtacatgtcagaaacaagacactaagaggtctaaaagcaggtccatccatttgcctaggaatttcataaattcattctttttaatagctgagtagtcctccattgtgtaaatgtaccgcattttctatatccattcctctgttgagggacatctgggttctttccagcttccggctattataaataaggctgctatgaacatagtggggcatgtgtccttattataagttgg

SEQ ID NO: 756 - DNA, 6225 bp, Mus musculus
attaatggactttagattcagagagagatgctgcctccaaatataaggtggacagcaactaaagaagacatcaaacattcacctctggtctgtacaactgtgttcatatacatcgatgtgcatcacacagaggattataggcccttaatgaatgttagcacaagttgacagaatccttctgctccctactgctgtgttgtttatgcaatggaagtctatgttaaaactatcttgtctacagattgctaagtctgtgttaataaaacgattttggaggctgggagacattgaaaagacttcaagttttctacagttgtcagagtgcatattgtgacttgtattctgtgtatatcaccttttaaaatgtgccaaagcaaaatcaagcaacaagacaaagtaaagtgtgtctggagagtattcctcaaggcttatacattgatggaatcaaaatggaaatttctggtatccttggagacttagttatgtcgtgtgatatttttttctggaatctgtcttaagagaggatgttttgctgaagcagatacgtgagagtatgttttgctgagaacagacacttggtgttctgcaagctaactggaaaaagggcatgtgatgttttgcttaagtagactcttgaaaggacattaatgtttggaaagggtctaagtataacccaacagacagtagatgatgctgtcacattggttcaccttgccttcatcgctgattattgcttgctgtaagaacttctcatgatattctagcagctccttgcatcttctgtggacttggctggttggcaaagcactgcaatttcttctggatagaactgcctctgctgagttgtgaatggtgttggcgagtagagcaagctcccactgctgatttgtgtgtgctgaactgctgatatcctgacaacaaagattggaattgcgccaaagaactatttctaaatggatccacacccccctttgacctgttagccttttctttccagtacttctgtaggcagtgggctagaagggaggttaaaatgtttaaaaaaaaagtttttaaagtaggttttgaaaaatctaagccaacagggcataaatacttattatttaaggttttggagtttttaacaccacttttaatcagtactatatagaaacccaaaggcagttcaaatcaggttaaattttactactgtataatacataaatttggtgtctattataaatatgacagagaatccctggtgtctgatgagctatgattttccccggagtcaaattaatatcatttaaacatccaacataaatgtagctataagatttgatgtcccatcccttctcccaactcagctgaaaagtttcaaacccagagtagcagctagctcagagtcagccttttctccctctttaaactatcaatagtagtccgtgctggatgttagggtctatgagcttcacaaaggcattcagatgagttgggttcctaagaagggcttcagtcatatctgaatgtgggcagactttccctctgtaataatgaaataagaaaaatcatcctggagaggcctctacagagcaactcaaggaaacatggcaagaggcttgaacatggaaaccttgcacatatcaggaattcagaaaaagatcagtacattttaggggattttctgatgctcgacctatagaaccccaacttacttgatcttatttgaacagttaatctctcctttggctttgcctatgttgtattttgactgtgtgtaccatcgttcctttgatgtccaaatacagcttcagcatccccaggtagcttaacaaattttttagtggctcacatagaacctactgctatagtgcagtcactgtgagccattagagttgggccataattgacctaaagatttctctttgaactggaatgtttcattcctggcaagagaatacctaggagaatagatagttaaagcactcatgtattcacttaattatgagcacatgtagtcttagctaccccagtaacagccaacttaatactaagaactccactcattaacatttgatatgggcagctgggggtgtagctcatgggaagagaatttacttagcatggaacatgcatgaagccatggatttgaccatgttgttgactgcctgtaatttcagcactcaaataaggatcagaaattcaagggcagcataggccacatagcttgtttgaagccaggctgaaatttgtgatagcactttttttttaagccataaaattgacattgtaccaatttttctcaaaataggtcttagaaagaagagggtatttatggtatcctataggtgggcaaggtgaacagcatcttgctaatgagagttctttttattcctcttgaaatgaatggattctgtcagttgtctctgccataaatcctgggtggttatcatgtacaccagtctaagaaaaccacaccttgcatagcacaacccacaaaactatggctggtatcaactcagcttggagatagaggttgaaaaatgtctcattctgtagcccacactagctgtaattcactctatagcccagattttcttcatacttatggcaatcttcctgcttcagtgctggggttacaactgagaatcaccaagctgagctcatctctcaattcttttctctttccagacaccttcacataccctaggtgagaagagaagagtaacttataaaacacagcatccagagctgctcttcggagtctcatgaagcataaagtgaaaggagatccggtgtctgtccattgccatccgttgttttcttcaggctcctcaggactgctgactgctgcagctagtgactttctgggtttcagccttctggacatctgggagcacagtggggatgagccacaggagtccatcatgttggtgtgtttgccctatttatagcctacctcctgctaaagagaggactgaaagcacctcacaaaacagtaacaagaagagataaaaataaacaagtggaaaattcccgcaacaggagtgttgaaactgcactggatgacgatttggacacagacaggcagacatctgcaagtactactaacctacaagcaacatacattcaaatggaaggtctatgaaggaatagtacctaggactcaaaggcagtgtatgctatatgttcatgctctggaggcagggagatataggctcttcatctcttcatgaactcgccagtgcatctgacctaataaagatctgcatccaaatctaggacctgtctaggaaaaacagttcaagtcttcaaaggaaagggagtggctttaaaaactactcaggcatcatccctggcacagaaagaacatataagcattgacagatgccagaccaatcccaggtccaggtgtctacatccacatatctctagtctagattttcaagtttgtaacggggccatgagatttctaaggaaactgaagtttgaacattgaatttaagtcttttctctatgtgaattgtaaaatgttgaaagtggaaacactgatagttgtgggggaatagcagagcatataacttactttgcatgatgcttgataatcacattccataccccaggtttgatacctaactctgtaaaagactgggtatggtggtgtagcttataacacctgcactctgaaggtaaaagcaggggtcaaaagtgaaagtttattattcttggatagagaactaggttgagactttgagatcagactgagctcacaaggtctcatttggggataaaaaaaaccctaaagccctaaaatattaatatttgatatactactaggagtagtatgagattttactattgaaaattttattcatagtagagtgaagcactctcaaatcctcttattcatacccttacatatacagaagctacatcctatgacaggataatccatacattccatctatgacaggtgttaacatcccactatcttttataattctctaaatgagcaccctggtcttggggatttggctaatctgctacctctctctgtgctttttacaccgcattaaggttcctcctttttattccatacacatatttcattgcaatagtcccaagcaacctcctggatgttttaaaccacagttcaccatagccttcatcagaatgcactgacgttcactgaaatgagcacattttctactctcctttagaaagcgtctcttccttgctgccatagtgtgtgttgcatgatattcttaagtattccatcttagctgcctgttattttaaataaactgacacagggagatgagaaaagaatgcttccacgacttaaagctgagtcttcctcacagcccagcagtccatttctctaaggcctatccaccacactactgccacacatcctgctttgctatcattcccaaacacagttgtctcggttcctctctattgtatctctattgtataagttggagaggaccagctaaggaagctggtaagcaattctttgtggcgtaaaatgcatgagaatttttaaatgacttgtcttaccaagttagtaatgctgcatttttctaggtccttctgttggttgctatagaaagggtgacataaaccagtggatggcactgtgccttctaaagtcacacctcacaaaaggatgtcaactggatgcaaagcaaaacagtggtgattattctcttccctactttggaattgctcagccactagcctcacatctgtgagactgagctctgctctaggataatttatgacatggaaacatatcagtctttcactgcctacaaaacacagcacatattcagttagggcctcagtgaatgccccatagaaagtaggcagatgagcgctgttcctgtctctgctgccagcattcatccttagactattcactgaatatttataagtaatgacttttaaaggaactccagaaatgttatattttctcaatcaagtacccactgcagtgtgatatgccagcttttggaataagaatggagacagtgataataattcagcactgagctagctgatggtttttccaaacctcattcctctagaacatcaaatgttaaagtggccaaaaatgttctctttgtgaaggaagacataaattaataccacatttaagctttcacccagaattgaataattcaatacatatttaaaataaagttattagcttatcaagactagttacagaatacattagaggatagaagagaccccagataagagtgtacaagtaatgaaggcagagagcacaacagaaatcagtgatgggagatgactggtacccaatacctactgactacactgcaccaatcagattcccctgctcaggtggttacatggcttaatttctaccactttctggaaagatgaattctgctggaggcagagctccatgcactcaaagcaatacacacatgaccatgtagaagacagaatttcagaaaattgaggctgtccatctactgctttatgctagaaatttgtctatatcttctgccctaactctatgaggagtatatttgtatatttgcacttttgctgatctattataagaaaaaatgtgaacctgagattacaacatctacatgctgcctacagataatcagacagttatcctttcaaaatgatgtagctcatttaaatagtgactgaagcctgtatgtgtttctccttgctgttacaatacattaatacaaaagcaggggcttaaaacatcacaaactcattactttgtacttttagaggtcaaaggtctagaatgggcctgactggactcaaatcgatgttggcaagctccatttcatctatgagcaacaggtgaatctactttattgccttctccatcttctaggggtttctggaattccttcgctctgggtcaccctgctctaacatttgcctccaacatcatagatccttttctgactctgacattgagtttcttttctctgcttgttgattggtttagggttgagagttttccttttctgttgttgcttagacaggatgttgtgtataccgggatggcttcaagctccctatgtgacctaggatgaccttgtacttctggtccttcagcctttacctccaaagttctgggattgtaggcatgcaccaacatgcccagtttattcccggctgggatcaaactttggacttttcttttcatactaaaaagcactctatcatctgaattat

SEQ ID NO: 757 - DNA, 2900 bp, Mus musculus
gtccatcacctgaaaaggttaatactgaaattagtagcatgtaaaaaatttagagctaaataaaaaatggaaaaaaaaaagaaagaaaacatggaaaaaaatttaaagtacactattaagaaagtaaaagggtatagcaatcagttaatttcctgttgctgtggtgaaacgccatgaccttggcagcgtatggaagaaagaatttgttttggtttccagggtctgagggagaagaatccatcatggtgggaggcgtggcggcaggcagcaggtatggtggctggagcaggagcagagcgatagtgtctttaactgcaagcatgaaacacagagaactgcaagttttcaaggctttatcctctcaaagctcagctccagcaatgcacgtcctctgggaaggccaaacccccaaccacacccaaataccaccaacaactggggaccacgtgcccgagtgcccgagtgcctgagcttatgggggacattttccaaaccacttcagcatgggaatttttcattactgcgaaagaagatgcctgaggtaagatactaagggaggaaggatttatgttggttcccagtctcacaggcttcagtctctgatcaacttctcttcattgtccattttcccagggagtgctctgcacctccctccccaaccctggctatgctttccacagtttcaccacccaacaataatggatttagatttactctcatcaatggattaatcatgaagccatagcctttgtgacctagtcattttccccaaacttcacctgtcgacacttcgtgccttgggaaccaccttccagcaacggagtctttggggacacgggcctacctgcctgaggacataggaaaagcctgaagtgggagaaacaatgaaaaaacaaccagtgatggccgactaggccatcttttgatgcatatgcagctagagtcaagagctccggggtactggttagttcataatgttgttccacctatagggttgcagatccctttagcttctttggtactttctctagctccttcattggggacttttggtatagcattgcaaatgtaaatgagtgaaatacctaataaaaaatggaaaaaaaaaaaaaaaaaaaaaaagaaaaaacaaccaaaggaaacgacaagctgacagacactttacaagtttccaaacacccatacatgtataaaaatgtgctcagtcaatctgggaaatttcaaagaaaacaaacaaacaaacaaacaaacaaaagaaaacaaacaaaacccaggtaaggtacagctgagagtgtgtgttggtgaagactcagagtaatgggagcctccactggagcgtaacctgacaccactgtgatggttttgtgcactggcttgaccacaccttagaggagaacagcaatttctcatctggttcctaggcaacagaattatatgcacctgtattgctctgcatggaactgactcatacggaaactgcccaacgtccattagcagcagaatgtataaataaatggtctattcataaataccctatcaaaatgaaggaaccgaaaacatattgtgtgacttcctgaggagacacaaagaaatgcttgttcacttcaaatagggcataggcagacttgggaaagaattccatcctgttcagcttggtaaagcagtgagtttttctgggttactgtaggagtgtaggaaggaaggtcactaacctacaggagacctatgggagcatggatggggttacttagggtagtgtgggtgactctggggcagctgtatcaccaaaaagcctcaccccagtctaggtgacaatttactaaagccacaccaatgagtctctaccctagtcaacctttgacctcctatatagcgtagcccctcccccatgagcatgtgcagatgcggcaggactaagtgcagttaggggagaaatgaatggtggctggagtctccggtgagggtgtgataaccttctcacccctcctgcaccagggtttcttaataggccgggtcacaagtcaatggccatgcggttccctagagaacagagttccaataaatagatacaatgtagtcaaattagaatagagtaaaatgataacactttaaaaataaacaacagtctacataatatatgacttttgcttatgtgatgttaaaaggaggggggaaccctacaaaactaactgaggtgtttaaggatacaggtggggatatgaaatagaaatatggggagaagcaagcagattattctatgagtcacaaagtgggtgggttctctgtggcaatggaagggactccgggggcaatgctggcgatagctgtttattggcctggatggctatgtctatacattagagtgatctagagaaactattgttcctgcagaatattttttttgtgtgagaatgccattgtttggtgctctgcatcataatttaaaagttaaaaattgttttactatcctgatttgcttcctattgctgtgctaagcaccatgaccaaaaacaacttgggaaagaaaaggtttatttggcttacacacccacatcgcagtccattgtgaagggaagtctttggtaggctgtaggcatgggtagagttagcagcagcagtcgagttctcatgtgaagaaggtctagtcagcaggtaaggaacaggtggtcctttggcaggcctgtaggggagtctggggtccctgtttgaagatgtggtactggagggcaggttgagaagatgggtgagctggcagcttagggcagggcccttgcctagaagagtgaagttggagacttaatagtagctacatccaaataacagagacataggactttaaactcatgtgtttgtttgtgaaggaaatggaatgaaacactgggaagtggagtcttgctgga

SEQ ID NO: 758 - DNA, 2625 bp, Mus musculus
aaaggcatgttagaatgtcgtctgacctggtcattcttcagtggcagtttcctgagaaagagaggactaagatatgagaaaataaataagcgaggagggtctttcacaagctcacgccagcaagtttgttaagaagcccagcatcttatatgctttttgaaagtgggaaaaggacaaagtcagcagaaagctaccatacaatgggatggagtcagcaggaagctaatcaagcaatgttacaggaaggaaacacagggcatctcaagtgtgtcacagaccagtatcagactgccctttcagtggtagaagtatggaaatttgagaatctgacaaaaaggggggaaaagcccaagatttgttaataaaaactactgcgctgcatttccccccatctttaattagctccttgagaattttatgccatctgttttcatcatgttcttcccagacccaccatctaattctttttcctcttacaaaaactttttaaaagccatctaggccaatcagtgctgcttgcatgcctttgcatgtgtgcccttctacacacttaccaggagccacgttcttaaaaccccaagtctctctcgccctgaagctatcaactgccgggaactccttaggtagggagttaataacaccttcattgtgacttttcctgggaacactgacacagacaacgcaaaaacaagagtcccccaagtctagttttgtgaacccatacaggcaactgcatcaggggcagccccgctccagcctgggggcagctccacccaactctcccagcagctgctttctactttgtaaccatgggaacttgttctactttgtaaccatgggaacccgtgaaacctgtcctgtgttcatttcctaagactttctgcatttcctttaagggcaaggtttcagttgagagcaaccagctctacaacactccctgttagctgcagaccccactccactgaacaatgggttcactctctactctgactgctgcatcttgcttgtgcatttggagactttgtcaaaggctctttgatgagatgaggtcaccttgagtttgctcctgctccttacaactcttctcaagtacatatacttaaaaactacatggtacacatgggctctgcacaaatgacaccaactgttcaaatactgtcctgtttcggtctaagttgtgttgtggcatgactcatattctaccagagagtagtagtcagctttgtgttactgcaacaaaatatcagagacggccaacttatgaaaaaacaaacaaacaaacaaacaaagtttatttagttcacatttgtggaggttcatagatcaagctcaggtagcccccgtgggcagcagaaggtgttgaaacagtcagagggtagagacccatctatctcccaacctgttgtccactcttcctctaagaatggagcagacagatagcagagtaccaaagatgctaagttgcctatattaaccttgaaaattaaacctggcaccaggtggtgatggttcatgcctttaatcccatcactagggaggcagaggcaggcagatctctgtgagttcaaagccagcctagtctacagggtgagttccaggacagtcagggctacacattgaagctctggctttaaaaggcagaaaacaaataaaaatggattgtctagaagaacgtaaatgaagcaagtttgaattcttgatagtgggatgaggagagccagtaaaactctaaaaagtgtcacaacccaaagctcaagagctccaggtaccatctgagaagagtcccttgtggagcaagtctgtaggtcacccacagacagcctcctgtctctggcaggttgtgagtgttagagtctcaggtctctggtggcttagggaatgagtccttctacctgggctgttggcgtcctggaggctggcttatgtgttttctctgcctggacagaagttgcagacatggcttggggaagcagtcagaccacagagggatggcccaagaggtcagctttgaaatcttcctgctcctccccccccacccccccccgcccggctcctgcagggaaagtgtgcacccaaggaccaggacctggtcactgcattgctccagtgctttctctgatgctatcaaaagctgagaccctcatgtcctagaattttgtcttttctttctcccatggctcccttttccttcgggctaaagtttcccacttgacagaaagcatcgtcccacccccagtccccaaatgggcaggaagctctacactgtggactcttttgatgacacataatggtggccacaccagcaggagcaagtggccaaatttcatcctgccctgcagagagagctggatgagcacatgcttgactcctgtgacagctatagcaggagaattagctcaagaacctcaagggaaagaactcaataggccaaaatgggctattattaatgggctcttcttaaaggtctacagcacattccaccacaccaaccggttggagtaaaactccaactgagagctccagggagagactcagaaaacacccctagtgttactggtaagtacacaaaggtgagaaagaatttggtcaggtagagtgttgagtaacattctaataggggtaaag

SEQ ID NO: 759 - DNA, 2250 bp, Mus musculus
tctgaagtggttttgttgtgggatgctttttgggacctcatgcatgccagggaagggctctacaactgaggcatattcccagccttcctcagaaactcttggcagagttcaagtcagctggtgtcttgagcagggtcgagctaacgcagcttcctggaactgccatcagctcaactttggttccagagatgctaagcgtgagtcacccactcttcagctgcatcagagctgcctgtgggctggaaatgacataggcacatcttcttatttactgttttgtcactttcctgatcaaagtcaaagtcttatacagaaagccaaaaaattatatttggtggaagagcgggggctgatgggaggatggctggtggacagggagtgtacagggacctcctagacttgttggattggctgtgcctctgagtctggggccactcctaaaatcttgaaaggttattttttttttctttttcttttccgttcttctctttctttctttctttctttctttctttctttctttctttctttctttctttctttctttcttccttccttccttccttccttccttccttccttccttctttctttttttttttttttttgagttctgccttttagaacaactagtctcagtgtgtggatccaatttcctagtatcttcatggctgaatcttaagctcacaaggaagcagatattaggaatagactagtcagtctttgggaagtgccatgtggtgccaggtactatggcagaaggaaggaggtgccatgccttttttccttcaggtctgagccgtctgagagagctcagaaaactccagagcaaaaatctcaaagtcccctctacccacagcctcaagttcactccctttgaagtacatttaactgtactttgttttgttttgtttttggttctgttttctcccccagcatttcagtgaagggagaaactagcatagccaggcaggtccagtttattgcaaagtcagcacttgtcttgtccagccagggacgggggtgggggggggcacacaaccataggcagccctaccctggatgctccattcatctgtggtgagttgtgcagggggaggagaaccacatggaaggaggtttctgtgcatctctaggggctggcagaaagggaggcccaccttgctcttcctcagatctgtccctaggaagcagaaccagatctccaggtactcggatcctgactctgggtaatgaggctgggaacaagtggctgtaagggtctctgtctgctctgactacagggacctgtgttgggtgctatggtggtctctctgtgccattagctcataggcctgcagtgtgcttaggctgtgtttgggtgttgcctggaccagtcatttatttatactcagagtcttggggtgtgaggcaggaagagccactgctcttgttcagcctccatgggacattgtgcactgggtgccaggagtcctgattgtgccccagggaagggacacctccttcagttgttattggacaactctgtgtcacacagcttggatgctaagtgcaacgcagctgctcagtttcctaagatacacaatgtggttgtgtcagctgccagacaagagagcctaagatattagaataaatttactctctaatgaagtaagttgtcttcagaacaaccttgtatgaacttgacttcgtgaacagagatctcaacacctcttccactgctactcttgaaactcctgaccttagtgttcagatcctgacgtgactccccaaggaacctaaagtgggcagcatcccaagaaggataattaagttagaatgcaaaaattaacaataaaaattaacagaagaatgcagtctgtaaggaagtgtgttacctgtgggggtgtagatgcccagcgggagctgcgtttcttccgccccaatcatgtgcctggagtctgttttctgtctgtttcctaatgactgctcagagagagcatcagtgttttttgttttgttttgttttaatgccatcaagtgctgagtgagttctctgtggtgaacacgattggatcacttagagcttattgattttatgatcagtccttcagctgccgctaaagcagatggattcctactgcatgtaggaagttgtgggctctcccctcagtgttgagccttccaggactcacatttccaccctgcttctcagcagccctcaggacatcctaattaaccctgggtcctttgtctgtagcacgctcagtt

SEQ ID NO: 760 - DNA, 4775 bp, Mus musculus
gagagagagagagagagagaattggctttacggttgcaggagttcctccctgttaccctttattccatgtaggtcctcagcctattgatggtgtgacccccattcagagcaagcgcctcctaagttaatcttcccgggaagaccctcacagaccctccaaagtatgcttgctaatctgctaggttcctctcagtcctatcaagatggaccatcccagagctaataatcatagcctcatgaggatcacgtgagcatctgagatactacttagaagacgacattaacgccggaaacttctgcatgtattaacttcaacagtgaaatataagtttaatgcacttgacattaaaaatcataaacacttaaaaccatcgaggtgctgagaaggccttttctaattctgtggggatggtgggaaaatgggaaatcccctctgaacatcttctggatccactttaaagctgatggctttgcttgaaccttctttgtgcttccttgcctaggcagtgtggttgttagtatcaggaattgcaggtcgcttccgaatccagcaatgatggtgatgtcacccataggcaacagggacccacacatctgttgtcatggcaatcaccatacattcccagcgtccatctggtttaactcccacatttacctgtgaacaaccccccccccccacacacacacacaataaacctctctcacatggaactgcattgccctggtgtggtctgtccggacacaaagccgcaattctatcacaacagtgacgttgctgacatctgtgctaggcaagtggtctacactgggctgcatccccgacatcttctccactgttgtcatggtggagagtccaacagtcacagccagtcgcagcactgccaaccctcctccaagacatccttatcagtactcatcctctctcttgtcaagcatctcagaattgtgagacgagactccctgcaccctttgtccatttgaaatttaaagtggtgtccagccctctaagaacaatttaacagattttctaaataccacaatagtagcattatgccagtacatgccaagaggcttgacaccgaaaggtaactcagcacactggaatattaataccacaaaacaccagagaaggtaggggttgaaatccgtgctccagagcaccaaaggtcagcttgtgcagttgctggggcgaatcatgaagagcttcgtattgctcacaggacccccgtgagtccttccttgttgtctaagcagccaccttaagaacacatggtgcctggtgaagggtgatcttcgggccacgggcagcagcagactcgtgcacatttagaaacccagttctcacttcagagtacctgaaccaagagtctccaacatgcttttctctaacgcctccactccaggagaattttaggcaggtaaaatgggaaaccctgttttagtgaaaggaatgaaggaatgtttctctgagactcaagacaggtgtttctctagttctattttcttttgacctacaaggcccagcaacctgctgaatctgttccctggactcccaatccttgcctttctcccgcatccgaccagcatgcaatataaagatgtgacacaagggggcgctgatgctccagatgcttaactagaccagcctttgggccattaccacttacggcaggagagggaacaagtacatttgtcagagacaagaagtatggctccccatcacgagaattctttagggatagcacacaatgcaataacagtctcatcgtttagctatgagtatttgtgtgtgtgtgtgcgcgcgcgcgcgcaaatttcctcatatcacgaatccaactaacccgccttgaaaattagaagtgttatttactgaatccgcatcaacatgtaacggttattaatattcggtttcacattgtgactaattggccacagagaagagtgggtagagcatggggcagaaagccaaagacgggagttttgagaagcaaaggtgtggaagaacagaaagggagagaaggagagcgctgtagcaggctcagaacccaaccaaaggcgggcaaagtcaagagcaatggcccgccacctattccacatcacagcccccacagggatctgagaagcggtgggtcttcacccacacaatagatgtgtttctatattggtgggctctgcgccaccaatccaaacagcacaacaaagcaagtgggaggagacaatgaggcttgaggtggagagacaactgaaagaaccacaaaggcagacagcaagcagcagagaaggggcacagcagtctccaaaccgccccccaccaccaaggttcatctaagcgcaatcctgagctaaacagaagacaggcagaagacagggaaagtctctccgtgcctttccattgctctagcctgtcccctctctcatcacacatacttattggctagaactgtatgtatagatagatgcctgctctcttggcagtccacccggcgtactcccctggcctaggctagcaaagcccttggttttctttgtacaacgaagagactcaatagatggaaatggacgtttttatttattattattgttgttgttgtattgttgctgttttgtttttggagacagggtttctctgtgtagtcctggctgttctggaacttactctgtaggctggtctcgaacttagaaatccgcctgtctctgcctctcaagtgctgggatttaaaggtgtgtgccaccactgcccagctgaaaatggacattttaaatgaatatactgttgtctcaggagttgttcagaaggcagtagaccccgttcacagagtgacaacaggagggaccgccatcaggacagagcttgtatgctgcagaaatggaaagaacatctctgcattgtgggagggtagctctcacccagagcaggacctcagccagtctcctcccttccctgggagtgagagctggctgcccaggaaagcatctcaatgttgaattccactgtgtttgtttggttatgagagaggtctcaggaagcctaggctggacttgaactcattgccagccaagaatgagctgggattctcttgtttctacctcccacatgctgtgtgtggagctgtgggtggggcttctttatatgcaaggccagcactctttcaacttcaatacatttcccgcctaagtctcccgactttagctctttaacagaataaacatgactccggggttcacctgagggtttttgtgtgagataaagagctataagcaaaggatgcggttgggtccgaagccaggctcatgtaaggaatggagtttctggattaggctggcccctttacaggaatcagggctcctaaggtttcttaaaccgatgttgttttcttaggggttatgtttcttaagaatctagaggtgggggacagggttcctcagagaacagaggccccgctttggatgacttagaacagacaatgtccacattcaggagatcaaggtgggctgggcaggggtgactgactaagcagaaaggaacagttcaagtgtgaaagttctgggccaaatgacaagcttccctccaactgacctgagccttttcagagagatgggcggcctgggctgtggctcggatgctgttttccattgaggtgaacctgaagcctgtggcactggctctctgacaagcccagaagagaaggctcctggccagaggcctggaatgagcacctcccctccagtcagtcagcagagttgctcattagcaggctccacccacgagcgggctgcaggtgcctgcatactttctgctcgcccaccatgtacaggcaagctgatgccctctgagggtttctggaacaaagaagacaagaaaatgaacctggtaagtttcctcggcacctgcttatctgtcctgctgcaaagcagggctcatttgttgcctggaaaacttaagaccatatggtgcttgtcgaagggtgatctttgggccaccggcagcagcagactcgtgcacatttagaaacccagtttctaacccagtacttcagagtacctgaaccgagagtctccaacctgcttttctctaacgcctccactccaggagaattttaggcaggtaaaatgggaaaccctgttttagtgaaaggaatgaaggaatgtttctctgagactcaagacaggtgtttctttagttctattttcttttgacctacaaggcccagtgctatcatctgttggtggactggtctctctctctctctctctctctctctctctctctctctctctctctctctctctctctcttcagtcctagagctaaatctggcccattgcttgtttattttttaaagatttatttattcattatatataagtacactgtcttcagacactccagaagaaggcatcagatctcattacagatggttgtgagccaccatgtggttgctgggatttgaactcaggacccctggaagagcagccagtgctcttaactgctgagccatctctccagctccctactgcttgtttttcaaataaagttttattggttccagccccagccatttgttatgtattagtataaatgaaatgggtagcttgtgggctacaagggcagagttgagctgtgagatactgcagggtttttggaagttccctttgtggtttaataataaagacacagacatctgtatagtatatggtcattggcctgtttgctcaggcagtccctcagctagcccatctaactcaactccccgccattgtgtctatctctccac

SEQ ID NO: 761 - DNA, 2900 bp, Mus musculus
atctgttttcatttcaagatagctcacaaagttgctcagcctggccttaaacactctacagccaagtacatcctcctgcctcagctttccaagtaactaagctaacagacctctgccaccaggcctggctccctgccattatcaaagcagtcaaagcttgggggtccgagtttcttcccagcaagccctcatcacaatttataaaaactcgcggttgacaaacacctgcctgtagttgcacaggtgactggagaaatgccaagggaagcctcactttgggttttcctgtgcagttgtttccagggccatcggagctgtccagttaactattcccatggcacctgcctccccccgcccccaaccctctcctcccactactttccaatggcattttgagaacactagctttgaagatggaaaagtcagcccctccctaaagaaagtgatttttataaatgatgcttccaagtggttctgggagaagtgagggggatctctcttgttatgtcccctttcacggagtcactgtcacctttgtcttagttgctttcctcaaactgtgactaaatacctgaccaatgcagcttgggagagggaagacttattttagctcaagggtttcaggggatacagtttctcgtggtgtggagggcttaatggggttcgtggcaaaggaagggaacatgtgacaggaactccttacattttgtttgagatagggtctcactgtagttacccttggctgacctggaactctctatgtaggctagggtgaccttgaaatcacaaagatccacctgctcctaccctcctctctcctccccaccggatgctgggattaaaggtatgcctcgaacatcttagtagatcaaagagcagagctctggatggaaaccagagcaggatatagatttcagtgtccaccccttaccacatacttccaagaggaccagcccctccacagcctcccaaagaccaagtatcaagcacacaagctggtggggatgggtcacgggagtttcacattgaaactgtatcagtcccatgtagaagctcttcaagccccacagagacctcaggagtggcccccatcagaagctcaggccaccacttgagggtctttctaagaagcatcctgtgatcatctgcagagaggcggccgctcgcaagccctaaaacatctacttgagaagaggctcagtgacccctccccctttctgtctctctctgtccctctctctctcctagatgattccatacacaggtaggctgtacagtcaatccttgagcaccatctccatgttcctagatcccggtctctgttttattcccagctattagaaattgtttttagcaaagcatgtgtgtgacacttagatggagcaacccgttacctaggaaactgtccctctatacatgcttcgctgcctggtatcatttggatccagctgcctcgattggcctttttccttagcctttctgcgacctccctttctcccaattactgtgccagatgcgtagctcccaaccaggaccagctctgtaatttgtggggttcactgtaaaatactcccccactcaaaaccgattgaggtttcctagataacagaccattaagacaagcactgtgcttgtgtgtatgtggggggtggggggcctctgtgaggttgcacaggctgtgtgtgcgtgcacatgaggcacggcctgcttctgaggtggtcagagtggcccttcacagatctcatttgtctctgtagactgactgggctcctggcctggtgacagaggcatatgccttccattttatcacagttgtgtttaactctctctctcttttttaaaaggctttcctctaacaacacataaacgtggggcttctgagtttgtaaggcccagagaccgccttgtataacccttattttatctgctcgggatattttctgtctccttcagtctgacaagagcatctgattgggactctaggtccctgtcaggcctggactgtcaagtctgtgagtgctgcctctggctaacatgacccagagagttttttatggatagcgttcttctctgtatgcgtattccttgtgaaccttctcaaaaaagtcaccacctatccccaaacacatcctgaatgaagcacccacaggtttccccaaaaccttttggagggatttgtgtttcctgcctgtctcacttttggggttcaccaatgggaggaactggccccccacagtgtaggttagcagttcttttcatctgtctggctagctgctgctttttaagtctttccagcctggactcccagagttctgagggtcaagactgtgccccttcgaagcacagctacatttcaacttctgttggttggctctcacatcatctttgtatcattctgtaagaccttggagatgtccctctccatggcccagagctctaaatgagcacagagcctccagactctgggctgaggcacactggtgacttaatagtggatcttaaccttcctttgtcctcctgggatgcaggagacctttgggccactgtctcctgggaaccctctgtagccactcctacctggcattgacctggctttaaccaacttaacttctctgacctctcagtgaatccagacttatattcataaggtgacatttccacaggccaaggatttcctgtggcatccaatttcctagtggtccgatgtgacgttcctttccttagcatgcacataaaggagagttgaactcagaggaacatgcagagaagaggtgcagaggaggagacttgctcgttgtatctttaaactgctctctgtcagtaacaaagtacttaaaagtcagcctgtgaaaagcctttgtaatactgtctgtcgactatgtcccttcccacagaacaca

SEQ ID NO: 762 - DNA, 2300 bp, Mus musculus
ctgtcccagacctcaccatgaagcctggcctggcactcccagatcctcttgtctccatctcccagatgctggggttaaaggtttgtgccaccagatccagcttgtgttcagtgtgttttcttttctgtttgtgtgtgtatgtgtttgcacttatacatgtatgtaaactgggggccaatcttagttgtctttgaggcattcactgtttcttttgagaccgagtctctcagaggcctggaactcaccaagtagactaattggccactgaacccaaagcattcttctgagctctgctaaattctcagataccaagggcatgccaccacaccaggctttccactggggctcagggggtcccagtcaacaaagtcagcattttaatgagtgcactatctcctcaatcctgtttttatttctctttctgagacagggtcttgccatgtctgatgtgtagtcctggctggactagcactatcaatgaggaccgagcttgcctggaactctgggtgatccccctgcctctgtgttcacagtgcttacataaaaagagtgtgctaataatgtaggcttgttcagttcctctagtgttctctgagaaaataattggtaagagttccaggtgagggtgtatattcaaatcccatgaggccactgagtcctggtgtgtgtccttccctatgtggatttcccatccacgagttcccaggagggctttgcatgagcatgcgctgtagagacctgttgttgataattaaaatgtctatttaaaaacctgtgtcacactgcaccttaatatttgattttctctccgtgaggctggctttggtgttaatgattttttcatttttctcagccacattttatggattatttaactagcatctatggcaggctgagacaaaggaaagtggaggaggaaggtggcagcaccgcccttcccagcccttacctcatgctgcaaggtcctcacaccaagagcagtgcccgcagggcaccctgaaagaaatgcagaggtgtgtggctcacactccctcgctcgctgggtgtccttggtgagaaagcctggcctcttccttccttcctgctgctgactgcctgtaagatctcttctcattctcctcagccaccttcaagttcctggagacagcgatgaggacagcagtcctttctctctactcctaggaaaactggagaattgcagaggcaggtggatccctgagttcgacgcctgtctggtcttcagagggagttagccagggctacacagagaaaccctgtctggaaaagctaagaataaaacacgacaaagaactgcaaaatcactatattgaaattacatacatatgatcacatatagatgcatatatagtcacacacgtatatatgtgtatatggacacacacacacacacacacacacacacacacacacacacacaccaaggaagtgtgctagttagtttttgtcatcttgacccgagctagggaagaggtatctttagtctagaatgtgtcttcatcacaccgcccaccaggaaagcctgagggatggttatcttggttatcgatcagtgtgtgagggcacatccctctgtgggcaatgctacccctcactgggtcctgtattacagaagcaaggaggctgagcaaaccatggagagcaaggctgtaaacagcgctccctcatgttctctgcttcagttcctgcctccaggctcttgcttggtctcctgactagacttctctctaggagagactgccatggggacaggtaagccaaggaaacccttcttctccaagctgttttggtcttggaatttctcacagcaacagacagcagaccagaacaagaggagatgaagcataaaatgtgttacctgacccatttcccctccacagcatccacactcatagggcagatgagggtcccttcccagggttgcatattcaggacatttggacccatctgtgacacacagctaccattgccactgtggcatcatataagatagtttccgctcttaaatctcctgtggtctgcctagtcatctatcccagaaccgtcaccatcacatagcttatgtagtcttcagcatggacttcttttggttgtgagtgtgaattcacattattaaacgcgtattacatgagcttcagaactctctgctatgttcttttgtttctcccccttcggcttggctttaaatgcacactgcgttcagctaacagctctggtcacatccctatgttgtatcgggatgttttcagcttgtttgctacctgtctctcccaccagaactc

SEQ ID NO: 763 - DNA, 1950 bp, Mus musculus
tctcagctcggggaggtttttcatgctttctgcttggttgctttctatcttcaaaactaacaatgaccagaacacatgcttttcacactgaccccgcctcccactgccctttcctttctaactctgtcaggagagtgtgactatgttggacccacccaggtaatccagtgtaagctcccgacctggaattctgggagtcaatttgtactcagttcattgtagttgagaacgagacagtaaagttcacgcgttcaataaacttgtcaattaaactgggccagctggtcatctggttcctttctgaaggtaatgatgtgggggttagaaacttggattgactgacatgaactgttgaactgtttcagtgacagaagatggaaaggagaaatagccatgagaggtccttactagcgaactttcaagtttgtccccttggttcaagaacccttaaagtataactctagtattacacacaaagcagaacttcatcattggtcttggtcactttttttaaatagtagccagaataatggaatactgatgacgttcgtttccaagaactgtatgcagaatacagtctttgggagttattctgatcaatgtcagcatgtcatgttaagccctatacttcctcttcttgaatattctgcttctaaaacaaacaaaaccttgggtgtagttcttacaggattgtcatctctgatacgcagtgcactttgagaggtgacgacactgtgtctgtctcacaggcttatacacttttactagagtattggaacacaggtcagtatttggcgttgaagaatatgtcaagagtgtacattgaggggagcatatatgaagaagtattccttccacaccagcaatgcagggaggccagcagtcccagcctggttcttccaccatcctcacacacatcctcccacccctgcctgatgtgataagaagtgatggtgggaactctttctgggcttctacagtggctgttgctaccagctcctccctcactggaggtaattagagttcctcagtgtggggttagagcaggcttcaagctgccctaactctgcctgcaggaggagagaggaacaggcagtgcctgctcccagctgggtttcagatcctacgttttcaccctgtgcacctgcaggaacactggaaggaaaacccactgctcacgatcctttgcaatactttgggttttatagtctgagtttgtatgtgttcaataaacaaaacgcccatgtatggaagcatttagacttgtagtacttcaaatacaagaacacataaggcctggcccttcctctcaacatgagcatcttgtcttagaggagagatagagcctgtatgcaaatatctgcagtgctgtagtagaaataaggaaagtgtgaggtgccagcaggagagaggctcctgatttgggggagaatccatcatgaggctttccttaagtgctaataattaagtaagagttttactcagaagccagatttttcttccagctaactagctttgatagtgctggaagttgctatgcaagctgctgagctaggaactgtatcagtggcctcgcccagcactggaccctccatgcttctaaactgacctagaggcaagatgtatgtattgaccaaatagggacatgaccattatggtagctaacaacctttgtgactggatttgaggcttacatcttatgagagaattttatgccttggtcaaaagcccctggctggagaggtcatataagccccagggtagaacctgttatcattattttgataaatagtcatcttgtcaaactggcttataagtatttatgtttatactcatagacctgggctgctctctgccttgtacagagaagccctctttgcagttttctccgtccattcaagagatgtaaaactgagacgtcttacatacatacatacatacatacataca

SEQ ID NO: 764 - DNA, 2750 bp, Mus musculus
tgagaacagatcaagtgaaccatttccagcagaggcgactgttgtttatccatggtataaatatgcctgtgttgtggagatgctctgccccggagcctctctgtcagaagttccagcatgaccgttttcagcagggcttccccagtcacttgatgccgctttctttgtgctctttactgggatgctccagtcatttctgcagcatgttataagtgctccatttagtgtatttgctatctatctagctacaatctataatctatctatctatctatctatctatctatctatctatctatctatctatcttctacttgctatttttttttttggttttcttgttgtggtatgctttaataagctcactcatttgatatcaaaagcctgcctattgtagaccattctccatccagaatacaggggatataaatatttccctagtaccatgctttgaatgttccctccaaaattaatgttggaaattaatcttcaaactggtaagtagacagtatttaaaggtggactctttgagaaataattatggttaggtaaggtcttcagaaataagtagagagagagcgatccctgggctggcctattattctggtttaccacgtgttgtcttttgtcacgttaggatacaaaatatgaccttgaccaaatactaagcagatgtgctgccgtgctcttgagctgggagtcagacagaagcctatcatttatcaatgactcaggcttggctattttgtcctagcatcagaaaatggactaagatgaccacacactgagatagcttctgcattagcccaggctctgatctagacctagagctgataaccatgatcctgaggcctctattcaaggctgttttcacttttgttcttctgaagtatcctgccaaatgcaacaggaaggacataagaggaggctgcaaaggggtaaatggggctcttccatctgtccccatagccccccaatgtgtcacagtcctgacagctcttatagacttggggtccatgaggatggaaaaggtaggattactgcctctgcttttgtactcccacccatgatcagctgccagaaacactggctataaccctacaaggaggtaagcaggccactgtcagccagtggaacttcctgcagtaacaaaaacattcgatatctgtgctcataaaatggcagttgttgggtgagtgtcactgagtgtgtggctagtgtgcctaggaaattacttctcattatattttgtgttgactgatttaaattaaacataccccagtgattactgctgccacactggacaataccatcccaggctctgagattccttccaggtctgctagttctgagtcagctctctatctggacttgtgcttcagggtctgtgatttttggtctctgcatcttagggactatgtgggcagatctggcttatatcctagatctgtacacatcctttgttttcccagcagtttgactatcctacattctggatgtaggtggacaggaaacagagacacaccgctgaatgcatcaggcagtctctagtgtgtgactggagccaacgcaggctgctataaatacaaacagactcattagaaggatatttagaagcacacagaagcaccaggagggcagaacctagctcatggcttctgctcgggtcaagtgaggaggtcacaatttatgtcatcaataccatgttcctgtcactggatgtcaccaggcaggatggctgttagcgtttgaagccaccatcagcatcctgtcattgtcactctgattggtggtacctgggccatctgtccacctgctacttgcaaggaaggctagaaaaggaagtagctgctaccttcagctgcagcccaggaggtgagatctgtgttagtttaaggcagtgggtctcaacctatgggttgtgatccttttgggagaacagatgacccttttatagaagtcaaatatcaaatatcttgcatatcaggtattcatgttgtggttcataacagtggcaaaattaataaaatagcaatataaataattttctggttgggagtcaccatgaggagctgtattagaagggttgcagctttaggaaggttgacaaccactggtttaaagaattccacaaagccaataaaaggattcatattccctagtattcatgactatctactataggacactgtcttgcttgggattttactgctgtgaacagacatcatgactaaggcaactcttctaaggacaacatttaattggggctgggttacaggttcagaagttcagtccatgatcatcaaggtgggaacatagcagcatccaggcagacatggtgcaggaggaactgagagttctacctcttcatttgaaggctgctaacagaatactggcttccagacagctaggatgaaggtcttacagtccccacacacaatgatgcacctactccaacagggccataccttcgaattgtgccacttcctgagccgagcatatacaaactatcacagacacttaactaaattttcactgaggcaggcacactgtcaacccattagatccagtaagagcgaatctagcaagttaacaaggagccatacaactagctctcactgggctggccatgctggccattactctatctggtcctctggtacaatgccatagatagataggatgtatgtgccactgccacctgaaactgcatgtccatcctaacattgttagatagaatgggagacatt

SEQ ID NO: 765 - DNA, 2275 bp, Mus musculus
gctcacaaccatctgaaatggagtctgttgccctcttctggtgtgtttgaagacagctacagtctaatcatatacatacatacatacatacatacatacatacatatataaatatataaatacataaataaatatttttaaaaagaaattattacatgcatatacaaaataaatataaatgcaacctgctcagtctgtatagtgttacttatgtgtatgttttcagggctgaccattgggcagtggagaaccagatggagtgcctgtcactggggaagactctttctcctgttctcagcatcccttagttcttgcagttctttgtgctgggctgaggacttgtgggcttccttcacacgcccctgtcacaagactgtattttctagtgaagtcagaaacaacatccgtatagtctcaccaacataactgcctacagaggaggtgaacaaaggtgatgcctacccttgtttctttatgcttgctatttcagaaaatataaaatatgaccaggtaaatccaatgcatgttactacctatactgaagccactgagcatgtcacagggttaaagagacggctggaagtgaagggaagcaagaggtgagaaaaacagacacagagacacagtcacactttctgacatgttctctcataaaatattagtggctattaaatatgcatggcagatatccttacttgttgtttagaaattatttgctactgggcccttagcaactggctccctggctgtgtttttacccttctagtcaaatgacatatttcaaatctgttctccatcaatgagataccttaccgctgttttccaccagtatcaggaagacagttccctgaacttttttttttttttttttgcattaaagacaaacatttcctgaactataatgctctgatctgatggggaccacaagtggctgcgagcggtgatgtgacagccatccccacaccctgtgcgtgtgcagtaagatgcatgcgtgtcattttgtcacagtgattcttgccgtgggagaaaggtctgtaccagggattttatggatcctcacgttgaacaatatgttcttcccctaaattcagagcaaacccaaatgtaggcaaccattctcctcagcagcacctggacatgtggcttcccactgctcctgatcacagctgcccagtaggcctttagctcactgagtttagagttccctgtacctgcatcagtcagtcaacagtgaacggaagggacagaggatgaggaaggtgatttcctgaagacgtgctgggcagtcagaactgtatgtgaggcctaccatggcagaagaccccagaggctgccctcaccatatcccccttctccacagaagtgcccttactctacctcgggattatatactgctctcagagcttattcttatttgccctaaccaagctttttggggttctcacctttctttcacaagaaacatcataggacagtcctcttaaagagacctgctgctgccaagtctctgtttcctgtgcagtcacatttaaaagctcaccaaatgatacttacactggaaaatctagcttcctcaggattgaaaagttaaatgtgtctcaattatgcatcttttgcaaaacatctgtaatgatttttaaagtggatttcataatctcctttaaaatagaagaactaagttatttggtgagtgagtgaaagttttgctgacggcagttattgctgttaacggcttgggcatattcatttgccagggaacaagatgaagagtttgaaaagggcctataataaagtggcagtttgatttgtgtgcaggatgatatctctgctccatctcaatttacttcattaatgtacccagatagtagaaagttggcaattaagtatgatagaaatacaaacagtgccatcttttggacgatgctcaaacaacacagctacacaaacagacatacctgtagagctttgttctcagcccctcaagccttatcacagatgcaagaagagcttatttcaccattgtttaaatttcagggcataaaagctcgtattgtctatgagaatgcaagccatcatgcttaaaaatagtgtgcaatctctaccttttgacttgcctgtcttagcaattcagattgaccttaaaatgtgtgtgtgtgtgtgtgtgtgtgtgtgtgtgtgtgtgtgtgtgtgtgtgtgtgatatgtacgggtgaatgtccttgtttcttacatacaggggctataggaggacatcagatgccttgatatattatcat

SEQ ID NO: 766 - DNA, 3350 bp, Mus musculus
tgtgcttgtgtgtcagactgataaatgttgggcttattggcaagtgttcgttgtcaacttgactacaaatggaatatactaaaacccaaccaggtggacacagttgtaaagggtttccttgagtggatcatttaaggttggaagagaatccctaagcaatacatgcaaaatagcctggtagaaggaagtcttgggtggacagagggtaataatagagggagagtgaaaactatgactagaacatgctgtatacatatatgaaattgtagaagatcaaatttatcttgaagaaatatttcacaagtacaaccaaacatatgataaacatacatatgctttgggtaagatagatactattaatgagtattaccatgtaaaaaaaaacaaaacaagatttttgcttctttaaaaaaaatacttagcagagaattgccttatcgggcgtcagttggaggagaggcccttggtcctatggaggttctatgatccaggttagaggaatgctagggcactgaagcaggagttggtgggtggtagttgaacgccctcacagaatcaggggggagagggataggatagggggttttgtaagggaaataaggaaaaggggtaacttttgaaatgtaaataaataaaataatgattagaaaacaaaaagaaaacatcctatggtagtcaacaccagtagagcaggagggcccagaggacctggggaccaagatttagtggcaaaactatcttccatagatgagtccggaggaggactttggggtcatggtatggtcacgaccaatgtgcaactatggagttcatggaggtaaaggtgaacagacaagtatatcacaatcaacaagctgggccttcttacatgaagggcagaccctcagaagagagctacctgttctcactgcctattaaggaatcctcaattattgaaattcctcttagagtaatcctcaaggatgagggtcagaaatcaatccagtgtagaagtggatttgctcttgccagcacagtgttaaggctactgttgctataaaggatttcaatagtcatgttattcttggtgctaagtgctatgagaaggtagctgctgttttctgatgggcaatcatcttgaccaagctttccatctctccattcagagaagctcctagagggacaagattggcaaggcccaaagtgttgcatacaagttgacaagctaacgtggctttgtgctggtttgccttgtccctgtccccagaggtactgctgtattgtctctgctcctgtctgcaagaagctgttgctgctgaccagttttttaaattgttacgttagccagggcccacagtattattctgggcaacttgccaagccatcttctatgtctcttccatgatctacaagtacttgagccatgatctctagacagagaatgttttcaccaacgaaccattgtttaatgaaaccccacaacagacagaatgcccaggctccagctatggctaccacatagcattttaatagatgaaaaatgaagtaaatcaagtcttcataatgatgaggtagttctgtcttgaataattgtagcattattgcacaaatctgtgcatgcgaaaatatagacaatcccctttatatagtgataaaaattaatgtgtgtgtaagtcagagaaatccacttaaaatctctaactttgtagatcaaatgagtgccctggccttactgcactatgggttttttaaatatcattacttggttcctcaagatgaacagtatactactcatttacatactatttttatagatttcactgacttcataattattatttgaaaaaaaagcaggtgtgagaacagtttgttctgtgagtcataacttgctcagttatgtaccagttttaatatatcccccaattttagattatagaactggtaaaaattaaaccaagcactaatttaacattttttaaatgcagtgacaaaaaaaattgctgttatatatgtatctttgaaatgctgaggctcctcaagtatctgcctcaccacatccatgtgccaggtgacctacatagtgactccactcaggagtgattttggatctgagggtaacaaggacttgatagcattacttacctcagagcagagttatggacaagcgacctttacctatctgatccacatagaagagcaaacattctggctcccaaacttgcacatattgggcacaaattagcatgtagaaaagaacccaaaatttgctgtgctaggaattcttttttatcttctggaagaggctttacatccaaagggaaagtgattagatattcctattatatctgtgctactattatattaggggcatgtttggcaggcattttgttactgaaactcttggagtttacataagctgtacagctttctgttctaactatgtgtctaattctttattttgtgaatggaaatatgaaaatactatagggtgttcaaaaaacctgttctctgtatacatctatatctatatcatctatatctatgtctatatctatgtctatatatctctatctctatctatctatctatctatctatctatctatctatctatctatctatctatctatctatacattttcaaacaactgattctttttattttatttccacataggtgaattccgttcattacaagtttctagcatcattctctgtgaagatgctgtgttatctgatagtatagattacctattatctatcattcgatgagtgaacaatactttcctttcaggtccactcttttgattttccactaagttcttcttgccaattctctagactaattaatcatatatttcaatggaaataattacatgaatatcatcaaaactttcagattttaattatgttcctaaactataagatgtctcagttaattaggcaatacaaaacaccaatcccattctttatttttaatatctcactagctctctattgcaggttatatagattattttactgataggctgactagttcaagtttgatgacctatttatttcatgttaatatgacatgagcacagtttttcatcatttttgctttatttattatctgagtagtatttggcaaacccatgctactggggccactactgccatctgtgccacactatcttcttatgttttgttacttagttgtttagttgttcctataacctaagtgttagtgcatccatgacttgaagtctaattcttcacagttatcaattttgatgtcattatttccgttataaagtacataacatagcctatatcatgcttaactctctgattctatttgtttttatacattagagtcatcaccttttc

SEQ ID NO: 767 - DNA, 3250 bp, Mus musculus
cattataactacccaagttacttttgaaatatgtgtttatctgccttttcagagctaatgcctatgcaatctcaaatttaattggaacttacaattagtaggcaggtgtctgccttagtgagctatccaaattcaatagtgcctaatggctatttgattggtatcatcaatacaatatgtcttttcaagcaaatatctatttcatgtagtcatcttaaaaattaatactaattgtattttaagccaaagagttaatctttgttccttctctgagaatagaatagaatagttattcaggcaactgctagatatgtctaggttattgcaattaaacaaaggcctccagtttgccataccataagtccagtgtcactaatattgaatactttcttttttaagggcagaaccatatacccatcttccatggcaattgctgcagaggagggtgcaacagagaagtaacccggaaacctttcaaggatgagtgggcactgaaaactggaaaagtggcagggaagtccaagttagggaaagaagagaaaaatgtgtatcgaaaaaagtagtttggtaaacagggagaaaaaaaatgatattttgcagaaacatctgtttgctgttgcttaaatttttgcatttaaatgttctctcgtctgggctctgaagttagcacttccctgaagtagttcacacctttgctattgctcctgctcagcctcagatcattttatgcaacgctgattttaacaagaaaatgatgcattaatttacaacgtgctgagtattttaaaagtggcaaaatctaggcttttgtgaaattttagaatctggaaaaatagaaatacttatgtaaagctctttaaagtatcagaatggcttcatgcacaagaaattataacctgattaaaatcattacaaaattcagttataaagaaatacatcaacctccgctcgtgtttttctgtctttttagggtcttttctcagaagtgcaggctgtacaactgcagacattattcagctatacacttaataaaatctctttccaataacccgttctctatgtcctttcaaacccttttacgattttactttgctttctttaccgtattttcttttttaatgttttccttcttagttattctcctctcacttatttcatttccagtgcaacttgcccttcctcctgctcccatccttcccttcccattcctctttctccctgattcacaccctttccaagtcccctcagaacagagcaccctgtcccctccccctaggaacatcagccaaatgagggttaacagactgcaattcaaccagatgcatattctcacatcaagcttccatgaggcaattcagtaggaggtaaaaagcttctgatgctgataagagtcagagacatttggttaggaacaccaaactacacacccataacacataggcaagggacctaggtcgaaccaatcgtggtttcctgatttctgtgagcccagttgagtcccagtcatttgattctgtaggtgatgttcttgcagggcccttggcacttccatctcatccaacctttcctcttcctcctttaagaaaagaagttaaccttggttccttacctgagaatagaatggaacagttatacaagcaagggtgaggcattttgtttggtgtctttgttattgtgatttaaaacaaagacctttagtatgctatgctatcagcttgccacaaaatatccaggaaatctgacacactatgaaaagacaaaaactaaaaataataggactagaagaagattcccatctcaaaggccaagaatatatttttaataaaatcatggaagaagaggtttttaacctaaagaatgacatgcctaaaaatggcacaacaagcttacagaacactaaatagattggaccagaaaagaaagtctccttgccacataataatcaaaacattaaatatacagaacaaagaaaaatattaaagtctacaaggatactagaacagtactatttaaaggcaataatgatgacagtttcaggttgcacgtttggggagtgacttgtacactgtggtaaacaattcaaaagagggcttctcattttgaaaatttgaaagtggtctttggctctcgagtggatcactgtcaatctagatgagacaagttcacatcagtatgctgctatgacaggagaaatatggtgttgtaaatcaggggctctgtcagcctgcctttcagtgactcagcatcagtgacttccatcataaccagatgctgccaagtgtctcacatttctattgttgctatgaattatatatttacctacgtggacatacactctttaaaaggtccctttggacatcacagccctttttcattctctctccttcctgtctgtaggtctgtctgtctgtctctctgtctgtctcatgtccctactcaaagagtgtctttcaatctcctcttccataataaatgtcttgctaagaactatgtgtaacaacataatgggctccctcttctcagaggagaatgggagagtgggaatggaaaggatctaaattctgtgtgaaggggtactaggaagagagggggtgctgatattgggatgtaaagagaaaatataaattaaaaagaaaaccagaagattcatcaaatattataggaatcagaagagtttaacagagacctcttcctcctgactacagtagtttattccttcatctaggaatatctagttgtagttctttctacattcttaatataaccgccttcatgcacaagagatggagcatcaagttcttcaagaaaccagagcaagaaattacatcttctcctcctcacaataatggtggcagttatgttttataatgtctattggatgtaagcagtgagatccgagaagtcacactgtgtggcaggtctaacgtgggaggtatattaaaagaaaggggaagatgcagaggctgcctctgggtggaagaaataataaagggggaggggtttgagaaacaggacccattttagggcatgtggtacaagtgcaggaggaggagctgtgacatgagacaacagtggatttgcgttgcttcttggcagctagtggtgctagccatggatggttctgatgctctttctgttgccagaaccctctggctggccatggacatacctgatggccaacaatgtctatcttagtgtttcttttattattattattattacaattcactcatgtttggttacaaaaaca

SEQ ID NO: 768 - DNA, 2150 bp, Mus musculus
tttaatatatttactatacgagcctctgagttgtgtgttgtaagcttagaaggtctgaatttctttgggaagtccagaaatgataaatattgtcatgtaacttaaattcaccaccatatatattcaaccctattttgccttcatgctctggctccagaaacttcaaattataatgtgttgaagaatgtatccaatgttcttgtttgcttttggttactgtaagcaacaccaggacccaaaggaattcgtagggaagtgaagatttatttacttatatttctatggcacaggtgtgacgagttggcaagaaagaatgactgttgcagccatcaaactgtatagttgacacactttcctctttgcttcattctggttttctatttttgtctcatatgccttttttgtgcccatattaattttataggtaattttatgtgtatttaatattatactgcatattattattatcccagtttgtttagatgttcaaaatcagatactatgagaagataaataaatgactgaaatatttggctgtgcttgcttgaagtttagaaagaagtgaaactatatgaactcaagtgaatcagggcactgtcacttgcctttagtctcagttactagggaggctaggcacgaagactatgattgctatgtaagcccatgccatttggtgagatcctgtcacaatgatgatgtgagtgggagaagtatatcagtggttctgggataaatctctagatctagaggtggaagagatcttaagtaataaaccaaaatctttacttcaagtcttgattgcaaaacccatgtcatttctagaaccttccatatcgagaataaaatgagcaaattgtttatcaaattaatgtcttgccttaggagtgataatgtcagagcttgggtgaatctatgctgtttcccctacagtcttcttatggtccttaaagaaaaagaaatgcaggattgctcttggcatttccagatgtcccaaacatctgtccaggagattggccttggaaagtgaggcatgctaggcgggttaagtgatagaggggaccttgaaacatgaaggagcctgatgtaccaattgcctcccaactccttccagatgagagaaaaaaattgcttctttccaagcagtcctttcgtctcagcctggtgagatactgcggcagctgccacccggttctccctgcagctcagcatgaatttttctctttgttggaaacatgatataaaaagtcaatgcattatttatagtagttattttcatcattacatattcacaataattgaaaggtgggagcagaatataaaagaatagaaagggaggaaatgatctgcaatgacttcggaaccattcagaggaaatgctcagttgctaaaaaaaaaaaaatccaacaaacaaacaaataaaaaaccaaacccccaaacaaacactgattctaaaatactgtgtaagccacccacatctgcaagtctctatttctgcttctatttatccaaccaaagcaatagttgttgtataatagaaccagaaggtaaattctcaaccccttctatgttgtgggacttgcacttagagtgagtctgccttcagatggttaacctgacaacctatggaggtcaagatagtagtttctctggcatgatcattgtccacatcattaccaagcatatgttgttgacactagttagcaaatatgtggcctcagttgcacacagaattgattgacacaatgtatatggattaatctaaacatattcatgaaacagactcacacaaaaattttatctagtgacatgtgttcttaattcatttacatatatacaaatatatataatatatacatatatatttgtacatttataaatcacaagcacacacacatatatatgtatacacacacacacacacacacacacacacacacacacacacacatatatatatatatatatatatatatatatatatatatatatatatatatatatcagatattaaaagcacaccttattttctaagaaaagatactaaccattagattgcctatgtacaatatcttgcatttaggttgcaaaatctttcttaatattagtcaagtgggtgtggagaaaccctgctgattaagtctaccattgtc

SEQ ID NO: 769 - DNA, 2400 bp, Mus musculus
tgtgaacgagccaagtcaaagactacacattttatccttaaactttctggttgtcatttctaaaacaagaaacaaattttgctttaaaatatttgccattgatgattaaattggtgggttttttgtttgtttggtttggtttttttttttttaatcaagaaattatttcctaggaatgactctgcagttgatagcgcaactgctttcagattaaaggcaaaacagaagcaaggagcacatggctcacattgaaggtccagcagaagcgaatagaaccccagctggtggaaagtggttctgacctaaaatacacaggtaggctgtctcgttccccagactcttgctgaatctcccacttatttgactggtcacagaggggcaggacccagctagctaagtatcttctcagtgatttactgtggccagtgtacatattttctaagtgacagaagcctgctgtattcctgcttctgctgtgcatgatgaacttgatgttttgtggcggctaagtccctctgatatcacgtagatcctttgctatacagacgctgaggtttccctagaagtgattatttagtccttagtcattagtgaagtgcagttattacacacataggacccaggcttcctgtacaaaactctccattgtttaaggagagctggcacaaatggatgagaatttggagatattgttggaagtacgagtgcagagatttgtagaattatgtattttttcgtttccaggaaggatttgggggtaggagatctggctcagtggtagggcaggagcaaggccctgggttcaatccccagagctgcaaaaaggcagaacagggtacagtactgtgattaagcccagggtgggcttcagccacttgggtttacctcctgtcctttacctgaagtcgcctgaggttacctgaagtgtggttttgcctgcattccagtgttacacgggcaagtgcaagtttgtactctattcggtgtgtttctagatcagtaatcaggatggaatttgagctgtgcatatttaatctctctcttcgtggcctttgataaaacaaggagaatcaccttgcttatgatctgtatgaatgtctgctgcttagtaagtgctcatgaaacgctagactatatgttcatccagggacaggactgtggtttctgtttgtttccatttaggttaaataactaagaaatgttgccaaataacagagactcagctgtgaacacagaacatgcactggaactggcttctgaaaggcaagccagctggctgctttagaaaaagtcttggggaaaaaatagcctttctcatctagttcacaaatggtaagttgaatttctctctgtgcttaactggcttctttttagcttgtttgtttgtttgtttgtttgtttgaggtgggctttgctcacaacactgagagttcctgagtaaaccaagggtgagcttttctaaaacattgttgcaaccgtcttcaaggaagaacctactgatgactccatgtcggaaacactgtatgcaagcttgtctggggccaagccaggtgatagaagcaacgggaaacttgctgcccagttgctgagtgtgtgtgtgtgtgtgtgtgtgtgtgtgtgtgtgtgtgtgtgtgtgtgtgtgtgtgtgcgtgtgtgcacgcatgtgttctgggaatactttatgttctgcccaccaaatgcacacatagaagattccaaaggcacaacagatagccagtgtgtacaaatatttaaaaagtatgaaaataatactttctcgaatttattgattttatgtttggaattgtaaacagcctctcctgctgccccagtaaccaagaaacacctgttcacttcgcatttgctaagcatgaactcaatcacttattaaacaaacaagatgagtgagttatctttatgactccctaccgccaaatgtgatatcgttagagagacaaaaatagcagtttgaagcagatgccatattgtcatctttgagtggcacacatttagtagcaaccattggatatgttattatgcatttctttataaagcataatccaaaagctgttcctctgtggcctcaggataaaaccccactgagagtcaacactggagcacagacggacgcttgagggggatgagggagatggtccactatttctataggaaggagggctagactgtgaaaaggtgaatgtattactgaacaaaacgacgcttctgcatgtaaactgtgtgtgcattcagtgcgcagaaatattcaataaggtgagctatcaaaagatcttccctttgataagcacatccattttaatagcatagcagttcctgagatgacagtcttagatttatggtctctaatctctggggccagaaagtctgacataacttttcggt

SEQ ID NO: 770 - DNA, 1875 bp, Mus musculus
ttcagggctggacatgttcaataacctctggcctgactttttctctgaaacttcaaatgtctttgggacagggttaaaagtcctgatgcaaccatgcaaaaaaaaaaaaaaaaaaaaaaacccaacccagtgggacaatttggcattgaccagtctgttatagctcttgcttgactgctggttcccaggctgtggtgccaggaaccctgggggttcacagggatctctggactgcttcctgttttcaaggtcaagataagacttatgttgaggactgccaactgctaggccatagggatctgcaatttctgtatcagaattatactaccttacttctgatgatacttttatctttgcaaaatgggatcctcaacagctataagacaacaagcaaatatctaatgtgcaaaatatgaaagctagcacggaatagaaataggagtaatgttttcagtcagatctcaagctttgagatttctatgcagcatatgcccaatcgagaatcacaatccatacaggggcaaagatcgagcagagattgcagcagtggtcagctaatgactggtccagcttgagacctatgctatgagagggagcccacccctgacatgttgatgatattctgctatacttatagataggagcctagcatagcgtcatcagagaggcttcacctagcaactggcagaaactgatgcagagcctccgcagccgaacattaagtggatcttggggaatcctgtggaggagggggagagaggattgaaggaggcagaatagtcaaggatgccacaagaacaaacacagaatcaactagcttgggcccatggggctcacacagacagagccgacaaccaggaagcctataagggattgacctaggccctctgcacatatgtagtagttgtgtagcttggtccatgtggagctccaaacagtggcagcaggcactgcctctgactctgctgcttgcctttggagccatttccccctagatgagctgcctcagtaggaaataggcctagatccactgcaatgtgatatgccaaggtgggttgatagccataagaggtcctccccaccccctttctgaagagaaagggaggaagagtggatgcaggaagagaggaggtgggggaggaccaggaggagaggagggagaggaaactacagtcaggatgcaaagttaattaattaattattaaaatacacacattccagtaataactagctggggttaaatacttatttgtttcagatattttgcattctaactgttgaaacataaagtagaggctgcaaccatccagcaaatgcacccatcaagagccttcctgcatcctgcctagtattcataatactgaaggcactgtgcatgctaccagaggagaaaggtgacaccgaccctttggtacacagtggtgacctagctgcatgatacaacagtagcacaaaagttgtaggagtgaccaaccaccatgtgattgaaggcccactccatgagatggggctcatgtccgccactgctcagatgcacagaggatgagactaaataggtcatagacctgggcaagacccaagtactgctgttctacgaaagagaaggtaaaacgattcccagtggcatcctgctatacctacagatcatgtctcagtcagccatcatcagagacgcttcctcctgcagaagaagggccaagtacagagatccacagctggacagtgtgcagagcatgagagagcttgcttggaacactcgggactaaaggggatatcctcatctaaccctcctcttgggtatcaaggaactatgcagaagaggaagacagacagttggtaagagccagaggggtagaagacaccaaagaaagagag

SEQ ID NO: 771 - DNA, 1775 bp, Mus musculus
aggagaatttctataacctcatttcacaaacaacattcaacaagtaaattggattattgtactcttccacattgtgtttttgatagatcagtatttagtagcctagcaatagaatctaagcttcagttcaaatttatttcccttcttatccagtatatattgtagtcactctcattgggtttattttgtatgttccaagataatatagttaatattattgcgttgctaaacaagaagaggggaaggaaggaaaggagggaaaaagaaaggggggactgaaagattggaagaggggagggggaaatgactgaacaaacagaagaaggtatatagagtcacatttaaggattctagctgcagagaatataaagcagcaatgaaaatctctgtaaaataaatattggttggccaagagaactttgctcaattttatggctctattccccttacattctctgagtaaataattcatgcttgcagagccttcattcattttagtatctatcaaattattctttagaaataaacccagcctacacattcccaaagctacgctgtacctgcttcccaaaagcaaaggaaacgaggtcaggcagggtttgactggttcttttctctgtgtattgtttttaaataagaaatatagaagctctacacttgcatctaatgtcccgagctcagattgttactgagtatgaaggtctggagagaaggtggggtgggggagtgggggaaaggtggggaggacatgtcctgggcttttgtgccacaaggactctgagatgaagtgagaaaagcagcagctgacagggcagggaggccaggccaggccgggccagatcttgcatcctgaatctgctgaagggcattgctggatgatgttcttccaaccacacgaatggtttccctgaccagtgatcacagctcgtctttagggtcaacgtggcacggctctggttccatgaaataagcacagctccagaggtgttttggagaggtgcttagcaccagcagtcagtgacctttagagcaaggaagttatcatctagaattgcttcatccaatccactgaaggccttagagcaaagttgaagcctccccaggggatagagaaatcaaactggggtctctgctctggcctgacacatttctgaagagtctccttggcacacatccagggaggacacatggagcagccgcagtccctgtggtcgtttctgatgatacacgatctgctgatcttggatgacattagtctaaagtcacctgcataaatagagtacctcttcatagcctaaattttagtccattgcttaagtcctgaaataacgtcttttaaccctttagaacatggagaagcagagttttcacttgacttgtccccatacccttaaagaccacatagatgaaggtcagtacacatgtactctctctattgcacaggccattgggccccgtttgtatccagtctacgagatgtttgaaatgagcatttgcaccatggttttcccttgttaaatacgtggctagtctttcaaggcaaaatgagtgcatatggattacagtctgtgaaatattgccaaaaccatacttgtctaaaataagtccacttttataaaaatgtaaagcttgaaactggttcattcgtttcagtagtcgcctgaagggcttccctcgcctgcatctaggcaagaggttttactcttaggtgtcacgtgcagactcaccggtgagtctaaactgtcctttccttaccatgagaggctgaacttttc

SEQ ID NO: 772 - DNA, 1825 bp, Mus musculus
tctggaatccagctttaaagaaagtaactaaagcaaacaagcactcaaaccaaccactgccttctggcaaggaagcagcttttcagaccctagtctggtctctggattccatacaagcacactcacatagtatctacttgttttgctttgcctcctgactgtgagattgctctattttgttgaaaacggtcgttaacttttatcagtagcaagtagatttccattttgaaactgtattgcaacttatttgtcttgtgtaatgttgattgcttttggctgttttctaatttgtaccattaaaataatacctaggtacgtacatacatacatatgtacttatatatgtatatatgtacatatatacatactacacacatgtgcacacacatacatatatatgtacacacacacacacacacacacacacacacacacacacgtttatacttttaaagtgcctgctaatggacccagcgcccaaacttttgtaccaaagatttctgagccacagccacatggggaatgttgctactcgggacatttgttcttagcaatctcagaagcacttttaagagtataggaaaacattttgaaaatatttaacacatcactgccgtttaagatatcagtatattgctaatgtcaagtgctggaaggatctgaaaactgtcagttatttcctgtatgtctatcaattaggggtcaacataggataactattctattcaggagtatagctaaaagcatcttaattaagagacgattgacaaagaggtaggcaagattaaatgagcaggcagtgcatgctgaaacccccaggtgttagcaatgaactgacagaagctatcaccatccttggacctgaaggaacctgctggatccggtaggagcagaaccgagcagcaggcagagccgagcagcaggcatgccattctagaaaaaactaatcttccttccccaggtttcttcctcctgccaaataaatccacatgcctggcttccttgtcaatggaggggtaggaaaggagttgtgggggtcaaaagttgagccagcacagtgatctgttgtgtagtgctgtagtacccgatgtagatgcccttggactagaaacagaacgtagatatgtagagctcttggatacatccatctaattaatgaaagcacatcagatttggggagtcccttgtgattattcgatcaatggcttcattagctggaatagctgtgaactaagctaatgctaaattgaacttggcatcctgctcttgagaaccagtccccactcaaaagggactaagacaacaagaagtaagtctaaatcagcctggaaaaaaatattacatagaaagttacttcagtgcctgaacaagtggaacttaaagtgttatagttaaggttttgttatttttatttcccaaggagtgattaaaaataagtggtgactcatggcgtcagaataccatggtgacctgtaactgcctctctatgctaactttatgttgtgatagtagtaaatatttaccaactctacctcttaaaaaacactatcctaaacagtatgtgagccgtggataacctttgccaacacccctgtccctgtcattttttcatggctatctaatttcaagtctaacaaatatgtgtcagtcactagacagtggcttcagaaatgggggtcgctttagttaaataacagaacatatgagcaacaagaacagtttactgatggatgcctggagccattaacttctcagtgtccagcatagcttggacagaatggacattgatcaaggacttcatttgccttatgcatccttggagata

SEQ ID NO: 773 - DNA, 1925 bp, Mus musculus
ataatcatatcatctactgggcctagagtagagcagctactgagatcctcctgcctttgacaggaaagcaggaagcaaacactgggatgctcattaggtggaatgcttcccaccgcagggatgcccagcttcccaggaggtcaggagaattcgttagatagaaattttatgagacaaaaaaaccagttttcctttgggcttatgactcttaataaaaaatggtacctagttatttttaacaaagacatctacctcaccttagctgaaaaggactcctgtcagaggagggtcttccctccggccagtggagaccatttgggaggtggcattcagaaggatgtgagttcttttagctcagcctctcatatttatttcacatgaatccacataggcgtctactgtatttttctgttttaattgaaaataaagttttagtacagtatgttctgactggattgcccctcccccaattcctcccaggttctcctcacctccccgcccacccaaatccgcaccctttcctgttctctacgttaaaaaacaaacaggtgtccaaaaataaaaatatagacaagcaggccagcgtgggagaaaacaaagagccaacgaaaaagcacacggaacacatacagacgcagggaggaacacattcataagatagaaatctcattaaaaaaaaaaaacaaaccataatatctaagcaaaagacctgtaagatcaatcaattagaaaacctacaaaccgcgactgagcttgaaggctccgctgtgtttgggaactcctcctaagcataacgtgttgtatacccagtgagactctgatggagaaaacgaatacttattttttgcaaaaggctatgaactggactggagagaacttctgtgttagggcttgtttccacttccactctcagcatcgggccctgtgctgggcaggccctgtgagttctgatacagtctctgagttcacaagagtatcaggcctgtggtgtccagaagaccttgctttcttggtgttttccatcctcactggctcctacaatctttctaccacctctttcacagagttccctgagccctgagggagggatttgatgaagacatcacatttagtgctgagagttccaaagcctcttattctctgcacactgtctagctatgactatttatttattttccatatttatttccatcaattaccggaggaagcctctctgatgatggctgagcaagccactgatctgtgagtgtggcagaatgtcacaaggagccacttgattgctatatttctttagcattaaagtattattaatttttttcaaacaacccctttattcataaaattccttagctccctgccccattcaggcttctctcttacttttatatatatatatttttttttattacatattttcctcaattacatttccaatgctatcccaaaagtcccccataccctcccccccactttcctacccacccattcccatttttttggccctgccgttcccctgtactggggcatataaagtttgcgtgtccaatgggcctctctttccagtgatggccgactaggccatcttttgatacatatgcagctagagtcaagagctccgggggtactgggtagttcataatgttgcacctacagggttgcaggtctctttagctccttggatactttctctagctcctccattgggggccctgtgatccatccaatagctgactgtgagcatccacttctgtgtttgctaggccccggcctagtctcacaagagacagctatatcagggtccttgcagcaaacgcttattaaagtattacatggtattatttggttttaccctaggtttgtaccctatctagtttcaggttcttgattacacaagcagtttcaggcatgggctaaatctgatggag

SEQ ID NO: 774 - DNA, 3975 bp, Mus musculus
ctcttggtgcctgattgtgtggtcagtagacaaagtgtcagggatgggaatgaggcttgtcacttaatgtccagagaacccgacaccatataaaagtacaggtgcttgtgttctgtagtttgatttcacaaactgcctgcactggtgcaagaactgctttgcatggctgtacagattgcaggtaagaagcctcttggaaccgaggagaggtaacagctccctagacatgctttctggaggatagggggagggggagccttcttgggataaaatgcagaataaacaatacataaagttgggtaaggggtctgagtgtttggtaagtcaaggtaaggcaatcgatctcctggaattgtgggtgggaaggatgaagctaaagctgctagcaggtgggatggctcccactgagtgttctatcctagcaccaacactcttcatatctggtgctattctgtatcccttgaggtcttgtgtattataggacacagtgtgaggttccaacacactgaggaacctgtgtgaaaagttcaaggccaacaagagagacctaaggttatctttaaggctataagaatgtatacaaccattcttgaagagaaatcacagactcagagttccaaagagcctggtgcatcacgcatcattttatgacaggcataaggaagcaactcagaagaatgacaaaataattttccttttccaaggaggagtaatcattcttctaatttaatgtttcatgcgtgcaaacgcacttagcacagatttttcttaactatcttaatcgacaactaataggagctgacacattgtaaatcccaccactgggggcaaggggataatttagactgcagtattgcctggtccatgtcagacaagggctgccagctgggtggttgttttgtaattcggacacaataaatccaaggaaagtaatttccttttagaaccccgaattgcttccttaacagaatggctggagctagatttaagctgtgaggttagccaagagcttcagaagggatacccatggggctctattaattgcactcttgtttttaatgtaatatgctttttattcacaggaaactccagtggtaaatttcctgtaagcaccagcttagattcagcctaccgaaaaggccgttgaagttttgttttgcaaggcagtcaaatttgctataaaagaagtggcattgccctctgcttgtgtgtgttgagtacaaatggagttaggaagctaactgtgcttgctgttcggctccaggccaagcagcagtgaggtaggaatgatgcctgattcctgttcatcatcacattacgaatcgcccctacactgggaactgggaagcaggatgagagacagagtctacacaacttgtaaatgttagcgccagtggcctggttggtgaatgttctacccacggaactgtgtgcactttgtcagtccctactgtgtgccaggtactgttttgcaagccacgaaggctgtaatgaacaagatagcctgtgtactgtaacatctagatttgtagactgtagttgaatataattctttgaaattaaagactgctatgtgaaatacatgaccaaaatttctcagctggtgatcatatttttttaggcaaaaaaaaaataaataataacttaaatctgataagagtgttcattaaaatctgtttttcagacatctactggccagcaagacctatttttatttttttgccctgaattcccctttgctatatagatgtaatgctgactcccgagtaccaagaacaatttaatccatttgttcaaatttcaagtgaagaaaaagaactttggtaatgtattagttgtctgccacattgggatagcactgagctaaattgatgaactttatataatgatctgttgctatagcaacaggctgcccagtgagtgggagatggtatttcatcattaccgcactggtaatgcttggctggtagcagatgcaaatacaaaggctttctataactttgctgtaactgggtcgatgagacaaacacaaaaaaatgcctctgaattacagtggcacagaagcaaccggagcctagtgtgcagtgaaataaaatcacttagctccctgctgagtggtcctggaatccacagtgaatctctgaccatcacagagggtcattgtccaaggtgtggcatgcctttcaggggttttacttctgttctgtatttggtgattggaatcttgaatagaaaaccttcccttagaaatatgacagactctagatagagcacaaatgataaactatcaccttgtgacaatccctccatccttatctgtagtcctgaagcaatctagctgcctttgctggccggattattgttctttccttacaaactaaaggaatgtatccatgtcttaaatgagtaacatgcccatctcctaaaatgtttactacatttcagacaaaacatgtctatcctatttttttattagatattttctttatttacatttcaaagttccctataccctccccctgccctgctcccttacccacccactccctcttcttggccctggagttctcctgtactggggcatataaagtttgcaagaccaaggggtctctcttcccaatgatggcaactagtccatcttttgctacatatgcagctagagacacgagctctgggggcactggttagttcatattgttggtccacctgtagggttgcagaccccttcaactccttgggtactttctctagctcctccattgggggccctgtgttccatcttatagatgactgggagcatccacttctgtatttgccaggcactggcatagcctcccactatcctatgtcttgaaagcatatttcactaccatttttaaaatatattaaattttccaagacatctttaattggtcagagatcataggtgtattaggatgaagccattttcacatgaagtcgagtggctttactgtaaggttgtcacttccatctcatcgtgtttacactgcagtgagctgaaaactatctggtcataggcaagcatcaaggcaagtgtagtttccacacagtgacagcaaatgttgagtattggctgtatttcttttccctccctttcctctctccatccttaatgtctctgctctcttcctgcaaaatatgttttgatgcttttttgtgaaatgcttacaaaactaaatttctagaaactctgtcctaagaagtttacactagggctggggaattagcttagccaggtaacagtgctcactgcacgagatagtgttcaaatccccagaaaccatgtaaaaagctggtagtttaacattcacctgttgacaccagtttggtgaccagaaacaggagaagtgcttgagattgctggctgccagcctacctcttgattcaggaggaagcctggtccctgactctagaaaatgaggcacactgctagagtagataaccgtgatcatcctcagcatgtgtgtgtgtgtgtccatgtagttgcagatctacacacacacacggagacgcacatacatacacacacacacacacacacacacaaacgcacacacacacacacacacacaggcataaacacctaccaggacgctctctttttctctccttctctctccctctctctcctctttctccccgcccacccccaaatgaaatgttatgaacagagatgttttcctcaagtatttcacggttcactagtgaacgctcatttagtactgatttttccctcaaaggccaaaatagacattaacacaaaggtttgaaaactagcatcttctatgtaaatttttatattttaattcaaacagataatgtgtcagaattatacttatgtatatttagacgtttaaatatgtgataatatgaacaaaattttaaaataataagctgcttctaagtatgaaccctgcaattgtgcacagttaaaaccatttcatctaccgtttt

SEQ ID NO: 775 - DNA, 2600 bp, Mus musculus
gaaaaagacagtttacagaatcggagagaatatttggtttctcattatacaccagaggagcacactgtcactgtgttctataaatatgtatggtcagtattcttactttaaaacaaagtttaaaggaacacaataatcacatataaaggaatctttctacttatctttccagaaaactagtaaaaattgagccaggtatggtggcacatgcctttaataccagcactcaagaggtagaagcaggtagatctcttagttcaaggtcagcctggtctacagagtgaattccagggcagccagagaaatcctgtctcaaaattaacaaaacaaaacaaaacaaaccaacaaaaacaaacaatcaaaaaactggcaaaattaaaactattaatgataatagtaataataataataaattgagaactactctagacaagctgggcagaactactagatattagcagtaagaaaaccattgactgcagagtggatacaccaagcagcatgaactatataggctctcttttaaagctctgtagttaccgtccaaatgggttaatcagacagtaaaacagatcactgagacagacagacaaaaccctgcttctccttcacgtatattaaaaattagctgatgtggtggcggacaactggcacagggctttaatttcagcccttggcaggaagatgtaggaggatctacctataagtgagtcattgtctcaaatttagaaaaggaaaacaaaaataagaaggctagtgtttggagggagcatagtgtttggagggtgcatgtgtgggaacagacaggctgctgctttactcgttcaatgctctgccctccggtttgcagatcaggaacatagaagacagaagtgggggacaagaaggagtttcataaaaaaaatggccattcaaacaaattctgggataattgtggaaaagggacaaggtggctctgagaagattgtccagcagttcccatctggaacaaggacacttccagaattcctcactcagcctttgcagtctgccttagcagtcagctctgttgaatactgtctagagagaggggactcatgcagagagaggagcttcccacagcctgcagtgacctgccctctcacagtcgctcccccctccccctgcacttggctctctcacagccgctcctccctcccctccccctgcacttggccctgggaagcagagggactataagcttaagtagacaggtgtgcagcaaggtttctgcctgcgtggtgatgacatcataacctggcaggttctggtgactcaggaattcagcaagatgctgtgaagctctaagccgagaggccaagatctgctcaacatgtggaaacctgatcttacaagtttctagtcacttcttgcttgggtcttcacaagagcttatggctcttcgttttacaaaaggagcccagcttacaagtgacagaggaagaagtgacttaggtctcagaggttccatagacttgattaatcatctccaatggggtgacctgtcctccctgtttgttttcttagctacactcaatgtacagtcacccctaaaaagggcaccccatatccattagcacagaactcctggcttttcccctttcttttcaaggcaccatccttctaacccctcgatcctgtcttttttccccctaatcaatatagaccacagtatctttggttgtatgtaatgaatctcttattacttttattcttgccacctgtatatgcaagcaccattcctggaacacatgggatggaggacaagagagaagagatttcagtgttcctgtatttccagtctagcaggaaagaagacagctaggtgcagtggcctgtatactaagtgatgtgcggcactatgaagatgcactgtgggttcccgggagggaggaataacctgccagttacacactgggctgggggtaaacatctatcccaagatgtatacagaactacaaacagtaaacgcttcaaccccaaatcagtcaatcaattaatgggcaaatgagccaaatttgtatttcttttcataagcacttgaagaaagtgtttggcattctcagctaccaatttctaactaaaattacattgagatctcatcttacccacatgatctagctatactcttgaatgtcctaccactgagatgcttaaacagccatatttataacgatactcttctaggtagacaagaaacagaagtttctatcaacaaaggagcgaatgcaggaaatgctgccaggtggggagatagctggggtaaaggtaccaagccaacgagctgcgctgcactccctgggcccccagggggtggaggtgggggtgtgagaacagactcctggaagttgttttctgccttccacacatgcactgtggtacacacacacacacacacacacacacacacacacacacaccacgtaaatgtaattaaataaatatgcatacacatagcagaactttatgcagctatgaagaaaaattaaagaatggcatttgcaggaagaaaaacagatgcgactggaaaccatgttaagcaaagtaagccagctcagacaaacattgcattttctctaata

SEQ ID NO: 776 - DNA, 3750 bp, Mus musculus
atgatggtggtggtggtgatgctagtgatgataagcttccattcattggcatatacaatatgcttaggtttctctgaaacatacctcacaagtcctttgaacctccccaccatctagggagtcaggcacagcttttcctccagctcatagagcacaaaagctgttatcaattaacacttggaaccacctttcatctgtcaggccagtgtctaatcactggggccagcacttgcttcagtgatagcaacattcccttgctcaggccaacaaacagaatgcagtcataatttgcttgggagtggaagctaacattctgtattaattacattcttgttactgttaagaatatagggctggtgagatggctcagtgggtaagagcacccgactgctcttccaaaggtttggagttcaaatcccagcaaccacatggtggctgacaaccatccgtaaaaaagatctgactccctcttctggagtgtctgaagacagctacagtgtacttacatataataaacaaatgaatctttaaaaaaaaaaagtatatgacagagacaacttaggaaacggaaattcatcattggttcataggaaaagcacggggacagtgaggtcacctccatcctcagcaatggcttcactacagtgtggcccaggaagcagattaaacaactcaaaaccacagaagatgtagtcttcagaggcctggccccagtggcttactaacaccagtcattccccacctctcaaacactcaagagcctctgaaagagccctaagatggggaaggagccccaaagcataagccatagcacactgctcagcaggagcttctgaaagagagccctaagatggggaaggagcctcaaaacacaagccatagcacactgctcagcaggagcctcagagaacctactttgggccagacactatgaaagttcatggctttgccaaaacaaaaaaccaacacacggccctacctggatctcagcctaagggggtaagacatccataaagcagaaatccatctggatggctcttttttaaagactttttaaatttttattttcaattatatgaacagagagggtgaggattatgcacccagggcaaaggagggcggaagagggtgttagaaccattggagctgaagttacaggcaattatgagctgcccatcttggattctgggaaccaaacttgggtcttctgcaagaacattatgtattcttaatcactcagccctgtctccaacccccaccatctggactgtcttatgagaactatgcacacagaaattggaggagccctgagggaaaaaggtggcttttctggtaaaaactcatatgcgcaagctttcttcgcgttcaaacaaaggaaactcagaaacctgaaagaaggcaccaggattcactcagccagtgtctaaatttggctctagatctccagccactatcttcatggtctccagatttctaacagtttccaactcttgatgatttagcaatagctcagggagggtgtgaaatgttaataaaaatagcaataataataattgccatggtttagcttccttaaaatacttaaggctgcttaattgttacatgttggatacaacttagggtccagaatatttatacacacatatatataaatatacatatatatccatccctcacacactgtacagattagttgtcgatatatagatgagtgaacaaatgaatataaatgagtgaatgaatgagaatgaatgaatgaatgtatgctaatcattagttttcctcctctcttccccactagactcttgaagtcaagggccccacctcacctcttcagtccctggttccctgtgcacaggcagaagagacactcagtcatgggtgtctctgtccatcagctagtaaggcaggctggacggtttcgaatgaaaggaggctgatttgggctacactcctggaagtgcatagttgagtgaccatctggtgttggccttcttgctggtagaatcccaaaacagttcagagacaggaagcatggaatatgtgggtgggtgggagaaaaggagggagggagagattatggagagagagagagagagaaagagagagactgtgtgtgtatgtgagagagagagagagagagagagagagagagagagagagaaggagggatcatggagagagaaagagggaggcatcatggagcatatctgtgtgtatgtgtatgtatatgtgtgtgagagagagaaggagggatcatggagcatgtgtgtgtgtctgtgtgtgtctctgtgtatgagagagagaacaaaggatcatggaatggggggcgtgagtgcatgcatgtgtgtgtgtttcctgatatctctctatcttgtgttttaattataattactaaaaccatgttatttgtgcagacttggggtttctttatgacatccttgggcatgctttagttatgtcccccccttcactcccacacctccttcttactccctccgagtcactctggtgctcccaaggctagtgctggcttgttttgctcccttgcttttgttgtttgtctttctgtgtctgggttacttctcttaacacagcgagttccagatccatctgtgacaagatttcgttttcctttctaatgaaatgctccattgtgttgcatgcacaatatcgggttctgactgcctgactgtcttttgataggcactgtagacttactgcatatagacacatggctcttgtggaccaggcttcagtcaacatggctgtgtagatatctctagtttgtgttcccttgagtcctttggctatagagctagatcagagagctagagctctgtttttaggtttttgttttgtttgatgttgtggtggagggtggctggattttgttgttgttgcttgtttgtttctaaggaacttccatactttacacaccacactgctgcctattgtaacagttacctttcttgttgcaaccaaatacctgatgagaagtgatttaaggaaagaaagggctctttcctacttagaattccagggatacatcttatcatggtgggagactcacagtggcaggagcaggggccagctggccaccttgcatgagcagtcaggaagccaagagaaagaggatgggaccctgaaataaaacagctcacttcctccagcaaagctctacctagcaaagcttccgcaccttccaaaacatcattactagctgggaaccaagtgttcaagcacatgaacccgcagaggacacttgtcactcaagccaaacacacaagccaaatacacaaaacactatggccaaagtgtaacttctcaatacctgtcttagggtttttctgcggtgaacagacaccatgaccaaagcaacacttacaaggacaacatttaattggggctagcttacaggttcagaggttcagtccattttcatcaagacggaaacatggcagagtctaggcagacatggtgcagtaagagctgagaactctacatcttcgtccgaagactgctaggagaaaactggcttccaggcagctaggagatgggtctgagagcccactccctcagtgacaaacctactccaacaaggccacacctactccaaggccacaccttcaaatagtgccactccctgggcaccacagtgcccaaagaaaccagcactttcacgtggtttgctttattggtatatttactcggttaaagtagtcttaaaactgaatccatagacttgtc

SEQ ID NO: 777 - DNA, 1825 bp, Mus musculus
aatctgctctcagcagctagacttcacttcctaaattcacccttcaaggcagtgccatcagctaggaattagatgtttggacacttgattctatggagaacatttcatatctaagccataagaccctttttacccaggataaaacttcatgactgtcacttgttgtaaaatctgttataggttggcacatcgggtgttctcgaatttgtagccatactccgtttatcccctcacaggtcaaagctcacagagaactagactggggcatcaaataggtacccaaatatagtctgtggtgctggttagctggattagagggagaccgtctttagggaaaggctgaactggagtccggattagcttgtaaacgcttccttctgaaccagatagactcacctatagggagggaaggtatacctgtctcagtggcttccttccaccttagcattaggatcagaagaaatgaaggaatttcaaggacagacagaaatttcccacgttcacaggaatgatcccaagaaaggaataagagccaaccaccaaactcttcattctactgaaagataacagaagatcctggaagcagagggcttaggctgcacagaaatgcagaaaaagctgacgtggttagaaatctgaaggggtttgttcttgtccctaatgttgagaagctacctgtagcgtagtttggtggagagatgattgcttccttggcattcaggagagtagagactagatctctggtgagctggcttgtaaagaaggcaggatgggaaagaggcaccattcctcaggggcccaggcaagagaagagaaggcgttgggatggaaaaaacaaagtcctaactacacagttagaatctgtttctcgattttccttgtattatagccagctcagccatgtgtgacatgccaatgcctatgcgggaggaggatgtccattagaggagaagcctgggaggagggaggcacctagcccaggaagaaaggagctccaagccccaggaagatggcattcatagtaaccattgccattgtgcagaggaatgagtgagaagcatagaaaaacaaacacccacccccattcctggctctcctccagttacactctcctgctactttgctcttgagcatttggtaaatacttctgaggaattctgggagggtggtttcaactggcctagttccctgcactgcagcttcagagcagtcccaaactgctctgtgggttctgagaactcacagggagaggggcacagactagagtccttggaggtgcgtgactaaactcagctgacttcttgtagttgaaaacatccaggttcttcatgcctgtcagtcaagctgtaacaccacgggctcatcatgctgagcatcagggctggaatgtataaaacaagggccaatggggctctgggaacagcacatccatttccttagtgaattcccactgaacaaagagttggtattcaatccactccagccattagctggccagggacctttttcaaccccatagcagactggctatttttcctcttaaacttgaggcttgtgttcctccatggctggactgagcccatgattaagaaagaagcaaggatagtcaatgctgtggcagttatagtggtggggtgaatggaaaagggtgggatactgagctaaaagtgcaccctaaacaggggtgcccgcaaagtattccgaatgcaatgtgtattgttcccctgttggttgagaacattcttttcaatttcccttaatgaaaaagaaaactgagtcaataaagcccctgctatgcagacatgaggacaagtcgaatcctagc

SEQ ID NO: 778 - DNA, 3850 bp, Mus musculus
tccagaaagggacatggtccctagatcagtaagcaggatggagaaagtgacaaaaggtgacgtgagcaaatacagaattatatagggcttaggtgcttgtttaggcttgaacacatatgcatagaatgaactattgagagcaactctaattgcattatatatggtttaaatacttctaaaaaacccaaaatgacagcaaagccacaaatagtatgaggttgcattaaatcacccccttggaaggctcttatgtcattcttaaaatatataatgctacttgaagctaaattataacctggtttagttttatattgaaaaacaaaccctcaagaactagagaataaaagccaatgactataaattttctatttctatttttcaattggccttttaagaatgttttagattattataattttgtgtgtatgggtgttttgcccgttctgtgtttgcatagcacacgcatgcctggtgtctgcagaatgtcagaaggtggcctttgatccctgagtggtggtgaactgccatgtgggtgttgggaacaaaactagggtcttttgtgagagcagtcagtgcccttgaccactgagccatctcaccagtccagaaatgtaaaatcttttcatggaaaattatttcttctttgactatttgcaattaagagaaaaacagaaaatttccctaggatttcttacctatttgaaatatgagacagtgccatcctttctgagcaacattgcaaaattgttacattactggccctgtgcctttgcttccccccacccccgccccgtgctaaaacaccctgacaaaagcaaattaaaggaaagagggttgatttggttcactctttgagggcatggtttattatggcagagaagcaaaggcagatatggtcaaggcagagggtagatttgaggtcacagttatagttgtgttaactttggagaaagcagttgaagaaagaaatagggagggggaggaaagatggaaaagggaaggaagaagggagggagggtagaaggagggggagagaaagagaaggtctatgatgataagagtcccagtttatcaaaaacatatagtagtctaatacagtgtgcatttacgaataaagctttattgctttttaaagcacatagtgtgaggaaggaaattcagtaggtggataaaggagaagtgaatgggaggggatggcgctggatttaatcaaacgcattatgtccaggtttgaatcttcaaacaatacaagggataggcgtttctaatacaagaaatcgatttagcagaacaaagaagaggtggattcacaatggtatacgaagattatgatgatgttggaacaatcagaaaacacatagacagaagccagttgggcaaacctgtgaaagtgacacctcagtgccttccttcccatgctgccctgtgacctctccggcaggaaggtgctttccttggtgacaactcccagatccatctcacctactacagcatggctagcagcacacctggcctggcccactagctctcagtagcatccttgcccctgtggtaacagttttaaaaagtgtccagacaaatgtctggagcatggagacaagagacccagtcaaacaactcatttaaaaaacatcatcatcaacaacaacaacaacaaaaaacccaaaaaccttgtagatccagaccatggactaggattaagacaagtccacacaaatccacataggtttataaagtgttgaaaacaaactcgggatgttctctgaagaaaatgaaatccagctattactcaatcatggtaagatttttgacatccagaatacaacagacattgagaaactaggcaatgcttatctaggaggctatgagtttaacagtttacactgagcgtggatgctgcggaggcaatgcacagagggaaattttcagctccagtgtaaacacgaaggagatgtaaattcaacagcctaagcttcagaggtaagaaatccaagcctcagaacaaatggaaggaaaacagcaggatgccactgaggagatgacaagttttgctgcacacctgtaatcctagaacttgtgaggcagaggcaggaagacgaggtgttttcaagtgtatcctcagctcatagtaattttgagcccagtctgtcttaaaaatgagataaaataaaataaaatcagtaagtaggaagaagggtgaacctgagagagacagagtcccagtctgccgatctctctattctcaggcctctggctctcagcagcttcctggacagcacagagctgcaaaggtgtgtgtgggagggacttggccctcaggaaggtgctgggaaaacctagccttgcccttttcttgagcctaaaaacttaggctttctgttccttgtctcctctgcaaatgtgggcacagcagtatccagcccacacagttactatagagatgaattaacacagtgtgtgtaggtggtgggcagcaagttcatgctgcgtggtgtgcacagctggctgctgctgtggttgctcaaaacagggaacatggccatctgtgtgtggaatcctctctccttcctctgagagttctaagatcctttttctagtccatgaaataggtatggtgtctatctatctgcctgtctgtcattctctctctgtgtctctgtctctctctgtgtctctgtctgtctgtctgtctgtctgtctctctctctctctctctctctctctcttggttggtttctcagcatctaggttataaacactccatggttaagggctgagttgtgctcctgacccacaaaccatattaactccaagaaccttagaaatctgacttttggcttccagagctatcaaaggaacatttcatcttgattatatgtgagaatgccttagcaatagcatccctaggaaatatatgcacacactttacatcccttctgtttaataacacacagcacttttgtttcctgatggaacctagctgaaatgattcccgcatctggtacatggcctggagcttaatggggaaggagagtgcgaagaacaactttcataacaaacagaaggaatccaacacataagtaccatttaatctaaatacatttgggattcactgaattatatacagaagtatttaggtgagcatggcttaaggccagtaacttcaggtctctcttcaggtctctcttgagctgcctcatttgaatgcatgtgggtcaacgctaaatgaacgactggcaactaaggaatgctgagcaggagaagaaagagcaaacttgttggttatccaatatcaaacggtcatctctgaacacatacacacacgtaacatagagagggaatgaagttgaaagagagcaagaagagttatattgggtaggtttggagggaggaaaggaaaggggaaactagtgtaatgatattataatctcaaaaataaaagaaatagcaaaagttaaaataagaggcagtttgtgctctgcttggtgcagccccaacaacctgtaactattagtaacgttgttgtctgtggtgtgggatgagagactaagcatgcagatggtactagatagaggatgggtcagtagagccccaaagggctgatcagagccatcagatctgatagctcttgttaattctagcaattgcaattgctttcctcccaagttccccaccccacagtcacatatagaccatcatattcatccattatggctgactacgtgatttcttccccagcaaggttttaaaatggattccagagaatagccaagatttatccctgtgggagcaaaaagcttctaatgcctgctcactgtctgaagcctctttggctggtcttccatatgcc

SEQ ID NO: 779 - DNA, 2000 bp, Mus musculus
agctctctgttcgcatccaggaatatcttcatgaggctcatcagactaggatgaggccataggtttctgcttgagaaacgaatggacaccctcaggctgaggtggcctcatttgtccctgtgagctcttgagaaccaggtttccattaggaagaaagaattcagacttgcaaaagagacctcactgcaaattaatccaatgccaggagtaacacctgttcttcttggtagccccctgctgtcatgagttcctgtatggatcagtggctagggctgctatcattcaagagtggctagaaaataggaagtggttttcttaccgttctcagaacagagttaggaatcaatgctcacagggtcaggatgtctctgaaggctctccttgactcttccagcttccaggggttgcaaataaccctaagctacccaagtccaaccatagtggccacactggccggatccttctctgtgtcagtctcactctctctcactggttactggttgaggacctatcaggtaacccagaatgatcacatcccaacatccttaactcagctatatctacaagggcctctttccaaacaagagacactcacaggtatggggagtgggtgtgaggagtgtatcttcatctcaggtcaggtgaggcagcatactgtatcacatgactcttaccaggcagtacattatttacttgttttgtccgctatatgtatattttgagacaatactggaaagctccgttagtaggagactaccttgtacagatgtggtaaatactggctgagtctacatctgtttatgcatctctacagtctcagctggcatctgactccctctctattctgtaacttgttctgggagttggaggttgacaaaagacagcactcccttatcctaaacaggaagaatgtgagctaacaggacaaaggctctaactataataatggacagtcagaggtggtggaggtggggggtgggagcagggtgatccaggtggcaaggtgagaggacaatgtgaccagtacagccagggagtgggggaggaccagcaatgcacacactgctggcagaatctctctcttctctcccttcttcccaccatccctccatccctccatccctctcctttccttagcctggcaaggatataaatagcctatattttcctgtcaggcagcaaccccaggagtgcagaacttcttcctcgtgatcgaaactacaatttcataacgggtacgctacagaccttacctccgagcttgtttttcttctaagcaaacacatcaatcttcccaacccttcatttttcaaataatgagccagagaagctgtcttgttactccactttcatttttcaaagaaaggtgatgttgaaatttcatatccagagtgcatgcttagagaaattccaaacaggaacgataggactgttggaatcttgctggttggaccttatcaagagagagtctgagctgggcgactttctatcacttgtccacgatcaaggccacagtctatgttaaaaaggaaggatgtgtggctagaagcaattgttggagtcaagcccctagtggaaagaactttctagtaagaccaagaaaggtgacaagtttatcccttgtctgggtcaccacctcatgtcaaaaactcctctgttttgtcttttaacatattcctaatattctttattcaatctcatttgccaaggaaaggttagacccttacactgtaaaaggctcattattcatgttctggagcctctgagcaagtactgtggatccaaagtatgaaataataagatctataactttgtcatcgattgtactaaatgtgccattcatcaccatccactgacacagttaccaccctcaaactagtccccattacactcgcctttttaagggtatggtttttttcccctctttgctgcaagcagagagccaaaacgccaaagtgacatgaggaatggaggaggtcaccaaacaaaagagcaatctg

SEQ ID NO: 780 - DNA, 3375 bp, Mus musculus
taatgacaggacttcatttctcattaaaaaaaaaaagacagtactaggttcgagaagtggcctgacatggagaagagagggaaggggcagatggagacaggaaatcagggatccagagggagtctggggtgagtcctggttaagggccagagtacttgtaaaaactcagggtgagtaggggaacctatagccagaagtgggtgaggagctcagagagaaaatgagaaagatctagaacgccatgctaaggagtttaggcttcagtcccaggaaagaggtgagactcaagcagtggcaagatgactctaagctcagcaaatcccaccatgtagttagctttagtaactggggctcctagcctactctaggcacaccatgtcagctaaaatgcacgcttacactttgaggccctcgtctgggctgagttggggagctgtatctatccaatactaccatcttgtccaggtactgcttcagtaggcaaggctccagaaatgaccagagacgctcatctgccttgagtagctccccttcgggagctccttttctgcagagatgggtcatctcaggagagtggaacattagtagactgggttcttgccagcctgttggcctgagcagacctccatccactctgtctggccttccataccgactccttcatgaactggaggtccctgggagagttaaggagagtcagactgcctggtaactgttagatctgtggggacaaagatatacccaggcctcctccaggaagaatagatcaggaagagctcgcatgagggcttgcatgtatgaggtagcctgttttcactgagtttagagcttcaaggagataggttttattctcatcgtatacaaaaacagatcgaagactctgcagaggacactgggaaactggccagaattcaggccatttttctggattttggaaatggctctgagagattagaaaaggctgggcagttgtggggatatgttacacaatcgcctaaactcagtttcctcgtctacaaacagataggtgacaatgcagacaggtctctgtgaggcttctgcggctgggctctgtgcaagcttctgaggcagctgcactcattttggtttttgccatggtgataaattatcctgacaaaggctattcaagagagagtttcttctcgcttacagttctagatggggtgtgggacaccatggtggggaaggcatgggaggaggagtgtgaggctgacccatcagtccagaagcagggagcaaagaggacaaggaaccgggctagaaaagctcaaaggcttctagaaccttcccaggtagtaccaccagctagagacaagtattgaaataaacaagccgatgggtacatttcccattcaaaccacatccatttcccatggtcaccgggaccccgagacaccttgagggcaggtgagacagtggggaacagagcagatgtcacagcccgccaggggtaggggtgtggtggtggggttctgacattaaagagttctaccacagaatctgtttacgagcagatgggtctgatttaatgaatggatttcttccttctgggaccctcagagctcttcgtgtgtgcagagtccccaaagggatgggtgtgaccatcatcccacagcaatccctgggagtaaggaaggagctggtgctatggcaagggctttccttgcagaggtgagctgagagcggtaggctctcattgggaacaggcagacagctcttgaggctggggtcctgggagactgaggagcgctggtgtgagtctcatagcattgctccttctaagactgtggcagccaggaagacctaaggctgattctaccatcagggttctgtgatttggggatacatcattttatggcagtcacgaagacataaggctgactccatcaccggggtgcttcaatttggaggtacatcattttatatctgtgatattttcttctcatcccacccacactgagttagggaaaggatgagaggacagtggatgctggaaacatctggggtggaaggcttggttgctaatggttaccaactcagatgcctgtttacacccgagccgtccactcaccccagacaggccactctgagcacatgggcttctaacactgtctcccttcccaccgagctccaaacagctttgagtgtcccagagttgggagcagtggtccgtctgcgaggatgacaaggatcttgtcaatgggcctgggatgctgatatgcagccaggtatgcgggcctccgaaaggctcagaaaccagactcccccagtagtgctggggcacaggcagcactgttgccttctgaggccagggtattttcctccctcgtattccatggtgataggaaacctctggtaccagatacaggtgtttaggaaggtcgttctggacgttgggggatgggcagaggcggagtatccacccttggatgctcaggccgtgggaggacagcacggatgggggcacaacctcagcccctctgggacctgaaactctacataaagactctctgccctcaattctttggggatcaattaatgttcccaataaaaatggaaatttaatttccttaataagttctgaggagaaggtcacttccacccacgggaaatttcacggctggttggcttgtctggagccaaatatcctacagggcggggctggcaactaaaagcagcagaaagatgtagacagccagctttcccaggacacagagcccagcagcccctagagaagtttgccccatcgtgcttctatagggattctcacctgcagaggtccagcaactggccagggccccacgaccaggaatgtgtagccccacctctgtggctcttttgaaactactctgttacctggacataaagaggtttgctgggaaagtagggaccctgccaagaagccctgaaacattggagattgaagctaaaggccctctcgtgttaaaggcacaaatgagaaggcacctgagtaggggcctctgtactttcccacttgccttcttgggcacccaccagttcaagatgttcagactgcaatatgtggctctggagagctgtggcaccccggctgcatttatgtggccagggacattgctgaagccaactgtcaggaccaggaaacactccagctcacacatatggatactcacactccacaggtcttgcatgagatgacctcacttacagccctcagaacggttctctctctctctctctctctctctctctctctctctctctctctctctctctctgtgtgtgtgtgtgtgtgtgtgtgtgtgtgtgtgtgtgtgtgtagggtctttcaagcagatggaaaaataggctagaatttgcccaaatggcagagac

SEQ ID NO: 781 - DNA, 1975 bp, Mus musculus
tgtgatgcacatgcagaatacccacatagatacaaggttgtgtgtccatacaacacactaatcacacacacagaccccaggacatccatggacataggtgcacaatgcatgcacatgcaacacacagaggagatacacccacatgtaggtatacatgcgtacatatggactctgatacatagggacacatatgtacacacatgacacacatatgtgtatatatacatggaagcacatgtgtacacacacagcacacagagaagattatatatatagacccagccacaagcatgcatatatatatatatatatatatatatatacctgacactgaaactctggtacacacatgcaagtgcatgcaggcacacatgcaaacaaagatgtgcacatctctctgtgggctggccatggctgatgggcctggaattgctagaggttactgataactcatgtgcagccagtgctgtcctctcagtgggccagggaggcctttacacgctttttgggggcacatttggcattttcccacactgttgcttaaacattaaacatctcccttggcaaagacaagttgcccgtcgcattggctgtgaagaacttgtgggatgggtcctcctgcctctgcctgggtgcccttcccatggccctggacgctgggctctctccaagcccaggctagtgcaggctggcagctgatgtgtttatttgcctggcggcatggtgggcgggaaggcgcgaaggtaattggtacattttgtaagcaatcatctcctggcaccttctgccgcagcgtgtgggtcgcctgatcccgttaatcacgcctggaggcctggggcccccaccaactgacagcctcatttctctctcctggaaggaagggctgctccacttcctaatggcactatctgttatccccggacagtccttcctgctgtaccatacaggagccaggcttgtggagagggtggcaagcagagttggtgtctgtccagatcctgtgtcatgccaggcctggcagggtgccaagggtctgtggctaaccctccacaatgtgctgtgcatattcctcctatgaagaaagggcaggaaatgctgatggccgatgaggttatagtgcagagccggtgggctctttctgggtcccctgaatatagacctcattcatggtcaggaccagctgtggaatctggaagcccacagcaaaacatgagtgatttcaagagggcattaaatcaacccctggccatgaggattttacctcacaacaggacagaccacacacatatgaagctgcctgcctgggtgttctgacacatgtgtacatacatgtagcatcagacagtgactcagactcagatacttcttacccagagccatagcaacgctgctctctgccctcacagttcttatttctgtgaggggatccaggatatggttcaacaccaggactgcaacgaggcccagtgagagatctagctgctgttgatagggagacacgtctatcactgttactgatgctgttgttaagtatggaaatgatggctatgtatgggaaacacaggagcaaattaatctgcagatgatgcacatggggcccaaactgtgactaatttctgaatcaccccactgcaaaaaagatatatatatatctcaaataatatactccatagtgtgtcgggtactaactctacctacctgctcatctgatgattgatccacccatcagtccaattagatgcttcattctaagcatccatccatccatccatccattcatccatccatccatccatccatccatccatccatcctccacaccttatgcaactccttatgcatctactcaccactcaatacacccatccattatctactcatctgctcttccattgattgatccacgcatccattcatcatcccttttccatccatctacctgctcacccatccatcacccacccattcatcattc

SEQ ID NO: 782 - DNA, 2375 bp, Mus musculus
ttggcttatatctcttccatacccaattctcaggcatgcttcagttatcccatgtacaagtagttcgggatccaactgttgtatagcaagctatggatttcatctgtatacaagtcagggttcatgttcctcaggtcccttctcatgggctatgcatggcattggctgtcctctccttccctatagacctatccatacttctaggttgtaggggtcatctttctagcatccatccttgggcctggacccaccaacagccctttgctcctaggagcctccaccaaagccctgacttagggagctacttggatccagctgtcctctacagctcctgcttagggtttgctgccccacacaaggccttctggccactattgtctcctgccggaaagactcctcccctgtacagcctgtgctgcctgcctctgagagcaggtattcttcatggtgggaaattctatactactctattatagcccagcctagaactgtacttggcacacagcaggcgcggatatgggggtgggcagtagatagcccgtgaggtttctcttctcttgatggctttctggtgtcttagccatggcagaactgaaatggatgaccgtgaacagagagcagaagctggacccagaagcaagatgaaaaacagcactttccaggccaggtagtcaggggctcagaaaggttaagaggttagcacaagaaggaagcagagaccaggtgaggctggcctgcatcccaggttgggtcctgtccccttctccactcctgccgtgctcaggcagctgtttgcatctgttttatttctatgcctgtctctctatacacaatggtctgggtagttctagaaaagttcctccttaggatcatgggtatcctagtgccaggctcttggcttgtctgaccctccccaattagtgacgctgcccacgggggaggaggaattgtgtcctatccatgtaccaatgtattaacgttatcagggtcacacatatacccatttttaccagtgcagtgagtacccattgagcatctgctgtatgcaggtctcagaggccaggtcccacatcgctgagatgtctgtgatgctctgcaggcgaggagctctttctgggtggagagcagatccctctcaccccatctcctgcccaccccagaaccctaagacagggccttcatgcatagtgggggaccctggaagtcacaccataactacacagaatggaaaggaaatgctcagttcttctagcccaggcgtttccatggagacggttccagcactgcccctcctccctccagcctccagggaagaatagggggtctttcctgaatgacacagggggttctgcaggtagctcaggagactgttattttgtgaaatcctcatgactctttgaggccctgatttgtttagggagcaaagtacccctagtgtgtgagctcagagatgctccactggcacttgtaagcttgctcagtatgttagagtctagctgccttcccaagggactagggatgcctgagatattgggatcacctggaggggaccccacagccacaatggtaataaagtgactcaggaaagctggctcagcctatagtccagaagtcatgtggatcacttctgatagtgatgccaggcaagcccagggcatggaaccctgagcttgtcaaagactggttgtccctgtattttgacctttcataatgaccaaggctggcctgaagctctcaaaatcctgacaccataacttgagtgtgccagcacatatctgtacgtgtgtattgtgtaaatttgtaaacacacctgcacatgtatgtccaggtgcagaccgaatgcggctgtgacccagttgcttggaaactcttcttgactgcgaggcgggctgcatctgctctgccatgtctctggaacctaagtcactattgtcaccaagggcaccctctgatttggtgtgtcctgggtacagagctctcacagtgggcacgatggcatgacagatggacacttgcctgcatcactggagcccaggtttgagggatgatgaatctgagctcttctgacttcatgatttctgacctaattagcaaggtctcggtggtggggctcccaggaggaatgctgacaagtcaggactggctcactgctgtgggagtgtttgcagggggccagggacaggataggacaagggcaacccctgaccctgccttgctcattgcccatccccatttaagcctgtctcttccttcactccagatccaatcatccagtggtcagctcactcctgctagctaactgttgcttgtaactcgccaggatcccaggcatcagtgaagccctgagccagaaagctccaggctggtcccttctt

SEQ ID NO: 783 - DNA, 1975 bp, Mus musculus
ggtggagagaccagggagaaatgacagccagggaccacttaaggccttggtcagagttgtgaacagacagaagacacacatggggactcagcatctttatctaatgtggaacttcttgattttacaacattcatggaaatgtgatattatggggcatttccatagtgtagtggtcatcacactggcctgatacagtgaattgatcatgttgggatgggatgggagaatcctgcctggtctgtttgtggggatagttttgtgttaatggtccctggcctgcttcacacatcatctgtggatgcccttctgcatctgtgtccagggcggaggtccagcagaatctgctcatagcataagcattcattaccaggcatttacaggacaagtctgccagcacctgacagtagggaagctggaggtaggccatgcacacactccctctggaatttctctctaaatccaaaattatcccaaagtaagttcaagaaagtcttcctgaaagcaaatcaaaatctcattgtaaaacttgtatctcccctgtggccaggactcatccacagacaaagtcaatgagcctagaaatacatctatgatgcctcccccgaaagaaagcataaagataacatgaggggcaaaaaaagaaagtgagatattacagcgtatgcaggaggctctaacgcacgtataatcagaatcccataaaatagagactaaagaatggatcaggagaaatactgggaaaaataacagccctgccttgctattcaaggcagaatagcagaagctagataaactagtcagcctggccctctctcgcttcaaatactccaacttctgcttgcttaaaaccctgagtatcagataaaaggggtagggggagggaatggctagaggaaaaacacttatctatcaaagaacaaagacgagaacacagccaacttcccatgggagccgtgtgggcaagaggttgacggaatagctttctgaagtgctgaaaaaggaaaaccatggaccaagtccttcaaaacatccttcacaggtggagtgagcccttaggcagcagccggggaaggttggtcccacctgggcacttgtgatgctgagggaatagcctccactttttactcatgatgcagcaaactgtcttggatttttatggggcccgttagcttctctagacatacatatttaaagctatggaaggtgtagaatgtgggggatggattgagggtaagaagtaaatgctaattcttgttatttatgcttggtggggggtgtggcattgtatcaaggctcattagaaaaggttttaattatgaaaacgaagagctcgtgaaaacagtctctcagacaagccaacctgtgggaaccttgctgctgacagattcggagacgtctgtgcagttctttagaaggcttgcacaaagtcgatgcaggtaaaacaacacgcatcttccctagctccagtagatgtagaatagaggtcagcaagcgctttctcactgtgacagaatggatattttgagtttcacaggccagatggtatgctacagcacccacgccactctcggcgctgtgcgaaagtcgccatattgaacatgtcaacaaatggcatggccacgtgccaataaagctttatttacaaaaacagctcgctgttggtggtttgctgacccctgctctaaaggagaaccaagaggaaatagggtgtcatggtgcgtgtagaggcaaactaatggcagtggcaagtctgtcaccagactaccctgggctgtctgtgttagtgactccagattatcaattagactggaattagaatcactatagaaatgctccaatgggtgtgtctgctgacaggaaggttcggagaaggtgggtctctactcacagtcacagggcagtagacagggtctgcattagtgcccagcaataggatccatgcttcatcctgtacctgggataaaagggccaagag

SEQ ID NO: 784 - DNA, 2500 bp, Mus musculus
ttaccttatacctgtacccctagcctggaccccttccctgtctcttctcagatggtcacatcacaaacactctagccatggcttcctagctccgtgccagtagccctgaaagcctgatgaaacagcagtgatagtgctggaagaggttgtcatagggatatgtgactctgtgcgaagaggatcctgtagactacagccctgtcctactcttctgagaggcagctgaggaacaacttaggctctgctcctcctacctgggagcactgaagtctcctagggaattctcatgtcctggtcatagggccattcctgagctcacccagaggctatcactcagatgcggagtgaccaagcaaaggaacaggcctgagtgcagaagctccagctggcttccggctctgaggcccgagtctaagaaggggacctttgtgggcaaagcacagtggttatgtgctgctcatcggcacattaaagaacacaacagtagtaccaactcagccatcagcaacacctgggccctggcacccgagaacttcctcctcaggggctcaggtcttagttttggctctatcctaccagttagcagggtctgtgtttaaagatctctgagaagggctggagagatagctaagtggttatgagaacttggtgctcttgtagaggaccagagttcaatttctagcagctacatggtggttcacaatggtctataactccagttccagggaatctgatgccctattttgttgtctacaagcaccaaatgtgcaactgatacacaggcaggcaaagcaccttatacataaataaaaagatctctaagaaagtaccatcctcccttcctgagaactttgcatccctcaggcacatcccagcctcctgttagtcagggctagaagctgcccctccaagatgactctcctgccagtccctccctggaaggctttggaagggtgtgggcctcagcttcagtggaagcagcaggtgtccggctcaggaggatgccattcagccttgcaacagaggacaagagctcaaaggcctccctgcctcaaacagaaataaataaccaaggatgctttgaaatgacttccaaattaagagttgcatccgtgctgtcaagcccctgctagcaacttctgtggcaccttccgtgcaaaaacgtatctcagcccatttattagaatgatgaaggcaaagggatctaaaaattgcactccttccttaatgagcagccgaagggatcggtaagcataatttcagaagccagtaatattttatataatcgccgagtggtttaaattgaaaacccccaactgaatcaatatttactgcattgaaacgaaatgaatagtaataagtcactaagctccctgtcctgtttcataaaataaaaaattataaaaatgagcacaggcgcagggaggccatcacattaacttttacagcacttggggagctgtaaccgcctgttctcataaaataaaattctaaaaaacctgccggaagaggcctcctccaacaccacgtggggaagcttgtgggggccagagcaggaggggatgaaggctcaaggactcatcttcaagagccttcccctggtcaaaaagaatccagagctctcctgcttcaggctgacaacacctggtgcttgcttagctcctgcacagaggagagaagagctaccttgaatgcaactcctgttccccacaggcaatatcctactttggtttctttacctatatcttcaatttcagtccatcagatggaatataagtgagcagtcagacagtggctacaggggccctcacagatacactcaggcctgcatctctaaccagcataggaagggacacgagtgagctgacagggaatgggacccagtaaatgttccttgacatatatgcatgggatcgggcttagagcacaatggtgttagcagacaccctggctgcaaggcaagtgtgtgcagggtacactgtgtgtatgtgcatgagacaggtgacagggagcaggtgggacacacacaggagacaaggacaagaatgaggtccctgaagccacaaccttcttgtttcctcagcctcagccaatccatgaggctgatgaaggaaagggtgggggaagggagagacatggtgctgtaaaaaaaaaaccaaacaaacctaaatgtacccctaagcttaagaatgaccaagcttgagtaaatgttcaacattatggtcaccaggggatgcaataagactgtcacacactgagagtagaaatcaaaaccaaagcaaaccgaaccaaaacccaataatatcaggtataagggaacagaaaggctcataataccctttggaaggaagatgagaccgtttcatataaacatgtgtcttctccacatcccagcgatccccactagaggaaagggaagctcaggtgtgcccagctgctcggcagccttcatttacacctctcaaatgagaatcagctcatgttcacccagagagaattc

SEQ ID NO: 785 - DNA, 1850 bp, Mus musculus
cttgaattaaagggtgtgcaccaccactgcccaactcaatgttcttaaaaacaaaacaacccaagttcaaagtttcttcagagataaacggcaaacccttagctgtgagcttctataaaattgaataaaagtcaccttcccatgcccctgagataatatcccacagtaacaccctatcccatgagagagaccgcagacagggagatgcaataaatcagcagtgtgaatgttagtgcctgcagctctacggctggaacctatggcatatggtggcatgacctacactccacagggcttgggcagccttgccctatggccttgccatttgtagcccatagggcttctctttgaggcgctctgcttcctgccagtaactgtcctcagcagatgctccataatctggtgtctttagcatctggcgtttccagtgcatcttcagtgtgattctcacgctgccctctcaggatttgccttccagaatcccaatcccaatcccatcacaatggtcaagcttcctttgaaaacttccatgcatctctgttgcagtatatatacccgcaaaaccagcattgtatggatggtaccagacaccaagtccagggaccacacttcctaggaagttcttgccagaagggtaccttgagctctgtacttaagcaaaacctttcaaatgaggtaaacttttatactcttgagcctaccatggatgttcacttaggttcctcttgctgtgataaagcaccatggccaaagcaacatggggaggaaagctgggcaggagctgggcaggaacctggaggcaggaacctggaggcaggaacctggaggcaggaacctggaggcaggagctgggcaggaacctggaggcaggagctgggcaggggctgggcaggagctgggcaggagctgagcaggagctgggcaggaacctggaggcaggagctgggcaggaacctggaggcaggagctgaggcggaggtcatggaggctgctgcttgctggctttgctccccatggtttgctcagcctgctttcttatagatccaggatcaccagcccagtggcaccacccacgatggactgggccctcccacatctatcctgaattaagaaaatccttacagctgtggttctaaaccttcttaaagctgtgaccctttaatacagttcctcatgttgtatagtgaccctccaccataaaattattttgttgctacttcataactataacttacctactgttaggaatctgataagcagccccgaagggctgtcaacccataggctgagaactgttgcctacaggcttacctgcagctcactgttccagaggcattttctcagggaattaaggttctcttttcagaaagctctaccttgtatcaagctgacataaaccagctaacacagctgggtccagccagtaccttagatgtcaccaaagcatccttcctgcttcccagctgtttaatagcataatctctcattttagttttattttaattagtttatttttgagacaggttctgtctgtgtagttctggctgtcctggtcacacatacccacctgcctctgactcagtgtttatattaaaggcaaatgctaccacgcccagcttagtgatagactcatataagcgccgtttattttctggacaaatatattttccagatactcctgctctgcagctaagtttttatcataaacctgtctccagtgacaaccacaagctggcttgaaatacagccaccggcagtcagtccacccactggacagtcagtccatccgtcacctgaagctaagcctgcagagtctcaggacacggaacagctctggataagttctttcc

SEQ ID NO: 786 - DNA, 2125 bp, Mus musculus
ctctagacactctcatgagacactgagcttcaaaatactgtagctatgaagtgaattaggtctacacttgagtcctgtaggcttcagagagccctatatgacccaaacactattgtgagaactctagaccagttacgaagctgtagtagccagccagtgaagttccattaagaggaaggtttgatcatttttatgacatttcttcgtttggggaatagccatgtcaatggaaggaaacttctaattcccagctctacccacaagagtgtcaaatatctagcttaagaaatgggtagcctcttgagctgcagtcccaacaaccatcactggggggagccagagattacaggcaggggaagctgcaaactcataggagttgtttaatgggcagtttctattttgcaagatgaaaaaatgtcagatcttagttgcagaacataaagaaaatattcacacttctaaaaaaaatcacaactctaaattttaatatgcttttaaaagagagcctagagaaatggctcaatggctaagattgctggttgatcttccagaggactcaggttcagatccctgcacccacatgccagcttacaactgttctgtaaatctagttccagaggaccttctacaggtactaggcacacaagtagaacacagtcatatataaataaaaattaaaggtttttatgaagtcaagtacatttttatttaagggatttgattcctttgctgtccatccaggtcatctgaaaatacccccttctccaaggagatccagttgtgcttttcatttacatttctaatgttatcctctttcctggttccccctctgcaaacctcctatccgatcccctcttacactgtttctatgagggtgctcccccacccacccatgcctcacaggcctagcattcctctacactggggcatcaagccttcacaggaccaagggcctcccctcacattaatgccagataaggcccttcagttccttcagtccttcccttaactcctcagtccaatggttggctgcatccacatctgtactggtcaggatctggcagagcctctcagaagacagctgtatcaggctcctgtcagcaagcacttcttggcatcagcaatagtgtctgggtttggtgcctgcatggatccccaggtggggcaatctttagatggccttttcttcagtctctgctccacactttgtccctgtatttcctttagacaggagcaattctgggttaacattttggagacgggtaggtggccccatccctcaaccaggggggaccatgtctaacctctggatatagtcttgacaggttctccctcccctttgtggtatttcagctaatgcaatccccatggggtcctgggaggctcttgctttcctggcatctggaatttcctggttgctacccccagttccccatcccccattgctatacacctcttttcaatttcctgatcctctgtgcatctcctccaatacctgattctgcccctcttttccccctccttctttcttcctcccaagtccctcataccctctacccccttgattatattgtttagagtattaaaaataatctacatacatacatacctatcaatatggctaacataaaaaatatctccacacgctggcaaggatgttaacaggaactcccattcatgggtcataagaatagcaaaaaaaaaaaaaaaaaaaaaaaaaaaggaaaagaaaaaagaaaaagaaaaaaaggaagtttagcagttgcttatacaacatttctttaccatatgacacactgatctgaaaacgtgtgcttacacagaaacctgcacagtatttatggtagctctatttataagtgcccaaattggaagcaataaagatgtcctttggcaaacaggaagtaggaaaaactgggcatatctagacaatagagtatttttttggcagcaacaaaaaaaaaaatgaactttgtagccataaatacatgaaggaaccataaacatgtatcactaagttggaaacagccaatctgaagtggctatacactgtatgactaactatacaccactctagaaaaggcaaaactatgatgatgataaaaagaccattggctgtcaggtt

SEQ ID NO: 787 - DNA, 1825 bp, Mus musculus
aacctgtactttagccagtataacttccaattagatttttactcgttttccctgaagaaaaactttcccttcacttttcccacactgtaattatatcacactaagccccaccatagcaagtgtccttgactgaggaagagtgagcaggcagagcagtggcagtacccagactgaacaggctcagtgcaagctacattatgactttaaatcttgacacattttaacttttttgagatagggtctcatatagctcagactagccttgaatttaatttccttcctttcctttttttaaagccttgacatggcctgtgcacttgctatgtaggctagactgatctcaaatttataaaggtccacatgcctcctatagatactaagattataggtatgttggcatcacactaagatgctttttttcaaatagataacatcttaaactgacaatggaagagaaattttcatttaatttcttttaatagaaaaaagagtaaaaattaagcaactctaacaaaaacaaaaaaacaaaacataaaatccttatatttctagacaccagaaacttgtcaataaattacaagatgtcttagtttctgggcatattttaaaaaacattcatgcagcctagcctttcacaagtgtctagaagcagtgtttggtgacttgaagtggcaaactacagtggctaaatcaactaggagccatcaaatcctcatctgagggaggctgcaaaggaagaatactgtataactcttcacgcccacaacaacatttccctctgcgagctaacagtgacctgaataagctgcctaagaacatcgctgagcagcctcgagcactgcagcagttgggcagtgcttcgataccgatcaattctgagcaagccttgtcagcctgtatcctagctttcagcactgcattcttttgttcatgcctacagtacttactctagcacccctggaccaggcacactgaaaacacaggctgatggaaagaatacaaggaatacacattagagccttaaagaaaactaatgaagttgactttttcaatattcattaaaaagctgatgcttggggaaatgtaggaaaagtattcatctttggctaccagcaagatgtttattctctcttaattatacctcctatatctagggcagaaacatctgtgaagctcactatgtactcctgctacatgactgcaatatggtctctagccaaggcattacactaccctttatggccatgggatgcaactttttatcccattaacttactttccagaggctttaaagtgttggccacgacagagtaggctttagtcttttcctggagcaagattatctcctgaggtttctctatcaaagttcttatctgagagcacaacgtatgttgtcttggaggatggcactcatgccagccctagaaccataccctgagggctggagagatggcccagcagttaagagcacccatcggtcttctaaaggtcctgagttcaattcccagcaaccacacggtggctcacaaccatctgtaatgagatctgactgtgacagtgtactcacattataaattaaataaaatcttttttaagaagcagcagcagcatagcccaagtgtccctcacatccaactcagagcgccgaggcaggccacagtacttgatcttcaggcccatttgtttgacgctctgataggtgcacagatgtactagtattactcaaggcccacagctgttctgcaagtgtcaatttcaaaacctgaattcattaaatccgggcctcaaaagtacaagaagtcagctagcagtcacgttagcagca

SEQ ID NO: 788 - DNA, 3650 bp, Mus musculus
aaactttatatgcctcagtacagggaacgccagggccaagaagtgaagtgtggggggattggtgggggagggtgtgggggacttttgggatagcattggaaatgtaaatgaagaaaatacctaattttttaaaaaaaggaaaaaacgataaaaataaaagtagattcctgtataggctgtttctttgggggtagaggtagtgggaacaaaggttgtcacagaagccttcaatgtctctcattttcagctatgagtttgggaagctgccttctccacaacagcagcagcacacagacttccatatggtttctggtggcagcaggtaccgtgggcattcaaacttcagcatggccttcggtgacaacgcataccatggacatctgaagcctttactgcttatactttacttggcattctgatgttctaaactcccacatgttaatctttgctcaaaccattctaggatttcaccacctctgagcttcagactcttccacattccttccacaagccagttcaaaggcccaagaacctcatggccaggtccgtcagcagctctgctcctccgcatcacttctttacgtaggctgccttctctgcgctgtgaacgaacacgggcagcaagtctgagaagagagatttattttggctcatggttgaggtggtgcagtccaccaagatggggaaatggcagcagggggctctctgtggtgatgggggcttactgcagatgttggctgatatctcagcgggacaggagacagaaggctggaaacagggataagctgtaaccctggagaccaacctcctccagaatgaccctgccacctaaaggcaccatagcttccccagatggaacgaatctgcagctcaggactaaatgttcaaacatggagccctcaggggcattttactttcaaacatttctgcatttatggacaataaaaatgtatggagttctccatccttcctccaactcttccacacgacccaccaagctctgtctaatgtttggttgttcacaagaagagcaacagagtcaactaacctggacccttgggggatcccagagactgaacggccacacacatgtagcagatgagcagcttggtcttcatgtggtcccccaactacaggagttggggctgtccctgactttgttgcctgagatggatcctgctcccctaactgggcttccttgtttggcctcagtgggcaaggatgtgcctagtcctgcagtgatttgatgtgctggggtgggatggtactcaggggaatctcctccttctcacaagagaaaagggaggggctatgtgcgaagagaattgggaggaaggagaggtggggctgtggtcaggatataaagtgaataagtaaataggaaaaagtgtatagtgctgacacactggctaccacactaaagagctaactacataattggatttgaagtctaagatcaaagtgcttgtgggcgtggtgctgggtggggccgcccttcgactctgaggtacccttgttgccagctctttgggaaagcatgctgcatgctcacacagtgaaagggtcagaggtcaaagggacatgtcagaatagagccagatgcttcatggaagtcatttaccagatctctaactcccattcatcggaaatgcacatcacaacctctttcctgacaggacctgcctctcagtgctgttgagctgggccccgtgtccctctgtgtgagtcccgggaactcaggtccacccagccaggttgtctcgcatctgttgatgcctgtgtcacctataatggtgtttttcaaacgcctgctcctgagactctgtatgcttcttattttaccctgaagtgtcttgctggggaacgatagcagccctccgcgttatttagcttctcccccttggctgtttatcattattgctcttttccttctgtgtctctcttaccaatctatttttaatttgtgggaggtgtggtttgctcattagttttcaggcagctaaacgccagcatccatttggacacagttgctggctcctgagctgtgtctgtttcttagtcattcggaccctctcccccacccctccccctttcacctcccctccctttgttttccactcccttctccttttcttgtccccaacttcattaatacagacaggctctggttggtttgctggtttgggttagtgagcacaatatattctccctcctttaattttcatatcccgcctctaggctcatgccatgaatatcttttataaacacatggttttaaaagcaatattttcatttatttattgtctagcatgcacatgtgtgcatgtgtatacatgtcacatacacgtgtacatgtgtgtacatgtcacagtacacgtgtagagacatgtttcacttagaggtcttcattcacaagtgtttaatgtgatcgctgtagggctcaggcttaaatattttaattatgtgctcttgtattctctgttgtttgttttgaaataggtctatgttgaccaggttggccttgaacatatggagatcctcctgcctctgtctcttgaatgctgggactaagggcatgtgcattttgcctgacctactccttctgtcctctctcataaccaccccctcttccctcctatcccccccatctccttgacccctggcaatcattaatatgttcaccatatctttgagaaactttaagcatgtcatagaagtggaactatacagtatataacttatatataatatacagtatattacagtatatagctttttgcctccaaacacaaattctcagatctctctctatataagcagttcatttttattgctatctagtattccacagggtagatgtaccacagtttgtctagtcactggcccagagaagaaactctgcttccagtctgatgctcttatcagtgtagccactgtgagcagtgcgggtttttatgtggattttagttttgaattatctggaacaagtacctggggcatgacttctgggctatgtaccagtatataagtaataagttcaatttttaaaaagaattatttattagttttatgtatatgggtatactgtcgttgtcttcagacaccagaagagggcattggatctcattacagatgatcgtgagccaccatgtatgtgctgggaattgaactcaggacctctggaagagcagccagtactcttagccactgagctatctctccagcccccatgttcagtttttaaagattgatttttaaaaaattttaattacatgtaagtgtgtgtgtgtgtgtgtgtgtgtgtgtgtgcactagagtgcagtacctatggagaccagaagagggcatcatataccttggaactggaattataggtaatgagctgcttaatgtggtgactgggaacctgggtcttctagaagagcagccagtggtcttaactacaggggcatctccctcctccattcctgccctgtgctccttaaaaagaaactggcatattatttccagcctggctgttttatgtgaataccaccctctcttcagcatccccatccatgtttgctgtaattcttgactttgctgttctgttgggtgttccgtgatgttacactgtggtgggtttcagcctaccattctaggtcacggtc

SEQ ID NO: 789 - DNA, 1975 bp, Mus musculus
atggcagctcacatctgtctaacgctgttttctggcgtacatgcaaatgtataaataaacctaagcaaattattctcatccatttgctggcctgaggtggcctcttccatgtttccggccagatccactcctcaggaacctgtggccttggtcctgctgttcacatcacgtacctgcttgggctcccacctcctcaagccgtggctgccacccggggacagcagtgaagcctcccccacccccacccccggtgttggggaggctgcggctgccacccagaaatggcttcttttcccgtcagccctcatggttgcaggcttttggtgggccctcttgagacaccaagtatccacccatctaacctctgaaatctttctaggaagagacaaggagccaactgcactgtccatcctagacaaaaggtatgaaggtcctgagttttagaaattggcaaacagccagaggctggcaggctgtgcagagacgggcaaatggatttcctttctacctgcatattggagtaccaaagtctatgtccctaggtgctaggaccataaacgcagggtagtgtcactagattttacaactggcacactagatagaagactcttcctcctccctggagagtctgactacagttctcctcaacaccccccaccccctcaaaaacaaaaacaaaacaaaacaaaaaaccaatagacctagacgggtatactgacacaccgacaatcctagaactcaagaggctgagactggaggatcacttgagtttgggagttccaggcaacctagcaagaccacacctcaaaacaaacaaacaaaaaaaacaacaaaccaaatccgtgggcccagtgccgcctcgagctgtaacagtgccggggcagcttgcattagcatgtttcttatactgctggaaacagctataaatacagagactataattaaatcaccctaatgccttttaacagggaatgacggtgcagctcattcaaaagtgaaacctcggggttctcaggggagcgaggcacctgcttggtgcagacgctgccctggaaggtagttcatggtatgctggaaacaggagcccaaccaatttcctgaggtgtatgacctggggtccatctgctccggccacataccctgaagcagtatagtgggtgtctttgccacgtactcacagtcacatgatgtgagaccctccactctgcctcctccaaccatctgtcctaaacaagctcatgacggtagtttctctgggtctaaggtaggatttaagattaaaatacctgggctcactgcatagcttgtttgccaggcaagcatgaggacctgggttcagatccccaggacccacatattagctcagtgtgtctgtatgtatctataattccaaccctgggtgggggatgggagagatagattcacagaactagccagccagcctagttgatcactaggctccaagttcagtgcaaaacaaaaaaaaacaaaaaaaaaacaaaaacaaaaaaaaaaactaaggcaggggtaggggggctggctggagagatggctcagtggttaagagcactgactgctcttccagaggtcctaagttcaatccccagcaaccacatggtggctcacaaccatccgcaaccatatgacagtgtacttatatacattacataaataaactctttaaaaaaaaaaacacctaaggtggggagcaactgaggaaaatatcggatgatgacccctgacctccacaaaatgcaagtgcacctgtatatatgtatctgagccctctaaatcctaatgcatgaacacatacatacacaaatacacacacagatacactcacatagatacataggcacatacacttgtggtggtttgaatgaagctggcccctatagggtcatatggagtggcattattaggaggtgtggccttgctggaggaagtgtgtcactggaggtgggctttgaagcct

SEQ ID NO: 790 - DNA, 2150 bp, Mus musculus
ggctgagtcctgccttcttgatggcctctgctccccacttctgctttagcctgccctccgtcctggtgtaccttgaaggaaggaccacaccagatgcaacacctccatatcagacttcccagcctccaggggaccctgagaaatgagtttctttatgaaccactcagtctgtgacagtccagcatagcagccaaagctgtggccaccaaggcacactgccacaatcgtgggtctggggagggagggaggtgtgggtgtgactgttttagatagtctaccccattcccctctagggcactggattgctatagaagcctaacagggagtccttgttggcaggaggaaggtggatgaaaaggaattggtgcacaggagtggggttgggtgtggtgtggtcaggtagtggggtgggggtgaggttgctgtctctttgctgcagtgtctctgagggttgtttccatggcagaaagtttccctgggtcctctctgtgttggctgctggtgctcttcttgaggtaccacctttccacagacttttcagccggcttccctccccccccccgcaccccccctccagaaagtcggtgctgttctgaggtaagtaggaacagcagagaagccaggctggtagcatctccgacctgctgggacccgccacctgggagcagctctcttaaatcaatttggaaatctcttccatgtaacacaaatggacttgtcaggggaatagaaatcgctgccaagtccctacctcgagtgggatgaaaaattagatgaatctgcaaaaagcagtcagcaggcggcttcctcccctgccacagagactcaggaggactggcagtagggatgtggtatggtggaaacttcagagctgaacagggacttcctgttcaggggctgccatgctgtaggggccgggagctttggtcatgtgacctgagttgcctgagcctgtagcctaatgctggtgtagtagctcctagctgggctgtggaacacttccaagatcctcctgtatcgttgtactgagaggggggtggatgaagggtaggaggccaggctccttttcctgagagtcctcagcctggagggcaggagcatctccaggccctgcctgcaagcagacctctctgctctttgcgtagctcataaagtgatacagaaagggcaggcaggcatgaaggtccctgctttccttcattcaggactgctaagcatttgccacggtgatacatagagccagacagtgctgtccaacacgaaggatgcccagggttccgtccccagcaccttagctattaggcttgctagcacactcttgtaaccccagcttccccttgggaggtggaagcaggaatccaaggacatccttgcctccatagtgaatttgagaccaacctggactataggaaatgtgttaagaggaaggaaaggaggaggaagaggagagggaggggaggagagaggaggttgttattcaccatcattggtagattttggctatgatgattatctctatttctaccccctgtccacccaccaatggttctggttatgactgtccatagagaatcctgcaggctgtgtggaactccacacagttcctaggttgtgtgcccaaatttctgttctgaagtctatacccacttactctcttaaccacaatgtgggctacatcagttttatagaactcttgcctgcactaagactctcttcttgatatttttcaagtggctataaagtgggacacattcctctttttgtaaagtgcagtacctgattgacatgttggctaggggagtgcacttcccagaatcccatgtatgtttctacctcaagagccacagggtctcttatggaggctgtgtgggcaggaatcatgctctctatctcgatagaggagtcatctgtcctcacagactgatctgccttaggagtaacagttaggaccaagccccggctctcctcttctccccacccctcccccatttcctcatctcagttgtggagaaggctcagcttcggcagtgtaccacccaagtcagagaccttgtaagtcaagggtgtgtccactcttgcagactctgctcatgctgtggtctacagtatctgcttgctatctccatcataaagccttccttctccttcct

SEQ ID NO: 791 - DNA, 2025 bp, Mus musculus
tcacagttagctattggatggatcacagggcccccaatggaggagctagagaaagtacccaaggagctaaagggatctgcaaccctataggtggaacaacaatatgaactaaccagtacctcctggagctcgtgtctctagctgcatatatatcagaagatggcctagtcggccatcagtggaaagagaggcccattggtcgtgcaaactttatatgcctcagtataggggaccgccagggtcaagaagtgggagtgggtgggtaggggagtgggtgggggtgggtatgggggacttttgggatagcactggaaatttaaatgaagaaaatacctaaaaaaaaaaaaaagaatggccttgctcagaaacctctctgaagggcttctcttggggttacccaggcctgtgctgtcagccttggccaatcagatgtctcctgaagtctccctgcccccatctgctatgcaaacccatcacaaggtcatgattggcctcaggtggtgctggcctctcgtcaagggtccgggaacagaaacatgatgtggtcacctgatcttgccctctaactctgtctgaggcctcctctgaggttgcctagggatgccaagtctctgcactgctcagcaatgtcagagcagtggcagcaggaaaggaagagcgaggctcttaaactggtggaatgacaggcaggcagaaaagcttttttttggggggggggactgctgtccacacatgatgtgaccagggtcatcttgaaatcaaagcatccatagtggcctgcatgagaccttcataagcgtggcctactgaccttcccttgtggaaggaggaagattcaggagatgtcccatcctgccttttgaagacctgtgagctgttactagttgttgggtggggggacttttctttggtggtgtagtgcctacaagatcctgtggttaatcccaattaaattcactgttcactaatctagaaatttttttttggtcttttactctctctctctctctctctctctctctctctctctttctctttctctccctctttctctcgctctctgaagtagatagaaatcaactttctagggaaagccacacaaagctttctcatggctaaaatactgagaccagccagagagggaatctcataaccggagccttggtcctggatgtgtgctaagaattcactggtgttgccatggagagagcttgttccagagaacggttgtgtctggactcaggcgtgcccagggcaagacagcactgggtagtggctggaagatgagtctggaaatagccagagagtttggatcacatagaccctgcagctaggtgaggggaggacaggggagctgttgttaacaagcaactatgaacaagagggcgtgcccgtgtgcacttgtgtagggcatgtggaccaaggcacaagaggaaccggtatggaactggcaaagttcagaccctggaaatcttaaaagttgagacgagtcggagtgaaactagcttcctccctgtttctgagcctgcctcacctaaccaggtagtcagtcacacccctagcacctggaatgcctctccatgctcatgaggcagctcagagccttagccttcagccaatgaccttttcccttcttggatattcccattcccctccccagactatataatccttggttcacctgaataaagtgtatgcgttcaaacccaccccaataaagaaatataaacaagccaagacagctgcttcattaaagatcataggagaagaccttcacctacaagggcggcaacactaaggttctcggagaagtcctcctctctccccaccccacctcctgtggattagcttccagactgggatcgtgcctgtcctagactcctcttcaccctctcccagcctggtgggcagtggcatctgacatccaggagggaagaggcagactgcagaccccacccatcccagactttgcccctttctctctgagccagtgtcaggacatcccaaggaacccgtatccacaca

SEQ ID NO: 792 - DNA, 2750 bp, Mus musculus
atgtggtacaatctttggaggttgtgaagaactcaccatgaagatgctgaatttctttgtgtgcaagaaattgtttagattaggaattaaagttgcttgatccgtcaatggccccatttaacagttaccattatgtaacacgagggagctatgtctggcaaggggtgtgtgcccgtcacctaaagttccaaactcttgctggtgtaaagccttcaaaatgcctcttgtctttgaagacctgtcaaggcggcagtagcgcctcctctaaaaacccgaggtatctgcagtagatttcctttgaagatttcacttgagtctgcagagaagtcttttttgaagagtcatggtatctaccatgatgtctcctttcaagattccttgagtctgccgtgtgacgtctcctttcaagactcatgaagactgccatcggcattgctattaacgacttgttgagtctacagtgacgtttcctttcaagactcacggaagcttccatgatatctcttttgaaggcctgttgagtcttcagtgaagtctttgaagactggttgtatccgcagcggcatctcctttgaagcctgcctggactcttaggcatcctcatgccttcgcttgctagccattgcaattgcaggcatgagccaccacatctaacttgtttctcattgtagtgcaatttaaagtatcagactccagaatgcaaattaccttatttatttttaaaaattatttttattttatgtacttttgtgttctgtctgtctgagtgtgtcagatcccttgaaactggaattacagacagttctaagctgccatatggatgctgagaatcgaacacgggtcctttggaagaacaaccagtgttctcagctgatgggacatctctccagcactgcaactttcttttttaattgtgtgtgttgcatacttaggagtgcatacaggtatatgcacctgtgtacttatctggaggccagagggaggacattgagtgtctgctttattttgcttgaggtggggtctcttgctaaacagggagctaggctgaaaaattctccaatcctggatcccccacagttctggagtagcaggagcactcttaccaagcttgcatctttcttaagtggcctatatttgggtttgcttatcatttagtctgacaattttgccatggatttggaagacagactcactgtgctcagtataattgctgaaatattttaaatttagctgtgaccatttattttctacttgttctattttaaatgtgtttctgccttgtactttttgcagtctttgataaacactggtgctaatccgacctgtattctgatggctttcttgcccgcgctgttctctggggcttaatgttgtggctgtcttagctcagtgcctttaccgtgttgagcatgcaaaaaaaaccaaagcatttgtggtttggggatcacagtctctgcactcgtgcagccagtgtgttccgaccttcacacacattttctcagcttctcttttcctttctgcagttcacagaggaggctgcggacttcactcactccccgccagccatggtaggcactcctgctcatgagtgcttaatgatgctatcggtcagcctcatattatctccagaacataagcttcattacccttgtccaagcaggaaggtgccactcgctcgaaatgctgaatccaaaaaggctgaaagtatttcttgctaagtaagggagagccatgcctggaggacgctgtcacctaaacaaggtaaattgcctgtctggtggagggctggggaagcatggagcagaggctgacaggcttccggagggactgtctggggatggatgaccttgggtgtagatacaggttagtagaatcaggttgtcattgaagcagtggctgtcatctggagatacactcacgaatgggtaacggtcctctggatcaacagaagcctaaagccagcattggtagctaaccatcagcgtatgaagagcagctgtcctcttctttcttgaatttggatttggaactgaacatggataagtagagaagtgtattgcatgcatgccttcatgtgtgcatgcatgtttgcatgcgtgcatgcatgtgtgtattcacaggttcatatatttgacaggaacaggccagagaaggatcccgagagccctattcttctctacctattcccttgaggtagggtttcccaatgaaactcaatgttccttgagtttcaaggtcatggtcaagagccagtcatcctccaatctctacatcccctggcatgggagctgccagtgtacagggccacccccagcctttgctaagtggatgctgggaatatgaacccaggtccttaagttggtacagcaagcatccctacgtacggagccttctccccagcacctgagaaatctttgctctcaattttgtcatatgcctgaggtcactgaggctcataccagttagtgactgtctttgttttgtccttttactgtgatgagatgacctaacaaaggcaacttaaggaaggaaggattgacgccaactcacagttccaagaggtggtctactgtgattgagaagtcaaacccacaagggcttgagggagctagtaatgccacagtgacaaccaagattcagagtctcagctgcttactgtgttgctcagactccctggttttaaatctattttagggccctaagcaacttgtaggttgtgtctttcgagtgaactcagttgagataaccca

SEQ ID NO: 793 - DNA, 2100 bp, Mus musculus
acacacacacacacacacacacacacacatatatataaaactgcatttgtgcacaagtgggtacaggtgcctaaggagtccaaaatagggcatcagagcccctggagctggagttacagaaggctgtaagccaccagatatgggtgctgcatactgacctttgcaagagcaacgcagactctactgagctatctctccatcctaaatggacttggccatgtacttccttaatccagcattggggttttctggcaagctagcttatcaaaagaaaaaaaaaagtgagcttcagattcagggagagaccctgtattgtagaaatgagttagaaagggattgagtcttcctgaccctgtgtgtgtgtgtgtgtgtgtgtgtgtttgtgtgtgtgtgtgtgtgtgtgtgtgtgtgtgtgtgtgtgtgtgtgtgtgaatgagtttgaatagctgcagtggatagttgttcagagtgtgcatacaccctatgcagagcacatgcacacacagcacacacatacacagcacatgcatacacatagcacatgcatatgtagcacatgcatacacagcaatgcatacacagcacatgcatacacagcaatgcatacacagcacatgcatacatagcacatgcatacacatagcaatgcatacacagcacatgcatacacagcacttgcacacacatagcatatgcatacagagcacatgcatacacatagcacatgcatacacatagcacatgcatacacatagcacatgcacacacagcacatgcatacacatagcacatgcatacacatagcacatgcatacacagttacataactccagaggaaagcagcaaagtgtgtttcacaaatatccactcagcctaatggaaagactgcacacctacgggactggggcatgttgtccacaagtctttccccctggatgatgttgcttaggaaaccaacacggtctcacactgcccctcagcctgcaagaatacaagccagcactcagccagctcagaagccagaaaagcccttcccagtgcccatcccaaggcaagcagtccatccacggatacaaaaggaaacaggcagttgatgcaggggttaagcgtcacagggtgggggtttggaggaggacgcacacacacacacacacacacacacacacacacacacacacacacacttttctggcttaggcccatgcctgagatatggtccctttggcatcctgtgctgctgctgtgcctgcttggctcccagtctcttgacactggcaacacccaggactttcacgcctgttactctcttagtaactgaggatagcacctttgaccagtgagcctcccatccctagcttggccttccacttctgacctctcatccctggattcccaccctgggcctctatccctcacctcctaattctgggttcccacgccctggctgggttggggcactggtttctgtcaacttgaaggtaccaggacaacaacttttccttttcactcagatcaaagtggccatcagtctctatgtggtcgcatctcctcccacccaccccatgctgggattgacatacaactatcatatgctgaaccctcaacctatgcagtgtgcttcctggagtttttattttcacaccatccccaaattcaaagtgaagtttcaattactatacccattcatctcatacaggggcccaggacctactgtgtgctaggcccacccacatcaatcactgatcgagaaaatgcccctcaggcttgcctaccagcctacttgatggctgcattttctcagctagggatctccctttccagaatactctagcttgggtcaaggtggcaaaacctaacgtatttgttgcctctgcagttcctggaggtgtcagcagatgtgagcagtaagaaaaagcagtctccatgcatagtcacaactgctcataagaaggtaccctggggcagggaaggacttcctggtggagatgcagccagtggaggggaactcgtggtaactattctcacatatgtcctgtaccacatggaggtataggacagattcaaaaggagaccattgagtgcaactgtgcacacagtgcc

SEQ ID NO: 794 - DNA, 3775 bp, Mus musculus
gtggcacagatgttgcgttcatttcttaggtgtgatgaatgtattgtgtgtgtgctcctgttgtgagctatacatcatgcacatttcattgatatgcatgttgtatgtggtatagacgtgcatattccatatgttaggtacattgtatgcttgtgtgtattatgttcatggtataggtgtacatgtgcattttctagattgtgtgttacatgcaatgtgtttggtatacgcatggtgtatgtagggatgtgcttttgttaagattggcagttgtgatgcagcctgtccagttagatttgaatttcagatggacaactggtattagttggtgctgtgtgtcatggaatatttatatactgccatgccaaaaactttattcatgtcacctactctttactcgtcagccccgaccacccttgactgtgtgtttgggcagacaaggtttcatcctgattcactgtgtaccctcaggcagcttagccaaggaaactgctgtcactggcttatcggtcttgctcattacaaggcacagatcatgtgtcccagctgcagggagccgtgtggactcctctgtgggctcctgtgagagaaggcagtctctctgaggtcccctgcagtaccatccatctctataaacacgtgttcagcttctacccatgttctagtgttggcaaccacaaagtttacccaccctcttccctggatgaacctaaaaaaccaaattcctctacctgcatgcctctctgacatctcagtgataggcatgatgatcctctccttcctcaggctccactagcctgggacataatttcctctgcttcttcccagcaactcccaggaaaattctccctggctttctgtgccctgtggccttcacttggtgtgagtgtcctgtgttctgtctggcttgctcaggcaaaagtcttgactacttctgtcccagagccctcctgggtctgtgttcaacagctacccacaaggcatggcttccatatgccaatcaagccaccttccaccaatcagaaccagaaccacccccttccttgaacattcacttccatcagcactcggctcgcgtgggtgtggccagaggaagcagccctggctatggaggcagatggaaaacatcctcttcctttatgaggaacgtgacgtgggctgagtatgccccagaagagaccttcaaaacctgcttcccagatctagaaagttggccttgcttggacacagggtctgtgaaaatgtatttaaactaagaacagtaagacagattaggttaggctccgggtatgatgacaaatccttacaggaaaagatgacaagctgtgctggagactgaggttggagctataagccaatggcttctagagccaccagggatgggaggatatgagagggattgtcctctaaggcctggccctggtcacctctctgtgataatttgaatgcaatgtgtcccataaatgtcaggaagttaaatacttgggtcctagttggtggatgtttggggatggctatgagatacagtggccatgcagggggaggtctgtcactggaggcaggttttgagattttagctacctttctctgtttcatgcttgtggttgaagatgtgaactctttattgctgctcctgccacctgtcacctgccacctgtcacctgccacctgtcatctgccacctgccatctgtcacctgccatctgtcacctacttgctacccgtaacctgccacctgtcacttgtcacctgtcacttgtcacctgtcacttgccacctgccacctgtcacttgtcaccttctacttgccacctgtcacttgccacttgccacctgccaactcccaactgctacctgtcacctgccacctgccatcttctacctctgctcttctaccgtggatgctaaccctctagaactctaagttccaattaaactctttcttctataagttgccttggtcactttgttttatcacagaaatagaaaattaatgaatacaatccttgttttcataatggtagagaatcaattcctgctgtctcaaaaatacatagtgtgagccaatctgttctggcagctacagagtgtgcaattagtcagagagaaacagttaatcagacaccccatcactggccacatgtggactaagtgcatttgtcccaagaaatacaaatcttagaataaaaagtctcccttgaatgagtgaatgtgcccccaaacacaccatgagacacttgatagtagcaacacagcctctagttatgctcaggcttcgagcaggccctttcttgatgcatttggtctccatagcaactccaggatatctgtttctctttatgagcagcccgagtcgtgggcatttatgtagaatctgaagccaggggtagcttagaggaatgcaagactctgggggcagggaggcaccttgcaaatttgtagtgtttgatctaagcctatggagcaggtgggaagtagatgttcatagcagagggatgagcatcaaggccagggagcataaagaagagtgtgggtgaatcacattggtgagaggagaccacaggcctgggcaggaactgggactctggtcacatgctgtagagaaatagaacctctttcctttgggtattgggaggggagacacaatagaagagggtaccagctaggcaagagaggagtgccctggtgtctgggtgcagagtggcctgcaggggaggcaggaggagggaggcagagaggaccatgttcatcaggaaagaaggcctgtgctgccacatggtcgtgctatgggatggctttaccaggtccagctgcctgggcacttgggtgactcaacactttgcaggacaccagttgccaaggtgtctaatgccactgctgtccccatggtagacccgaatggctggacaaggaactggttctttgtcttctcaagctagtagtcactgtcaagatgatcttggggaataacacagtcagtagggttggacagatggggtgagcatacaggaggagttacagacgccagggcaagattccatgtgcagtaggggtgtggatttgtaccctgagctgttccgttttaggtcaccaactgggacaacagtgtatgtactgtgtatatgtatgtgtgtgtatgtatgtgtatgtagaatgtatatgtgtgtgtattgtgtgtgtgtatgtgtggatacaaatgtgtgtttatatgtagaatgtatatgtgtgtgtattgtgtgtgtgcacacacatgtgtgtgcatgcctatgtaagcatgcttgtggtagccaaaggtgcatgtcaggtaatatacaggttaattttatataaacctgatacaagttagatcatctgggaaggaagaacctcaagtgagaaaatacacctgccaggctgggctgtggtgcattttcttgattgagaattgatgtgggagagcccagtttcctgtgggtggggccacccctgggctggaggccctgggttctagaagaaagcaagctgagcaagcccatgatgagcaacccagtaagcagcacccatccttagtctctatcagttcctgcttgaccttctccagtgacctctctcagtggtggaacacgatgcagagccacaagatggaaccctctcttccccaacttgcctctggtcattgtgtttgatcacagggatgggtgcattaaccaaggcaaggcttttcctccatcgctctccatctttacttaaaacaaaaaccttttattggatttgttccttgacagtttcatatatg

SEQ ID NO: 795 - DNA, 3375 bp, Mus musculus
ttggatgggagagtctctatctgaagctaggaggccaggccacacccaccatggccttgtgcatagaagcgggggatttggcttatttctgaaggaaaatgggacactgagacggacacagtgctaatctgctatgctatagagagtgggcaaagcacctcagaggattaaacactgttctcgatgctacgaagccctgaccaaaggtctgggcagccatggatttgaccactcatattaattagcagtttcttcatgggaaaaatgagactggacaaggtctgaggttgagggtggcacccacccttatgggtggtcacaggcctgagaaatgagtgaatgccctaatacaggctcaaggtggctccagataggaacacagtacagacctagagtccaggtgtcacacgacaacttttctgagggactttagaagtagagctctcctgggatccatagcttggattggatgcttatctaaactgagctctgacttatagaaggagctagaaggcaggatgctggtcctagtgttgcttgtaaatgctctggacattatctggcgatctccctctttccataaaggccacacatacctatatatctcctaaaaatcaggtcactcttgctcggcacgtgaaaacagttatgtggcagctctccagtgatctttatgatggatggatggatccctggtgtgatggtggcaactctgctgttgtttggtggacattcacttccacaggtaacccttgtgtgcaggtctccttgaatgttccccagtgacatgacaagcaaggattatggaccttttctgactcacagacaagctaatctgaagatgggtaactgaaggctgtggtgcccgctctgggaaatggcgagtcctgagagatctaacacagttcatagccagtgccactggcaacactgcattcgatacttaaagcttgccaggaaagcggattgcaagtgttctgacaagacagagagctccgtaagctgatagctatgctaagcatcctgattgtgataaccattccacggcacattcatatatcacaacatcacacagtccattataagtgtatataattttatcaaccataactcaataaagcttgaggcgaaggagacggaattggaagacacatgtacaccacttaggctgtcagctgatgtccaggaggaaagcagtgagcacgtggagatggttcagataacccgagccatcttcatcccacggtcacctttggctttgccttcatcagcaagccttatagctcctggttgcaaaaccaggctcttttatcacaagcccggggcttcatcctgccttcaggcaagctttacaagatgggctttctccgcatcccacccccacccctggaagggggcactgcacctacagcatgaaatttaccttgatgggaccagacacccttgctgccagagcctcattggggcttggttgaagtctttgtctattctatgctctctctattctgaggtatgatacctctcccatgtgtttctctccagtctctgggggaatgcacactcacctttgctgagagctacatttatttttatctgttatttattctcctgactcatgaaattgcacccttcaggatgccagtacaaaatgctaaaaaaaaaaaattagcaaaactgcataaagtggatgaaagatgttgggtttcttttatctcctggaatatgaatttgaataattttactttatgatcccgggagaaagaattaaataaaaagtcagcacacacacacacacacacacacacacacacacacactcaaacctcccctccttcaaacttaaatttgaaaagcaaaacaacaaaatccgcaagctcttggcccagaaccaaggagctgctgctgttctcagaataggtgataaagaagccatcttagggacggagcagcttgaccttcagcacggctcagcaccactcatggtggcagtcaacacgtgggacactctgtcatggccatgacgctttataaggactgggtgcatgaagcctgagtcctttatctgtgatcaccatgcctggtccaagttcagggaagctcttgctatccagaatatttaccacactctctcttcacccaaggtcccaagggttctagggtatcgtccttagtgcattcagagatgccaaggatattaagactagggtgctatgacaagggccaagagaatagaaagggatggtggaatgatgtgtcactacaatggagtctttctatgatccagtcaatgaagcagccccctttccaagacaaaagggatcatgagttcattcaagcatcctttcttcccagaaacaacccacagagagtggggaggaggtgggtctggattccggtgggctacatattggggtaacatgctgataagaagttcaaagtttaccactacatcctgagataggctacagcctactgcaaaggatgctcttagatgggctctgctcactgttgatatggacaaggaggtccatgtgggaacagctgagagtttctagggggcactgagcagcagggaaacctcagaattctcagaggacatttctggattacttgtggtaggaaaaaggggaggagtgatggatagtggatgtcagaatgagaatgaacagtgtcttgggggatcttctatgaaaccaagaaccacagagcctagtagactcagtttgtatgggggggggggcctggaagccaagatggggtcactatggcctcaagtgtggtcatgataagccccaacaagcctggacacttcatttatctgaggcaagatgcatcataacctaatcttagcaaggaagggccttagccattgaggacactttgccagataatgtagctaaatagcaaaaatgtggagccacatggaaatgtctatgggtggttttgtttccattttctccttagaagccccttgtcctggaccgccagggtatccttggaggatcctccaagtttttttgccgtgagcgtctttaggtacttttaaaaggtcaccccaaagctcaatctatctacctagccagctatcagcagcagcagcagcagcagcagcagcagcagcagcagcagcagcagcagcagcagcagcagcagcagcagcaggtctgagacacagccagggctctactagggcattctcagcaggaataagtgtaaatgggacatctctgcaaggaaggtgcctcccaaggaactagacagaggcacagggctcggtggttgtggctctgccacccgatggtttggtactttggtggtcctctgaaaataactcatgggaaggaaggagaccccttctcctgagagactgtacac

SEQ ID NO: 796 - DNA, 3975 bp, Mus musculus
tccttccaggacaggaatactggtccagctgatcacaagaaaatcgatatggcccaaacctagtgctatatagtagggctcttcccctcagctttctcaccataagaaagaaggcaaaagctgtgtgcctcaccctaagagctagattctcaccccacactgctgcttactgagttctgggacagtaagaagaactccatctagtaaccaagctatccaagggctgcatggggcagtatgaccaggggtgggtcagtgaccagccttgcaccaagagctagagtcccacctattagccactgcagacaatcttgccctgctaagaactcaggcaccaagcagggaaactatagctgtacagtcttcactcagaaaaaacaccactatacaaacaaatgaatcaagacatggcagatatgttgtcttaggggaagggaataaaggagtgaagaacagaaaggggagagaagaaagtggggagaagagagaaggccccctacctgcccagaccacgagataacaggtaactgcctttataattaaagcactttggataataactgacttttacgtttgtcaaacactgcatgaagtggaattgagtattgtcgtaaaattgtgggaaaataaaggaacactcaactaactgttcattaaattctagaatgttctaacaccagggtaagtaatttcaggacaaataaaatcagccatcagatgaacaaacatttcctgcgtacagaggaagaaaagtgggcaactgagtaattcaacccaataagagagttgtatccaagaaagaggcaagggggagcccatgccggctggtaaggagttttaataatgttgcctacagtttgttaaatggttgatgaggtaaggaccagtgtggaatatgttggataccacgtgctgatccagtaaagaggactcaatacaatcctgatcctgggagcaggacacaggacaaaggttctgacagaatggctcagtgaaggtacaaaatgccccagaggcagcaacaggagctggtctgtaaaagatgacagtgcttaggagcagcagatgccagattccaggactgaatctaacagcagctgctaacaccctcccacttgacagtcttctctgcctggcagctccacagaacacagggcaaaggctagctgacagcaagttcctacaagctaactaacagtctgactataaagctagacacaatgtgggtacacatagcataccatccgcatgacacggacagaccacacacacactacagaactccacaccaacaccatccacagggcacacacatatgcacaccactttacacatacaaacacagagaacccttcagtgagccccacagtgggctttcgtgtggctcaggtctgtacgcaggtgggctacacaagcagaggtgaccacagagagagagtccctatgggggactcatgctcactagtaccttcccctctggcttttagagcccatggcttctcaatgtacatctggatcatagaagaggaaggaaaagccaaggcaagcctcagctccaatccctctgaaggggcacaaaagaacagtatgcctgaggctgtcactggggaggtatctctgcaatgttttttttttttttttaacttcagcccaagcctggcatcaacatgcaagccggtctagttcctcctactcgttctgccccttggaaggaaactcctccagagtcaagccagcacccagtgtcactgtgaaggctcaggatcaagcaggaggcacccattgtattccaggtttccatggccacctgaagaggtggcaccacaatttctattaagcacacaaaagccctggacctgaagtcagatgattgagctaaatcctcaaagctgtgaggctgaaccatatgatcttgccaactattcaactatttttggacctacccaaataacaacttcccgcagttcaagccaggaagaaagggacagagccaagactcaggcttggattttttttcctgaatattgagtttaactcttaatgagtatacaattaatgttcctacagtgatgatctttaatcccacattcagtcccttcttcttccaggcctaaattggtggagtgtcgctaagtcccacaagctcagactgaagaatgtgcagactctggggtggcagagaagccaggacagctcttcagagcacagttcattgtggtagggatgggcaaatggatgggagacctcagttcccaacagctgtgatttctcatgatttagacagcttgtctcttaatatttatcatatcctaggagtcaatatatgttattgccacttaccagtgggcaactggggccaagattatatactgctcacagggaaggaactggaaggaagtaactggagttggtgatacatgccagtctttgaatctgttctcgagctccatgtctcaggataccatcagcttctcaatccactgtccaggctctttgatggacacaccacagagaagggagtgaccattctgcagcagcagcagcagctcctggaggctctcagggccctaagcatacccttgacgctagcctactctgctcctggctccaagttccagaagcatctattatgtatgtccacttcactctatcctccccaaacatggcccttcatctaaaagactccatggcaaatacttcctgccatcagcattgatcttaatcacatctcaggaatgattcacagcctaggcagtcccaccccaccatctcagcacagggaagtgatactcccaagcttgacaacaactttgaatgtaatatctgggactaccttgataattgtttgtttgtggcaccttgggagatgacatctgcagcccaggcagatgaaaacactgtaggtgtgtgcgataagcttcctgcgggttgtttataaatgattcacaagaggcaggcccataaactgagaatgtgtatgaggagaaatcccagcagactttcctgcctcacactctgcagtttcagggaaaatgtgtagggtcctctatccatgttatatgaagacagctcctcccatgagtcttatcatcgtcgaaccaagacctctggatatacactgtccatgtgtggtgtggttccctcatcttaaggaagaaactgttggacagttataaagtgataatatagtgcatttgttgtgactgctgtctttattgccagtatcacccttaccaccataatcatcatcatcctgtcttcaccatccacaccttcaccttcaccaccatcaccatcaccatcaccatcaccatcctcaaccatcatcacctccaccatcagtatcaccactactgtcatcatcctcaccatctccaccttcatcctcacctccacctggatcatcactgtcagcatcgtaccaccacaataatcaagaccactactgttatcagcaagaccagcatcatcatcagtatcatcagcatcaccagcatcaccaccattaacctgcaggggtaggtgacatagctactgttattgtcccctcagttaatatttgctgaaagagaggaagggcatcccatcattacctcagacatgagacaccttttttgttgttgttgttgttgttggaaatactcccactgctgtgtcaggacatgtcaatcaaaatagtgtgagggagataaggtgtccattgtggctttacctatgtctacagagaagtgtcaacagaaagccccctctaactaccacagcagggcccagtctgccttcaccagcaccatggagagcaacacgctgttcctggacacaaccatttctttgctctcctcagtaccctaggatgacacagagttagacaatttctcaaaataacaaagaaagggatgtatagccttcaggcaaaagatcatgggttcaaggctgccccagctacaagagctatctcaagaaagaaatagaaatggc

SEQ ID NO: 797 - DNA, 2125 bp, Mus musculus
gcatactgtagtcttccctgaagtcactgttgtcttactggggaacgggcaggtggggcttccatgcctgagggtctctctcactgcccaaggacccagaggacctcagtgccttggaacatccctgtcaccttcctcccttcctcccttgtctagctgctgagacatgacacccctgtccccctccagccctcaataccacgaatgcttgtcttcatgtcctagagaataatgggaatgtcttccttcagctgcagtcatctgaagttaaaaaaagaaagaaaaggaaagggggagggggagactcattcaccattactctcccaatgacagggctgtttataattaaactcagaagatgtgtaattctttattgagagagattcttttattgctcaactgacaccacataggtttgtgaggagagggcttgtcacttgttgatggtgacagtccccaccccctgaaagccagagtccccttccttcaatgtgggtgtgcccttccactagttggagaggcttttggtctcatttcagaactgtgacctatgtaggctgctgtgccctacaggacgtttggcaagcgcatgagacaacccagcaacacttatctctgtgacaaacagcaatgcttagctcctttatctctttccggccatgtgtgcatttgtgtgtgtgcgagcgtgcgcgcacgcgcgcgcgcgcgtgtgtgtgtgtgtgtgtgtgtgtgtgtgtgtgcctgtctgtctctctctgtgtgcatatgtatatgtatctgatacatatgtatatatgggttttctcgatgtgccactctgtagctggtttctctcacacacacactcacacacacatttgttccttcagcctcagttttctcatttctaaactggtatgctgagatagcaagagaaccctctagactgcagtatagtagctgtgcaggaggataccccacacacaccctgaccctttctctttcagaaactgagctgggacacagttggagtaaaatctttcatccaggaaatccaaagactcacaaagaagccactgccctggctgacctggatgggctaagaaggagctagttgatgcgggaaggaaactgcctgctagagatcacctttctgccagctctggtccccgtgtgctgaggctgcctcccctccacccactccacccccatctctgggctgttgactgtacttgacagtatttggcagccatgataaagagccaggtattgagaaggaccccgtgtccccctggctatctaacccagccagtggagggaagcaggcttgtccaggaagcccctccctacttcggtcctttcctagaggctgccgggagcctcgttgagtttctgcttaggttttctgttgtgttgccttttccctgtttatttgtgatctgcagcgtgaaacagttactaattcagatttttactgtggataaacaaatacagaaaattaacagatgtgttctgcagatgtccttaaccaaaataacatccttcgtgacgcaaagcatctgaggacggagcaagaagatgctccgtacagtcagccccctgcctccagtggctggcacctgagctcccaagggctgaacaggttcacctgagccgataagatcctggcagatcatgctgtggccacgtttgcatcgtggaacagtgggaaagtgggcaaggaacccacagagggacaccaaacagtgagattagcagaactatgggacacatagctacatgagcatccagtgtgcagcagcacaaagaaggctgcaataagaaagtccagagggcccctcaatcagatgagaaagagggtccatgacttggaactgaggctgcctagcagagactaggaccccaagagtgaagacggaagtcggaaagtcagccagactattgctgggcaggacacggcacagggcatctgttccctatacatacagtgtgaggtgctaagacatccaatttctgtgtgatctgggctcagccctccactcaattcaagaggccacaactatctgggcagtagtcctgggacgcagaggttgtgatcacctctctggaatggaggcaggaagagaattggtgacccctgtgccct

SEQ ID NO: 798 - DNA, 3175 bp, Mus musculus
agaagaaaggtgacaagcacagagagaagaggcatgttcatctaggacagcaggacatggctggctaagtttcttgagcatgcacttgtcttcatgtcaatgacctgtggctagcccgatgtcttggggccatcatttctaaactggcaaattgtaggttccaggctttgggctttttgcatgacccatggacaggagcctcacaggatcgtcctgaaatggaaagaggggagacagacatggcccagagaagagtaaggatgacattgtaactctgggctctctcctaccttctcctcctccatctttccatttgtccactgtctcctacctcattaggaaactttctggggtccctggatgatctggcccaaacattgttgtgaacttaggtattgagcctgatgggtctcccagagtgaattggaaggtcatagttgttctactgcaggtcatgacttaaccagtcacaaagggcggcccaagagagaccttatagccccttgaatccaggcatctggtactgagtgtacctaagtgcctggtaccccttcatccctaaaacaatccatccttctcctcacagttaccactcactgcctcttcactctcctagacagtgaaggaggaggagtggactataacactctgagctcaaaccctctccagcatcagtgtaagttgtttgtttactgagctgtcctgcagagtcccagtttgatgctgccagcacagcatgaccaaaaattaccctaggataagaacaggaagctctaacttcaaggagacctcaaacctcacctcatactcccctaaaccctagctctgtcttcacagtctgtcgtgaaagtgatggtgatgactgggatggtcgtggtggtgatggggatggtggtaattctcacagtgagcatggtgatgctgtagatggtggcggtggtcatggtgatgatggtaatgaccatagtggcagggataattatagtgatgatgcagcccgtgatgagaattgtgagtgatgatggtgaaaatagtggtatgacagtggtgatgacactgtttttattattgttgttggtgttgttgttggtggtggtggtggtggtagtgatcatttgttggtggtgatggtgatgacaatcttaatggtgatagtggtggtgatgacgatcttggtggtggtgatggtggtggtggtgatgatgatgctgacagtggtggtgatagtagcaagggtatcaacaggtggctatgggtcaatacctcctgcagcaggagctgcctctctggacttgtgggatagagttattggcaggacaggcagcagaggagactgtgcagcctgattcctaggttaccataggaggcggcaggggacagaatgctctgttactccggagggattgaaacagccacacaactgccagtatccttgtggtccagcatggacccctgaccagggggcacaagactgtcccttgattctatccaccatctcattgctgtgtccagctcagcatcccttatttgtctgtgctggaatcccagcaggatgaagccaggaccataggaggagagcaatggccctctgtctggggactggcgataatgccttaccagagctctctgggtccagtgtgagcaccaaccaaccccccttctaagccaagctactccttatctgagatcctgaaggccagtgcataatagagccttgtccccactgctgggagtcccctttagcccttccctggggcaggtcaggcttctctccagataagactcacctcggctgtacctcctgttccactgaccagctctctgtggcctagaaatgggcagacaggagcattcctcagactcaaacgatgtagaatgcccttggaagggtggctcccccacagctgctgctgagtcgtatcgtttttattacaatgttatgggaatatgagccccagccaagctaagccctcccagactgtacagcaggaataaaccaaagcccatttacaattaaacacaaacaaaactgcaaaaccaataaaactgaaatttgcagcattaattttacagggcaggtgtttcccagagccgcagctcagggagtagactccagggtggaacaaactacctgccggtactcaaatggcttccgtgttcattcaggagctgccagttcacacatacataagggcagctgcctgaactgagctaatgacagtggctttgtttgttgtgatcacaccttccatttaacccagagccatcccagaaggcatgtttaatagcgggttcttgataactcgtttaagctgtctccttcccatgccaacagctctgacttgcagcctgacagggcgctgctttaaatgggagtaatccaattactgcagggcccaggaacagaatcttcatggtttatttactgtccatgcttagtgccgatgaactaactgctgcaagacagggagtgcgaagcagagaaccggcagcccatggtgctagttgttgccgccactgcaggttggcatcagccttccccagagccatgccccactgccctttctgtgaaattcatgccgatcctctgctacatttgaatgtgtggatgcacatgtgtgctcccggggatgctggctgggttatgctagtgactttactcattgctgtaaactaattcctgacaagaggcaagctacggaagaagggttcgttttggctcacagtttgagggtgcagcctagcatggtcaggaaggcagggtgtggctgagcagctggtctcatttcatccagtgttggggatcagcaatgagtctcagtactcagcttgtttcctttctgtttgttttgtgttgtgttttatttttaatacagccccaaccccagcctgcaaatagtgccacacacgttcagggcagaacgtcctacctcacttaatacagtctagataatctctcacagacattcccataagcttgtctccatagtaactctatatcccatcaagtagacagtcaccatcagccatcacagagctgaaatgtccccctgcagaccactcagaaagtactgcatatattctagtcctggacccctgttgataagacacactatgggaaaggcaggtgagagaaggctcatttcctgagttccagtctgagttttctgatgag

SEQ ID NO: 799 - DNA, 1775 bp, Mus musculus
taatgttaaatgtttgcagagatagatgcggtaacttgaatgagaaatgtttcctgtaggcttgggaagttgaacccttggtacccggttggtgatgctgtttgggaaggttgttaaccctttagggggtgtaaccttgctggaggaagcatctcactggggataggctttgtgggtctgtggccaagtctacttccagtttgccctctgtttcccatgtatggttaaaggtgtgatggctcagcttcctgctctgattggctgctgcctccccgcccctccccgccccttgcctcactattatgcaccccccactatggagccataatccaaagtaaaccctttcttctattggtttcttttggtcgttgtgtttcatcacagcaacaaggtaacaaatagagtaggtatttcactgatttaacctcgtgtgatgtttatgtgttggacatggaattcaactctctaaacatacacaacttttctaaatccataaaaataaacagacacctcaggaaagagaatgtaaaagcctgtaggataatttttaatgcttgactctttggttttattagtaagttttattctgaaatattagctttcaacattatctgatcataacctaacagtataggtacatacacatagttatattgatctggcaaactttgatatttttctctctattccatttgattgcattttctagtcatgatctatgaaacacatccctagccctgattacaaacgtgcctttatcgaaacacacacacacacacacacacacacaccctttactctgtggatatcaggcagcaggggacattcgcaaacttgaaggtcaggagcaaggaaggggctaaagagcagcttgaagacctggctctgggtttcagtcaccctggccattgcagagatgtggggatcggaaagcgctgagaaatctgtattgcttctcacgctgaaggcaattaggaagcattttcttgtaccctgtgagccttctcccgtaaatctgcacaagctctagcagatgtgagggaagagagtgtttattcctccacagacagaaaactaagtggcaagaacaaatccccgcagaacaggctacagccgaaagtgtaatataagaagtcagctaaattgaatgaatcatgcatgtatgagataacgtagggctttctgaaactaacccgaacagggagaaataacttcaactaatgggaaggcaagctaaacaaaccgggtgatgccttatttggtctgggacacccaaattgaattatttctctccctacctttccagcccttttctaggtgagaaaatacacctttcccttgggcacgcccacctccatgcccatccctgttgccattggtttcctcctcttaggaatctgacatcaggctttgtttcttcctggttggaaaaatcttcctactctagggagtagagatggtaaggtctactttgctctggcatcatgcagaccatttatttccgctacatctcccagagctcgctcttccctcccatgcttccgctgttaactagcctgaaagctggagtccctcctcctgtgagtccatcctggagggattttctctttaatccactgtgcaagggcacaggccacgtctgtactttcgatgttagctcttttctaactcttgccctccgtccctgagatacctaaactgcatgcagcgcactggtagagatttacagggcaacctttcgtttttacccggtgtgctccttgagttctgttgtt

SEQ ID NO: 800 - DNA, 1725 bp, Mus musculus
tcagtttacaattctaacctcctgggcgcccgggctcaggctccacccccaaccccacaagccagcgtgctctagctgttgcctctgactctacttttcatcggtcagaataagcaagaaaagttctatgccaagactagaggcgttttttagttttgcattttcagataacctttttttccccttcattaaaaaacaaacaaacaaacaaacaaaataacaaaaaaaacccggcaggggtcgggtccataaaatctcacaaagcagagatgcaacacctgagttatagaggctccctaccgccccccaccccccccaccccaccccccccccccgtcccaatgacatacttctagcaaggccacaccccctaagccttcccaaacagctccaccaacaggagaccaagtttcaaataccagagcctatgggggcggggggcggggcattcccatttaaatcacctcaggaagttatctcttaagctagggagatcccccaccctattttagctgggatgactgcaaataagaaaccatctgagattttgttttttaagattataaacataggaagactgctgtcagtatctacagtggccaagccctagcagacttgcttatgcagtgaacaggctctgcccaccagctcctcagacaaaggcatgctcagccctctgtagacagagccagcacgggtgggaaggctccaagaatcagcgctccacacacccccactcccttttactccctcgaacgctcctggctcctctcccctggccacactgttcggggtgggggtggggggtgggggttgaggggagagccagaagctacaggggcccctgggccgatctgcaaggcccactctgccaggttccagctgcaattaattttccagaaaaagctccaaacctctgaaacgcacttcaatttgaaatgctgatatagccgtcaaccaccacagtacgcaggcataaatctggagcacagatagtttttgttggtaataatgaagaacaacatacatttaattagcgtgagatttaggaaatgtgcagtgtaataaaacaatattctaattaggttggggaaacttgtttgaatatgatttgtgcagtgccattcggaggagttcttacaaacggcacggaaatatgcttttaccgaacaaacaaacattccaaacaaaagacacaagggcttcatgtccttgaacactggtctcaggagagcacaggattaaaaacaaatgctctctggtcatctggagcagccggctcagggggaaatgtgttccagggctcaagcctcagcaaggcaaaaggttggtgacattgaatgtcctctcacatgagggttgatgctttcccccaaattcctgcacaaagcctgtcacacattacctaggaatcccacctctgtgtacatcccaggattcttggattggtttttttttgttttttttttaaattttatttatttattcattatatgtaagtacactgtagctgtcttcagacactccagaagagggagtcagatctcattatgggtggttgtgagccaccatgtggttgctgggatttgaactccagaccttcgaaagagcagtcggggtgctcttacccgctgagccatctcaccagcccttggattgttaaagatgcatttcccaagagacctccagtccttcaattcagcgtgtgagcccagcagaccccac

SEQ ID NO: 801 - DNA, 2675 bp, Mus musculus
agttgacagaagactagccagcacagctaccaagttcacacatacaggaagggtcgctgactcatggggtcgtctagatgacatattaagatgccactgaatgtaagatatacaacaatttttaaagtgctaaaaaggaaaccaggtgtggttgcccacaccacaggacacagagggctgttgcaggaggattgccacaagtttgctgacaggctaggctacaaaggagttccaagctagctttggctgtagaataagaccttgtcttagaacaaataaagaaaaacatgtgctggaatgtaaagctgagagttggtgagacggcgtgtcccagaagcctggagcatccgggttcccaggtctatctttgtgctctgacaccgtctctgggtggttcctctgagggtcactgtgttagccaatttttatcatcatgacaaaatctcagagacaaatgattgagaggaagaaagattcatttgggttcctaatttcagagcctccgtggtaactcagctatggtaactcggctgggtcgtttctaggtgagttacagtgaggaaaagcacgactgtgtgtgctgaagctttacttcacaggcagtgagagtcaggaggaggccagggccagggcatatccccagtggcctgtctcctctactttgtaaaacctcttcagctatggtcagggttccatgattcagtcacctctcagaactgccaccagctaggtccaggccgtcaacacacgagcctttgggggtatacttcacattcaaactgtaaccatgacaacgtggctggggtagttctgctcatgatgtgtgtatccacgattctttccaagaaaaccccagcatctccttgagttaggctcacttggatgtattagctgacttgggctgatgctttaaattctttcttacacaaaagaaatctgaaggtggaagtgttgggatgggaaccccaccagcacccaggagctgacatcacatgatttaactctcaaatctacattccaaagggcctgttggagctccagatctatgttgtcacccaaagtgggaaaaatggaaggagcaaaggctgcccctccccaggggccactctcctaacagctctgctatcctgtggcatggcttgcagccaccatctccttcttctcctacatttagtgtgcatgcctcatgtgggggggaggggtactcatgtctgtggcagtgtgtatgccgtgtgtgtgtgtgtgtgtgtgtgtgtgtgtgtgtgtgtgtgtgtgtgcttgttcctgtggaagggtacatgcctctgtgtgtgtgtgtgtgtgtgtgtgtgtgtgtgtgtgtgtgtatgtgtgtgtgtgttcatgcctgtggaagtgtgcatgactcatgtgtgtgtgtgtgagtgtgtgtgtgtacgcttgttcctgtggaattgtgcatgcctcgtgtgtgtgtgtgtgtgtgtgtgtgtgtgtgcttgtgcctgaggaagggtgcatgcctctgtgtgtgtgcttgtgcctgaggaagggtgcatgcctctgtgtgtgtgcttgtgcctgaggaagggtgcatgcctctgtgtgtgtgttcatgcctgtggaagtgtacatgcctcatgtgtgtgtgtgtgtggtgctcatgcctgaggaagggtgcatgcctcgtgtgtgtgttcatgcctgtggaagtgtacatgcctcatgtgtgtgtgtgtgtgttcatgcctgaggaagggtgcatgcctcgtgtgtgtgtgtgtgtgtgtgtgtgtgtgtgtgtgtgtgtgtgtgttcatgcctgaggaagtgtacatgcctcgtgtgtgtgtgtgtgtgtgtgtgtgctcatgcctgtggagtagaaggacaacatttggagccagcttcccctaccatcacacatggattctggagtcagaactcaggtcgccaggcttgatagcaagtgctgagccgtcctacacacccaaccatctccacagcacacatttccattcgctaaggcacaaaagaggagactgtatgcaggggtccacagtgtccttcactgtcctctctggagggctaggatgaccagcagtaatagcaacgtgtggccattgctcctggaaagaaaacacagactccactcctcaaagtgaaccttccatgatgagggtaagtccccaagcagttaccctgggtccgcctcctctctcctgatctgcttcaaaccctggccaccatgttctttagtggaagctgggtccctaccccacctcagataaatgttaatctctctgaggacctccgtgaaatccaatctctgctagtacctggcccacaggggaatccgaggtatgctttgggcctgagagacacagaggaagttctttggaaaatgtttggagatcttctcaggccagagggaacttctgcttctcctgccctctgatcactgctaccttcctgagatgtctgaaactgcagcatctaccacgtgagtttcagaaatgccagtcagagacacggcaaaaaccaacatggaaagggtggtagagaatgcggcgggagagccccgggatggaatcctccgtggatcaaagtggattcgacagagcagaggaacctcaagccagtgtctgaacccagaaggacaggcacaaaacatggcatccaataccatcctgtaa

SEQ ID NO: 802 - DNA, 2850 bp, Mus musculus
ctgagacaatgacttgaggaacaacttcaaaggccatgtctctgctcacagtttcaggcctttaactatggcctgggcaacactgtgtccagtggagcagagcatcatagctgtgatgatgtagaggacagagttactcagcttatggaaaccaggaacaggaccctccagaggtatgccccagttgccttcctccatctaagctccacctcctaatgtttccatcacaccctaaaacagcgcccccagctggggaccaattggttccacatgcaagcctgtggggaaatatttcatattaaaaccataacaagcagactggggcttcctctgccacgagcattctattaggaatgattactttagatcctcttttcaaaaagacctccctggaaataaagaacgaaaaggaaaacaaaatgactcactctgaatcccacaacaaacggggacctaggagctgaagagttggtaaagtgttggcctaaaatgcccaaagccctgggttcaatcctcaccacgttataagatgggtgtggcgatataagcatgtattcccagcactcaggaagtaaaggtaggagtcagaaattccagaacatccttggctacatatcaaattccaaaccatcatgggttaaatgaacccctgtcgcaaagccaaaaatagagagaaaaagaaaaaggaaaagaaacaaaaaattagtttgactgtcagaaggaaacactgcagggccaagagcaagatggcctggagcctaaacagaggggtcctcttttctctacactggcagcctgtcagaaaaataccctggggtgttacagatcccaggcttagaccctggcaatgtggtctcagaaatccaagaggtggggccccagaggggacatgtgcttcccagggcttccttgtgagagaaaaaaatactacaggaagtagttcctggggtaggttctttgggcttgtctactctgacaggaagtggggtaccagggagtgaagcagacatgttgggctctgctggtccaggtatctcaccccgacatgcctcagtcctgagcctgtaactccaccctagctacagcccaaaacagcactccataaaacacacattgctttaattttcctttgaaggggcaatttagcaggccacctgcaagcccttgggagagttaaggagatctatcttgttttctccaagtgccctccccaaagtggattcctgaggtcaaagttcacaggtaactattgaggaggaagagtgtttggaataagcatagtgtttgctgagagtggagaacagaagtatttttaaatttatatgaaggaaaagagagaaagcaggagaaagccaggcccagccaacaatgaggaacacacaaatgctgtgtgactcagcctggatcttttccctctctgggtctcctgtaagcaaatatctcataaagtaagaaatgtgtgactcagctccagcctctggggccctcacacctactcaagatgagattctctgatattcatgctcacagccaaactttacttacagagccctggcattttcctttttgggatcttgccaggactcactaagagcaatttcagcccccagcaaccacagaccctcctctgccctcaacttcaccccctgggttcttctgcctgtcttcaaaggtggattttattaggctgctgggaggagggagccaccacccttccttaactttttttttcccagggattttcccatggcctttctcttcttctctctagagcaggactgaggggcagccgctccttggtctctggatatatccaagatccttagggaccacaagagagtgggagatgtaagggacaggaccctagggtgccttgcacaggtactgactccccttcagctccctgcaaggaacatctcctgtcggtaaggtatgtgaagctcagaagtttgggggtactctctgcagcctccaccaactcctctcccaggggtgatgtgggaaaatgagggctagtcagaagcagaaatgtaggatgggggtctcattcactcaggagccctcccccttcttcacactttggaagagtttttctggtctcttagaattccagcctcagtattctcagagtagggtgataaaacaaggagcctgttctcaggctaagaagggctccagaggtcagggtcggggatggaaggcaggatatcttggctgtgggccggaagacagaagtatgggaacccagggtgatgggaaactccggtccctgaggtagcagcagcagcagacctcaccaggggcgcccactggaaacttgccaagcttctgcagccccggcatcccagtggggacctgagaaggcctgatgccaagtcacagggctggttctaagggatggaagggcagattctcccccagcagttgtcaaggggaagagaaacagaatagagcccacacgaggggattgagaggaccagacaaacctcaaatagtggagtcttgtagtactctgtgtgttaagctcccccttttgtctgtctgctttttgcaatactctacatagtcctagctgtcctggaactcagtatgtagatcaaagtgacctcaaattcacagagctccccctgcctctgcttcccaagtgctggaattaaaggcatgcaccaccaagcctagtttagttctcaaccttttaaatataaataaattgaaaatataagcaataagaaagtgtcctcatttcatgcggatatgcctagaattcacactcacctactttctctggatctataacccgcccaactcaatttcaacaccatccatggcttaccacttaaccttccctct

SEQ ID NO: 803 - DNA, 5925 bp, Mus musculus
ttggaaactggatctctctgaatccagacctcacaatttggctacacagcaagccctgggaatttacctacctctgcctcccctgtgctgggattacaaatgcatatgaccatgctcacaatttttacatggtctctggagactgaactcttgtgcttgcgaacaagagctccactgactgagccaactctccaggtcttcttcagcttcttggtctcttgtcacctctctggatgtggatttccatggtctggttagaaacagcattgctggaattggtggcatagttcacattgatggttataaaatttattttgaaagagcccttctccaatcattgtgtctgttggtgttgtctgagcacctacatgattgttggtcaacagcagcagggtgctcaactaaaactaggttgaacacaaccaaagtgtgccctcgtatcactcaccaataatccaggggtacaggcttcctcccacagcactagggaagctgggcacactgaggataccagagactttggtctgcacagtctttatactatgtctggctttgccctcagtaaacgaccgccacaagccgtgacttttgatttggagagtgagttcttacaggaaattgagcttagacccacttgatcacctgtcccatccccaagccaggccataagctcacttatgaatgtcaaagcatgatggagacctagctcctgagagcaaaggtgaggtgtaaagtgcccaggcatggtgacatgcctgccagcccagcatgtgggaggctgagacaggatgactgcaagtgtaagtctgggctgcacagtgagacttggtgtcaactaggaaaatgaatggaaacaataaggacaaaaaattatggtgtgaagaccagaaagagctcatggtgttgtcctgtgacaacatagatcttctcttggtataggaacttgtacgtgcaatgtttcctttggtggtgatgagaatattctagaatgagacagccatgatagtcacttactattgagcatctcagctgtcaccagtgtcaccagtgcatcagtggctaattctatgcaatgtctgcttcaccccagcagaatgagtattaattccattataggtttttctttttttattagatattttctttatttacatttcaatgctatctggaaagttccctataccctcccctgccctgcttctcttcccacccactcccacttcttggccctggcattcccctgtactggggcatataaagtttgggaagagaggccccttggtcttagtttttttcctatctccttagtttttttttagtcaacatgtatgtgtgtatctgtatgtatgtatgttacatgagtgcaggtgcccttggaggatagaagaattttaattgatcaaggtaaggagggaacaagaatggaaaagctgagtgggtggagccacccttcagtcacacccacagggaactcaacactgaccaagagggtaaataaaagcttgagtgtggctgtgaatgcttctgactacagtacccggctgcctgctttggcaggaggatcaggtttgagcctagcctgtgctacagagtgagagcctgccataagcaaaagataagatccaggcccacagccacttgttcatgttccctttgtaagccacagggtctggttttactggtaagtttttattttaatgcatgtggtgatggggatagaactcagggcttactgcaagctggactagtgatccactactaggctatgtccctcgcctctcactggtggattccaggcaagagcttttccacagagctgcatctccagcttgctgccttttattttgagacgagggatcgataagctgcccaagaagatgatctccttcccttgaccagtgcatctcaagtagcccggctgaaaggcctgcactactgggtgaagctttgtgtccaattttgtgtattattcaaactcaaaatgtaggtcacgccattgcagtgttggtcctgaactgtcatgtgctcttctcctggggaccacacactccatcttatttgtttaaccacacaagtttagagtgatactaatctatagctcatatctcagatgtgtccctcaaataagggtgtgagttagttgtgcctaggactagattaagttagcatctatttactctctggtggagtccacaggaaccacatgactttctcattgtgatgtagtcagccttgtcatatttgtattgctagcattcacattacaatggaaagatctatgattcagaggggccaaggaagggacccaatagctaggtagcagataatggtcctatcttcatcctacttaggctctggtactgtattccctgttggacacaaccccagaaagtaaacaaagccatctgcagatgctggctgctgtgactcacagccacccccagaagactctgaagcagattgtgaggtgactcttttcgttcaaggtggacttcctgtttctaatgtacccagtggtggctattcctcacgtacactggaagatcggttttggaagtttagagctggaatttaaaagcaaagcaaaagaatatagaagcccatagtgcaatttccccaaaggtgctggctggagtctaagtgcagagagccccgagggagaagctggggcgaccctctggctcctgtgggaggagagaggtggtcaggcaaagtgggcctctactgcatgggcatcagagaccttcccacatcgctctcgaaagcaccgcatccatttctgctagagatgaacactgatgttatttttcttaatgtctgtttttagtctatgccctgcatgttggtgttcagggaattcagccagaggagagaaacaatagtattaattaggaacgtcagtcatgggtgggatagaattcaaacctgccaagtttctggagcatttagtggtaattatactagactgtggagacaagctgttctccagttcctacagagacacacacgctttgatgggcaagccatcagcttgccagtgcaggtctgcagaaggcagagggagcctccctggtccagctttttggacgatcttagcttccctggagaggaagcctgagagtgaccaggatgtcccttgtcattttgcaatttaaagtgacctccttagttatctcttggctgaatctggggtctgagggaaaccagagtgagaagtctatcagctgggcaggatgtttacactcaaggtagagccacgatctgtccaggcagtgccacataggaaggagcttctctcagagcaactagtaactatgttctcagcatctctggtgagatgggacgagagactcgaatctttgaggattggcacagaagagggacgatcaccctaggggcagggaatgaacctcactgaatcagagctgctagattccatccaaggtatttctcaagatgtgctcttaagggctctgcgttagtcgtatgtctcatgccaaaggaaaaaacataccaacagaagcagctttagggagaaagggtttactcgggctcacagttctgggtgagcgttctgtccaatggaaatggaaatgaaaaggtcacgtggatgggagtgtgaagcacctggtcacactgtgtccacagccaggaggcagagcgctctctccttttgattcagactaatggttagtggagggttaacctagtatagaaaacccctcacggacacaccctgagctttgtctccctaggtggtggctctggatcttgtcaggtggacgatgaagattaggcattccaggcttctgccccctgggcaggtgccctgcccacctattgaggaaagcctggccaggtagctaaaggcatttgcttgaggttatttgaatggtgtatgtcaggaaagtttcagactcggtgcttggggagctgcctccaatgcttcctgccgtctctggacaagtctcttccaccgaaggacctttgcaaacaccatctctatgactttcactctaaaggtcataacagtgatttttaggtctgtctaatgtttgaagaattaggcctgacatgtggaaaagagtctgcatgcaatgcttcccttaggtcccatgttttatttgattttgagaaaatgagctcaccctgaaagtcccatcttcctaggaagtcacgtagcagtgggggaataggaaccatctatgtccaatgctgcctttcatatcctcaccttctcaatgctggctacaggaaacataggaagagaaaggcacatagtgagtgattttgtggctaacaggacctgcttaactcagtgctggtggatgatcctgacaggtcccagaaataaaagaatcctcccagtaacttggccctgggttctcatgttaaaaataattaatagaagtcccttcttcatcctccatttttcaaaaataaaataaaataattgggaggcttggggctggagtagtaattgctcaaaggcgtgaagtgaaggagtttctactcccgcctgtgagtcagtgacatagcgctccttccggcgcttgggatgtctgtgtggccttatctctacatcctttggaaaagcagggcacgttttcctgctgacatacacaagcctggtcatttagcatggggaaagaaaaatggtttagaacgagaaaatatatttagaactcattattcacgcaggagtcatggagaaggggcagaaatggagctgtcaggaagaaccggcgcttgggaggggctgtaggaagccagcctggcactcagaggcagctctcaaggttggcagggtcacagtcaaggtcacacatcagggaagcaggtgcaggaggttgcatctttctgagtcgacctgcctggagactccttcttgagccatgaccttgaatgagcctttggctcctgcctcggtcagcctacagtaaattgatatgttcgagccaagtgggaatctgcatggcatccccatgtccctcttcccgctgctcagactggagcaggaactaactcagttagaagctatggggggggggggcagctctcctgattgtaggaagttcaagttatttttgtgtgaaaggttagaaatacatgtttaagtctttttgggcacgtatgtgcagctgtgcttgtatatgtataggtgcttatttgatatgtaaacatgtggggcaggagccaatgtctaccttggttttttgagtcagggctttcccagggatctggagctgggttgggggccagagagcagcagagatctgcctccctatgtgccgagattatgggcacacaacaccaggcctggcttgtttccaaattggctttggggatccaactcaagtcctagtgtttgcacggcaagcaagtgtctaagtcctgaactagctctccagcccacagcacacgtttcatcgtaaactttgcttttgtaaacagaaggatatactttaagtcagcaataacagtacagcacaatgactctgtagagcagcccagggtgcttgttgctggccccagggatcagccactgtgcaggtgacatgtgctctgctaccatggcctgaagggcaggagctttgtttatagcagcaacccctttacccccatgaagtgttgcgttgtgacatcatagtgtcctctaggttttttggaaccatccagttcttgttgtcatctcgctgtaacttgtagcttttatttggcatatgatgttcttttgatgagacatatgacctttatcttagtacagtacagacatataattacacatacatgatgatagttccatgtatataaattataaacatgcatttctagtacttgttagagcctttgaaacaacaacaaccacacacacactatatgtatagaaacatatatgtgtgtatggaaccatacacatatatg

SEQ ID NO: 804 - DNA, 2725 bp, Mus musculus
tatttttgttcttttgattttttctttttcctttttagggtggcaggacaggggaattcattctgagaatcatggctcttttctttctgggttttggcttttgactgaaatggacacatttagggtctctttgctcttacttatgctgagcaagaaacatcaatattttctagataatttataaaagccaaaagaaaaacacctttctttttaatttatctatttatctatctatctatttatttgttggtttatttatttatttatttacttacttacttacttacttacttacttacttacttacttacttacttacttacttagagacagcatctcacagtgttgctcagggtggccagaattcatctgtatctctggctggcccagaactcctggcaatgtgtcagcttcccatgtgttagaaatcacagatgtgagccacaactctgacataagaaagacaggttttaatgtaagaagttccaggttattttccttttcctttgcctttaattatgtctgtctctgtgtatgtgcatttgagtgcaggtgcaggtggaggccaaatgagggcgtgagctctcctggaactgacttgagaacagggagccacattctagttctctggaagagcagtgagcattctcaactgctgagccctcaccagcatccctacaacttctctcatgaaaaaaagtaagtggaggctcagagagattcaaatcgaagccagtagtttatatcaggaaaaggataaagctcatgtctctttaagtgattaacttggaaaaaaattgaagccttctagtttcctgagcaacagagttaggaaaaaatgtttcagaggtaaaaagaaaaaaaaatgtagcaatatacctttgaaaactatcctcggggactcaggaataaaatgactatcagggatagcattcagaaatgtttatgtggctgtggagtgtctcccatgcaagagaacagacccgagcataccgatgccatcaggatatgatgctttacagtgcgtctataaagataactgcaccgagcctgcttgatagttacaatttccttgagattacattcttgggctgatgagacctgcttgaattttcaagcacagttgggagatcctttgtcagcacagaatgagttctggtaaactgattttctctctggagaaaaaaatgatgtccacatattgtagcttagaacccattattttcgggacattttaattctgagtcatcttctcaagtctgaatttattgagggaataagaaaccctagagtataacacacattaaatacatttttttttctacaaaactattgagatcaacaaggtggaggatgggtttgcttcatgcacgtcttctcattccatttgaaccaagcagctgttagtttcttttccttcctagagcaatgagttatgaagctcaaaaataaagtgttctccatggtgtaaataaagctgtaatctgagcaaatacatcacactatgtacccaggcttttctttttgccttttaaaaactcttgtctgtttcttttcctcctccccatagtctggtttatgctactgtgtattgttgacacattcatcttgataatagaaaaagaaagctacttttcattgagaaatagattcaaagtaaaagatgattaatgaaccgaggttctttgcattcccgagatgtgttctgtaccccagatctataaatctgcctgtgacttgccctcttgtgagattcctgatcactctatcaattctccatctcaccttgctgggtgtatggtagctcagcccccaacctacccaaagttgtgaatggaagagggtgatggtgaaggtttccaggagattgctttctgtgaagcacctggcctgacactggctgtcacaggctgcgggagctgactttgcatggggtgggaggataatgcttgcttttatgtcactattgtcaccataactgtagagttgactctagtgtgagtgagagattaacttgactccagacagcacattcttgatgaccagaacatggtgcagaggctggtcacagggactagaaaggaaagaagaagacataaagcagaggcagataccctctgatcttcaaaagtccatgtcctcctccagccaacacctacgtcctgtagttcaaggctgtctcaaagagtactcaatgccagagagaaaacactggaaacacaatgcaactagagggagccatttcaagccattataagctcaatttataattagcctctttttaacctgttagatgcaccctcacaatgtctctaataataggtgcagagaatgaactcatgggatgacagaaatcatgagtagctggttaggagttagttattctctgtgtagcagcactttgtgggcggagctcattatagtgtcctggtgcacattgactcctcccacatgcagatgtgctcgaggctcttaggttgtcttaggtttttcccaggacagccaaggaatatctacttgctatgaaaatttttcacccctaaattaatccatcctggtggccattcagatagaggataaaatctagcttaagtggaattggccctagtccttagcatctgtgagtatcacactttattacaaactatgaggtgatgcctatagttcagagctagagcaagaatacagatatgaacaatgggtagcccttgtcttcttgtgtatt

SEQ ID NO: 805 - DNA, 1725 bp, Mus musculus
tgtacatacttatattgtgtcacttatggaaaagattttacatattgtgtcatgtgagttactttgaagctaattcatgttgtggagctcaaattaatgtacgttaggtagtattagagatattttacatttacttatactcacatatacacacgtacagagagcggggagagggaggggagggggaggggagggggagagggagaggaagagggaaagggagggggagacatatatgtgagatgatgctggtcattattatttacaagtctgtggtgggccctttaaatgtctgatttttaatttgtgcagtgaagaagtagttgaatttccttatggccttatgttttaatgttttcatagctttactttaggttctgaatctaaacacacctgggcatgtgcttgctaattatctttagcatagagcaggtgagctgctggtgtcttggctcaatcagccagtaggtggcagtgtgcaaccaagaaatcattgcctggctgcagacactgttttaattagctaaaaggaaaacaggtatggcttcacagatcgtttatttatttatttatttatttatttatttattttaatttgcctaagcagccactgagggcagatggtttcccctctctcctcccagcttaagtatcagaggagaaggaatatcaaaaggcaatcaattgctggcctgggccaaccccctgaactttagtcctgcaaacatcatcagccctatgccatcttcgaaattgctgcagtggaaggaagcatggagctatcaattacttctggggctgcaatggcctctgtccttgaaaagcaagcctgctgactctgtggatgagataaagggctattgtggaggctggaggcgggcttctctattgggtcctagaagttgattgagggccccagagaaagaaatggaagaccagcttaagtagtacatgatagccaaaccccctgaaatgaattaccatgagacgtacagcacaataattgcatcatggaggccgcagaagcctcttgtggaagcagaagcctttctaaaagaccacctctcctggagctgttcactttgtcttttgagaggggaagctgaatgcaggggagatgcgaggctgtctgcatgtactaagcacacgttagatcagtgttgatgttttgggtgtagtctccaattaatgaatgcaaaagggtagtatcaataccacttggaccaagaagaactgtgaatgtcggaaacagtgtgtatttaggagactgggagtggctcagtctgtaaagaacttgctttgaaagcacaaggacctacctgagcttaatccccatcaatgctgaggccacacccaaccatgctgaggtcacacccaaccatgctgaggccacacccaaccatgctgaggccacacccaaccatgctgaggtcacacccaaccatgctgaggccacacccaaccatgctgaggtcacacccaaccatgctgaaggctacacccaaccatgctgaggctacacccaaccatactaaactcacgcccaaccatgctgagtgtggtagtgtacacttgtaactccagggatctctgagtctcactggccaggcaatatattctacaagatgaactctaggctagtgacagccactgctcaaagatggccctggggatgacacctgaggttgccctttgacctccacaggaatgcacaaacatgacaat

SEQ ID NO: 806 - DNA, 3450 bp, Mus musculus
gtgaggtagaaaggttgctcaagagcatggctgggctggtggttagtgccctccttgtgactcattgcaacatggccatgtcctcttaacacctcctcatttcattcctttcattgtgtatatggaagccattccctacacaagtatcatggaatgactagccatggcacatagcagtttggaacatgagagttggcatctataaagccatcaataattgctaactggcacaggctgaacacctataatctgagatcacaggagtgccagcatctgaagtctttcctcattcttattcctgttaattccactactgtggtgtggtgagtcttaaacctaaggcctcttgcctatgaggcaagaaccttgccactgaactacagctccagtccttgagatcttttgagaatcaacatgacataagtaaaaaatggcaaacctggcccatacgaggggtcaaactgaacatataatgcaatgaaaacatgtaaagtgagcttcagtttatgtgtataaagattatggtatatactcatatataccatatatagagatatgagttcgatctctaggctatacatgtatgtgtatatttatatatccatatgtatgtatggatatatatatacacacacatatatatatatacatatatgtgtttatacacatatgcctatatatacacatagtaaattataagaaatctggaatagccgggcatggtggtgcactcctttaatcccagcactcgggaggcagaggcaggtggatttctgagttcgaggccggcctggtctacagagtgagttccaggacagccctggctaaacagagaaaccctgtctcaaaaaaaacaaaaaacaaaaaagaaaaaacgaaatctagaatattccagggaattcaaaagagagagtctcaccctacattgttactgtcaggatgatgtctgtggagtgctgacaaattcaaaaggaagaaacaaccctaatgcttttcctggaatgtactgaacagtcttgtgaagagcaatggcagacacgctgcctggctactctctacagctttcttttcctgcctctctacatctatgctttctttctttctgtttaatcgtatctctctttcctacaatcctcagagctgggggaagagagagagagagagagagagagagagagagagagagagagagagagagagaaccctaacacaacacgatttattttcctcacactccgttctgttttaataattataatatcgactctgaatttattacagtacaaggatgactttatatggaatctcatgaatttaaacattaatgtaagataaattagttttaaattgaatttctcaaatgcaattgaatgtgtttccgtacgatgaataaggaattttccaaataaaatctaaatctctgatgtttcattttggaagcgggtagaagaaatatgtggggatatttgataaggttgaaatatgattacagtgcaatagattagtcatgtgctataagctatttttaaactggagagaaatcatttgggatagaatttagtcgagaaaacaagatttctatgtatatctttattaagtctcattacttgcaactaaacataagctgtttgtacaatttttctctaaaaaaggacagggttccttacatttttaagaatcaacttcccttgtttttgctttctctccatgcgtgactctatgtgagtctgcaagtgcacgggtgcatgcatatgtaaaagccctgctgtgcacatttacatgtgaagaccagttgtaattctttcagtgtatgagacacatcattttatgagactgttttgttgttgttgttgtttttgtttttctttgcatatttatgttattggaagtcattttactgctatgttccattaacagaacaatcatagtagactttcaagtaggcccgtgccctatctagcctcaggttcttggccactttggcaatgtcaggtatgaatcccagctcatgaattcagcctaaatctagtcaaggaatggttggatactctcaacatttccgccactatttcagctatatatcttgcaggcatgtcactgttacaagtcacagggtttgtagctgggcaatattgatgttaccttcctcctctggtagcatgcagagtagaggtgaagtaaaatattatttattaattaaaatctcaatcgcagctttctctcccttatctccttccggtccctgctttcacccccacccccgctttgccccattctctcccttctccctttctcctcagaaaaggggaggcctcccatggatgttagcctacctacattagcatatcaagttgtagtaagcttaggtgcatcttcccctattgaggctagaggggaatcccagttaggggaaagggtccaaaggcagggaacagagtcaaagacagctcctggttctgctgttaggagtcccacctgaagcccaagctgcacatctgttacatatgcacagaggatctaggtcagtcctggacacgctctctggttgttgttgcaagctctgtgggcccctatggacctaggttagttgattctgtggtttttcttgtggtgttcctgatctctctggcttctctggcctccctctccctctccctctccctctccttctccctctccctctccctctccccctacccctctccctcccccctccctctctctctccctctctctctctctctgttctaagaattgaacttagaattcagttcccaatgcttgtttgccttactaaccaagccacctctagaacccattgctatctccccgcctctttaagctcctttctattaaatttttcccagtatgatctaccagggactaagaagattctcttgcaaagtaggccaagaggtagctgtcactgcggaagaaaatgcatctattaaagaaatggaaaaagcatgttctgcaccgtatcagacttggaattatggcagggatataaatgcttactggcatggtcaaggcctttgctcagttcctgggaatatattatggggagtgcacagctaaggccttaccaatattatttatcacacttcaatagggtgatctttttaaagtctggatgtgatcatggcattcccctgctctacagtactttcaaaatgctgtctaaatccctctcaacttgcaaagtgcaaggcatccatccttcattgcatttatctgtctccctgtcttcaaccccatgaagtctcttctaatctttaagggccatcttcccttctaccaatggatgtcatctactgacccactcacctggatgggaaccttcctcactttgctgatccaactgtcctggtcttagtattctgactaaacttttccaggccaatgaccgccatgaaacttcacactgtcagtttaatcactgcccctact

SEQ ID NO: 807 - DNA, 1975 bp, Mus musculus
tagtcccataattgccataacttataataaatgcataattacagaatcagccttttcagaacttacagttgctcattgaaatccggaatatatgtttatattatggtgtacatatttcagtttaccaaactctgtaaaaggaaacaaacccatttgcaaaatttcatttcttttattacctttagggttacttctcaaatgtaatggaatttggttatataaaaaaacaagtagacttcttctttataatttccttggcttctttccaagtgataggacatttttgcttcaacctttgctagcacatttcctatcaatagctgcccaattgcatcactactttgtggtcacgggcctggcagacccatatgggatctcctatgtgttatatacaatggatggtttctatttctgatcacttgtagttgaataaacagtgaagtcaattttgaattaggttcaggtgtttctatatgcagtacaactctctttgtatattgggagtcagttactatattaagagattcttgagaaatctaaatcactgtaagaattgcacagagctctgattttttttagctgaatcatgaggactctcaaccaccttatttatttttgtgactcatactctgtctttcctgaattattcacatcagtataaaatgtaagggctcaagcaattgaagtcccttttacaatatgagggagaatccaactggctctttttataaactgaagttgtttgttttttaggtgtttgctattaatattctccaaaaaaatgactccaaactgtttgccagtgtgcattttctgtctataaggaggccatttcagcattagtaaaaggcaccactgcctctgctggatccgtgcttgctgattgacaaagtctcatttctccattcagaatcagttcagaaacattttctatttatgtttactggttttgtgcaaaaaatatccattcaaagctatatctcagtcagtagagcatgagactcttaaacccagggttgctgaattcttgagtttttcctctcaaccccagggtcccagaataattgctctgagactcaaatatctgtacaaagagctaggccatggctctggctgttccctgattagaccataacttaatatatcatttattctctgccacatggctgtgctcagctgcagtgcttctgacttccatgttctaggctctttcctccatcactctatcccagaatcctttgtgcctactgtataaacctaaccctgttctggaataactcatgtggctacagcactggccagctctcatacaagcacctgctcttccttggatttgcagtcattgttgaaggtgtgaatggctgtgtgtgtgcactagctgctgtattcacttttgtggtttttatagatgcagtagctttgtgaattttacaaatgtctatattaattttgcatgttagaaagtagaaaattccagaagatgccccaactggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatcca

SEQ ID NO: 808 - DNA, 1675 bp, Mus musculus
agaacattgtgatcaataccaaagtgcgtaatccagattaaaagagagggtggaagtgctcttaaagatgtgcaagaaaagttttgtctaagaccaatactcttaactctaccaaatttccctcacatagttttgatgaacctcctaagcattaatgttttgtaagatgctcaatgcacctctcaattctttactacttttaaatgcatcaatagatatggaggtgctcacccatctctggctgtggcctggccaaatgccctgctctccattgttggtgtctctagcagctcaggtccatgtgggtttccatcctatgcagagggaagccagaggacactgtccccgaatccccatgatgttcatccagtttgattcctatcaccatactcttctctctgcctttggcctcacagcatttacacatcaggaaaatccttttgctatgttcctgggtttataactacaaaattcaggaagatcttgtaaagtcattgagctggaaggaaatttaaatataatttgctctgtcggctttcaaacttgagtgccattgttcgctgacatgaaagggtaagaagaaagttccacagaagataaacagatccgctctcactaaaatgggtttggagactggaggctccattcactctccctgcagacaccttctgcagattctacatgaacagttcacctagaccaagtcgggcccctcttttcgaccagacagcagcagtgaggaagtgtcttacttggtcatggtcactgtgaattcagcctgtggtccctccccagcagacctgtgtttttcgccagccccgccccctcccgctattctgaaatgaaggcacaggtgcagagcagagggctcctctgtctcaggaagggctgggagagatgagaccctccttctgctcatcctgccccaggactcagcatccttgctagcccgctatcactaatgcacaaaatgtgaaattgtggagaatcatttgccaatattcttatctgcactggcacagaagcgagcttgctggagagctgcgaggtgttggagtattgttgtttatccaccacacatccctcggctgcttgcacagagactcagaaaggttgcacacataaattcacataaattacctttacaaaatgtcagaattaaaagtggatttttattttggggacatgcctggtgaatgttaaccccttcgtgtaggtagccgtgccaacagtgggaagaacagtcaacagctttgagtgtaacacagcacagcaacaaacattttctctctcctaccacctacatagcaacctgtgaaaaaactgaagagttctacttaacaagctaaagacgtttctaaggtctaagtcagagcacaagtattctctggggtacgatactgttgtcctaggatgcctgtaatttgaattttattgtctgtatttaactttttaaaatttaatcactcacaggttctcaagagtcacataatctttttgggcttaggttttcttacgtattgctcaaatttgtgcactgtccagaattcacattctgtgttatttgcatgtgtgttagtattaagaagtgggatctttagtaggtaactagaccataggttttggctcttgaaaatcatatggctaaagaaagtgctgcagctaactagtcagg

SEQ ID NO: 809 - DNA, 1950 bp, Mus musculus
tgtttgttttttcaagacatggttctccatgtagccctggctgtcctggagctcactctgtagatcagattggcctcgaactcagacatcagcctgcctctgcctcccagtgaaatggattaaaggtatacactatctgtccacctacacctaattcttattctcaagggcattttaatctctgaggggccacttctaactgtgttttcttttgaaccctagcggacagatctgcctctgagtgacctggagcaaatgacttaactcccttgcctcagtctcctcatttgcaaactggaagtgggatgtaataatgccagtctctgaggggcctgtgctggggtttgacgagttaaacatgcgccattcttggaacattatctgacgaggaataagtgtttgagagacagcagcacatgtaaaggcttggcaggaccttgtcctgaccaacttttctgatgtctgtcaatctcttgtccttcctgcatctcattttgctgacatgataatgcttctagacttccctatttcttagtggtattgacagtcatatataggcacatgggcctcacttggcatagcaatcttacagaagctattcatttttgtgaaggaaatgattttacctaatcaattcctcctttgaaaagcagctctaaagaggttttctgcagggaaatactgttgctgtaacattgatatgccagccaaagctcagtggcccaggccaagaaatgtcatcctataagaggagctattatatgtatatctctcagtgaagttttcatttgcattctgtaaacatagggatttgctcccaggcctgagaagctgtttctgtgatcagcacctgtcccatctctggagagactcacaccattccagtatctcctgctcctgggaccttcctaggcactcttctggagtctcagcattgagtttgtgaacccacgaatctgaaggccacggtgatgttccgtgcccccagcattctaatttggcacctcttcctcagcatagagcttcaaagggcttctgctctgcgtaaaatcggctcccggcccaggctgattctgctggcttcgcgtctgtcagtgtgttctaatcactgttataagtgtggttctgtggaacaccttgtaaaatattttcctattgctccagcaacatctcctgtctagacaatgtaattatgagcacagagcaaatagctgaagtgtatgccgcccccaagggttgcataactccaggagcggggctggggagacagagggaggtgtggatgctgttacaaagtcatgttagttacttttgtgttgacctgaccagaaaattgagtgtaccaaaggaatctgaataacttttaattaagaagaaattatctggagcaagctggtattttgttgttttctcaaactcgggggattaaagacaccaatggaattctttctaatcgcatttcccccttggctttagaggtggtttgtggtctttgctttaggaggtttttttttttttttttttttggacttattaataatctttcctccctgtggcagcattttgaaaatcaaacagagctctataaatgtagttctttttaactaatatttaaattcagtttggtgaggccgtcttgggatgaggccatagtgtgtgcattggcatattgagtacctcagaacaagaagacagtccctgcatcaacgatgtttaacttgcagggaggcagattggtacacactgtgcacatgcttctaagcgggctctggtctaggttccagtattgagccaacatgtcatggtcaaggggaacgaaagagaatttgttgtggatggaatgaagaaagcctcaggagggagtaaaatggacaggttcctgtagagtcacctgtagacagcagtcacaggagtggtgaataggtgatatttggctattgtgatgtgcca

SEQ ID NO: 810 - DNA, 1900 bp, Mus musculus
ttgctctttaacagcaatgtattgtattttaaaaattccaattggatgtagaaaaattcaggagagattatctttattatggattgacgagaaaggaggaaataaggtggtttaaaggataaatatggaaaaactgactagttttttcatgataaataaaataaaagaaagcaacagtgtactcacatatataaaataaataaacacatctttttaaaaatatgtatttatttattatatctaagtacactgtaactgtcttcagacaccctagaattgagcatcagatctcattatggatggttgtgagccaccatgtggttgctgggatttgaactcaagacctttggaagagcagtcagtgctcttaaccattgagccatctctccagctcaaaaaatacatctttaaccaaaaaaaaaaaaaaattataaaaacttaaatcttaggcgcatgtcccagccccagcacaggaggcagaggcaggcaggtctcttgagttccaggacagcctggtctacagtgtgagttctaggacagccagggctacacagaaaaaccaaatcaaaccaaacaaaaaatttctacattttaattctgtataaaagctccaactcaaatcttttttactgtatgtttacttgtaaatctgtagaatttctaagtacttgttcagagtccttcagacattaagttagaagacaacagtaagcttatctcttcctgaaagcaacaggaagaggtggctgctaattgacatgctcttccctctagccttgaatgattatgaaattcccagactgttacagtggagatgagttctacacagatgagctgaacagttgtcactgagaatggtgatggctatggcagagaggagcacacaccacacagtcggagacagagagcaagtgggctagctgtgcaagcctgtgggggagagaacaggacagcctgagagtcagacagactctcacctgccactcacttccaaaacctaactgcagcagggctctgctgcactccccagcactgtcgcagaactccaaacaaaaactggtgcatgctatgaaagagaggttcatgactagcgtttttcctatggaatctttgttagtctgttttctaaaaaaatttccatgataacagtttaaaagtgcatgggaagtctcttacaatctgtgaagttccttaactttcattgttttctcctatagaaccactatagacagctcatttcattccctttaatggtatagatattctgttgtgtgatgggtatgttcaagtaagtctctcgttttcccattaaaaggctacagcaagcatcgcccagtgtagatgttatataggtttctgtgaatagaaacacaggcttgcatatctcccttctccctagcagtcaattggccacttaaatcagatacctgacaaaaggacttaaaaggtagaaaaaaaaatatggtcttgggcagaaggagccaggagtgggtgagtggaagagcgtgagtagagaaggacagggtatgctccacagacccagccccacggcctgcttccttcagctccgtctaacttcccactgctgtgaagttctagaacctccctaaatactacccccactgaagtgccaacttttaataaataatcctcttggggttggggaagcaattcatagtcaaaccaaatctaggtcaagagcacacacctttccttttaatagatattttcaaggcttatttgaaagtctaagcagtgatcattgatagaaaaggattttctgatattgcaggaaagctgtgtccacagtttgtagttatccatttggagtcttaagtttctggctcaattcagaagtgtaggagtaagaaagcatgggtgttgaaggggacttcatctc

SEQ ID NO: 811 - DNA, 2975 bp, Mus musculus
ttggaccccagcactcatgccaagcagctcacgaatgcttgcaactccagttccaaaggatctgacatttcctttggcctttatgggcatctaaatgcacagacacatacacaaacagacatgggcacacagatgcacacacacacacacacacacacacacacgggcacacagatgcacacacatacacacatacacacatgaaataaatctttaaatatggatattaaaatacaaggtaagttacatttaatatgctgctatcgagttcccttccccaccccaccccacccctggggattgaacccagggccttgccatactagcacttgtcatactagaaaatacaacacctgttaagagaactagatgaaaaggacattttgagaacactcctaagtccaccactcctcggctctggatggacccataagtgccatttagatactcatccttgtcctgcttcctagaatcaccagaatatatccctgcactattttagattgctgaaagcagatacaaaatccctccgtagatctgcctctcagccagttaccagaattttgacccaatcactccccactagttatggtctttaggaccctaatcgacagcctctttccgaccagcaccctctcccacagtgagcaacatacatttcagcagggccatttcagaaacatagaatcagcatcatctctgatgcgtcaacgctcatgttgtcttaaaaaagaggtggaggctggcttaatgtgatttccttttaacacattgggttaagtctctacctccccaccccccaactcttgtctctgtgtcagtgtttagggctagctctcagtcaattaaaagtcctctctgactctcatccgtgccatcagaggtgaaggggaaacagggtgccagagagatggtgctggcagagtggaatgataggttccttgtgcttgtcgaggaagaagtttctgcaacctcgggaagctgctctctgcccactcactcccagatgttctcagctcagcccaaagctacaataaaaacaggggagggagaggaagcagagatggcattgggcactcgcaaggagtgtgccttcctgaagccacacccaatcattgcccaagagatggccgctgggagtacctacttgagacttatatcctgagtgacagaaccagaaacccaaagacatttagaacacccaaacaggtgtctagctccattttccaactatagccacttgtttgctaagtggccctctgtcgcctgtgtcggaagatagtctaaaaggattcttgatgatgtagaaatggtttcaatacagaacaaagaggttcccagaaatatttataatggcattattttttgtggtgtttgtttgtgtttgcattctgagtattcttgatacagagatgtgtgctggggcaaggggacatgagaattgaatacccgtggtataggtgatccttgtaggtgcccctgcaaccctagaatatttcttccctttgaactgcaagagaaagagaagacaaaggagacgtgtgggttgaaggggcagtggacacccaagcacccttcccttcatgttcccatggtagtgatttcctaagggctggatgactcacacctagagaggcactagcttcagctcagattgcagtctcaacagatattcctgaagtagcgcaggttctcttatccccatagcaaccagcacaaatgcaagatcttttatcagacaccagataaacctcttggatcttgaagcatgggaaggaatctcttgtatgaccagcagaatggaatctgctgccccaggggcatgtgatggtctatatatccttagcccagggagtggcactattaagaggtacagctttgttggaataggtgtgtcgctatggatctgggcttggatacccttgtcctacctgcctggaagtcagtcttctcctgtttgccttcagaacaaaatgtagaactctcaactcctcctgcactatgcctgcctggatgctaccatgctcctgacttgatgataatggactgaatctctgaacctttaagttagccccaattaaatgttgtctttgtaagagttgccttggtcatggtgcctgttcacagcagtaaaaccctaactaagacagggcagaatgctggttcagtagtaggattacactgagttaaaagaaacataggaactgggcttcctatactttggaggcaggaagatagcaagttcaaggcctgcctggactacagaaggagttcgagaccatcatgggtgacacattgagaccatctcaaagcaaaaagtgaaaataaagttgagagtgtagcgtgctgatgaaatatttgcccagaatctgcaaaacattgggttcaatcccagtacccccagtacacccttacacccctgcacacacactcacaaacctaccccacatacacacacatacgcacactcacacactgcataagggaagtaaaggtttcatgtgtacgtatatgttcctaaacagagtttagacacattcacccatgcaaggtcaatgaaatgtgtttgtgaacagaattcctgaactgttcttttttaaaaatgaattatttatttatttttctatgtatgttgagtgttttccatgaatgtgtatctgagaaccatgtgttcagtgcctgcagaagccagaagacagtgtagaatcccctgggactggagttttaaaagatggttgtgagccactaaggtgctggaaatcatcaaatcttggtcctctggaggagcagccatttctcctaattaagaattagtgcagtctagaggtgagcatctttctagctctcaactctgcaacacgagttctaataagtcaggatagctgtcaccatccctaggacataactcggcccttttaatgaacctctgatgagtccacacttccctcctatactctgggacaacacacaaaaca

SEQ ID NO: 812 - DNA, 2875 bp, Mus musculus
tttcctcgggttcaagacccttggaaaggcctgtatacttaccgtttctccttgctcctactctctctccccgctttacttctgatagactgtcctgaatttcctctagaattttcagccctatcttaaccactatataacatgtgaaaaggaacagaagggcttctaacactagaaaaaatttaaggccaaacataacttgtaaagccattttccactttacttctgatagactgtcttgaatttccttagaaagttcaagatcagacttacctcgttccccagctgaaaagttctgaattcatacagttgaatccttcttaacagtctgctttacgggaacctttatcaccgtcgttccccagctgatgagttctgaattcggcagttgaatccttctcaacagtctgctttacgggaaccttataaccttgattcgcagttctggttctgaaatgaagtatccctcctgcgccagtccggagttttttctcgtcccggaattcggcaccaattgttattagacgcgttctcacgaccggccaggaagaatacaacaaccagaatcttccacggcaaagctttattgcttatatctttatcgggccagagtgtaagaagcaagagagggaagcaagagagagcaagaagcaagagagggaagcaagagagagcaagaagcaagagagagagaaaaacgaaaccccttctattttaaagagaacaaccattgcctagggcgcatcactccctgattggctgcagcccatggccgagctgacgttcacgggaaaaacagagtacaagtggtcgtaaatacccttggctcatgcgcagattatttgtttaccaacttagaacacaggatgtcagcgccatcttgtgacggcgaatgtgggggcggcttcccacactccagagtgcttgtcagaagcccttctatgagccccatggctctctctatacttccctggttgtgatattgactcttctatacggttctatacggcaaatcctatttgcttttttctggattgctttctcagtgctatataaattctttgaggatatgaactttataactgtctaaatcaccaatatggttccaatccctagcacaaaatctattacacaggaagtattatgaccaccacaaaattcagctgctgactaacgaggacagacaccacctattgagcattataattccaaagtcttttttgagcttcctaattgttttaatatctaattaaaaacctaattgtttttatattattactgggcagtgatatagagaagctgccatgataataatacgtgtaaaaaaaaaaaaaaaccaagaaagtgcttgtggaaaatatttagcactgaagggagaaggaagcagagagtccttgatcatggctctcccggaacacatttgtttggaattgggaaccgcattactttcagcctttctggtagaaaagaatcagaccaaacactgaatctctgggctccctctcctctgttgagctctttatgtgtttgaactggatatagtccagaggggtgtcacccagaggctcagagtgagacacgtttccaggtcaatgactagaaacaatcacacccaagcctccccttagggcacttgcctaaactaacaggcctacatgtcccccgtcttttccaggacaaggttctcagtgctaaaagaatgccacttgatccaggttgcattacttcctgactaatccagctcctctttaattctctttgttcaatgggaaattcttgggaagctttgcagagcagatgggggggggggggctaaacctggaagcttctttgaaatgcccaggcaatcaaaagtagcatctacttaccagaaaaataagtattggataacacaaactagatcgagacagaggttgaattatcttagttccttccttgcatatttcagcaataagcaatgggcttcaatcctgactacacataagaaccacttaagagtgccaggccttggtggcacacacacttaatcccagcacacaggaggcagaggcagttaagggggtgggggtaggggtgggggtggggtagggatgggggggtggggagagtcatctgagatatttaaaacctttagtcactcgaactcctgattggtaatcctacatgtactccaaaacttgttttttaaaaggcttctttgaaatttattaactatgtgactatagcacttaaaaagtggtttatgggactggagagaaggcgcagaagttaagaatatctgttgctcttttagaggacttgggatagattcctagtacccacatggttgcttagaattgtctgtaactccagttccagaggatctgatgccctcttccggcatccgtgggcactaagcacacatgtgatacacaaatatatgctgacacacagataataaaagttaaaaatttaatttctgaccaccattcataatttatcttcaaacccaaagggaaaccactgcaatgaggcttgcctgatagggttagtggaaagggtgcatggaagagtagagtccctgcatgatgccttctatgtggcagggatcaacggctgttcacatccttttccactccactcaccaagtgccagcaccatgagcaatcctggaatcccaaaagccaatgcatagcagtcttcgccaaaacacttcacatcccctgaggaaaacaggaagggaagagtgattgtgactcacgagtctgccatattttactctataaggtcaggctcttggtgtacgcatagctatcctctcttcttcccatcatctacccccataacccttcttttaaatcagaccagttgaaactaaaacaacttctcacatact

SEQ ID NO: 813 - DNA, 3400 bp, Mus musculus
acgttccaatctggttgtaaaccataattttgttggactaatgacttgatcagctgtgccaaaataatgtaagaaactaagatgttgctgagcagacatgtcctatccaggttcatgcttggtgttgataagctgaggctattgcctgtgttctcggttgcaacgtgagcagcttgaattcatgccttacactgagtcattctttaatggggctacgaactaggaagtttgggtctcagttccagggagaaagctaatgctttcaagttcccatggaactttttttttaaaaagaattatttatttttatgtatataaatacactgtggctgtcttcagacaccccagaagagggcatcagatcccattacagatggttgtgagccatcatgtggttgctgggaattgaactcaggacctctggaagagcagtcagtgttcttaactgctgagccatctctccagccctcccgtgaaactttaatccttcccttgctgcttggtctgggctcctagacaccaaagaaaagcctggtgtgtcagttttctgtcactggttccaaatacctgagagaatcgatatataaagagaaaaaggttattttggttcacggtttcagtacacagtcccttggaaatgcagtacatcatatacatggcagtagagacctactcgccgtgggtggtcaggaagtaaagagagaagaaggggagcccaccttgatacccacttcatggatgactgaacttccctctgctaggctctacccacaatctctcatctacttcccagtagttccataagctcatgaccagtacatcaatacatgactttggggggacattcaagatccagtctaggacctgggtacccatgtggcctagagctatagcatattctagtttggtgcttgccacatgttgtcttgagttcttagaatcagctcataccctggttccctgtctcaagctccaactcagtgtcccacctgggactcagtgtttccctccaaattataccttacccgtctcatctataccatccccttgcctggatttttctgctatgtcaaggcatggaaagacagaactgtagggcatggcacgtctgccttatgggaccctcaagtgagtcttgctcagttcagagcctctgaaacagcgtggcaccactccccgtgggaagttctggacaattagagacatttgatcatcacaatcactggtagtgacactgatggcatttactgagggacaaaggacgtgctgtcatgcacaggcacgacagtcaacagatggcatgtatcctctgtaacctcaaaagtcacacagctctgactgaaaataccgcttgtaatttcctgagtatgaaactcaatcccactttatttgggcacgtaaattagttttgtaaagttctaacatagaattttgaggcaaatggcctttcaacattttttaaagcaagaggttatactttgtttgattcagaactctagcaaagcagcctcaatgtcagaaaaggacttccctggaagcaatacccctcttggcactttcattacctgcccacctgtcctcatctacgtttgtctctgttgtgttcattctgttctcaaattgtgccttcttgttagccacccccacacatcaacatacttcaatgcatattattgtattgcaaattgttccttttcaccagtgttttctttattttcaagagtattgagtttttaaaaataggaatgagtgggtggtggtattatttgtggatttccatagttaagaggatgcaattgaaacatttatttaaaagttgggcctgatagcgttgatagtcattgacttccgtgaacactgttgggctcattcttgacatcacaaaggacccatgacagcattttgtgttatgggaaaaggctatgctacttacttagaggacacataggtggtagaacttgtaacctttagaactgaccacttcccatttcctaacatgttcctttcttaggaccttagaaactctcaaagtagaatccagggccactcagatcagtaagatctatgggtctcatttcacagtcaactcacaaatttattagtccatgtttcttcttagggtcttggaagctcatgttcattgtccagagcacacacagcagggcgacagtgggtgatcatgaatactgtgcagggcacttgggtgccagggagagtccagtgcaggcactgttgacccacagctgagcattctcttccagtaaccacaaggaacagacaggggtgtcttccacacagtgcttgggaagggactgccatggtacagttctttggactttcattttctgtaatcaacccttaccaccaactaccaccaccactatgtttacacggtctactgctaaacaggatatggacattacaattgattaaagtctttaaaggacattagcactctggacctgttttcctcttattacacccagagctcctgttgcgcccacctcggctggcaaggaagacacaacacggccggattcttctcaacagcctttattgcaggaacacctcgatgctgctacagggaccctgggcacccagggaggtctgcttatatgcaccccagcacagggaaaggcttcgtgtcctcctgggataggttgaaccgctgtcacctaattagcgtgtaccggctcaggaggggttggtgccagacttgggcttatgcctgcacagtggtgttatttatgacaacggcacaccagaaaccggcgccatcttagagttggcttcctacaagctcccaccttgatcgtgggtatattgggtcagcccgtttcagacagccttccatttatccaacaatggttgacagcattcactgtctttgtattccacgagtttgactcagaaggtgacctcatacctctaatctccaaatttggggaggtggaggtttcccattggtgcttctgtattctgtcaaaggtgatcttcaggctcctttctgtctcagcatcagtctctaaagctgggacaattttctcaaaagtgtgtgtgtgtgtgtgtgtgtgtgtgtatacgtgtgtacctatgtgtgtccatgttcacatgcatgtgcatagagatgcatgtagacaccaggggcaacccaagcagtatttttcaggaaccatccaccttgctttggagacagggtgtctttttttttttcaatatataagtcttttattctcccaaaagagcccaaattgttcttgtgatcaggatctcgtttctggggccaggaactgaggcctcctcactcgtcagcctgctgcacagttcccttctcagacacatagatgccgtccaaaaacttcctgatatccttgtttttaactgcggtggcttgctgaat

SEQ ID NO: 814 - DNA, 2575 bp, Mus musculus
tatacctttatcaggcaatatctgtactctgcttccaacatttatggtaaatatctgttgtataaggtcacccttgactagtttgctgtttcttaagaaatgatgacaataacccacagacacaaatgcattgctctccagaccaagcacataggaaaatacacaatttaaaattaaaggtatgcactaatttaggatgtaaaagttaattatgtagaaatccaaggcaagtaatgttggttgtgacactgttctcctaaaacagcagttctcaacatgtgggtccctaccccatgggggggtggggggttcctgtcaccctttcacaggggtctcccaagactatcagaaaacacagacatttatattatgactcataacagtagcaaaattacagttatgaggtagcaacgaaagtgattttgtagtagggatcgccacaacacgaggaattgtactgaagggttacagcattaggaaggttggaaatcactgtactaagggaaggttcaacaaataatctgagcatatagcagcatatctggttgattatatagttataaatgacctccacgggtattagcaacttatctgtgagggccaatgaaagttccagcctcttagaatgtaaaaggtattttcacaaaaataatagtgctacgccagatcaccatgaatagttgctcatacatcacgcctcgaagagccatctgttttgagaaaccaacaaattaaaaataaaattgaagccacagtttttttctaaataaataaattattttgatttttaaaaatagaaattaaaaacacagtcttcttcctgactgaggaaaaaataaaatattcattcttaaaaatatgcatcaatcccacttgggaggtagaagaaagcaatcatggagtgggggtcagagggaagaagggccctgggtgggagaggaaccagaagggaaaggaggaacatgatcaggtgttagggtggaggaaaacaagtgaagccgtgcgggccagcagaatgaacagaaataagcaacctctggaggtaagaggttgggggaccctctagagtataccagagacctgggaggtgagagactttcaggactcaaagggagggaccttagatgaaatgccctacagtggggagagggaacttgtagagtccacctccagtagaaagacaggacatcaagtggagggttaggtttgccatcccacagtcaaaaactctgacccagaattgtttctgcctaaaagaactgcagggacaaaactggagaagagcctgagggaagggagatccagtgacagggccaaagtgggacccatctcaagaggaagctccaaggcctgtcactattacagatgctatggtgtgcttatagccagaagcctagcagggctgccctctgagaggcccaacaagcagctgaaagagtcagatgcagacacttacacccaaccaatggacagaagccaggaacccctgtggttgaattaggaaaaggctggaagaagttgtggaggaaggcgaccccataggaaaacctgcagtctcaaccaacctggatccctgagatctctcagacagacagtgagccaccaaccaggcagcatacactagctgaaccaagaccttcataccaaacagacgactgcctggtctggcctcagtgacagaagatccacctaaccctcaagagagtggaatccccagggattgagaaggcctggcaggggtgggggtagaggtgggggtgggtgggtacatcctcttggagatgggggaggaggcatggatgagaggaactgtccggagggcagaccaagggtggggaagataacgaatacaaattaaaaaacaaaaacaaaaacgacaacaaaaaaacaggatcttcttcctgcctccaacaaactagcagtgacacacaagcttcaagtatggcaggttatcttaggaccaacatggcaataacaaagccttctgttcaactttattgcaagtttaggtcaggtaaaggcttttacaatcttgttcaaaattctttatcaatgggatctctgctactcagttgtcaaatcatcctacttagctttgtagtctgttttctcttcttatgtgggggtagtgactattctatatttcatatagaaaatgcatttacaattttatatttaatatgcatttatattctgatacagcctataattgtactttataggttttaaaatattatacgagagttccctatagacaatcagcaagatagaaggagaggtggatcagaggttaagagaaccgactggctttccagaggacttgtgtttggttctcagcaactattctgccacaacatctggagctacagttccaagagattcacactctcctctggtctctgagggcaccaggtatacacatggtattcatatacataaaaagaagttatgcaaaacccaggaaaagacagtaaaaaacaacattttaaaaacacatagtggacctccgattctgaatctcactttacattttttgacaagttaccttgggcatattcattttctaaatccttta

SEQ ID NO: 815 - DNA, 2050 bp, Mus musculus
ttctccacacttaatgtaatgatgactatagcttttcattaaatagctttccatctttggtttgagacagggtccctcactggtctgaaattttaccatgtaagctaggctagctggtcggagagatccagaaacgcacctgtctctagtttgacgcagtccaagactgaagttttctgctcagggttctttcatttttctatttattgaacattttctctcaaaatttcaattttatttttccttattttctccttgaatccattcaggagtttatccatgcactttgcttatttatataactacatgataagttatataattatccttatatttttaatattaactgagcactgatgcctatttttacctgactgacaattaggttaactaactgaagctattatctaatgaaaacattacttctaccatattttccatttctgggtgttttatgctaatttatctaaccattgttatttatatttaactgaaattgttctgtttaaactgctatgtctttagagtacattttaatcatgaatttaaaaaaaacaaacaaaaacctctgcttatttttttcaggagtgttctagctacctcgtgacagtttctaattttaaagcactctgtctagtttcaaaatatatttttttttaatgtgaagagaagtttctatcaaaggtgggaagaaaaatcagcccaagtgaattgttataataataataataattgttgtaagaatgtttcctaagtaaaatgaccagtaagtattgaggttttgttttttactgtctatttagtaacgctaagtgcgacgacccccaagacctggagtatgcacataattcctggacctctgccaccaccaccccgcccaagcccccagttaattctgattggtgtgaacagccaagagctggatagaagagtcatatgtgggtttaggtttggatagagaggacccagaagagggagggcagaaagaaccttccatggaagaacatgaaggaaggacaaggacagccgccgtgggctaagggccaagagcacgtggccggcagggagggctgcctaactggagtgaagagcaacccagatggaacatagtacattgtaagggatagcatgggcttatcaataggaaggtagaattgaacagcctggaaagtaggcacccgcccagctatcgtgctgcctaaggctatttaaaaatgtaagtctctgtgtatcttcacacaggatctgaaatggtctaagaagcctagggatggtatgttctcatttactactaaaggtaaacgtaaaaggacccttcagctgcactgaaaagcttgctcaccagaactcagcactcactcacaacccaaccgcgacttccgtcagctttccaccctacctgctgattctgatactgccttaagctgcacaaaatcagcttcatcaactagatcttttggagccattgaacataaggacaacagaagtacctggggaggctgttttctaatttcttttttttttttttttttgaatggggaaattacttttaattctttaacatggtaagataattattagttaaagcaagctatgatatctttttttttaatttttaattttttattacgtattttcctcaattacatttccaatgctatccaaaaagtcccccatgccctccccccccacactcccctacccacccattcccatttttttgaccctggtgttcccctgtactggggcatataaagtttgtgtgtcagatttgatttaaatagaagttcatgagagagagagagagagagagagagagagagagagagagagaggagtctgaataaacttgggttcaattaaaaaggaatagaagattcaaatagtttaaaaatagttgacttggtaagaaaacaaatgcctttactctcctcctgtatttgtttcattaaatagctttagaaatgataactccagcaaacagaactgaatctccactccagcctttctccttagtgtcactctcttgcccataaacaagtccccaagc

SEQ ID NO: 816 - DNA, 2800 bp, Mus musculus
ttagagttaattaagaaaggcttttatatagatctaagtaggggctttgaaagagagaaagatagagatggaacgagatagaaattgaaaggaagtgaggacagctgcacctctctctctctctctctctctctctctctctctctctctctgtctctctctctctgtcttctcatgacaaaatttttttcctccctctcttcttcctttcactccatcatttctggaatggagaggtgttatttgttatttattttcaaactgggccttactgtgacttaccatgcctggttttgaattcttacatagcctacgatgaacttgaattcaactactactgtgaaccccatattggggctctgcttctagtctagtcttttcttttcaacccccccccccctctctctctctctctctctctctctctctctctctctctctgtgtgtgtgtgtgtgtatgcttgtgtgtacttgtttgtcatgtctccatgcccccatgtgcatgcatacagaggctggaggaagtcaagtgcctttccctattgctgtctccctattctcttgagacagggaacttcagtgaattgacactagcagtttcctctcatggaatgctgtcacacctggcaactgtgaggctcagttctcctctctcatgaaccacacttggtgcagttacaagtctttgaagacttgtaactcttcttcagattttacacagaattgtcggaaatgattttctcagtcatgctctctcctgttctaagtggacactcatctattacataatggccaccactctgtggcagctcacgcgtacctatcagaatggcttcaatgcacctagagcaaatctgataaatgattgatgggacctaaacattcctgaactcacagagtcaaggtctgcccaacggtctataaatttgtctcagtttacctctaagagtgtatgtcaggcccaaatcatgagtccctagctctcgagggagattctttaggaatttattaaaatttttaactaaccaaattctttttacaagcagaagcatctttccttgtgtgttcctatcttttcttacacttcaggtctttctatagccttggcttttatcaattttaaatatgatatgtgtttatgcttatctttccactttttattttcattcttataaatctggcaaggaagttctcttaagcttgttagatagcacatggaaattagaagttaagtgttttcaagaaggtttggaacacacacacacacacacacatacacactcctgtatagaactgtggatatgcagagaactttattaatggtaaaattactgtagttaaaaattctgagtatggcttgtgtctctggctaaatatatctcaaagaacattcttcctaatgaagcaaggctaagaagaacatgtttgttttcctggctgtcgtgcctgccagttcccctgccctctcccactctctcttttgttttctgttgtcttggttgatttatcattatagtgcaatccacgtgtttccaattaggactaattctatgataaatcccaccaacgctagcgagcatgtattcagaactctggtacaaacactgtctcacgagctgacctatgagcccttcgcccaggatgggagccacacatgattccccttggcaggtggcttcccatctcggggcttttccacatttgtctgctgttgctccgtgctcaccggctgctcttcagtcttctttgctgattcattctcatctaaccggttccttaaactggagcgtctcaggatggcgacattggatctcttctcttgtgtcctaattctcttggtgatctcatccagtctcatgattttagaacaatctaaatacaacaagctgaaatttcctatcgccagccaggatcagatccattgaaccgactccccatttaatatctctccttggttttctgacacctaagatccagcatatctcaagtgaggttccagaaaacattgtaccctagcctttcttctgctatggtctttgctaactccattagatactctgccacctttctgttagctcacctgaagacctctaaagacatctgagactctttccattcttctctcacgcatcaaattcagtgcagttacaagtctttgaagttttctttttcagattttacatgggaatgtttttctttctttctttttcttaaaacttattcttctcttacaatacatcctgatggcagcctccccctacctgcattcttctccttcatgctccaccttccatttccccaacatccactgctcctccagttcccttcagaaaagggtaggcctcccagggatatcagctgaacatagcataacaagatgcagtcagactaggcacaaatcctcatatcaagtctggacaaggcaacacagtaggaagaaaagggtcccaaaagctggcataaataaataaatatcagagataccctaaacccccactgttaggagtttcacaataactccaagctaaacaaccacaactcacattcagtacatacctagtacagactgatggaggttctgtggttgcagctccagtccctgtaagtccttgcgagggctgcttagttgattctgtgttctcctggtgaccttgacacctcttcctcctcttctgtggctaataaaagaaaatctccagcacaagggggggaaactactccctagaaaaagcaagaaagtaatctttcaacaaacctaaaaaaagacaaccacatgaacaaaatcccaactctaacaaca

SEQ ID NO: 817 - DNA, 2050 bp, Mus musculus
ttttttctggatagatttattaagagtttgggtagaattattatacttcccaaatgtccttttattatggctagacattcataacaggagctttttcatcagcctagaaccccacatgaacatgaaacagaggaatagctgattggcagttgtcaccgagcataaggaagatacaaatgttattatgataatttactctaacttgagggacatttgttatggaagaataacatggcttattctgacacaatctgcagcctgattcgtgtatggcagctcaggcacaatactcctctgacacaagattcttctaaaaatctctttaaaaaataatgatttgaaaataccaatcaagtatggataacttaggattttgttaatcaaattgaaatactgttttaattgatattcttatttgatgttacagtctgattttaaaaataatttattcaaaatacaagatcataggcagaacctctcaaaacacccattacagaaaccaatatccacagatttgtcattttgttaaaggaatgcaagggcaaatctaactacagtagaacgaagcatagatgtttcattaggtaatgtgcattcttcaaatataaaggcattttaggcacaatgaattatttagagtatgagaatattcagatctaagaaccatttctagtgcccttcataacagcacttgaatatctgcagacaatgacagcagatggtattgccaaatgcttgctctattacatttaaaacttcctgtgggagagcgttgctttttacaataaaacaatcacctaaattcaaacattaaagaaacatagaggtcccttaaaaggcaaactcttcacgagtggcagagatcatttctcacgctgaacaattgtgtagagctgtagtgatgctcacgtcctttccaattgtaaccagatgcatctgtattactagactgttctgccgttgtggcattttcagcgaagaaatgctgcaaattttactatttaaatgtgtgcctgactgtagggagccacctccagcaggaagacagggcattaagtgagggatagggctgccattcctcagtcacatctctgacccataattgttcctgtctgaagaatgacagggattgaaatggagaggggcccaaagaaaagaaggtctagtgaccggcccaaagtgggatccagctcaaggggaggtctcaaggtctgacactatttctgagggtatggagcactcacaaaaagggacctagcataactgccctccgaaagaccccaaaactcccctgaaagagtcagatgcagatatttgcacccaaccaatggaaagaagccgctgatcgctgttgatgaattagggaaaagctgaaagaagctgaggagaaggcgatcatgtaggaggaccagcagcatcaattcacctggacccctgagatctctcaaacactggatcaccaaacaggcagcatacagcagctgatataggtccccaacacacatacagtacaggaccgaggggttttgttcattaagaaatgatacaccaaccttcaagagattggaggccccagggagtttagaggtcaggtggggtgtggggtatggacaaccacatggagacagggccatggggaggaggtataggatgtcgaacagtcggagggtggatgggggtgggggatagaatatggagggaaaaataaattaattaaaattaaaaaactaaaaaagtgtattttcaaataaatcattaatacccaaaagatattttcacgtcaatctgcaatatgagctctagacgatttgtctcacactgtggtgcctactgaggccaatacaaacttcattcccttctataaaaacttatccttaatactactcatactgagctcaggcaataactgtcactcttagccattatctcttttagtccagaaactctgcctcttctatggtcatttctcagctcagatagtttccattcctgtttaaaggtagagactgatatttcacacattcttgctctgaggtcttttgccttatga

SEQ ID NO: 818 - DNA, 2425 bp, Mus musculus
tgaaagcatgctgcttttgtgccaattgagggaccagcacatgatatatcctaaggttgtgcccccttgcaacctctctgtaaccaataaaattgtgtaattgtgcatgtgtaagttctatatcattaaactcatataagctcataaccagggcacaatgaaacagcctcacagcatctgtcaaaatctaaatcaaataagttccccttgcctacctgcaactgaaagttcggaaatgttaaattaatgcttaattctaatttaggaacaattacttcaaaatggcaaagtaatcattatttttgataaaatatttacatataaaggggtgggaaaggggtactatattgtgaacaagcaaagaatgtgaagtcaagacgcagatcttctcttaagatgttggctgtgtacactaatgataacacctaggaggctaacggccaatcacacattcaaattaatccctttctttccaatatttgaagacagtctttctatatggttcaagacaggccccaactcaggacaacacttctgcttcagcctccagagtgctgagagtgcaagagtgcaccaccagaactggctttctctttctttctttctgtccccacatgaacaccgaatttacagggtagatgaggtcatggtctctcacttctcattttgaagggcacaacaaacaacccagagaaagatcttgctaagatcagaactccaatttccaagatcgagacgaagttaaagttttgctttggaagtcatttaactattcttttttcatttttaaaaaatatttccctttattggatattttctctattaacatttctaattctattcctttccaggtcccccctccggaaatcctctattccatccctctttcccctgcctctatgaaggtgctctgatctactcattccagccttccagccctgggattcccctacactttggtatcgaacccccacagactcgagaactgctcctcccactgatgttcaacaagaccatcctctgccacatatgcaaccagagccgtggatcccttcatgtgtactatttggttggtggtccagtccctggagctctgaaaggcgtgcctgattgatactgttgtcccccaccccacctcaccatggggctgcaaaccccctcagctctttcaatcccttttctaactcctcaatctgggatcccaagctcagacaaatggttggctgccagcatacacttctgtatttgtcaggctctgacagagcctttcaggagacagacatatcaggctcctgtcagcaagcattttccagcaaccacattcttaatagtgtctgagtttggctactgtatatgggatggatccctaggtggggcagtctctggatggcctttccttcagtctccatactttgtctccatatttcctcttgtgagtattttattcccccttctaagaagcactgaagcatccaaactttggtcttttttcttcttgagtttcatatggtcagtgaatagtatcttgggtattccgaacttttgggctaatacccacttatcagtgaatgcataccatgtctgttcttttatagctatgttacctcgctcaggatggatgcaaccatttgcactatatctgaaagcactcagtttctctgggagatatttaatccatactagttggaaatgaataatcttggaaagttgatcaaatgtttgttctacctggtggcttaggccatttagatctctcatgatcttagataacttataaagtgacttgtaaaggtaaaggcttcttcttttctggtaactaaatagtacattttctataatcacacaaattttatccatgagataatcacttcattatttgtttcttaggaggagaaaaagcaaactattaacacaaacaaagcatgccttgttttttgctttatttcatctcctccctaaattgcttgccatatgaggttgtgatgatggctggtagcaaagcttctttattacctaagaaattaagtaatgttctctactcttaaagatgcttattgttctaaatagcagccagtgttggctgtcaatgccaactcccaaactcagcttctttattgctctgtttagcatttgatttctctgcttgcagctcagtatccagcatttgtttctttcttttaatagctgtgtgaattacatatgcataccctgggacctgttagcaacagacctattttgtcagaacaatggtataaataaattcactttgagctctttatagcccacaccatgtgtgggcttcatattgatgcatgaggggaaaaaagtcacagacatgccttttgaatttgatgtcatgaaaggtgaagactggctaggtgggcactgtagagttggtggagagaaacaggaactgagaaaatag

SEQ ID NO: 819 - DNA, 2325 bp, Mus musculus
ttgcatgatttcagtccgctggcctaaggatgcagtggctttagcactaggcgtccatcctcaacccctgagttgcggcctcatgctacgtggatagtttatactttttaaagttcttaagtgtcattgtattggttatgatttataatcaatgatcttgggtattaccacaatgtctattgatggcatattgatcttttcccatataactcatgaacttgatagagaaaagttgcctgggagcaaactactgtctgaaataaactgcttccctctcctgtccttttccttcctctctttttccctcacctctgctcctctcctttccccttctcacccctcctctcctgtctgtaccttcctccaccatctctcccctctgctcccctcccctcccctctccttctctcccctcccttccttgcttttctctgtctctgtctctctcatcttgttattccctagatgcaaattacaacaattcttaattattgtagtataatttatgcattcaaagtacataagaatctctcatcttttgccttaaatccaaacaagaaagcaatcagatttagtgagaaatctacacccacagttaaaataagcagaaaattaagtctcttcaaatttaggcaaattatgaatacaaagacaaaatattaagttgagacaaattaatgatgccactgtagttaacacacagttttttttttttaggaagggagggtacactctataatatcaaccaaccagaccccccctgacccccaagaactaccagggactaaagagtaccaaagagtacacatggagggacccaatggcttcagccacatatgtagcagaggatggccttgtctggcatcagtgggagggaaggcccttggtcctgtgaaggctctattccccagtgtaggccaatgccaggtgaggtgggagtggctgggtgggagggggagcatcctcatagaagcagggggagtgggagagggatggggaagggtggttccagaggggaaactgggaaaggggataacatttgaaatgtaaatacataaaatatccacttataaaaaagaaaaaaaataagtttttacaatctgaatacaaaatgaaaccagtagttaagactcaaacagccaagtccaacctgtaacacaactctgaagttctttagctcagtgagggctaaagagaaggaggataaagaggaaatgtttgaaagtaggagaggatatctcctgaggcttaaggaaaagtgctgtctccatagtacaatgtgaggcagcaagtttgtggagattctacgtcatgctccaggagtcctagctaagctcactgataacagtggctccaataaaaacaacatcttcaaagcaaaggaaccatacttacgtgggaagaagatggcatctagaactttgatagatgagaagagaaagcagtatgtttagaggatgagccccctcctgttagggactaatacagttggtgacatttagtggagccagtgttcatattccattctgaaaaccctagggtcttgaagaattacactgaatctgttctgccttgttctataaatggaatgacaaagcctgggtggcagaccatctgtttacaacatgggttgctgaatattttaagcccactcttgaatttactgtgctgaaaaagaagagtcctctacatattagcactcattctcaatgaagctggtaactggaacagtcacatacaagtgtgcaagacggataatgctgagggggtactaacacaacatttattgtatagaccatggatcaaggaacagtttttacctttcaactcacattatttatgaaatactttttataagatttttagctacaactgactctgactctctaatggatttgttcaaaatgaattaacaattttttttgataagcatctgtcctttcaaatgccacaaaatacagcagtggctcatcctatcaccaatttgaggaaccgaggagattttgatgcacttttcttacgtaactttttaacaaattcaatatctgttggtagataaagaaatttcaattgtgataatttaccaagaagaccggtgaaggttgtagatgggactgaaaagctgcaatgtcaaagtgaaaccttaactggtaaagaatcacttctttttttgttttgttttgtttttttgtttttttgtttttttttgtttttgtttttttttgttttgttttttttccattttttattaggtatttagctcatttacatttccaatgctataccaaaagtcccccatagccacccacccccactcccctaccc

SEQ ID NO: 820 - DNA, 2275 bp, Mus musculus
cggagaaatcctgtcataaaggaggagagcactgtgtgaatttacctagaaataaaaactgagcagaaaatcttctcacgttttgttcatattttattttcgttgacatctagttatttgtttatttaatatgtatatataaatatacactcatgcctgccatgacacactttggcatacatataaacgcaccacacaaacacgctcaaactctaggctgaaatattcaatgggaacgatcagcaatggatgattaatgatttttaattttaaatcttatgaattatgacaccctgtagtgtcataagctttcaatttatttcacaaggtgttatctgttccttttcctgacatatacaagctatctgtgtgccccatctgtatgtaccaccctcccatgttgtctgtgtgtactctctgtatataccaccctcctatgctgtgtgtaccttctgcatgcactagcctcccatattctctgtatgtgtcatctgtatgtaccactgccccatgctgtctgtgtgtatcatctgcatgtactatcctccatgctgtctgtgtgcaacatctgtatgtactaccttcccagtgattactaggtgatattcagttatcgggttaacgaacatgacattgatttcacctaataatgcctgcaaggctcaagaatagtaatgctgccagttcagacatgccaagaagaatcctcgatttttttttcttttgacagaaaagatacaagtatagggagatgttttgaaagagaagggccatactcacatagatttcaaaggcgtatgtcattatgcttttacatcattactatttttcaagctaatctcttactgtccttaattcatacatgaaggaacacagtctcaaacctactgttcatgggtccagacatccactgggaggcttggaagaaatgctgcaagaatgagtggggctgtggtagtgagagtcacctgctgctgcctgctcctttcctcaggagtgaactaattcggcccatctgctaaggtggtaacccagcagccagcctccttattagagactgatttctgcgactcctggcaaggccaagtgagactttccttgctggtggcatttgtttccctgccagtcttttcacaatctaaagagaacaaaacaataaaaagaaaaagaagaataaaaggagaaaagaaagaaagaaaggggaaagaaagagagagagagagaaagaaagaaagagagaaagagaaagagaaagagaaagagaaagagaaagagaaagagaaagagaaagagaaagagaaagagaaagagaaagagaaagagagaagagaaagagaaaggcaggctaggaaggccagtctcctgccttacttattctcaaccctgttcagttgtgtagaattttattcccaattggatctagtttatgcttgttactatggtgatctctctctctctctctctctctctctctctctctctctccccctttgcatttcacagcctctccttgcaggcttccttctctgacttaaaacaattaaactctcctttcaactgtgcagcaccttatttgcataccgtgttgtgtcattatttctctagtgcttgccctcgcaggaaactgtacctccttaatataccctgatcaaatatttgagttgtataatgtgaatattagcatagatttttatcaacaaaacactccaggagatctgcagatttacaataaaaagatctgtagaaatttgtgcctgagacagaatgctttctaatctcatttatgagtttcaatttaggttgacacagctttgccacaccccaattaaagcaggaggaagtgatcagaatgataggaagtgcgtctgtcttctgtgtggaacaggtggatggtattttataaatagtgacaccaaggaaaccattttcacactttgacttcctgttgataaaacagaagggtgtgaggtttagaagttgtcaaagttgctcaaataagatattttatattttttgttccagtgaactaatgttcattatagaagcagtcaacttcactctcacaggtatttgctagtctgggacctcagcaaagagttagttaatagtcacctttcctcatacttttaaattgtgtgcttcatatttctaagtcactgctctgagtttctgcttagacagtagtccctgcctatgtgaacgttgtctaccaagtgtgtcaagcaatgaagtgaatagaagttaactagcgagagagaataggaccacttaaact

SEQ ID NO: 821 - DNA, 2750 bp, Mus musculus
agctgaaggcctgggatggaaatggatatggggaatctatgggagggacactagctgagattgctaccagagaaaaatatagagactgaactggccacctcctatagctagtcagaacttctagaggagagagtggacaccaatacacccacaaaaccttcaacccaaagtttgcttgcctacaagaagtacaagaattaagatgaagtaaagactgatggtacagccaaccaatgactgctccaacttgagacccatcccatgtgaaagagccaacccctgacactatcaatggtactctgctatgctcacagagaggaacctagcataactgtctcctgagaggcttcatccaaagcaaacaaaggtagatacagtgacccacagccaacatcaggaggaacctgaggagtttcagaagaaaataagtagaggaaagaaatgagcaagttctgggtgtgtgtttgggagggggattcaaggacaccacaagaaaacccacagagtcaaattaccggtgatcataaggattcacagagcctggaccagcaacaaggagggatacagagctggacctaggactcctaagcatttgtagcaaatacacagcttggccttaatgtgggtctcttacaagtggagcaggggttgttttggtttctgccccttcccattggatctccttctccttacctagactccatgcggttgggcctcggtgggagaagatgtccctactcctgctgggactagatgccccaggatgaggtggtacccaagaagggctccccttttgtaagaaaaaggaaaggaggcaatagcaggagggatttgtaagttaggactgggaagagaggagagaggaggctctgatctggatgtaaagtgaatttttaaaaagtaaaattaaaaaattttaaatgcaaagttgaacattgataaggagatgtgaaaatttgggatcatggcggtcagtggatcaccatagccagaggtgtgtcttgattcaaaatgtggccctgttcagtcattaccacacccagtgccaatcacagccctggacaaggtcacgttcgcaagtctcatagaactcctataaaactgagcatcttgaggcgagcagttatgattagccagcgtaaaggaatactgagtgacatggaaagctctagaagttcttcttcaagggcaagtgaggcatatgccatagcgatgccaccttcttccatcccttagcctctgcagttatcactcattacatcacagtgccttaaaatacacttagtcaccacagtgaaggaatttttcacatgatcgctcacaaacttttctcccaaaatatatcttcagttcagaataaggagttatttttataaatataacccacagcttctatcaaaataaaaagcaatattgcacctataatgaagaaagtcctgaagtggaaatttctggtttctttggagagactcggtgacatttttttctggaaactgtcttatgagaggatgtttttgctgagagcaggcatgcagtatttttttctggaaacagcccagcaaaagggcatatgatgttttgctagagtggatgcttgaaagagcatgtttggaaggggtataaatacaagccaacagacagtgaatcagcggggtgattgtggtattgattggggattgaacaggtgccatgtggtattggtttgacttgccactctttgacggtcatcattgggctttgctgaggacgcttgagtggtactggttcgatttgtcacgcttttctggtcattgcttgtcgtgacttcacagagagaaaagcacctaagaacttctggtggtggtccagcagcttctggacacttcctcaatctaaggccgatgggcagagcctcgcagtttcttctagatggaaccgccattgctgattggtgaatggtgtttgtggctgtatcaagctacccctgctgattcgtgtgaactgaactgctgatatcccatgaagaacaatttctttttaattttattttaattaggtattttcttcatttgcatttccaatgctatcccaaaagaccccatgccccccccccacttccctacccacctactcccacttcttggccctggcgttcccctgtactgaggcatatggagatccacatcctcctttgccctattaacctttcatctctactactgctggtgggtggtgagctagaagggaggctacagaatttaagtacccttattaaaaatcagttttggaaactctaaacctagaggctcttgtgagtgcacagccctggaagttgcttacaacaaaccttttggttcttttgtcttcctgttaagcctgagaccacaagcctatctttcttgaacacagacgtgtgagctcagttctgacttacacatagagtcgcagaagcatagggatgcccgtttctacctgttttcaaaataacttacaattgatgctcgctgagttcacatctaccatcaatacagggtcagttgctgaaaaaaaaaaagttatcagtatgtgtatcaaagttattaattattaacaaattattcttctctttgtattgtgcatgccttgtatgactttttattgttttttttttaagacaatatcctgctatctagcccaggcttggacttcatgtctcagaatcccaattgctgggactgtgggcgtgtttcaccatgttcaggtctcacatgtgtgttttaatatagtcttag

SEQ ID NO: 822 - DNA, 2125 bp, Mus musculus
actgttcatacgagcatccctcccaagcaagaattaggaacccgagggctcctgtctacacagacacagatataaagcttactaggaatgtgtcaaacaagaggctcgggggtgagccatgatgtccactccacaaagacctgtggtctctagaccaaggactgacagcttttagattaaacttcatcatggttctcacaaagtaaaaaggctgaagaagtaaaactctaataaagagtgcctctatattagatgcatgttagcatatttatgttgtttgcatttatgtatatttatattagtataaatgtatattactacatcttactatgcaatcaagcccaggtagtggggctgcacacccttaacctcaacactcagaaggcagaggtaggcggatcgctgtgagttcaaggctaccctggtctacataacaagttccaggacagccaaggctacacagagaaatcctctcaaaaaaaaatacatatatatatatttatatatatatatatatatcagcacacaacaccgaaggaaagagaggaaggggaagaggacggggaaggggaaggggaaggggaaggggaagggacccaattcctcattctggggaaaaggaggccctgaccgtcactcatctgcagtagcaccagccactccttacaagctgcccatgaggataagtagatgtctactgaacatgtttgcagaccaccagggtacctgagatccagtacccatatccacatcatctgtccacaagcctgtcacagcaggggtcagaggtgcactgctctcctgtgtctagaggcagcactttgggttgcaagaactgtcatctgcactcagacctgctttcttccatcagaaagaaataatggggtttttttggtttttaatttgctagacacacgcaattcccagaatattattttcactggaattaggttctgtgagcacgtgaaaaatgagaagagaaaagcccagtgtgtgggcctcctccaccacacgaacgctctccacactctgccagcacaccaggagcggggcctagactgtgccactataaagtccgtacaaccccacaccgatgaccaggagcccctccgccagcaccgcagaccactgctgcatagctgcacttggtacaggaagaacgctggtatctcagcgagccattctgtagagctggcagcgcttgtttgaatgttgagtatcgtaaaaagccacttaggcagttttaatagaaacagaaccagcatttggaatgctctaaacctttcttctcttcaccagcaactgtaataatatataataaccatatgtcctacatttccagcagggtttcagtttcacatattttgttacataaaattaataaataggcttgtacagattgtttaaaaattcctctttttatgttttccaaatgttatacatttgaacatacgctttctcgtaatcagaaggggaaaaccccttataaaatatatatcatatacaaatatatctttatatcatgttcattcaaaactctaaaaaaatgaatgcttaaagcagccttattcataattttacaaacttggaagcaactgcaatgtccttcaggacccaggcatggtagtgcacgcctataacataaacagctcagacaagacaaatgaaccgtgtacatcatacaacaaacataatattattcagacccaaaaatgaatgccacagaaaaacatggaagaatgttcagggtacattgctggaagaaagctttgtgtcatacaattccaagtctatggtgtgtaaaagtcaaatgacaaaaacactaagaggccagagagtaacattggcagcaggcaagcagtgcgtaggtggagcacggaggacttttagggagcacggagaacttttagagtagggaaattaattcctcatacctcaggtgctctctggcttatagtgagcttacatcctaaaaaacctcttcagaaactgacatcaccatgagctccaagcacactaatcacacccatgccactcgacgctacgtcaatcaaccatgctcctgcagcttacatcctccgtctagagcagggcacgtcacccagcacagcacaggttataataa

SEQ ID NO: 823 - DNA, 2750 bp, Mus musculus
gggtcctggcaaccaagtccagatcctccgccacagcagcaagtgctcttaacagctgggccgtctccatggcttgctgtcctaaaatcattagggaaggtggctttctactttttggtcaggtagctgcaacttcttgaagggttgacaaagtaccaactagtaagtgttattcaaattcaataaggtttctctagtttttcctaacaatcctatttttcctaataatcaaatcctagagatcaggaaaaacctaagcttttaaactgtgagtcaattactcaacttctctgagctctggttttgatagcgtaactgagagagtagaatgcacactgggcctttctctaaggcgtcaaggtcgccaccgcgtcccaccatgaagtcattacagcttgtccgctgtgcaggagtccttgtctagatggagcgtcagactcatcatcagtgtgagtagctcgtgagttctccaaagggatgcttcctcaacaaatctgcaacacacttgaaaggcctccccctagccccctccccccaaaaaaagatcttgaaaaacagtctgggcaaatgagatcactgggaaccaatcacatacattgaacatagtgatgaccagagagtctcttttaatttcaccaatttaaataacaaatcaagagtgtgtttttcccatgctggtaacatgtccaagaatctcacgatggccagtttttagtcacaaccaccaattctatcatttgtctttggtctgggtttgggttgtttgtttgttctgtttgggctttgagacggttgcacacagctaacactggccttgaactcaatgggacgaggaagatgctggctttctgactcttctactcacacctcctgcgtgctggaatggcaggcctttgccacccacagctaaattaattgttttaaatttagaagagtcatgcttcagctcccagctgtaaaatgagtttcggcacaatctgaagggacggtcatcacgaaaagccttagatatcactgtcactgtccccaacactgctgtgttctgttgtattgtgttgtgttgtactataccgtgttgtgcttcactttgttgggaaatggggttgactgattggttgtgagtctaggtagggtttttggttggggagtttgttttttttttttttttaagtttttaaatgttctccccattacatctgtgtactcatttgtttgtttgttcccacacatgtgtacctgtgtgggcacacacagaccccagcaactgtgtggaagtcagaacacggcttgcgagagctgcttctctctaccacactcaggaatcaagctcagacaccagcttgacagcaagggccctcacctgcctttgcttgctgagccatcgcgctagacgttattttgttcaggttttgaaatagaattgcactctgtggcccacatgggccttgaactcatgaccaacctcctgcttctgcctcccaagtgccaggaccacatacaggaggccctattcccgctccaacaatgttttaactcctttgcaaaccaagatttctacctgcaaagccagatcaatccaacctaatataagttgtatttatctttctctttacaaatggcatcaaagagcagagctatagcagtaagacagagaaagaacagcctgaaccttggcgattctcagtaaaaatagcctgacatgaacagctgactagttcagtgctgtcacaagaaaaaccccaagtgtgcacgcacagagagggctgagagactggacagacaccctaacgtaagccgcagccatcgccagctaagagtaagtcgtctgaaccgctggggaggacttactggggaggacttaccacctcagagcaacagcacaggacatggcggtcctgagcacactgctcggtgcacctaggctccagctgacatccaccactgttagatgatcttacccctctgtctttctctgccatcagcttgttcattgataaagtggagattaaccacgcagtctcagcctactctacagccatcataatcccccaaaccaaccaatcgatcaatcaatcaaccaatcaatcaatgtatgttgaatccagtgcctactagcaaagcccagaagcaggacccaacagtatgtttccttgctcgatgacaagtctttgcagcagggaggactttaattctgagaactttggagaagggggaaacagacaatcaggaccaatcagagtctaccaatacagaaagcagaaaggctagcactctgtgacaattgggcgcccacgtgttagcagccattctatcgtggatgcgtctttagctggcccatcagaggaaacgtccagaatcacacacgtgggagtcacttaccccttcccatgttcagtgaggaaccctgctctggaaatctgacattggaaatattccccagggggagatggcttagcagttaatgttcttgcagaggtccccagaacccacagctctcacaacttctactaactccagctccagggaatctggtgccctctagtggcctccatgggtaactgcagtcccatacgcatataccccacatagacacacctgtacacacttaattcaaaataagaataaatatttttttaaataccttatgctgaggaggaatgtgaaaataatgtaattatattttagttgaaattttaaactttaaatatatatatttggatggctataaatctctaaaactttgtgagcat

SEQ ID NO: 824 - DNA, 2225 bp, Mus musculus
aggtgattgataggtagatagatgatagacagataagatagatataaatagatgaccgatagatagatgatagatagatatagatagatgagatagatagatagatagatagatagatagagcagcccagttgtgatcaaggcctgtggctgcatccctgatgcaataactacatagtggatgttggcatttttttttttactattttattgggtttttctatctcttattctaccctaatccctttcacctccccaacactaggtaggatagaaagaaggttagagggggaaatggcatgtagacttctttcaactacttcctgctgattaggggtgttgagtttcttcagcccctctcaggactctcatctgtaccctctccagagttcccagaattaaacaaactatctgcagctggcaaaaaccatgccccacctagtgcacacccaagacaaccatagttaacggctgcagacaaactggatcagccacgtatcccacagctgggattaaaaggaaaaccttattcatatggcatagctgggctttcctaggaaacaaaactctcaatagaagtggatggcagagaccacaaagccaagccaagcctggagctgtgttcacacccagtgcgtatctgacattaataaggctgtactctctgatcccgggggaaaggcagaggaggctgggggagccctattcctgggacctggggtgaacgtcttgagcaaggggaaggcatccttttctccctcttttccacatggtccacattattccacacccatgacacagctccatctacaggtgcctttcgagctgtgtcacgcctcactgtcagcacactgctttgctttttgctttttgcttttttttttccctcactgaaacaagcgttgcttttatcctctcaaaacacgaggtcataagaagcacatttcagaccttgttatggcaaatggatttcttctgatggatcacaccccacttttctaacataaactccgataaccaaaaagcatcgcagagcactgccacgaggtctctgcctcctctgctgacgttgccactcctgggtaatttccgtgggcagctggcagaaacagaaaacattagcaactggcttttctttattcttagttatcactccaagacaatgcttgactggacaggacgcacttcagtgttttcgtaattcatttttaatcatcatctcctaacgaacacagacaaaataatccctcctgctaaagtaaaaaaaaaggcaagccactggagctaacgtagaaaaatggatgcaaatcaggacttcccttaccatgctgtgaggccatgtccaggctggtcaagtgctctgtctgtcagctaaagccccactctatgtacttacggtttttgggtttgggtgtggttttgtgttgttgcttgtttttttgtctgtttttcttttttctttctctctttctttctttctttttttttttttttgttgttgttggttggttggtgctgggcttttttgtttcttgtttgtttgtttgtttgtttgtttgtttttcccgagacagggtttctctgtataaccctggctgtcctggaactcactctgtagtccaggctggcctggagctcaaaaatctgcctgcctctccctcccaagtgctgggattaaaggcatgcgccaccactgcctagctgttgctcttgttttgaggcaaggtttctctgtgtagccctggctgtcctggaactcacgctgtagaccagggtgatctctggcgcacgcctttaatcccagcacttggaaggcagaggcaggcggatttctgagttcgaggccagcctggtctacaaagtgagttccaggacagccagcgctatacagaaaaaccctgtctcgaaaaaccaaaaaaaaaaaaaaaaaaaaaaaacaaaacaaaaaacaaaaaaaacaaagagatctgtcttcctctgcctcccaagtgctggaattaaaggtacccacctaccacccagcaagtgtatgttttcaataggtgtgtacacagtttttccccctcaaataatatgtctctatattccctcaaacaatttctctctctctctctctatttgttttttatttaggcggggtctcatgtagtcagtccgagctggcttcaagttcacgccatagctcaaggtgacgttgaatttctggttctgctacttctgctacag

SEQ ID NO: 825 - DNA, 2025 bp, Mus musculus
ggtcccacttcatcaagggtctacaacttggtagaaatcacaggctgaaaacaaaagctttaacacacagaatttggggggctgtacttgctggttttgtgtgttgattggacacaagccggagttatcacagagaaatcagcctcccttgaggaaatgcctccatgagatccagctgaaaggcattttctcaattaatgatcaaagcaataggacttagcccattgtgggtaatatcatcgctgggctgatagtcctgggttctataagaaagcaagctgagcaagccaggggaagcaagccagtaagaaacatccctccatggcctctgcatcagctcctgcttcctgacctgcttgaattccagtcctgactgcctttggtgatgaacagcaatgtggaagagtaagctgaatcaaccctttcctccccaacttgcttcttggtcatgatgtttgtgcaggaatagaaaccctgactaagacagaggatattcaagatccaaactagcaggttagctgtggttcccttcctagagggtctagtgggatggaccaccgccatcttgccagagagactcggtgtacattctaacttgccatatgttgcttttgagaacttctgtgctgactgtgacctgagattggtcaactcaggagtttgactagttggcccatacagaagcagacccagcagttgctacccagattctacaagtagggttgccagtgacaatataaaagacaaagaagcctttctttctcagagtgtgtccacgcagtgaggtcatatcatccaggagcgacacaaactggccttttcatttagcaaaataaaatgcctgtccgcttccaccatgctgggcaagtctaagccagaatcttgtttataaaagtttttgtttgatttaccacccacaagacttcccccacccctacaatgcctagcaccagggtggacaaggagaaaggagagggtgaccaggcagatatagccacgtgacgggtcctcgtggagcaagcatctacagaatttatatattaaataacctcaggaaaggggtgagattttgatgacagcaggcctctgtacctctgggggatttgttcctgtttttatgaatactaatggtacacggtcctctcacttttcagagctgtgttttctcattaaacactactgcattgcactcggaaggaactagatattccggacaggatttggcagacctcaatcacaagtgcttcagtattggcttccagaaacccattccacacttggccctcactttcaaaccttgtccaggcaccaagcaggaagatgcctctgactggggcctggggcagggtgccacacttaggaaaactcttaaaggatcgcttcaggagcctggttggggaagcaaagtaatcgcttctccaatgaccttccctcctgggacaagggcacaaagtcaaagtgtaagaggggtttcaggtgtgtcccaatagtatcacacaagcacaggcaccaagggaccttttgcacagaccaggaatggggtggttttggtttttgtcttagcaacctgccccccactccccatttaaccaggtactctaactactgtctaacttgcaacacttactacattcaatgtaacatttgctttaaggtaaaagatactctcatgatcacagttggactctgtctcacttggcagttcacaaaacatggttcagaaactcgcatctctcaaccagaaaccaggaaatccacttccactggagattcctaacaaatacacaggtaccagacttagcactgtgtgttattaccatgcttccagcaaagcctgatgcacgcccctggtaagccactagatacaaaaagcccacacgtatttgttagttgtctcagaaagttgtggtagaaaataagatggatttctttgttggtgtgatggtttgtatatggttggcccagggagtggcaccattaggagatgtggccttgttggagtgggtgtggccttgttagagtagg

SEQ ID NO: 826 - DNA, 2650 bp, Mus musculus
aaagacacaaagaaagaagtccccatggggtaacatggatgtgagcccatggctgtgagggacagcctgttggagtaggagccacccagccagaacacagcaaatgatatctcaggattttgacagggaagtatacaaaatagcttagagggtagatatctgcccagctctagtgctttaagacttattataaacataaaggttttgtgttttttatttgggaactgaatgatcgaaggtagcctagaagcccccagacaaaatttaccacaacaggaaacatcctaccaaaaagaatgaaagacaaagtatatcaggagagaaaattattcgtgatccccttatgggcagcatcattccctattcaggggttctgactagtataagagaggagaaaactagctaaacacacacacacacacacacacacacacacacaggggggagtgagagaaagggagagagagaaagagagagagagatcaagtaagcaaggatgcatttattctttcttgactggatgtggtgtggctagctgcttgagtccctgccttgactccccccaaatgatgaactgtagtgtgaaactgtaagctaaataaaccctttccctatccccatgttgccttttgtcagagtattgatcacagcaacagaaatgaaacaggccctgacctcactacactcacagcccacatgtgggacaaggctcaagcggccattgtttcaatttccagttgtcctgctgatggtcaagtccaggcatccagaaacacaggggcgggggggtgggggggagaagggagcctgggatgctttccaaaagacaagagatgtggcagagcttcaggtgtgctgaggcactgtgacatggagcatctgagggtccaccatcacatgccacctgggatggtaggaagctgtcaggggaagctctccagctcacggtgctctcagaggggaccaaggcaggctgagagctgggaggcccgagctcatcgaagcctgtgtttggatgttctactttgcttggctttctttctctctgggattggtgagcacaagaaagaacttatcactcttttctgttcttgccttcagactctctacaggacacagacaggagacgtgcccagcacagttaagaaatcacattcagaaccatctttttattatagcccatcttgcttcataccatgtggattttatgggaattcaatgattagacaaaaagtcacaagtgaacaacattggctctttccgccagaacccctttgccacacattttagagttggaatcagttgtctgatttatggggatactgcccactgggaatgcagtaccatgtgccagagtggtcgggcctcgtgtgtcctgaggacggcctaatggagactgtccaagctgcatctgttttgcagattaggagagacgcacaaaggaagctattgtatcccgtggctcccaatggccagggcaggggctggagtgtctgagcattaacatgcagcagaaggaactggtcttctctggagaagtctttgtcttcttgaaaaatacttgaactgggttcagaagcccatgactaccgagagggaagtgaagggtgggcgactgaccctctcacgtgctttaaaagtgtgtgtgttcacgctggtgtgctcagccgcaagtgcatgtgtgcacagaggttgactttggaatgcctttcctcagctggtcctcctgttagtttctgaggcagggtctctctctggacctgaagctagctggtcttgtcagactgcctggcagtggattggccactacacagcacgacaggactcaggccaccttcccactccccacggcagggagtgaacagtggaaacactgaaagaactggctctgttgagtcagggttctaagacataccctttttatttagcacagtttgagatttgtgagctgtgagcctagctgtcagctgctagcttgacatagcctggaattatctgagaggaaaacctcaattgagagattgtctaggtcaggctgggctgtgggcatgtctatagggggtttgtcttgattattaatcaaggacaacaactaatttaggagggccctgcccactgtgggcagtaccaaccctatgaggggtgtacactatagaagaactagctcagcataagcccgtgcgtcggccattaagtagcatcccccatggttcctgctgcacttatttgcttatgaagtgagttccttggttgtaggtgatgctgtgtggaagagaagccaggcttgccttcaagttcctgcctgggttcctgccttgactttccttgatggtggatggtgacctggaattgtaagccaaataaaccctttcttcctctaagttacctttggtcagcgtttgatcagagcagaagaaaggaatccagcacatcctgcatatacacatacacacagaaagacagacacacacacacacagagacacacaaaaacacacagaaatagacatacacacagagagatacatacaaacacatatacatacacatacacacacagatacatacacacacagacacacacagagacatacacagacacacaggcacacaaaaacacacagaaacagacacatatacagaaacacaca

SEQ ID NO: 827 - DNA, 1750 bp, Mus musculus
gacaatcatctataattccagttccaggggatcgaatgccctcttctggtgccacgtgcacataaaatttaattttttaaaaaagatttatttatttatttatttattatatgtaagtacactgtagctatcttcagacacaccagaagagggcatccgatctcattacagatggttgtgagccaccatgtgattcctgggatttgaactcaggacctcttgaagagcagtcagtgctcttaacctctgcgccatctctacagccccataaaattcaatttaaaaaataatattaaaataaaagtaaatgtaatttagaaataaatgaaggtaagcaaagcctcagctgctttagacaaggaagataccggggacattcttcagacatgggtaaacccaacgttccttttgtgacaggcacaggaccctcctgagagtccagaaaatccaataatgtaaaaggaaacctgacccccagctattttcaagaagtggggggccagctgcaaagatctacctgatggcacatcagatctccattcccagaatcctaaccttccaacaggcaccggttaccacgggaagacaccacagacagttcacaagcccaccactagagggcgagagacacgcagagagaaaagccttccagttttgtatggaaacgtctcacacacaatctccgaagattcccaggggagcctggctgcagagtctggactcagactccacttcccgcgctgcgcaagcatctgcaccacaaccctctttgtaaagcagggaagatgacagcatcactgtcacctcacctcagatctgtgtggcaatgagatcaaagagagcctggaatgccacagggggctggagagatgctcggcccctatgagcacatcctgctgtttctgaggactcatctccctcttccggtctgacacacatatacgtaaataagtataaataaataaataacaagcctttaccaaaagagtctccagtgagtggcagctgttgcaaccatgagcatgatactaagatgctacaaataagtccaccaagcccgatggcctaagttccacccccaggacccacacgttggagggagagaaccgactctgtgagtgtggtccactggcctccacgtgtgctccaaagtctatgcgtgtgcgtgctcacacacaggtacacaaacaataagtgtaatgaagtaaaactgtaaaagagaaatcggactttgaatgcattgctggctgagatgcaaatagctcagcatcttcaagaatcatctcagggttcttcagatgttagacgctgggttagcacatgaccgagcaattccatctgagtatgtctctctctctctctctctctctctctctctctctctcacacacacacacagacacacacacactcgcaaacacagagtgcataaatgcccacagccctgtgcataatccccaaaccaaacacaatcctactaaccctgtaataggtgactgtctgaagtatgcacatgcacatccataaatggacaactaagcagacgctaaagtactaacaccacacaatctcaggcaaaccatggagagcctaaaagatccagtctcagtcaggttctattgctgtggtgaaacaccatgaccaaaagcaagggggcggggagaaggtttatttggcttactcttccgtatcacagctcatcatcaaagaaagtctgggcaggaacctggaggcaggagctgatgcagag

SEQ ID NO: 828 - DNA, 4675 bp, Mus musculus
tgaccctgttggagggtacaatcatggtggagaagcatggtggctggattgaaaggtggctggtcacactgagcatccacagtgaggaattcacagagaggtcaccatctcgctcagcgctcagctaactctcatcgttaccgggtctgtgaccccagcccacatagcggaggcacccacatttaggatggctttttttttctccatctcaattgactcaatctagaatctctctcaagaagtgtccagaggcttaactactaagtgattctagattttgccaagctgacaatcagtatacaacacctcagtttcctgaatcaggatcaggatggcttctattgactgatgttgggtgtcagaacttccttgaagaaagtctaaagggtaagcagagatttgggaaggatgaccatgcagtggcctcaagatgtaaaccttccctgcctcgttcttagtatgcctggtaggaggccacagacaactcttctagcaggagatgagcaatggacaatggaaggaacccaggacatcatataccatggctcttctctgtgggccatggaagcagatgacctctgtcagcacactggaccaccaagttcattagggtgggaatgtacggagaagggtcacagtcacagaaactaggttggcatcttgactgacatgggtggcactggaaagcagaagtctggatcatttgaaccacagaagtctttggtattgttggaactggaatgggcacacaattgactcagtcttccagagagcctaacctggtctctcagccaagtcctagatgagattggttcacagacccaaagcttcttgtattagggcatctggctcctctggaagatcccagctatagactagtagatagttaaccaacacatctcccagacatccataaaagcccctgctcagcacggcactgatggccctggacctctgaagttaccaaccaccccatcccaggcctatgggctctgatctctgtcattcttctgggctcctcttcttcctctaccctgagtgtgaagctcttctttgcatttctgccctggtccattttctcatttgctaaaatattctcttcacttcaaaataactcaggctcctccagatagactttgccacctccctctccaactcctacttctctttccccaagtcccgttaccagggaattctgggttccttttaagttcttagacctgttaattaaagaattgaacaattggttcagaagggagctcaaggacgatcttatcacaacaggcagctgtaagccttggcaacttccaggagcaaagaagaagagaaaaatccatgacctttttgaggcagcatcccatgaaagccagcatcgtgagcaatggagggcaccagaggtatggcagcgaggggcagggagcttcagggaacaactgaaaaaaatctcagagtgtcaagaaagcaagctcagaatctttggttaaaaaacaaaacaagaccaaaaaacaagcagaaaaggaaaggtgttctttttgaattagaactcaaacaaaaaccaaagggggggggggaaccaaccagatgtaacatggtgcaaggccagagctccacaagcagctatagtgggggaggggtatttcagaagtgtagaggggatgtatattgttcaccttgatggtccccagcaaagccttgaggcagaagctggtagttgtggttacctgtctagtgttaccagggaaatggaggcatgggccgaagctcaccttgaagggggagcgcccatcctcagcggcctcccaggctatagtctgaggctcgattccgcactcctgcctctccattcgctcagcagtgctcagccttcctatcccggccaccctttaatacagttcctcgtgctgtgctgacccccaaccttagagtcattttccttgcgacgtcataactgtaactgtgcaactgctaccaatagtaatggtattggctgctacttagctcatgagtagctaaacagaaggcacttccaccatcacaaatatccttccacacagcacttctgtctccctggcactgactcatcttgccctttccacatcaatccgacatgagcaaggctcagggacatattgaagaagaggaggcagaggcagggaagacgtgctgtgaaatcctgtcttctggaaacttcatgattgtggcactcatgaactgaagaagcagtggctgtcggcacaagatcaagccagttgacatgccagcatgaagaggggggtgggtaaccatgggggcccacccctccctgggaagctctagtcagctaatggctgctgcaggtggggcagtgtcataatcctcaatggatagctgctggtaagtcttccttgctcaacagaataacacccaacttgcacgtaggcaagtaatcctggttcaatgcagtgtgccaccaaacaaaagacagcaaagtagaaggaactgaagtgtgtgcgtgtgagagagacagagacagagacagagacagagacagagacagagagaggagacatatgcacatatagagaatgatcaaatacataagacatagaacattggccatccttgactacatctctcttctcatccaataccttgttcattccttaagatgcttagaatggatcctgttggaagtgtgtgtgtgttctttaaggttttgtccagacacagtagcctctgtgaaactttccaccagtggtgacaacctctaagctctggactcgctcccttgctcctgagactagccttctatccttcagggtcctaaagctgaattgcctttgcctcgcatgccctgcccctgactatagtcaaatctgtcacttccttcagccgctgatcacatggcatttcttccctctgcctaaaactatcctccaacatctcctctgctggcgttccaatatgaagctgcttgagtgggtgtttatgtggagggtagatattgtttctgtattgttctgtctttcactggggtttatatcctctatgagctggatcctaaaactgtccctaagaatcagtgatctatatggggggcagatattatttgtgtattgtatgtcttctatagaatatacaaggaggctggatcctaaagctgtcctttagaatcagtgactgttccctgtcacatctcttagcttcaccaagattgcactcctgtgagataggactttacatgttccttgaagcttcaatttgtaagaccaaattcttagtcggagcctcctttctccagtaattgtttccaccagaggaaagagagaaggaaatacattatcctcgtatcctctctgatccagctcagtgctttggggcactgccttttttttttttttttttctggttatatctagaacagcctctgccctctccccaaatttagcaaactaaagatcaatgtctctgagtaaaacccctaccccaaacacagcctcttatacttcttctccatgactgcttgtcctctgtggagccacagaatatcggtggcctggtgtatctgtgtactaactaccagccacaggtgtcgctcagggcagctgccttgcaagatgctaccacacacctatatggagcatcatggagcatgacccaggggtgcttggctccacctccactgcccaacgacctatcacctccacagaagaggactcacatgacctctgacttctcaggtggccttactccctgattggccacaccgcctggagtcaggtttggtattgttttggttttgtgtcactctgtgtgtgtgtgtgtgtgtgtgtgtgtgtgtgtgtagctttggttctcctcagtggcagggatagataactcatccttcagtgatgtgcctgagaacagcacattgatggcaaaggctgttttagacatcctgtcctggcttgatagtgagcactaaattgaaagcactaacctcgagatctccatggtaacagcatggtacttaccaagccacacatcctatgaaggggagaagcttccacatctaaggacacctagagtgaagcctggagacatcaggctcagacacaaaggcttcccggggcgcctccacactggaccattctgtggatgatgagcagtgcccatccttctaaacctgtcttcactgcccatcaaacttctgtgctaagagctgctggctatgatccagtgagtcccgtggtacacacttcagtagcctatgtaaccagtcttcctattagccagacacacacaccacaccacacacatcacaccacaccacacataccacaccacacacacaaacatataccacatacacactatagacacaccacacacaacatacaccacagcacatcacacacatcataccacatcacatacacatatacacatcatacatactacacaccacaccataccacaagcaacacacaccatactacaagcaacacacatcataccacaagcaacacacatcgtaccacatcacacacacatacacacccataaacactacacatacacacacacacctcacaccacaccataccacaggcaacacacacaccacacataacacacacacacacacacacacacacacacacacacacacactcctctaatatttggtttggacccatgactttctcctctg

SEQ ID NO: 829 - DNA, 3225 bp, Mus musculus
cttgaatcgcagcccaatgttagcagggctgtcattggtggctttgagattggaggatgagctaggtgaatgaactgaagggaaggagaggcagtggaagagcctgggtatgggaccagtggtcacctggggaagtggatttgtgaggcattgcacagtgagttacaggggcctaggaaatggtgggtcacctgaggggctggctgtgaagaggccagaggcatcctgtgaccagcactcacagtgtgagtcggaagactagagagctaagacgggatgatagagtggcctcaggaacagactagaggccaccgagagctgaaaatggagacttcaaagtcggctacacctgggaatggatgaaagactgagatagccagttcctgagtgagagtcactgcttagaaatgtatcgtctccctggtctgttccaccaagtccatgcctggccagctgcctcgttgtcagaatcgtggtctacaccttaaggagcattttggtcacaaatgcaggaacaaactaagagctgtgacgattgtgctgatgtgatagagaaatgcacactgtagtccaggagctcagggagggtgggaaacagcagcttgctggtacctgtgtgtgcaactgggagtgcacacacgtctggtgtgtgtgaatgtgattgtgtgtctgtgagagagagtgagagagaaggaggggggagagggagagggagagagagagagagaaagagagagagagagagagagagagagagagagagagagagagagagagaagtttgcaaggtgaaagaagtggaagctgagagatgtttgcaagctgttgtctgtgtttgtcgattatgaggtcaatgcgagtgttcagactgtgatggaaagttagttgttaaccatagtcaggtgcggagaagcctgggcccaatgtgggcgttcgatttgcttatctcgtattgtgggctaggttaggcttggagctgggctccatctctatgtagatctagagtagccaggtgtggtttctgcagggaggagggtggaaggatgcatgaggagagggagtagaggtgggagcctgtgaggaagaaggcaagaccactgggagccctggggcagcagactgaagtgaccacactgtaaaacctgcctccagcggacatctcgcaggactcaaaggaagccaaagcctggtcctgctgcagcccacttgtcccattggcagccttggtgacaactgttcctgccatgtcaactttgaaaggtgactacttctctatgctattaaggtcaagtttttgtcagatgtaacgttcaatagttagccttaaagaatgcagtttatgttattggtttcccagggttgccatgacaaccttccacaaactgggccactttgaacaatagagatttattctctgtggaaggctgatcacaggctgttcttgggccagctccctgtgaaggctataagggacatgtgccaccccagcttttcacttaggtgcacccaggcccctcaactaccctctctccctgtctccctttctccttctttcccctccttactctcttcctctggccttataaaaacacccaccatattgcatttaggatctacacagttaaaacctcatcttcacttgggtttatctactaagaccctgtttctggtttagtttatattgactggtaccaaggttagggctgccacttatcctgaggaacacaattaagatagaagtactagccagggttgggggtggtggtggcacatgtctttaattccatccctgggaaggcagaagcaggagaatttctgagttcgagaccagcctgttctacagagttagttcctggacagccagggctacacagaaaaatgtacctgcactatgctttcatgcttactccttcagtctgatctttcctccaagaagactggagattagtttagggcagttgtattccaaagatggagaggctagggtaaggagctttctgcactgtctccagaatccgagccaggtgttccaggaaggatgcctaatcacagagtgagttagagaaatggttggggatgggagccatccccacccccaacacccccccaccctacccccacccctactccctcaccccacctccccaccctccccccagccccccaccccccctacccccggcatggagcctcaggatgcaccgcagtggtggtacctgttccctgcaggaaagttcctttttaagaagtacatgctgtgtgtccttcacagcctaaaattacctgtcaaggtgagtcaagatgatggtgacatgctaattattggtttcaaaagagagagggagggagtcaggtgggatccccaagccatccccaaattttttctcttcctgtacttcttctgtcctgcatcaaaactgcactgtgtccagaaagcacagcatctctccagctgtcaggacagatgtccatagcaggagctgtgtgtggtgtttggaaggcaaacataacccatactcatatagtctctggtccaatagaagcagccaagggatcacacagatgcctgagttctaagcattcacctatgaggggctcagttcactagagaaatatctgccaggagacctgggggttctggggccccatgggaagggttgatgttgcagaacaggtcttgtggaggatttggtggctcttgtggtgagtgaccaggtacctcaggagctgtgtgggggtagccggatgtatatatccccaatcccgggaaggcagggaggaacctggcacgtctgagaaggggaaagggctccctggggttggagcccagggagcaaggaaggtggggtgagataagcatgagagccagcagtaacctcctccccggctgtacctggagatttccacggagcctgcagaggctcagcagtcttgttagaattcgctgaaagagaaggaaggagacctggagagtgctttaaggcgggcgcctctggtagcttcttgataccatgtgtggctgtagtggacacatgacctccgtctgtgggccctgtatgatctgcctagactaagctctgtgctaactgtagacacagggcagggacacatcctgacttgctgtcctccacacctccgaggccacccttgacctttaattctcacaacgcttctgctaaaactaagtttttggatgtacctttgaattgtctttctttaattttt

SEQ ID NO: 830 - DNA, 3100 bp, Mus musculus
ctgcctcaaaagggtggaaggaagtaaccaaccccctaaagctgtcatcagagatgctcaaatatgctgtggttcacaagtgcacccgcatgcaccccaacacacaaacagtgcgaagtaatgaggtggaattataggtcctttgttggaaagaatgctgtagtgtattgagtacaacatcaacatagagctttttgtatgatacaattttttcttgaaaagaaatatatatatatatatatatatatatatatatcatatgtatgtgtgtatgtgtgttaaaaataatgcagtgttagaatagtatggaaagacgaacaccaaggtgtttctagtgcttactttttgtgatggtttatttcaattttcaacttgagatccagaatcacctaggagtgggtcttgggcagacatgataaagaattatttcaattaagtttactgaggtaagaagacccccaggcagtggcactgttttctaggatggaccttgcactggacaaaaaggtgactgtgggaagcattcatcattgtctgcttctcttctggaatagaatatagctggttacaatgtaatcagccgtctctgtgactttgctacaatgatggactgcaacatccaactgtgagctaaaataagactgatgttccttagtttgcttttgttgattatttattgcagcagtaggtaatcaagacatccctggagaggagtcagggaggtattgggcatgaggaggaaggaggtactccaattttttaaaaaaatgtatccacccccagaaaacatccatagaataatttaagaaaaataaaagactgaaccaaacttctcttttataacattagatgttactatgtcagagacctccatgaattccatttaatagcctctaaaatgcattcaaatcaaagcatgctttccatgtgtgattatgcaaagattatggttccacagggttttctagcaagcctgaagctctctgtatggttcttaagccagactgcagacacagtggggaggattctatctgtgtcagttggtgaatgtggttcttaaccctcacagatccatcactcctggttgctcacaccccacatggactgaccaagaagtggctggggttgaacaggtggcttcaacgggtagtcagctcaaattaatgaacagttgtggctcttaagacaaagggacaatagcttggtacaaagtagctcaatccttgctgcatgaagccctaggtggtatcctagtgcctgctgttgcatcagattgagttagtggttccggagaggaagataaaataccagtgtgcaggtgggagccaagtgttaatgtactattttgagaaaagcagatcacatttattttggttttctgctctaacattgaagtctacttctgacctcaaaggaaataattagctattttataagtcattagttatgctgagcagcagttaaaatccagcaatatctcatgtattactttagtgcttttcaaaaataattgaaaggaagacagtgtgctaacctgttttaaaaatacattctaaaatcaacaattatacctcgctgagatttaatgctctaaataaaaacactgcctgctgtcgccctaagaaatacttggaatgtgatatttgaatttgagactctctccatttccagcttttcctacaaactggagcaatactgcagtttgaatggacagagtgacagatcctggacactccctggtgtttgcaaacatcttgaaatcacaaaaatccttttggtggaagaatttacagtataatggcagtgtaatctgtctctaagtaagagttatagctgcatagagagtatattccttcttttatatatatttttaaactaaaataaggctttagagaaaccatggagatgatggagttaaattgcatgaccttttgatcctaagctggttctcaccagaacagttaccacagtgattccaccacccgagggagggaagtgagttacccggagtgctgagtgttgccccggttttgtacctttcagatgaaatgtgttcataacggaagccccaaggaagaaaccggaaaagaaggtagaaggaagccatgaggctccacagccgaggcctacttctccctgagctgtgctgttctcagccaggtgcaaacattgtctcagtcctctctgaccaaggtcagaaacccaaaggctccgaggaataacgacaccgcattctgtcagatatgctgtgatagtgtgtcagatatgctgtgatagtgtgtaattctcagttttttgctttataagatattcttctgctattgccttatcatgatctcattaaaaaaaaaccagttcagtcagtggtttgaggtaaatggtctaggaagtaaagtgttgctagggctgctgtgtctattctttgaaaaatgctgctagctctaatggtgcacagtagtgagggatgttccctttgcatccagggaggtgccaagttcagggatcgaggatgttaatgagaaacacacactgtaaggagagagcatctattacctaaagtctgagacacctgagaagacttacaggtcaaaagcaaagcaacaaaaaaatcctctttttaaaaaaagaaatcaatgataaagtctaggaggtgaactaatattagcagaaattttcaaatatatcagaaacccatgtcataaccaatagataatatgtgtgtgtataaagggacttacggctagctctctttaggcattaggattttatagccaatagtttgtggtctattatactttggtaccccagtcattatgtaaatctgaaactgggtagatcaataagggattgattgttttcaaaagcttcccttcgccttgtagctacctgcctaatcctttaagtcagaactttcatttttaattctggtggaatgaaatcattttaaatggattgtatccctccatgccacctcgctcagagtgtaatggatgcagcgtgatcctttcttagcgcctagtgggatcatttatcttctgattcttctgatgcgctggaggcagggaagcttatccagagaggggtgctggtccccaggtgc

SEQ ID NO: 831 - DNA, 3600 bp, Mus musculus
tattttcacatgtaatcctactttctcccacccaagctggaagttctttttttttttttttttttttttccatttttttttcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggacttttggtatagcattgcaaatgtaaatgagcgaaatacctaataaaaaatgggggaaaaaaaaaagccttctctcttaaactctactttatatgcttctattcaaaacccaccctaggtgctttgtgaacttctaatgacaggggcttgagatcctctggaatctggaattcctgaaatcccgacctcaagggaagcacaatagtagcttgaccagagaacttaggaccctttcgtcttaagttatagtttgtaacctcttatcctgttgcataactgcacgtggaattttgaaatgtttagcaactgtagaaggtttctggatttgcaatgtccaaaactcagttgaaaatcagttgcatactacactgaaaaggtttggggcatcacttactcatgtagtgcaatgtgggatttctctgaagccttggttttgaacacttctttgcactttgagtgcaatatcaaagcacaatatcaaagaacgccgcgtgaaggtaactttacttagattccacactttatatgttaagaatagttatgtttttagactagacctaggcttccctgcacatacaaagcacatgtgcatcttggtcttcatgtgagtcctgaacagctggagtgggagctatccctaaagtgattgcctgtttgtgggacatgttcttctagctgggctgccatgcctggcttcagtgggagaagatgtgcctagcatctgcagagacttgatgtgccagggtcgggtagggtcggggagggtgaggatacccaggagggccccaccagctcagaagagaagaggagggaggaaggattatgagaggggttattaggagtgggggagtgagcagaatttaaagtgaataagtaaaaaaataaataataataaaatttaaattgctgagtattttatatcaaatagtagctaagagcaaaacaatcaaatgaaatgataaaataagggaaaaaacggttgtgtttcactgcaatgcagaattttctgttcctatggaaacacaatggcttaattccaaagaataattactttgaacatttttgtaatctctgacaatgtatcaaactgatatatctttagcaatattaaatttctatactctacctatttctactttctagatatactttctagatatacattagaacatcttcatataaaatatatcagactttcagggcacctggtctttcttccttccccttcactcattttggttgttaatgtcctgggagacaattttatgtttgtgtttatgacatatagaaaaatattattttgtatatgtttaaaacctagaaaccacaaatgagagaaagtgtgtgatatttgtttttctgagaccaacttaattcattaagtatgtttacattcatttgaatccattttcctgaaaatgacaactttattttactttatggctagaaaaatgtccattaagtgtttatggcacattttctttattcactaacctgttttaagtaacttctatactggttttcattttcattggcctgaccccaatagcatccccaagcggcatcctcaacaacagtatttaaggacttacttttgctcacatcctcaagaacttttttttttagtgtctcctattttaattggagtgaaatggaatctcaaggcagtttgaattagcatttctctggtatctagtacacccatctgattagtatgcaaattggccttttgtggtacaaaaatggtaaaattgtaagaatatcaaagaattggctttttaaaaaaataattcgtgttatattagtagcaaaatttaatttctatacctactttatgtagctctgtgccctgaggcacgtagcaatttcttagatgaaaaggagtcatgaacagaaaaggattcacaagacctgctcttatgttacatcacaagaatagttccaggacttatgttttgtgtaaaaaaaaaaaaaatgtggccatttgttcttggaaatgtaagccaaataaagagaaaaccaatcactaccagaagaaaaagactgagactttataaattcctagagaatatttgaataggaagaaagaataaagacaggagaggtggtggccaggtggtggtggggtggtgacttaggggctgtggggttgtctagggttggtggggtatggtggtagtgtgggagaatggggaggtggtaggggaagatatttttaatttcactgcagatataaatcgctatacatgccttattagggaaagtatgagaaggcataaaaaacatctaaaaatatcctttccataaaagcaacaaaacaacttgtaaaatcgagctgaactgagtcagttttatcaggactgcaaaccttaactaaaagcttgcagtgaatcagggggcatttactaaagagtaatggaccatccgtaaaaaccctgcaagctgtgcagtgttttaagtggttctcatgctttttggttcctcggttacccacaaacaggatttgttgccagtgatggtatgaaaggagggaagaaggagaaggaaaagaaaaaagaggcataatccccactttacttgcctcttgacaaacttattaacacacaccatttcatcgactgaaatgaatacttcttttcaggatttaccatagttgtaattcaagttcaggatgctaggaaagtaaatggctatagcttttatagttatgttgagctatatttgtcttctccagcctctctgtttcatataatttactgctctaaactttctatcagtgtttcactgaggttctgtaaagaggacagacagaagaaagggtgaggagggaagaagagtctttgacattataaggtttctaaaatattttggttctatacacatcaaatgtatagatcagatggagctaaatctttatcacaattaacaattaaaagcacatgttattaaaactatgatattaaaattgtgttttgtttcccctctgcatcaaaatgatcttgtagtatgtttatatttgaggtagacaataacacaactaaaatgttaattgtcagctctaccacaaaaaccaaacaagtgaacattgtccatcacacagagatgaatgatgctattacattttttaattttgtctggcaataagtgacacttttggccatttcagaacactatgtataactgcacttaatattaccacctttgcccaaaccaatgactagttagcaattttataaataggctatttaggatctctagacatctgtccacagtcacattgatttttgtcttaaagaggggatgtttttctaattatgattttctaaaggcaactttgtgattttattccacatgc

SEQ ID NO: 832 - DNA, 2425 bp, Mus musculus
tgggaggagagagaggagagcagggagaggaaggaaggacagacaagagtgaaactctctgcaaagtcagtcctagttctttcaattgtctagtcagttctgattttgaggtttgattttcaaaaatcacattttgtttaagccttggctaatacagccaaggtttccaattgtctcctgttagatgaacaggttatgatttaattaatgaatagctatctttctatgaaagcaaaagcactaacatagagtttcctaattttgtagggaccaagttttaactttgtttacatatattcttgaccaaactgtcttgatcaatctatacgtaagcaaaggacaaaagacaaaggttgttttgcattggttgtgtgtgtgtgtgtgtgtgtgtgtgtgtgtgtgtgtgtgtgtgtgtgtgtctgtgtttatttgtttcctaaaatgtaaaacatccaagaaacagttacccctcaagcaatgaagttgcccaagctttaatcctcatggtcaggaatgattaactgttttgcttgaatctcagcagacatttttacgaatccgacagttattctcatatctctgttaattctaacaagtctactcatttattccccatgagtctcttaaggctcagagttcttgtcagagcatccagagcagaaacaaacaaagaaacaacactatgtaggtagagacttagaatggttgagaatggattatataaataagacatttatttatttatgtggaatgcaatgtttgaaataatagctagaattataattgataaaatgatatagaatatatcaaatttccattccctgagtaactaccaggtttctgaggaatagatgtgagaccatccaacgtcttccttttttataggatactaagggttgaaactggtgttcatgcgtgctaagcaagggctcttcctaaggtacacttgcagccctgtttcatttgtccctcttgtttctcacacattcaattagccaccaaattctacccagtggacttcttaaatatccctttactaactcattttctcttttgcctcttggtacttgcctaggttagggtttatctctcaagcaggatatcttatatgagcaactcatccatgttgttattattattagtgcaaaaatttcaacatgatctcacggagacatctgcatgtacattacagcccactgttcgtgctgcttctgagagaactcttaaacatgcattgcattagacagctaaagattttcagtggcaaccattacttaggatggtgcagaagtggctgatggagaacaggaaggacctcactcctggtctgtatcaagagacctgcatgccattccattctttggaagccacactcagtgttccaatgtaagcagctctgatgaaatccaggcagctgccaacttccattctgggggagtgttgtttggggtacatgctatcactggtatttttaacaatgcattgacacagcaataagaattcgaaaggcctccccctaaatacctgcttatgtaactaattacagtggcttcaaatagccctgagctttcagtcaaagcaaacacccacttacagagtgaaagtacctctgtgtaaatgaagaatgttagattgttttctttacataatccctctaaagaggagaacctctcaccttattcctaagggtgacactgtcaccttgaattgtctgagttcttgcaatatctaagggaactacttattctgtactcagagtaacagataatgtatttagggacgatgggacacatcaggtacttctttctgtgcctgtcaaagagctttgctgtagcaactgctttgaaaaagcacttcttcatccgatgtgttgagaacaaagtcttttgcatttgcagttcttactgtgtattttcggcgcccccctactatactctaaacaagtcattccaattagtatatctactaataatggacatgatgccacacattgaatttatacaatgcagtacacattctgttcttggcattcaaatagtcagtgtctgtatcatgtcacagaatataagagaaagaaattaatatatacagcaacaaaatattatgctgaatcatgtatgttaaaattaaagattgctgcaaagtttcaaatgtgttctgataagtggatattagcccagaaacatagaacacccaagatacaatttgcaaaacacaagaaaatcaagaaggaagaccaaagtatggatacttcattcctccttagaatagggaacaagatacccatggaaggagttacagagacaaagtttggagctaagatgaaaggagggaccatccagagactatcccacctggggatccatctcataatcacccaccaaacccagacactattgcatatgccagcaagattttgctggaa

SEQ ID NO: 833 - DNA, 2125 bp, Mus musculus
tgccattccggccacaatacatgcagaaaccccttcccttttccagatacctccaggctaccactcagatgctgtctgcaggtccttagcttttcagatgtctggatctctcatctgggacagcgtgtttacatcaaaggtggacacatatcctgccacttgcccttctctgcctcctgcctatgagtcagagagagcctggctattggcttatggcctgaaacctcctctatcctcagaaccatacaagaaaagtctgctactcctgccacatgactgattcttcttcagagaccccgccacgttgtctgtctcatgctggggcctgatctcagaatcctgccgcagtgcttaccacctgtccatcatccatggcaataataattctcttctaataaatgactcctcaacaatccaactcaaggtccctcttaaacccctatctaagacctttaaggctgtggcaaagtttagtatcagggccaaagggtagtccacttcccacaccaaaaagagacagtgctctgacttgaccaaaaagagactctagactcagcctatactggactataggagaatttctggtggttagataaaaggtggtatttctcaggaacttgtgaaattatttcccatctgccaaaaggagaagcagcagaaaagacatctcactctcctttggcatatactagtagttgtgtattaatgtctatgctggccctcaggttctttgggccccacacacaccattcgttatgtatctcacagaccagagagctttcttgcctttctcacctctgcctcaaggctactccagacaccgacacagacacacatgtacaggcatgtacacatacatgctctctttctaatgccaaggggtttcaccctacccaactaatcttgctcctctctctcttgctcttctccactattcctgcttccttagtcctggccttacccaggctgcttcctttcccctccactcaggactctccaagatgcctctgaacacttctctctcttatccccaataaaatccttctccctcatcatggagtggctggtttcttcactgcacccctcgcacacacttaggaactttcaccacggtgatcagcagggcctgaagcagagactgggcatagtagggctgggcaaggaggtgactggggtcaaaagatcaacatgagtgtacagagatatgaaagcttgccctcaaagtctcctagaatcaacccaggaaggcccaataacttagggtgacaacaagtcttctaaacaggtatggcattggacctagtgatcacacattgaaaacctccatccgcacaaatcgctcagggaaattgtttaattgtgcttctggctaatgaggtgttatataaggcccaagactctgcatttgtaatgagttctcacaagagtcttagtcaagcagactggctagcagcttctctatgaacggaaagcagggagcagagggcaaacaaaaacaaacacaaacaaacaaaaaccaacaacatcagaataaacaaaacaatcttaaaagaaacagcatgagagttcaccgacttcctgacttcagtacacatatcaggcagttcagtgatgcatgaggagtctggaacaaatacatacccataggtaattttttttattctgttttaaagttctgatcttgcctttgtatctctgatccactgtgaacatatgcatttgtttatctttacattatatagtctcatatataaacaactgtgtaaaaccatgaacattagcatgtggctttatttctagacttggtctcttcttgtgctagtatccccatgaacttgattgctatactttcatagtgagaccttaaatggagtatcaatcaaaaagaagaagaaattttatagatataaaattttggacatgagctgaacagtggtgacatacacctttaatcccaatactctggaggcagaagtaggaggatctctgtgagttcaaggccagcctggtctacagagtgactggtagacaggacagctaggacagctaggaatacacagaggaaccatgtcttggaaaaaaaagatttggacactaatggagcattagtcataagggacaaaaa

SEQ ID NO: 834 - DNA, 3575 bp, Mus musculus
caaggggctccacagcgggctgcagacaggaagaaccaggaaaatggcatcacgaatgagctcctcagtgtgctgtctccctcccatcctacaggcatctgaaaggctagggagcctggttgggctgcacacagagaacatggagtctaccggttagaaccaagtagttgctggaactcaatctcaggaacaggtggaaactgcgcccaacaaggctggaggatgctggtctcccgggcggtttctgttttagtgtctaagccatgtgtcctcctgggaagcagcacagagaggcttgccttgcgtgctggagaccctgggtcccgtccccagcaccagagcagaaaacgtttagtgtttgagggagtgaaactgtacaattaggtcagcagtttggaccattgactggaaggtgcagaaagagcaataaaaatcttgtccttctcaaagttaagaaaaaagacgaaggtgaaccgggtgtagtggtgcacgcctttaatcccagccctcgggaggcagaggcagatggatctctgtgagttcaaggcaagcctggtctacagaatgaattgcaggacagcccacatagtggaagaaaaagaatgaaagagaaagagagagagagagagagagagagagagagagagagagagagagagagagagaaaacagaaacaaaacaatagattggaggaacccaagccgcttgcacagggccagccatcccgtctctgcagtgatacttgggggtcagctctgtatttctttctctaaaagcctcttagccaatgagagtagaactttcattggtcaagtgcagaggttgggggtgacagaaggccctgcatcagtgctggggttaacctcaggttcgtctgcctgcatggcaggcacagaccccactcctggccagtgtacttatcagcagagctctcccaggaagtcccattggcagcagcagggaacatctgggtttcggcaagcctgggggtgtcggatcgtcaatctgctaagctaactatgccttccatttctaatttgctaattcaaccctttttatagccagagtaaacagtgaactcgggattctaggttggcgaagattaaatggctgtgatgaagtctctcatttataaccacatctataaaatgggggtaagaatagccactgctttactgaggtaatccaatcaagtgcttagcccgctggctggtccaataaatgttacttttattagtgtcatatatctcagactctgtcacctccttgaattcctgtgaatctttaatccagcaaattaactctcttcactccaaataaattgtctgcccctggttagttagctctcccagggataaggtaaataaaagtactaaaatatttagtgtttatggatttttttttaaattaaagtgtttttattagaatgtatttggggagggacattaatatagaaaagtttaagtggcatatatttttaagttaaaaagtaggtgttattcccaggaaaaaaataagggtttgtagacttggtggcagtgagtctgtttctcgggtgtttcagtcccgttgaaaaacccttcgggtcctcgatggcccaaggccacctgccacatcccattttcctcctttcttcagttctgaggatcccgggggatgagggacctttcttggctttggttttccaggctagccacatggctgggttttcctgaccatctgcactgtactggttggttttctggttaccgacataaagagtggattttgactcccaggcatggggtggtagaactcagggcagtaggaactcgtggtggtcaacgggaaagcagaaagggtaggccaggacgaggggcacggctgaccttcaaaggccccagagatcccaacagccttcactgtgccatcatcggcagcaccagccgtggatgctatcagtcactttccaagctaagactttggtcttcctggccgacagcagcttctagagagttcgagtgccttgatttacggctcccagattaaggacgggaagaacatagcccctctccttaagcttcatcacttccgtttcagaactaagaaggggtcagtgggtgtacagaggtatgggctctatggggacttgagagtgacgaagaatgcacctcagggccaccatgcagttcttgctctttgtattagctctgcaagccaccctagggatgggtgctgctggaggtggggaaccacctggagatgggagttacctgtgcgactcgaaacggaaaaaatgatgccatatgaaaccttgcttggagaccaagagttttttatagtcacatctcgactgaatgtaaaggttacggttgtggggaaattcactcccccacaaatgttttgataaatccaattcattgttcgagaggagacattctctttccagacattaacttagaatgctcagtttacgaggccgtcggaggcaaggaaggaacccgaaatgctcaagtaggtcaaatgaaaaggcatgcccacagcttctcctttcccactatttcatctttaatgtgatcttagaaaaggaaaaccccctcccgcatggttctggccttcagttctacggtatggcaccgtggatgggaaagtgtgcatgtgtgtggataatcagatgggttttatttgaagattcccccaccctccgccccccacccccaggaaggaagggatacgtccactgtaggcagcagcaaccagcgggccgtctctgagcaatgtgagttcctgtaactaagctatctaaggcagctctggataaagctctggatgggcagccatgagaaacttgaatttgaattcccagcacccgaatgtagaagccagatgctgcagtgcttgtccaggatcccagtgctcctcaggcccgctgggaggtggaagcagggttctccccagaagcccacgggccacgtagcctggtgcatatggctccttcgagaccttgtctcaaatagtgcataaggtgagggtctctccccagggtggttctctaacctgtgtgtgttctctgtaacatacactcacatataccaggtctctgtctctgtctctgtatgtgtgagtatgttgatgtgtgtgcatcagaggtgaacttcaagtgtcttcccagagcatcagaggtgaacttcaagtgtctcccagattgctctctccttgtctatggcgacaagatctgtccctgaacctggagcccaccaattcagcaagactaacttcctcataagctctaaggaccctcctgtctctcccaccgcggtcttggattgcaggcacacaccaaccatgccctgactttcaggtggctgtcagggatttgaactcaggtccttgtgcttatgccacctgagccatctcttcagcccttgtatgatgtctaaagaaggatgtctcttaggaccgtgaaaaatccccaaacgggccagcaagatgggctaatctctgggagctccgtgaaaagagaggccggaagatctgcacgttgtccccatgtgtgccctgactcccctgtgtgtgccacggcaatgagtaatga

SEQ ID NO: 835 - DNA, 1950 bp, Mus musculus
agtgaaaatagctgagattttagcatacaaggctatatttgtatattactacagtatcaaggtaacaagactcctgtttatgagtgtaagtgtacacagtcatgaatttgaaaaaaattcaaaaggtagcatgtgaatacacctattatatgaagttctaaaatccaaaaatgacaattctttcctctttccctgaatgaaatgatatcccataagttcttaggcactgctgggaaacatcacgatctcaagcttctccatgtacataatatgcatgtttgtttgtttttgttttttactgattattattaatatatgagtgagagagagtgtggcagattgcacacgtatcagagtctttgtggtctcagagaaaatccttggatggccatatttgctatatacattgatcgagacatggtctcctgttggactgtgaaaggcagcctcttttctggttgagctaggtttaaaccccggatacctagggatggaaggaagtttgctacgctcccagacaccaggttcctgacacaaggcctcaggtccataattctgtgaccatcagtctcataggacaatgccccaacttcctggtattctgtatggactccaaccccaagttgccccctcctccctctcttactctcttgctctcttgctctcttactcttgcctctttctctcttgccctcttgctccccccctctctcttctcttccccctcttgcccttttctcctcagccctgggctagtcagccctgtggatggctactccattctcagctctttggtgacatccagtggcattggcaatgtccagagcctgagaacttgtcatcttcagcctctgtgcaggcatggggagtctgaaccaattccagcaggtctgcagggacctcggattgcacctcccaacaactggagcagggtcttgtgacttcttacagcccgatgtcagccaagtggcagtatagcatgcacacagtcaaacttcctatgtctgcctccatgagcagccctagccttgtggtgggctggacttgggacaccgtttcaacccatagtttccttcttgctgctgcatatatcacactatctgacctgtgaacttctggaattctcttgcctccaccttccttataaccacaggtgtgctgggattgtcgatttgtggtttttcctgacttcagggtattcaaactcaggtccttacacatgcacagcaagcatttacattctgacccatttcccttgcacagtatattgtagttttcatttggcaaatttcagtatcctgggcactccagatattatcatcttttggtctgattgacaacatcaaattgagactaaccttgttaacaattaatcatgactttgatgaaggcatttgaatatataagtcattatgactgtttcccatacttaaaggagtataaaaacagtgctgtgaggtgtcactgcatatggtcagaagattctaaatgcaagtgctaagtcgaagccagaatagtccacactgtactcttaccatctgcttaccaagtgacaccctggagcttgcaagcatgttgttttcttaatttaaaatatctctatgcattcataaaacatttaaaaatagtgttaaatgtcattaaaatagaaatgtagctataatatttctatgtgagctcaaatttacttcaaatttaaaaggcttcagcagtatgtggctatatgtgttttctctatatgtattttctaattctctagaactcccaactcaattttagctaaatgtatgatatcaacaaacttccatgttatactttcaggtgacctttacagttatatagacaggagctagagatatggaagaatggttatgaacacactcatggagaagaccaatagtcacttcccagcatcaacattgagaagttcatacctgcttgtaactacag

SEQ ID NO: 836 - DNA, 2725 bp, Mus musculus
ctatgaggttatttgtgttttgaagggcagcatccatctgtactcttctcttgtttgtactgcttacgtttcttttccatgctgccataaaaggcaaaataaatattcgggaaggagaaggaacttggtgcttagaggttggggtggggtagcctaggcacctggtgcctcagcctctccaagctatactgaggctatagtatagctatactccaaatcaaaagctgccccttgtgacagctcagttactgcttctaaggtcccagtttcccaaccccaggacttggctggcaatggttcattggcttcttggcttgagtttaggagataagggttgagttcctagaagagggttgcaaggatattgcctttagccaagtaacacagtcaagaactggaatcaaattctctgcctggagatgaaatgatgatcgagtagatgttgctggtgcaccgtgatattcttggttatcagaacctgaggtctgtgagttcacactttataaacagaagccagagaaagacccaggtgcttgtcaggaacttggttagtaggcaaagttgacacaatccggtgtcaagtccaggtcagaagcacccggaaaacaggcagagttgcatgtgggaaatgcatctgtgcttcttagcttgagcttaagagacaagggttgagttcataggagagtattgcaagaagattgccgggacacagtgtgccaaaccagtagggcacccagatgctagttacagcagcagactggccatttggaaacaaagactaaggctgatgttgatgtaagagaaagtaaatcctacaaggctgatggagccttggagcagagcaaacatgcagatgccaggttgccaggacttcctgctactgctgaacctcatgcatgtaaaatctgagaatggttcctggggaactgtccctgaccttctgtcatcagagtgacacaaggggaaaccacagtggccctggggataaggtgtccctgatgaaggaaggaaggacagagaagcagaggggtctcccaggcagacagcaaatgcagggattcagcatcagctgcgggaatggcttcctcccacgcactgatgtcgctgaaatgcagaggcagatctgccttcagaatggtgctctgaaaacactcgcagtttgtgttttcatctagcttcaggtgctaggatccagtgttacatattctcaacataaacttaccatgtgttatcttaatcattagtatctcatcatattggcactgtaagttgctaatggtatttgcaatttctcttttcatcctgaggtaaaaaggatctgtcaaagggataagatctcttgcttactgcaactgtctttcagctttatggttgcttagcttatatcctctcttcatcggctagactgttgaagaattgggtactagaagtttttgctttaataaaggatttgagtgatccctaggaagttcctggtattaaactggttcagtttcctatgggtcagccaaatagatcacactgtctcttcgcttgcctgcactcatgggctcctctgagaactgaggacgaacaggaagttgtcagttccatcagaagagccaacactcccagagaggcacctgctgcatgcaggtatctcctcagcctgtcacctgctgctttctccactcacagtgacttggggtctttctctaccaaccagacactgtgttagatcctgaataccagagttttaattcaaagcagtttcaacacaggtcacatagggtttttactgctgtgatgaaccaagaccaaaagcagcaacacaggactgaactggtttgttcagcttgtggttccacagcatagtagtctgtcactgagcaaagtcagggaaggaacacaaacagggcagaaacctggaggcaggaagtaataatgcagaggccatagagggtgtagcttactagtgttctccccccaaattttctggcctgattcttaccttctcaagggtggaaccacccacaatgggctgttccttccacatcaatcactaatgaagaaaatagacaatacgttgcccatggggcaatctggtaggggctatttctcaattgaggttccttcttcccaaataattctagcttgtttcaagttgacataaaactagccagcacagaatagtttgttcctttagagacacatttgcccaatacatagctaactataaaaaagtaaaattaattctaaagtggttgatagctcttcaagaattgtttgtttgtttgtttgttttgtttttgtttttgtttttttctatgtggctaggctgcagaaacatatgtgctcttcaaaacacaccttcatacctataggaaaggcttgagcttgtgagagggcaggccaccatcagcacaccatctctctagccttaactagttttttgcagagtgtgtgagccatcacccatcacagtccagacattctcacagcagattcacagccttgcttctgaggctcaaaacgatgtcaacaattacacccgaaagcgaagtctccccactgcatctgatctttcttcatctcccatcagcattgtcttaaattcttcatcgtgcttttctcccgcaaagtgcacttttgtcctttaatatacttttttgaacctcaaagtcagtatcatcacaatccaggtcctcacaggccttgcatggctgagccagaaactatttcactc

SEQ ID NO: 837 - DNA, 2050 bp, Mus musculus
ccaacagctttagttttgctgttgtttggcttttttagataagatcttgctatgtagctctgaaaaaaactggaacttccatgtaatacaggctggcttcgaacttacagctttcctgcccctgtgtcctgtgtgctggagttcccacgtgtacactattatgcctggttgctccctccaaactctggagaggccccataccacagaagagttttttgaagaccaccttttactctaggtgattcgtgaatacttaaaggatgtttagagtatgaagctactgttattgttgaaataaatcacaaggccacacaaagtcagctctaccacttctcctgcataggccaaggaggtgagttttgcagaaaggaaagctcactcaagtccagtgtctgtcagtcacacagaaggactgatagttttcagggtactctgctcatctgtcacttgaagtggggcatagggaaattccttttggtttattactgcaaacaacgtctttacactccttccagaaccctgagagagtggacaatcctgtagattctacagggttaggaggaggtggttagctggagataacttagctggagcaactcctcagccatgccaggcagcgagagctctgaagggttaaatacattgattttaattaagcaggctgtcttcgccagctctagacagcggccctcccacagatttttgatgctaaacttagcccttctaatatgctggcgtcttcattctctgcctgaactgattagccagcccttcagtggagaaccccagtgatgtgacagttgagatgttagagcagagagtgtagaacacagtcttcctcctcctgccatgtggcacacaaggcagccgtgatgacctgcaggtgaaacacccacttctggactatctatcagtgtgtatctgagagctgggctgcagcaccgtgtgccaagaccctactctgcagccttgcgagggggttccttggagaaggggctggggtggggaccctctaagaggcttgcgttagacccatgacatcacatgctctgagattacacaggtaagcacagggatagatgtgaaagactgagtcagtgatacctcttctttccagccttcagctcctgcccattgctagagcgtgccatttccattgcaccatgaatacgctctccacgttaagtgaaacatctggaccggggagaccactgattcagtaaagtgactgcctcaacgcataagggcctcagtttaatcctctgaactcaaataaaaataggattctgggtctggagagatggctcagtggttaagagcaccgactgctctcccagaggtcctgagttcaaatcccagtcaccacatggtgggtcacaaccatccataatgagatctgatactctcttctggggtgtctgaagatagctacagtgtacttacatataataaataaatcttttttaaaaagtagagttctggatgcagtgctgtgtgtttataatctcagtgatgggtagaggctttctaaggattgctggcccgtcagtcatacctatttggtaagcaccaggccaataagagctccggtctcaaaaaaaaaaatggtgagcagagttcctgaggatgacaccagggttgtcctgacacctccatgtacccgtgcacattcatacattcgtgcacatacacataggcacataaataaatgaagcactctattagatgaccatagtaacatagctgcagttgttaccattaaagggttaattcatgcaatattatcagttttaatataattttatttgttatagagttttaatctatcttttattatagtgtgtgtgtgtgtgtgtgtgtgtgtgtgtgtgtgtgtgtatgtgtgttggtcagaggacaagttgtttccttcagttttttccttccaccctgtggtttcccagcattaagctcaagcttcgtaagtgcctttatctgctgaaacgactccttggcacttaactaatttttttttaatattccagaaatctcaaaaaaaaatagaataaag

SEQ ID NO: 838 - DNA, 2200 bp, Mus musculus
aaaagaaaatagggtgcagtcataccgggaaattgaatgcagctgggtttttaaaaacttttttattagatattttctttatttacatttcaaatgttatcccctttcctggcttcccctcagaaaaccccctatcctatctcctctccccctgctcaccaactcacccactcctgcttccctgccctggcattcccctacactggggcattgagccttcacaggaccaagggcctctcctctcattggtgtacaaggtcatcctctgctacatatgcagctggaggcatgggtccctccatgtgtactctttggttggtgttttagtccctgggagctctgggggtactggttggttcatattgttgttcctcctatggggctgcaagttcctttacctcctttggtcctttctctagctcctccattagggaccttgtgctcagtccaatggttggctgtgagcatccacctctgtatttgtcaggcactggcagagcctctcaggagacagctatatcaggctcccgtcagcaagcacttgttggcatccacaatagtgttcatagcagccttatttataatagccagaagttggaaagagcccagatgtccctcaacagaggaatggatacagaaaatgtgttacatttacactcagctattaaaaacaaagaattcatgaaattcttaggcaaatggatgaaattagaaaatgtcatcctgagggaggtaacccagtcacaaaagaacacacatggtatgtgctcactaacaagtggagaccaaaagcttgaaatacccaagatacaattcacggaccaaatgaagctcaagaagaaggaagaccaaagtatggttactttgatccttcttagaagagggaacaaaatacccatgggagaagatacagaatgcagttttctttgtatttatagaataggctgtggttacagaggccctcgagcaagctggagagccccataatggctgagaacattcatagcatgttctgggccactgtaacatgtctaagaacatgttctctctggaaccttcctgagaggtgagatatttctctcacaaagtgaaaccaacaaggattgactctgctctggaaagtttctctttagagctctgacatggaagggaaagattcctccttgtcacacccaggcctgtcactgggaaaaggccggagtggcagggactgccataggcaccagtgcctattgctctgacctcctctttaagccgtggcttggccaaacttggcttgctgttctgctcctatccctagaggctcatctatgcttcccttccataagaaaatgctagatcctggggctgccaaggatgatgggaatctcacctccccctttacaccgggctttcccaatgttgctaacacaggcaggccagggaaaccccctaagaagttcctcgggccatgaaatctttagaaaagatcagaaagggaatcctagaaaatggcctccacgttccctttgttacagagatctttgagtcttgggcccctgccctaaacactccccaggactggaaggcctccatgagggctatgttgtctggatgccaattgccaattcctccagaggaaagttgctaagagctttgtgaaccatcttcaatgggtggtcattgaaaggatgaagtagttagtcagatggagagaaaacttgacgtcacacaacggtaactacaggatgcagaggtgagagcctcacaaaatgcattagattccacgtaaggaactccattataacagcagtagcaatgcttctatgtctttggagggaacaagtacagaatgtctctgataatgttctcacatagcctgggtgttggtgacaggaagttgtattaattaactcatctagtagactctgtcccaacattaacatgctggaatttttataaaaattctttgtaggaaatgtgttctgactctttttcaaggttgaaagatgtgtcttaaatctgaatgaaaaaaaatgacgttcaaaatttagcacggtggctggaggtttgattcccattacccacgtggtgggtagacccactcatgtcccaggggatctaatgccttcttctgacctctgtgggcacaaacatatgcagacaagttgctcaagcatacaaaataaaataaacagtctaaaactttttaagaagctag

SEQ ID NO: 839 - DNA, 2050 bp, Mus musculus
agttgtaatcttagggatcgctggggctcactggccagctagcctagccaattgggtgaactccagcctcagcaaaagactcatctcaaaaaacaaagtggagaacgatagagaaagacactcagcatcgacttctgacctccatgtgtatctctgtacacacatgtacacatgcgaaggcacacacatgtgcaggcacacacatgcacacgcacactcgcgcacacaccacacacacacacacacacacacgtgggtccgtgggatatgcctcttgggcaggtggaacttggagcgctcagactgcgtcatccagcatgggtcgtcattgtaggacgtcgtagctttttaaggaagctcagctgagacaccactcaggggttgggaaaacacatcctaggatgtggtaggccgaatctggggtcccctgattctcaggtactcagtcaaggcggaaaaccacacaggggagtcaggaacaaagtgccccaggtccaagggccccacaacgagactgggaccaggaaaatgggagctctgactaagctcatctgcacaagcccttagcttggcgatggttgtcatctgagggaaagttaggctgcagctctgtaggccaaggccttctccgtgctccccacagcagttctctcaagagagagtctttagttccaaactgtttatcatggaaaaatggatgcatatcatggaccagagattaaataccttttgcacagaggaatatccaggaagggaagcttattgtctaaaccctcggggccgcaagatacctcattagcatggagaactctgttttgggctacaggaccatcgtgtttccttatgtgggaaatgtggcgcgtgttccaggccaggaatctggtagggaacagagctgcctcccatctcaggtgtgtctaggtgcaggggactctgaacctgctcaacctaccaaatttcctggcatggtccactgtctgagagagagagagcgagagagagagagagagagagagagagagagagagagagagagagagagagagagagagaggaagacaggggggaagagggggagggggagcgggaggggggagagagagagagagagagaggataaagtacagttattccctctatatacatggtggttgtattcccataaaaaagtaattagcaacacgtgttgctcaacaaagctgagatacaggctctggccactgcaaaccctcttctcacactgaggatgcctggaacaggcagtgaatatgcctgccctcctcctgcctaagaagtagaaaccctgaatcttatttagaaacaagactctaagactctaaacataagaaggaaaacaagtatcagcttatgccctgaggataaaagaatgattcaaaggcatggagctatctgagccttgtttttacctcttgcatgccagattggatgctgagcaagctagcaacataaaagcacatacagaaaaaaaaagcctgtttcctatatgcaaaggaccaagcgaaaggcattgtagctaactttattgtggtcaaatatcacacacgcacatgcacatacacacacacacacaccctctgacccatccccaattcacacacacaaggccaaatagagatcatatatttccactctcagctaatgctaatgaggctgcccacccccacttcctcccacaggaacagagccagagaaatccacagcaaaacagagctcagtcaaccatctaaaaaattataatcaaagggagaattttgaaatcagtatgagacagatgacaccttccctacagggtagagataatcaggaccacaaaggattccttaccaaaaatcccaggaagcaggggaaacagttacattttccctgtgctaacagaaaagaactatccatgcagagcaacatttaaaatgtccttcagaaacgaaggaaaaatcaaaacatgctcagatgaaagaaaataaagagaaattatcaacagcctgcctatcctaccaaaatgcttacagaaatgtggtttctaaagatctcc

SEQ ID NO: 840 - DNA, 1800 bp, Mus musculus
acatttttaatgttaagtgacagataaacaaagatttgccacggagacttttggagctttagttacagcatcagtgccttagatttcttggaagtgagaagagacaacacccaggccaggcttaggatcccctcagtttccctcagcatcatagctggaaggcctgggtaaatctacaaaaatagtgttgaagctagctttagaatttcaatagttattgtatattcaacacagccacagaagcactctattttcattttaaaaatttacaattaaagtgatttaggtacacctcaaatacttgattatatacaaacccattacagggtttatgcacacagtaaatcccttcttattatggggttttgtgcacattaaatgcctggttgttgtagattgttgtttttcttgttaccattaaatgtaacattttcctaggtgatgaaatgtgttattattgggaacatttatttgagtgtgcattctgtagtttaaaagagaaaggtatttaaacagcaaagacttagctgttatgaaatttatttttataaatagctttcagcaaaaaccagagcagtgctttaaaattacagttaaaaaaaatcatttaatcatcacacttcctgttggctaatagggtagtaagtgacttttcctcttgcaataggctgctctagctctgcccactaagtgggtctgagcgtaccaggctggtttccgtcagcctccacacaaagtgctgagagttcagggagcatatctttccttccccgtaaattcacttaagtactagtcgtgctgcggctttaactggggcagacaaccagacttgagataaaatgaaaataatggtccaggctgggtgcaggggatggtagagcgcacatcaatacgctgagtgtgagtctatgttaatgtgggcctgatggatcagctttctcttttagcctggaggaccattaagccctggaagctgggtcaaactgatagagtcggcaaatatacagctcatcacttagcagcggtggttaaccggcacggctgcctaatgtgcaggaacaacgctgcttaaacattcgccatgatcaggacacagatcgggaagaagataatagattctgccttcatttgcataatcaaagcttctcattttccacctatagataatataagagggggcgaaaccacagccagcacttccattatgctgttaatcttgaatctcagcaaataatttccataaaaatgtaaataacttgtttcaaaaaaaaattgcaatggaaaggttttcctgtgttgcttctttggggttaaattgtagatacaggtagagcgctcctgtcctgaggattttgagggataagaaataaaactaagttttcctcctttttgtaattatgaattcttatagtgatttgactcatgtgcaaaactttttgccgtgttaagccagattgcttttagtgtacgggatttgaaaaaaaaaaagttgcaagttaccgaggtgaccaaaaaacttggtcgtttatttcccctcaaagcagagaaatggcaaagttcatagtaaaatgaaaatgaacaatgggagaaaggaaagagcgcagggccaagagttacccttcacagagctcagcaccaggggccctctggcatctcacagtggcgcgtcccccatcacctccatcttcctgtctccccttccatctaatcacgccacagctggggtgggtagcgctgttagccaagtactttcttacataatttccaaagtgttaaacttttaaacctggcatcactagc

SEQ ID NO: 841 - DNA, 3525 bp, Mus musculus
ggagctgaaacatcataattttcaaatttcataaatgaaaataaaagcttataaatggggatcatgctaattaatgtatatattttagtacagaattatatttattattattgccattagcttcctctgctaatttttttcaatgcccagtcaaagcatagtgaaactaaagtgtcttcaaaattaccattgagtttgttttatgttaactatctactgcggggcagggggcctgtccttacgtgaggcttgtataccccatgagattgtgttgcagaaaaactaatttttcctttgtgcgaagttatcaactgaaaatagtgggttagggatgggggctgtgcctgctttcctctcaaccctcggacccatctggcttagacctgtgcaacccctgtgccatacatatatccctgggtttttatgagccagtcctcttgtgtctagaatgtcatactttcttggtgtcttccatctcttctgcttccttgtctgcagagttctctgagccctgaagggagggatttgatggagacattttatttaggactgagtgttccatggtctctcatcctttgcacattgtccagctctaggtttctgtatttgttcccatcacaggaggaatgggttgccaataaaaataaacaaacaaacaaaaataaaacccacctcttggttctgtttaattctctgttgatggctgagcaatatactgatctgtgagtgtagtagaatgtcggtacagtcattttattgctattttcctaacaggacagtaatatttcattttcccttgggtctatggcctatctagtctcaggttcttggccacccgggcagtgtctggcatgggtcccatctcatagagtgggccttaaatccactcagctcttgattgcttactttcactgcttttgtgacccggttgcatcagcgtgtcttgtaggcaggccaccatcgtagattccaggctcagcctcattctttatccctttgcttgtctttgctcctcatctctaatgtgaaactgagatctgctcccccattgctgttcattcttgtagtgcacctgtgtgggcgaaagtgtagactcgtgggagagccccgagattgcagggaatcttgttggtgaggctccttgtgagtattaattccgaaggcctaccataaactaacttaaaaatcatattaaacctatcagaaacattatgcgagcaaaacatattaactacatttctgtattttatactcctgtgtaactgtagtagttttgacagtgcaatattgtggttttctgtcaagcttcatgagtgaaaatatgtaaatataataagcatgtaaatttctgatgcaaatagctatgcagacacaagagctggacccagcccactccggacagaacccctggttgaagccccgctgttctttctctgcatcattggactaattgtccatctctgcctctctttgacttctctcataagtcatcccaaggagcgcagagctctttcctttttaatcctggtctcactgtgtagtctaggcttgtcctgatctcactgtcttccttctctagcctgctcagtgcttctgattcaagcatgtatgaatacctaactgtatcattcttattatgtatatttccgatgaatatgactaagtgactgtgatttctgccaatagagaggtatgggtggtattaaaaaatacacaaaataaataaaacccacctctttgtcctgtttagttctgagcaccaggactggagaaggaagccagtgacatcagactcacattgactaggggggagtgtagatgttctctgcagtctggcttctctgcttttcacatccagctgccctgcttgctgtttctctgactcttagctgtaattacattcattcaagttgctcccttcttgaaggcagaagggtgtctgtcaggactgagtcatttatacccagtgtaaatcccaccgggctggttcctgctaacaggactctgtggaaggatgggtggtccgggctccgggcagggcagtcggtgttttgaagcttagcactgcagcagggtggtgggcagcgtgggcctggaagtcctaaggacctgcgtgtgacaacgtcgtcatttttcatctgtgagacctgtaaaaggtcacttgattttccgaagcctgattctttgcctgtaacacgaagataataacaggttccttataaagagcttatgaacatgaaatggaataaatatagaaagttcctcacaatgcctagatgtaggagacattcctacgaatagtgtaataataaactgtctctttgtttgttctcaggtagccacagtttcaaagaattaaagagttcagatgtgttctgtagttagttaaggcaatgttctcttttataaaatagtttagaaatattactactcatctcattggctatatggggaagtgggttcgaatttttttcagccaaaacaaaatagacatttaaaacacaactcatttttcattatatttttatacatttgtttctatcttaagttgttttataaagggaaggctttcatataactaaaggttggaatctgtttaatgcaggggttttggattgaaggatttttctagcagaagaaagcatcttgcagttttctggctgctgtaggatccgtcgtgaccatgtggctttggggacatttgggggtagctggactaatgcagctgcaagtgcaggttcaggctgtgtcattcaggctgtgtcatttcgtttctctgtcgctggttagtatttccctttaaaagccctgtgatgacctgtggactgtggggtgaggagatgtctgactcagtgttaggaaatataaatgcgcagatcgttctgaacctgaatctctgtattgttatggaagtgtatctcagtgacagtcactcagacagagcaggatcattgtacaaagccacaaagagtggctgttacccatggttttattaacagtatctagtacagaggggtatttttaagctattcatattcacagaagtcagagtaattctattgatatttattggaaggacatatatgccactaaaactaccttgttgtcagttgtgaaaaaactgatgaacaagtagtcttagactcacagagctgtagtcattactttctaatataaaaattcagtagccagatccgctacctgtgccttgttgattagagtaagtgtgccatgtggtacttaggagtcataggtgtcgaggcattagtctgctcccttttaagaaaaaaaaaaaacattatgtttatggaaatagacagtgtatgcttctatttaaacatcctactaacactctgttagtcactaaaatgctaaatatgtgcttgtgaatgtcttgtcacgatctgtttggaaaagaactaacttttaaatgatacatctttatcttcatagatgggtatcacatgttactaatatccaaatttatttagaaaatacgacattgaagaccacctaaaattaagt

SEQ ID NO: 842 - DNA, 1825 bp, Mus musculus
tctcatggaggcatttccccaactgaagctcctttctctgtgataactccagcttgtgtcaagttgacataaaactagccagtacacagactttatagttacaacgagatcttgttggattgggaaggaccataaacccagtacatgagttgctatcaaagcccacacagagacacatggaatcaggaccatgtaaggtggaagtacagattggactagcagtgccacaagataaggaacatcaatgattgccattactgatggcctttttccaggagaaaagcatgggcaagtcctctcccaaagtccccaaagggattatctacctaagaccttaatttgagattttctgaactgtgatataatacatatatattatcttaagccaattgacttttgcatcactgttagggaagcccaagaaagaatagacttctttgtagacattataggtttgggagtacccctgtttttctcttggcctttcaaagaccttccactatgtatgcactaaaaagacgtttgcctccttctcatgagctctacagggtttgtggtagcccaagtccactccaccccaggactcgggaagtccactccaccaagtccactccaccccaggactcgggccactcgggaaggtgggatgcgggagttttgactgcacttaccccatgccagcacaggcctgaggggggtggcagggcggttgtcaggctatgagaacctgccgggcaccggaccagggctgggggatgctggagctggctcaggggtccccgggcctgcagagaggccagggacatctgcttctcaggctcttggacagccaggcaccactggatgctgtggaagagctgagaatggggtgcgggcagagggaaaaaggcagggaaagctccagctgggtcctgcagggaggagtccttggcttgttaggcaggtggctgggcttggtggaggccatggctgggagccctgagaggccttgagctggagatgagacagccggctctttagatgaaaacctgttccattgctccccacggaggatcccagtgaaaagaggcagtccatgcttttaagacattgattgtcatggtgtaaagtagaggaataaaaccttaccccacttctcaggggcaggtctgaggttaaataccttttgcagggaggagtgcctgggaaggagaattcattggctaagcctccaggccttatgatacctcattaaaatggagatctgtcttgaggctaaatgactgatggccacaaatctatggagggctgaggcctcctgtcaggagcctagtgtctgggagcatagcaaaatgcctacggttcctgcagggccaccggggtttcaagcctttgctcgaccagaaacgaggctgcctttcagggccctacagagctccactttgttcattggccacatccatcctatagatggttttttttttcccgtttttttcagctatgattgataaacatgctatgtcaaggaatataaattgatatttgaaatatgtattataaaataattttcataatcaagctacttggcatgcatgccctatcacttgagtgtgtgtgtgtgtgtgtgtgtgtgtgtgtgtgtgtgtgtgtgtgtgtgtgtatgtgtgttggaagttagaatctattctttaaaaaaactttaattatgaatacacaatgactgttcagtacaacagaattagatctccaggatataatcatcttggatctgaaagtttgcttccgttgaccaacatctccagatttttgaaagatatttgaaagttcagcttcagctggcaaagtc

SEQ ID NO: 843 - DNA, 2350 bp, Mus musculus
cagacagacagacagacagacagacagatagacagatagacagatagacagatagacagatagacagatagacagacagacagacagacagacagacagacagacagacagacagatagatagatagatagatagatagatagatagatagacaattttaccaccatctatccaattaggaaaccttatctatcagtagttccatagcactgtatagtccttgattttcttcatagaactgctattggaagcacaatgaatatcaaactattaataatgggacagacttacatgttttaatattctcaaatctctttgtttaccagttacaagaagtacatcctgctcttgtatatactgtttccagcagctacccatgtagtgacttacaacctcaggctctgttaacctcaactctctaactctatctctattccattccattctatttgcccttcccctctcttgttgccctgccctattttcattcctgactgctgtgaactactcagcatttatccacatttttttataccatgatgcttctttgttaccagagtgtgggttaaaatggtatgccatgtcctttgactgcatacaccccacgccactgccaggcaggcgttgggctgtgagaagctgcaggaccctgctccaggggttgggaggcaaagtctgaggtccctgtgaaactgcaggagtctagcttgggggtccccgggctacatggagggagattcatactcttgagcactgcagatgctgttggatgccacagaagaactgagaatggagtggggaccctcagagctggctctggcccagggctgaagggaaaagggcaggaggtgagagctccggctggtttttgcagggatgagagtgtcctggcttgcttgggcaggcggcttggcttggtggagaccttggctgagaatgcagaggcctccggcctgagattagatgcagctctttagaggaagacctgctccactgctccagcactgcagatcctgatgagaagagacagtcgacgattttaagacatttcttgtcatgattgcattatgatgagtgaaaattgtgcccccacgttctcagggtgggcctgaggttaaataccttttgtagggaggaatttctgggaaggggagctaagagggtagtagaggtagagaaagggagaaaaaggagaaagtaaagaagtagaggccagctatggccacatggagagagggggaagggaatgcagaggaagggggagcaagatggcaagagagagaggcaagagtaagagagggaggagtgggcaagtagcccctttatagtgggccaggaatatctggctgttgccgagtaattgtaggggtagagtccagacagaataccaggggctcagggtgttgccctacatgactgatcaccacagaattatggagctgagatcttgagtcaggaacatagtgtctggcatggcatggcaaacatcttctgttcctcgcaggaacacctgctgggtctccagggtataaacctagctcaaccaaaaaacaggctgcctttcacggtctcacaccagaggattgaaagaaattcagagatatgatccagggctcaaagatactctgtgagtcaaaataaaccattctacttttaagttcacattttccttgtaatttttttcaatatcaattagttaatacagcaaatatggcatagtgaaaatttaagcttcacaaatttgtattcctataaatttgaatatttatatgcatgcatacatttctatgtgtgcatctggaaatatatgcctatgtatatgtgaatatatatacatatatacttgtctatataggcatgtctttgtctttgtggagatatttatgttgaaaaataaaaatatgcatatttcatgtatgtatgcatgcatatagatgtatgtatacactcttgttcatgtggatgtggatatgtatgtacatgtatgtatttatgcacacttacctatatgcatatatttatgcatgcttgtatatgtgagtgtatgtttatgtgggcataagcatatatatgcatgcatgtgtatatgtatatatacatatatacatatacacaagtattcatgtatgtttgcatctggagattatagatgcatggatggatagttaggtaggtggataaatagataagtagatattatgcatgtgtttgtacttgtatctgagataagccttcactctgatgcttagattgatacagatttagatgctgagcacagcagtgtttaaaatcacattaaaataaataagggattcttctgagttcagtatggatgtcaaggaaaaaatga

SEQ ID NO: 844 - DNA, 4200 bp, Mus musculus
gttagctatagatcagaagtcattagaccctgtttgtgacgtgcattgcatcttcagaaaaagggacttttcattcacctctgggagataatgagagggaatagcaataggtataatgttttggaagccctgaacaacagctcaaaatagagcttctcatgtctcatatttgatttctttcttcttcttcttcttcttcttcttcttcttcttcttcttcttcttcttcttcttcttcttctttttttttttttttttttttttgtttttcaagagagggtttctctgtatatccctgactgtcctggaactcactttgtagaccaggttggcctcgaactcagaaatcgcctgcctctgcctcctgagtgctgggattaaaagcgtgtgccaccacgcccgcttgattttttttttaaagagggtctttggctcctagagagcactctcagctcaaacaataaatgttccttaaaggaaacaagttccactatgttcaaagcagccttatttataatagccagaagctggaaagaacccagttgtccttcaacagaggaatgtatacagaaaatgtggtacatttacacaatggagtactttgcaactattaaatcaatgcatttatgaaattttatgcaaattaatagaactagaaaatatcatcctgagtgaggtaacccagtcacaaaagaacacacatggtttgcactcactgataaatggatattagccccaaagcccagaatatccaagatacatttcacagaccacacaaagttcaagaagaaggaagaccaaagtgtggatgcttcagtcatccttagaaggggaaacaaaatatttatgggaggaaatatggaaacaaagtgtggagcagagatggaaggaaaggtcatccagagacttcggcacctggggaatccatcctatatccatcctatatacagtctccaaacacagatactattatggacaccaagaagtacatgctcacaggagcctgatttagctgtctcctgagaggttctgccagagcctcacaaatacagaggcagatgctcacagccaatctttggactgagcacaggctcctcaacgggagagttagagaagggacagaaggagatgaaccccataagaagaatatcagccaactagaccccagagctctcagggaataaaacaccaaccaaagagtacacagggagggacccatggctctagccgcatatgtagcagaggatgaccttgtcagacatcaatggaaggagaggaccttggtcctgggaaggcgcgatgcccagtgtagggaaatgacaggaaggggagttgggaatggatgggggagcaccttcatggaagcaaggagagggatgatgggataggagcttccagaaggaaaaccaggaaagagataacatttgaaatgtaactatataaaatatcaaataaaaaaaaagaaaacatacaatagcaaaaggaaaaaagtatatatgtatattatatgcagaattacatttattgtgcatgtatttatagatacaacagataatagtatggtttcttgtggcctttacatgcagcattattggtattttattctcttccctcctccttctgtactaaactgaagaccacacccatctcccctatcagatcacttgtgctctggtattgaccttctcttttctcatgtgccaactccttaaacaagaaaaacatgaataacacacaacaaacatttccagttggttccagatggcttagaataatgtgtagatgaaagaaaaagacctatgtggtaaagaaatgaagtagatgatggaggaaattcatgattatgccaatcccccacttctcctgcactgattgtgttaccacctccttggattttctcatgccgttccatatggaaaatgtcttttctctgctgtctatttaaatattacctatttataaaatgcctagccgtgctctcttatctccctgatcattctgactatataaatatctcctgactgtatttctacttttttttacttaatgctaccatatgctatcttgtatgcctacatcttgcattattagtcattgtgttcctattttatctattctatccatatgcctaatctaaaataataacttcttttgagaacaggaactaggacagatgcatcttttaaattccctttgttgtccttgcagggtatctccagaggtacaatacagaaagtctgtgaatgcataaacagaaatctagtggaggaaggaatgactatgtttgtagtatagagtgcttcaaaggttttcagtaaattgtttcataccacaaactttttggtttccttataagcaaaacaatttcatttgtttatatctccctctgacagagatggcctgcttttcatctcaggaattctaaaattatgttcttcttcatcatcatcatcatccacaacaacatcatcaaagttcttatatgtaaaagcccactacaggttttacatagtattaatgaatcctattagaattgctttgcatatgattgttttaaagaggggatgcaacgtattaagtactgtagaatagcgaaagtgttggaatgggcagaaacagactgcacacagaggcattcagtcagaagcgtttgtttttaggtcctttttaatttcatggaggaaaatgtctttcatctcttctccacacttgaacagcaggtgggcagacactgaaatttttcaggagactgagcgtgtgggttagccacttggaagaagttcaaacgtcatgtacattactgatgttgacaactgtaactgcaggacacggggaagcaatcctagcctgggtagagctggcattttctagggatttttttaatagaatataaatgttctgacactgatctaaaactagagttcctgaaggctgtggtgtgtaccaccaagtgtgagtccaggcttatacaaaagccgggatggaatatttcacttgaataaaattgagagcactttacatgttctgacactcttcaaatcacctgcaggaactttggttggaaaacaccaaatctgctattcattgtttccactgatgcctttgcttttccagggtctagaaaaaaaaaaaggaaacgtgttcaggagcataatgagaagttttgaaagcattcaactgaggtgactgttactcttctatttcttatagcatataaagtgcctcctctgtgtgtgtgtgtgtgtgtatgtgtgtgtgtgtgtgtgtgtgtgtgtgtgtgtgagagagagagagagagagagagagagagaggttctccatttcttaactatgtatagcagatcagtcaaaaatcattggataaactttctcagaattaacagagatgaagcactggagaaacaggattgcaaatgctgagctaaagaaaccttcttctaaggcttccgtgtgcacaaaagcatatgcacatgatcttaaaaaataataatgagagcaggttgcaactccgtggcactaggaagctatacatgtgaggggcagtggattcagttcacaacaacagaggaaaatcttccgatttttctagtaccatggtcaaagacaaagccagtaggaaaggccttcctaatagcactcgtatctcttgtaacaagatcattaaccaacaaattcaatttcagaaaattaaaaattatttcttacaaaaaaatatctgttacatgtagagacagcctatatagtgggaggaaatctttaccagttacgtatttaacaaggcattaacatctataatatacagagaactaaaagtactaaatagaaataagaaccaagaattagtctttttacgtgaaatggcctaatcttttctctctgtgtatcacacacatatcagtccacaaaataagaatttgctagaactagatacaatataaatgtgattaatatatttctatgagaaaatttatatttgaacagagggtaccagatgccactttcaggagagttatctttagtttggtaggatgggtcctacaagagcatattgatacacaagaaacaatcaggaaacttaaatagtaaaggaaactaataactgccctaaattgatgcaaccccaagtctcttaagactcttgttagaatgttagctctaaggctttggctagcaggttttaagtccatgctgacaaaaaaa

SEQ ID NO: 845 - DNA, 3850 bp, Mus musculus
ctataaggatttagatagatactacacaggagagctaaattattaataaataaaatattgtaaagcttacaaggcgataactagttcttaatccataagttgacaaagatttgaataactacatattactgtcggagatgcagacagcattcgattgagcttggagaggaatgaaggactcagctgattccctagacattagaatgttttaagacctggccatttacccactgtctaacatacagctggtagaagacatgatgtagttattgggtaataatttggtaaggtgtgtcaaaatattaaaaggttttaaatcctttaaaggatgaatcacatcttctattagttctctgaaaattttgtacaatgtgttttgatcttatcccccctcacgaactcctcccagacccactatgttcctgattttgtgtcttttttttttttttttttaaacataagctcatcaggtccagcgtatgctgtccatatcgtctaaagtatgtgaccagtcatggagtttttgctgtatttacattctaaaaccatcccctttacattataaagactccttgaatatatgttcaggggcctgacacttggctagaaatttgaggcaccgtagacatgaagcctgtgttttcaggagtctaaaggccattggctcccgtcaagtccagttcttttgggattaaagcacagcatgtgcagaagacaaaccttcctgaaaggtggtagggaagatcagatgcatgcctgttccagtagtgaaatggtgacagttgtgaagttggtgtccagggtgacaaagaggaagtgataatgtctcatgctaaaccatgagagtctggactaaagtttattcagaactcatcaaaccctaccgtttaatgttcatgacgacatcaggggaactctgttgtaatgttagaaactatcatgttctaataggaaagtgctatcattcccttccatattccaggtgatcaaggccaggggccaggagacctgcccacttagttagcaagaggcattggtggtgctcataccgttctcacttcattctggcctccaggtccagcatgatccttctagaaagaaagaaggtaaaaggagggagaggatcttcttttatgagggaatagatatgtgtggaacgatgaaatgatggcaggccatacaaaagactacggctctgactttccaggaaactggaaactacgaaaactactactgttaagcagggaagaagtaatgaccaagcttccctctggaatgctcacgttcgccaatcaaccaagtctgagaggtattctctcagtgtctcgcccctgaccgtgggccatggtacagctacatgctccttccaataaaatagaatggctcacaaatggaaaccgttgctacagggggttaataaaattgcaggaggccaggaaagtcaaatcacaatttaaaatcctcctttcactgttggcagccggggagtgacttgtgagcgtgggcgtctggcagcgaggctttctttggcagtatattgtatctcctcctcctcctcataaacatttctgtttattttgtgggagggtaaagtgcctgacagactttatccagcaggaagccttaaaattttcaagttccagcaacctataagccaacacacacacacacacacacacacacacacacacacacacacacacacacacaacctctcagatatgactcttggaaatgtggggacctgacaggtgtgggctttgcctgcctgtctccctcccaccctcctctcccacatctgtgacactctttctatttctcatcttttctctggattctgcctcccaggggtccaatgctctcccattgccacagcctctcgatggatgccgctccccagggcatgtctgccctttgcacaactgcccacctttcaaaattactttcctacgtttctagttacaggcattaaactcctcctgagactgagctcaagtacatgttaggaaaagagaaatttaattaaattgccctcccataaggtataaataactcacagagacaccctgccttattcatctgatggttgcaggtatgtgggcaattaatgaattaactgaatccctattgctgcacggagaactgtgataacaacagcatcttccacgtggggccatgcgttaggatcctgaccaacatggctccatgtcagccagcctgcactagcttccttagtttaacttaaactgcattaaacttccttagtttccttcctgtatgtgagtagttctacccccacccccaccccctgagcagagcacacttatcagctgtggcccttctcaacccttgggtctcccttgtcttagtcctacaaacccaagcctgactatttgttcttgctctgtgggtgacactgtgaaacagaatgaagaagcaaaaggggaagggaaaggattaggatagaaaagaggtgtcagcaagcacacgttggtctatgttcaaatgagaaatacagttcattaaaaaagaaattgtgagcaaccgtagggaaaatgttgatgggccacaggacaagggggcacggaagggacactttatatcctataatataaagacatgcactgcacattgtaaaaaggcatcaacatagccacgtgatgtctagttcagcaacacacctacaccattaaggatttgtttattctgagtgaaacccctctcaacccaggtgccactggagggatacactgttggcaggtaacaacaaatgaatagactcagcatttccagacttcaacccagacaccacagaagaaaggcaggatatgagggatcataacaagacatgatcatgcaacatgtgcctcagagatgtggcttgctgcctgagcagaggggagactgagctttaaaatgactgagagcttgtgtccctatcttttccctatgtatactgttgggtggaggttaggtagaagaaaggtctttagctggttactccactgttttctcactgttctataaataaaatgcagttttaatgacctggttgctgtttctgcttattgacatctgaacatgacaggccgcaaagagctgtttgcttctgatttccctttgaggaggcaatcaaactaagagaccaaatttatggtttggccttgggtttgaaagagcagatagacacattaacattcccatcttgcataagtttgctaatgtctttgggtccaagtgtcatcatttgtaaaattaggggttgccggagatagctgcaggtcctgcgagactgtgagagctgattggtactcaatgctaccccacactagctgtcatgaggacaatctagacttatgtgtcagaactatagtctgcttttcaaaggtagtaaggaccagggctttgtgtcattgcagtatagaagaaaggccatttgcacagagagatgtggttgaaagatctttcaaattgtatccaaagactagggctcttgccctattctcacaataactgaacttcagattataatttaattatgttgaaactcaatttctttcttacaataagggttataaatatctccctcttctactttattgcaaactttgaaggatcataatttctgacttttcttattgtccagaccagttgtgtcttgatagtccaggggacctattgcccagtggctgttaaggcaagcagggacaaatggggatgagtctagagggttgttttttttttttttttttttttttttgacatcaaatttaaaagaaattgcataccaatgactgaaacagttctctttggaagtcatatattggcaatctatgctataattcttaaa

SEQ ID NO: 846 - DNA, 2125 bp, Mus musculus
tcagctcctgctttctgacctgcttgagttccagtcctgacttccttggtgatgaacagcagtatggaagtgcaagccaaataaaccttttcctccccaatttgcttcttggtcatgatgtttgtgcaggaatagaaaccctgactaagacaaatatctttaagggatttattcatttcctctttaaggacctctaacatcttcatagagttggttttaaggtttgtctcttgtgcttcagcagtgttagaatatttagggtttgctgtagtaggatagctgggctctggtggtgccacattgctccagctgttgttgattttgttctttttttttcttttttctttttttctttttgtttttttgagacagggtttctctgtgtagccctggctgtcctggaactcactttggtcttgaactcaaaaatccacctgcctctgcctcccaagtgctgggattaaaggtgtgagccaccgccgcccagcgttggttttgttcttatgctggcatctgggtttgggttattataggtcttggtgttggtttgtgagtttgtttttgtcaaaggagtgttttgtcccttggcttctggttcttctttggtcttctggtgtttgtggtctgtatttctggtgtcttaagtatgacctctggtctatcagggagtctccatcagagttgggagctggacttttggcagctaacttggcctttggtccagcaagggtctctgcccgaattttggggtaggacacagtgatgagaggggagtagcaattgaggatagcatgggggcactgagagaagaaagaaagactatgggtgggccacctaccacctatctgtggttctggtgactggtatggtctctggcccagcagggagtctctgcccaagttggggactagagctctgctggctgccgtggcctttgttctagcaatgagccttgtctgagttctcttatctgtttttctgacctacacatggcctgaacctgttcttcagactggcatggtctacatgtaagcagcagatacacacttgtataggggtgagtggggcagtggggcagaagagtatcagtggcttcaaacttgagatctgaacagagggtgtgggaaggttccaaggacaggtgggcctcttacttgttctgactggtgtggtctgtacctctaatttagttctcttaccttactgctgtgcctagggttttcagtgctgtgtgaaatagcaaaggcaagataaacaattatctttgtcttgtccctgactcaagagaaacaaatttccatcttttcatattatcttgttagctgtgagcttttcatagatggcctttattgtgttgaagtacatttctttctgtaccaaattccttatacacctaccttcaaaatacaaggctacagtaatcaaaccaaaatggtactggcataaaaaacagacacatagaaaaatgggataaaaatagaggaactaaaataaattcttccattatgacaaattgttttttaacaaaggtgcaaaacacgcataaagagaaaggaacatagctctccagtaaatgaatgctcacatgcaaaatgaagtggcaccatgtgtaacaccatgtaaaaaaaaccaactcaaaatgttttaaagatttacgcataagacacaaaactaatagaaaaatgtacagtcagatgctttaagacatcagtacaggagatggtgtgtttgtctaccactgaaagcacagagaagaaaagcaaagacagacaaatgggtggtatcaaacttaaacatgtcagcacagtcaagacaactgtgtgaaacgacagtctacaaaataggagacattgtctgcaaatgatctggtaaagggacactctgttggtttgaatagatatggcccccatagattcatgcatttgagtgcttggccaaacactattaggaggtgcggccttattggaggagctatggccttgttagatgaagtatgtcactatggaggagggctttgaggtcttaagtgctaatgctattgccactgtgaaacactcagctcctggatgccttcggatcaagacatagaactctcagctccagcaccatgcctgcctggatactg

SEQ ID NO: 847 - DNA, 3525 bp, Mus musculus
aggctctcaaccctgagcatttcttacctgtctgacccattccatacacactcaaatttatcaaaaatgcagtcgttttcatagagggagcacaacttgctgcggaggtagtcatgaacctaggaggaaacaccaagaacatgtcagcatgacataaggcagggattcctgtgaataccaacttggtgacgtgttcttcatcccctctgtgttcccttgcattgcatcgggtggccctgtactggatgcagccctccctgtctttaggaagagagcctgggtcagtgagctcttatgttagtgtgcattgaagaaggttgcttgaatacatagtggcataaagaaggagccagtaaatagtagaattattattattattattattattattattatgtgcctgcatgaccatgtatgtatatgtgtatgtgtgtgcgtgcacacacacagatggagggcagaggataattttgtagagttggttttctctttcccttatatgtgggctctggggattgaattaaggtcagctggtgttagaggctagcattcatttagaattttgacaaactgctgttcattaaaagtctgctccagggcttaaggcagagcatcgatgaagcaaccacagagtggaataaatgcatgagaagtttcaaacagtgctaatgtcacagagtatgaaagtgaaaaaggcacggagagatgaaggacattactttttgtagagtgggactcaaggtgtgggaagataacatggcctcaaaagcctgtgaggagtgaatgagtctgggcaatatctgggaggaaggctttccaaccatagggaagaagagcatatatgaagggccacaggtccaggaaggactatgacagacatgtgtggcaagtaagcatgaccaaggtgaaggatgagatcatagagcacatcatagagcaacggagcctactgtgtttcaataatgcataagagcaaatggccgaggccaaggggactagtttctgcctcactgatgagtggctggcattgggccaaaagcagtagctaaactctagacaaggtgtggggcagggctgataggacacagagtcctggggagtagagtggaaagctggagtcgaagaggcttcctggtctttcttttgagtatgaggtggctgggcaggagggactgctggagtcccttccaagcacacaggtgaagctatggatttgaaaaccggatccattaaaaacaaaacaaaatgacaacaacaacaacaacaacaacaacaacaacaacaacaacaacaacaacaacaaacccccaaacccagaaacattgagaatgaagatggagttgaaaaatccagtttctgaattagaaaactcagggggaagtcttataaagagatgacaaagcatcaggtctcaaatattagaggaattagaccacacaaacaaagaatataaaaattaagattacacaggaaagggctatgcagggactgtgtggcggcatgaaaagaccaaatcttccaactataggtatcgatgagggtgaagaattctaggtcaatggcatagaccagatcttcaattattgaaaaaaatcttccctaaggaaagacacacccatacttatacaggaaacacagtacaacagacagaccagaagagcatatcatcaacaaaacactatttatatagaataaagaaagagtagtaaaagttgcatgaggaaaaaaacaaaccacaaaacacatataaaagaaaatctatcagaaaaatagctgatggaaactttgaaagctagaagagcctggagcaatgcactccaaattaaaaaagaacatggatgctaagcttgactacaaatccagccaaactatctatcagtaatagagaaaggaaaacttcccatggtacaaatagtctaaaagaattcatgccaactaaatcagccctaggaagaaaactggaacaaagaaaagccaagagactctagaaagaaaacagttgtatttaatgaaatgtgaacattaagaacacaaacagcaaaaccacacacacacacacacacacacacacacacacacacactccaaacccaaacaaacctaaaataactataatcaacacatacctttcaataataactttaaatattaatggccttaatatttcaattaaaagacacacactagctaagtggattaggaaacaaaagtcaatctgtctataagaaattcagcattaaagatgggcacaagtctaaaaacaagtaggaagcaagcaggtattgctatcctaattttatgccttcatattaaaattaaccaggcggaaaagcaggtaggctaactgcagatctctcctctaaatccaactccctagttttatcctcacctctgtagcaagtcatctgctgaacacgccccctcctctcagccaccatctccagaggatcaagcagacctcctcccagagcctccccttccacattgtgtctgctcattaactcctgtaaaattccctgggaactcacaggctaggcaaacaggtaggctatcctctctcttctaaatccaatcccctagtctcatatcagctctgtagcagaataactactgtgatatgtatggacttactctctgccccaattcccaggtgactaagcagatattgatgaatcaccctgctttcctccctcctgtggaccctctcaaccctgcttctagtccattcctattcctaaatgccaactcccaatacataggaacacattgtacccagaaccacagtgaccacactgggcaggatcccagaagcattccataccaggcaacacacagccaccactctcctaagaaccagaaggagcaacagaaatcaaggaacaaaacacccacccataaaagataggaccagatatcaggacctagaattataatcattccaaacccagatgttggggtgaaaacacaacactcagaacaatatatctccatgacacattgcaactcttttataagagtccctgtaaaaggctgctgaagcacaagataaaacagtctgtgaacatgataggggtccttagagaagaaatgaagaaagtcccttgaagaaatctatgaaggcacaaacaaacagtgggagaaaatgcataaacaactcaagacctgaaagtagaaacaatcataggaaacccaaactgaggggactatggacatgaaaaaacgtaggcactcaaacaggaacttcacacgcaagcctcatcaacacactacaggaggtagaagagggagccccaagcatcaaagacaagacagaaggaatggagagttcagtcaaagacaatgttaaatctaaagagccccaggcacaaaacatctagggaatctgggacaccaaggaaagacacatttatgaacaataggaataagggaaagaagacagctggtcaatggcccagaaaatattttcaaaaaaatcatagaagaaaatgtccccaaccaaaagaaggaggtgtcaatcaaggtaca

SEQ ID NO: 848 - DNA, 3150 bp, Mus musculus
tttgtttggatcaatgaataaacttcccaatattacaaagctctcagagtacaaaaaattagagtctgatgctattcttagcacattaatttgaatgataaagtatcaatgagcctagtcaatattagtcaaacccactaaatccatgtgattgttcagataatgaaaaaagaaaaagatccccaaactaaccaagcagattctgtgaacactgagaggctaggaagctgtttgaggaaagctgtgaataattggtttctaggggactgaagtatcacatctgatatattgcaaccattcttatagtcactgtgagacttgggagttccctgatggcccacaaaattagtaggtcataattgtatattatggatatggggttttcatgtgaaggctcatgtgttggaagtgtgatatccagttggtagctctgttgagagatctggtaaagaaacataaggacacaataatgatttctcagttcaataggctctaaaggtgtaaggcctcattggaggaagaaggtcattgaagatgtgcctatagtgtgtgttttgtcctaagatcttcctattaggctccctctgcttcttggctacagtgaagtgtccagctttcctctaccaagcccttctgccatgatgtcaaacccattaaggtcatgtaattaattattgccacgagatgagcagccctctctacccacccccacattcctactgtaatgttacgctgctttgtctcaggcagaatctatagacacagccagctctgcactgatacctctgaatctgggagccaagctaagccatgcagccttcaaactgtttgcctaatgtgtttgtcacgatgatgaaaatggatattttcaaaaagttgacaaacatatatgatctatggaaagtatctagacattaaacacaaggaaattgctagaaggaaaattaaaaaatggactgaaaaactgaaaataatagctaatcaacccatttttcttaatttaatagaataatataaaactatataacaaggtaattcaataaaatatacagcataaattcgagaaaatctttatcatgcacatcatagaagattattaaaaatggttataaagacaaagagattttaaatattcagaaaaaggccaagcaaaagattatcaaataactgtaagttattgaaataatggaaaaatatcatctcaaaatctacaattcttgcatcatatgaggatataaaaatctcctcatattttcaaagttaattcaccatccatatgacttttagatgtaaatttaattctatgtgaaagaacagaagatggtcagcacctgagtaaatatgaaagaactgtacattcaattcacttatggattgaaaattatttattaaactaaaatcaatagtaaatgttacattacataatgtactaaacttaaataaatgtcatatgtaaagaaaatggcaaaaagtcactcatggtaacatttattgctgttacatgctatgaaagtggtatagcactgtgatatgttacagacacataacacaaactccagagaaaccactaggcacaaaactaagtgatacagctgatgagtcaatacagaagagatatgctaaaaatagccaattaatacaagcaaagtgaggaaacacggaaatagggagcaaagaacagatggataaacagaaaaacagcaatatggtaaatttaaaaatggaacgagcacaccaattaaaaagcagagattgacagactggataaaatgtggggccaaactgagtcctcgctgaaaatactttcagtagaaaaggataggtaaaaagcagaacggtagaaaaagataaatcaccggagctgtggctaagagggctccatgtcttcacacgaagacttcaggatgtttccctgtattagctggggaacttcatgctaacttcttgtgtcagcctgattggttaaagtgtattcaggtagctggtgggccctgtgtctgggcgtgtctgcagtgatttggaagaggatggcatttgaatcctcttggactggtccacccaggacaggcagagcacagtggtggactaaagacaaatttactgagtttttaggatatggtttattcatcttctgctttccaatgtcagtgtcacaggccttcaaagtgcaggactgaccaatggtctcttaatttgcaggtgattggtctctgatgaggaatcccatcacttgctgccctggatcaaacctttgtcttcacacttaatcttccactagacttcctggttctacaagtggtagacagcatataacagcgtttctcaatctccctatctgtgtgagcaaatctccttatagtctcttctaaatctctgcatgttccattggttctgtttgtctggaatacgctggttgaatattgataatgaggtcactgtgtcagaaagacatatgcctagaccagccataggccctaggggagaactattattctgctaaagagacacacagtatttaaacagattcttaatgactcattgttacacacatagattagtacatatgtcaatcctcatccgagaaacttcattttgtagtggatgatgattaatacagatacccatgactggtcaaggagcagagaatgtcgagagcccagccatgattggcgcatctttatcatacttctcctcccaaaactcagggaacattgtggaagagagggaagaaagattgtaagaacgagaggtggttgacaaccacaacagtctcttcagactcagtggcgtagctgcacgtatgaatgtgcagcagttgtgctggcatgtacaagacctgtgcaatcatgtgtgtgtgtatgtgtgtgtgtgtgtgtgtgtgtgtgtgtgtgtgtgtgtgtgtgtgtgtcggacagcaagtctcaccccaagctaaaaagcttttgggaacaaataggtgctgggagaatcagttttgcttagggtgtaactctttgtagatcgaccccaatacaaagccacatatccaaaagtttatgggcataagttatatttgatgggttgaaaacagcaaacaacaaaaagcacacatttgggaaggtgaatatgatcaaaacacagtgaatggtttttcctaattcttactcacta

SEQ ID NO: 849 - DNA, 3675 bp, Mus musculus
ctcacaggcatcttcctgtgtggatgcctgtggatgggtgattggtttgtaaactgtgggactgctgtggctgcctaactgggtcctagaaacctgacttggaagtacgaggtgataaagaaagacagacacaagtaatgagaagctagggttgggtgggctgtgcacttgaatagagacacaccagcagctggggtactcagagtatttataacatacactaggaggtgggttagctaatcacagtaaggggtcttagaagggtgtggtctttcaagaatttagcattcttgacatggccttgctcatgccaagaacactcaacaaaagagtggtaagctctctccgaacactggggcggtttacacaacagaatggcaaacagctgttaaagatataagcatgccctttatgctctaatgttggataccagccagtaaatattattaatggaaatatgcaagattttgcagaggagatggggatgtatttacatagatctgctaacacatgtacaagtaatattaaaaaattctcaactctcaagtgtcagttacctctaggccaggtgatgcttttagactgcagtaatacgaaggaagttggactgaagttgatttttttcaagcttgaactatacacagagttaagtatcacttgcttagcagacacatttaagggttagaaagatcctctgtagggtctttatattgtatctcatgtctatagaggtctgaatgagagcagctcttataagctcatatatttgactgcttggtcctcagttggtggaactgtctgggaaagattaggaagtacagccttgttggaggaggtttcaaatacctacacaattcattccctgtccctctccctgtccctctccctgtccctgtccctgtccctgtccctgtccctctccctctctctctgtctgcagcttgctgattagatacaagctcttagctactgctccagcagcatgcctgtctgccctcatgcttcccaccatgctgatcaaggactaaccgtcccctctgaagctctaagcaagcccccaattaaatgccttttctcgtatgttgccttggtcgtgatgtctccacgtggcaacactaggagcgccgtctgaagcactactgatggttctttgaatggaaataatttttctcaaatgcaatttggcaacaagtgaggggaatcttaatgtagcgctcactcctcaattaacttattgcacatttggatttattcagaaaaatatagatataaaatatgttcatcatggtgctgtaacagagaaaaaaattaagatagcctagatgtttaaaaaatagaaatatttaagtaaattcttttttttttctttatagagttttgaaaaaaaatttaactccatgttcaaaatgctttggatgcaaaagtaaggtggcagtttcatgtgacccagttttgtttttaaaaaggtctgtttatacaagcatctgctctgataagattctgaacatcctgtccctaaatatggtcccttggaatctgaggacagcagaagcaggagacttactctcactttctcattctctcacaagacaggacgttaaataattcccttacttataaaatcatgataaagcctttattccaaagccgtgttcctgtcactttaagggaatgtacattccctaagtcacagtaacaccaagaaggttctgaagtggcaaccccacccttcacgccctactcccatcccccaccccacacgttgtcaccaggaagccaagcggacctctgcattgtagccctctgttcatcaagcctaagcacactcatacagttttacagttttccctctttctttgggtctttatttctgaaggttcctgtgtcatgtaaaatttaaatatatttgtatgcttttttcccccttgctaatctgtcttttattacaaggagcccagctacaaacacagcccagcagtgaatgaggacagaagtctcgcctgtcttacattagcatgaacatgtaaacacatggtaaaaagacacagaataatgagaagatcctttgtgcatgcccatttaatatcattaaagtccagtactatctcaataggagtctcaatactacctggtacatcaaatgatttgaacaaacattattattgaatcattttaaaggacatttaaaagacgttgaactttcagtgctcagacttttgaaacataaacatttcataatattctctgtaggcccttcgcactcacgctgagcatcatcaccaaataaaatacccacagctgcaaagcagctcaactataaataaaggcaaaaaccgcagatatatttctactatccaaattatataatgtagaagatctaaaaatgaagtatttcattgtcaagaaatataaagtttaagctatattttgtagtcacttctccctagacttaagtaattaatattgtcatattaatgtttcagagtgatctggagtttccctctcttcctctgccatcctcactaaatatctcccagcgtgtcaagaacatgggacactaggtgatgggctcaggatactataaacctgttgtcttatctctcacactttctggtcctattatactgcttggatcgcttcagtggcagtcttagcccaagagctagctggctgatctcacttcattcctaaggtaagaaatctcttgattaatccaccacctctaatcctcttaacctctttggaagatatacatgcccatcagtttggcaaaaacaccttttctctttaaacagtgaaggtttaaaaggaagagtttgtgacaggcaaggtgtaagtgtgtgtgtgtgtgtggggggggggttaatagagaaataacaaggggtaaaggtatgagagaaggagagatgatgggctttgaagagttactgttctcacagtatttaagaaatgatgagggctggagagttggctcagtggttaagagcataaatcttgcagaggacctggactcagtttccagcacctacatggtggctcacaatgtaggcaaaacacctattgtagttagggttatactgctgtgaacagacaccatggccaagtcaactcttagtaggacaagattcatttggggctggcttacaggttcagaaattcagtccattatcaaggcaggagcatggcagcatctaggcaggcatggtgcaggaggagcagagagttctacatcttgttctgaaggcaaacaggagaagactggcttccaggcagctaagaggagggtcttaaagccaacacccacaatggcacacttccaacaaagccacatttgttccaacaaggccacacctctaaagagtgctactccttgggccaagcatattcaaaccaccacaacactcatacacataaaataaaataaatacattaaaaatttttaaatagaatgccaagaaataaaagaagggaaccaagcaataggaaaagaggtattcctttgccattttccagcttttctatggactatgtgactcacctgaagcagggtaacaggtttaaaagcccacacactcagagtggaccctttatgcttgaaatggggggtgggatcccattacactggcagccatgcagcctctttgacaggagacttgctgatcagaaagatgagag

SEQ ID NO: 850 - DNA, 2400 bp, Mus musculus
ctggagcctgtgaagggtcagcttctgccacaactctctgctgctgtgtcctagcaacctgtgtgggatcgagtttctccatagctccctgatcatcacttgacacttaacccaataactcctcgcataaacagccatccccatcctatgtctgcctcttgccagcacttattatcaagacttcctctttgtatcaccttcccattccaggtaaatgtttgagttactaaaccatcattaccatctaattccaatattcaaggtcctaaaacttatggatgcttcataaaattaccagttacaagcatctctgtagcaaatatgtcagaagagcacccagtcagttctatccctccctctttctctccctccccatccctcctctcccctccctctctccctctctccctctctctctctctctttctctctcctctctctgtctctctctgtctctctgtctctgtctctctctcacacacacacagagaggtgggggaacaggacaaaacaagtctttcgaagtacaatttaatcacttttacaggcgttgacttcagaagatctgaaagacagccagaaagcctacactttcccctctgctcttctgcttacagattaatgaaaactgttacacctccaagtgtcctagcttaaaatatttggtaggaatgagggtggaggctggagaatattcactagagaagaaaggagctatcagcacatgagtagtgaatctagtggacacttgcatcattgggtactgagttattatgctgtaataacataaggtggcccctcccccagtggccaaggtttagccaggtaccacctgtgaccaatgaatgaatttgagaagcttgtctctgacttctaagctcagatttccagatgctgtacaacttgtgcttgctcacgctcctggactgatactggaggaagttgcaagagactacagaagccccagggtgaaaactcactgatgatggatgcccagggaagaacaactgcagagccacctcaatgagggcccaactgtaagaaccacagtcagtagtttaagccaccaagcctgatgggtgcttgtaacacaggaaagagaaaaacaggttctgctcctgtttcatggaatgcaacatctctgtaaggaagatgctccaaatagctggggtttttctttgaagtatctatttttaaacttttatgatgttgatctgagtcattgggccctgtttatttctaatcaggacatctgcctgtcttcccgctccctctctccacttatttattttggccatgtagcctctatgttcaaagtagacagaatctgaattaaaattctccaggctaccattcttcccctgaaacacacctccatccgggaggtaaagtctcgggctgagtcagcctccgtgctcctttgcagtgaggccctgtgcaacgcaggaggcacaggaacgtctacccatcaatccagtgctccaagtgccaaacgctgatcctaagtcttcctgcgtttctaagatgagcatcggcctagaaagctcctggcagcatgccaagcaccggaggacctcctgggaaggcgtctgcccagaactgcccaggatagccacactggacacagagagcacatcagccatgtgtgggccagcactgcctgctgtttcctggctggtttgacctctgaggatccttctccttaggaaatttcacaaaaaaaagggtttggggaagttcccaagtatctttgggttcctgaaggttacacacaccctcaaaactccatgagccacgagaagcatctgtgttgtcatcctggttacagttcccaagacaagctttccacagaaacacctcccttagcgccttctgcaatgactgtcttgtcaaacagctaacagaggagcctccgacactcacaatggaagtgatgggattggagtccattggcatcaccgaccccttgatcagctgggctgacaggagaaccacggtttctgccacgttctcactaaaggtgggtcccggacctaatcagtaagacacgtcagaaagcccagttagggctttatacaaattaatgtctagtatgattcaaaagatctatgtctattgaaggacaataaaattactccaaattgttacagtttggaaagcaagactacacactcttatttttatttttttatttgattttattttttaccattaggtaggaatacagaccaaacacattcatgggatagtggaatttaataaagtctacaaattatgtaatgatattattatatcagagctgctttttattttaattgatttatcatgaataagtgaagcattattacttgaggaatctggacgaaatatgagaattctgttctttctaagtctgaagtg

SEQ ID NO: 851 - DNA, 1925 bp, Mus musculus
atagcatatcctgtagtctttatctttttttccctcaaattttctgattctctttttctctgataccttcaattaatcttccaggtttaaacagttagagatatttttattctgtgcagctcccacagctgcagtacaactgtgtctctgatttatttccaggagagttaggagctttgattttcaaaagtggatgaatgatgtggttggtgggaaacacagagggacagacaagctttcaaaactctattttcctgctctagaaattaggcaaagtgttgagtctgagtaatgaggatgatacagagcttatttttataagctcttaatgttttaaaacttactttgcttcataattttatagaatgacaagacattactaaatattctcagagaggtgctaaaaggaacacttaagaaaacgaagcctctgtctccttaagctctttgtgtgttacactatactccaagagctttttgatgccaggtaagattagaacttaaagcctaatttttaaaaagttgtcttccctaaaccatccaagaaggtttttgacgccatccacccaacaaagaagtataatgaataaaaacaaactaacaaaagcaggtgagaaaattcacacttgtttagaaacaagctttcagaattgtgcttaggttttcaagccatgttgtatgtgctaatggtgccctgaagagcagaatacaaataaggcagggctgactggcacttcctccagcacagtgctcaagtacggttttggtggagtgcctgtttgcacttggccctgatcccaggtaattgcattcattcatttagtcatttattcaatggctcataggtgagagcactgctggactgtctggggtcccttgtctttgctagagtggcgatcagaccctgaccccactgtcacccgtttccatcaaggatggacacttgtcctgtagaagaaggcttggaggaaacgagagctctgttctgtaagggcatgcacacaatgagggtatcatagctattagcaatgcactttgtctccgtgattccataaagcctgcacaatgtgtcattattcctggttatacaactgtggtgctcctgtgcttctgagacccacagtgcagtcttcctgcctagcgcctcatacctaaaattaacttcgtaaccccattacagttctcttaaagactgaacggaaaccctcgagtattttgagctatttaatcacattgtggttttaaaaaatggtatcacaacactgtttccaccactccccatatggtttaagaagcaataaaaactttgaaagccccagtgtaatcaccgaggcttttactaatgacatcttaactctttgggggatgtgtcttagttattccaggcaggacttagcaaacctttagcaaacattttaggtcttgcagagtgtgtgctctttgtcacagttactttactgtgccacagtggcacggagacagccacaggcattaaacaacacagtgcagctgtatttcaatagtatttaatttgggacactgagatttaaatttcatataaatttcacatgtcacaaagtgtcagtctttgttttagttttgtaaaaaaaaaaaaaggaatataaaaactattatcacagtctgaaaaagctagtctttgcccaatagggatttctcaaccaaagcaaagaacaatgatatggatataaaacacacagagataactatatacatagcatgataagataatggcttagggtgagctatttctattagatgcttaaaatctccaaggtttgttgaagtcaatattttgcaatgcatgccataggccatttaaagccactgaagaacatatatgaagaagggagagcagtagagttttcaatgaggaaatgactcttggctctcatgctgacttggtg

SEQ ID NO: 852 - DNA, 1725 bp, Mus musculus
aacctttaccatacaatctttcatccttaaatcatctctcaaccatctaaaatgcgctaataaaaacattcaagagcaaaaaaaaattatgggcagaaatcttttagatctgggaaaactactgatccttgacaccttccctgaggaaataaaaggtaaagagaaatgtagtaaaattagcacctttttaaaaacttcatcatgctagaaagagtgccctttacaactcagaggatttcagaaggattctgtcccttcccctagttatcccgggtaaatagtgtaatggatttgtacttatagaagagaacttgttttttgaggaaaattataacattgttgatgactgcagaatatcaccatgaaacctatcgattttgaacattgaagaataacttatatatgtgtgttaataaaatgtgatagaggaaactaaaatcacatatctgttaaaataataacttattactttgtaacatgtatgtaagaaagtccagttgtgttttatcaatcttaccaaagaagctaaagctaaacattaatctatatgcctatgcataaaaatacacaaatatacaaacaacacacgagagagagagagagagagagagagagagagagagagagagagagaataagaaaacagatactttgtgaacattatacttgagtaaaatttgctctgagatgccattttatctgtccccaatggctagtattctttcctctaaagtcacatgtgtctagtgtgaacgacctgcccactgcactctgtaaagagcaattgccctctgtcccaattggaacctcctcacccttggttctcattgctcctcattcctggcagcccctgccctctggccataccagccctctgcccttcagccaacagagagagcatttgtgtcccagctcacatggtaggcattaacactgaaagaagacagagagaagcaaggtttcccgaaatcaatgtgacagccccaagattcgcttataaaaacgctgccattttaaacttaggagagttcatcagtcagacagagatatgaatcttgtcattttctaaggccacataacgaagagaagagaaaatgggacaatgagaatggcaagccaaatgagaaaattgaaggctgagaaatcctgattacacacattctggagaactttctgaatacataagaagacatttagggttgcatattttgctgggttaaaaagaagcaaaattatttctaacactttatcaaatgtacctaaacagtgataattcttgatattaaaatttattaatattgaaaagaaatgttttttttcatgcttcccaaatgtatttgagtttaatttagacttggtacattcattacatgttctatttacctaagtgtctataaataagacttgtgttaatttgagatgctgacacatttcctgagatgttcccaagaacagaaggaagttctctatcgtaaggggggggggggggattcagtctgaaacagagcctcaaacaacacttaatgctaatcttatttttcactaaatgtacctcagacacattgtacaaactcatttttgctaccagtgttcaagtggaaatcaaatattacagatacaatggaagaactcagctatctccaaagtaataattttgcaataaggtgtacgcactgggaagccttggagtgtttttgaagtacttatttctttataacagcaaaa

SEQ ID NO: 853 - DNA, 1900 bp, Mus musculus
tctccgatgatcctcgtttgatcttggcagagcactagccaaggaaggaaggagaaatgtttgtcttagaaacctggcttcctgtacttcctgtggcagtggtactttgaaggcagagaagtttttcagggaaatttggcacggcttgcctttcagtttagtcttcttaagaagttacattaggagcatttacagttcccagttggaaatttctaagcttttaattgaactttgtgactgtgtagagagttgctgtatcatacagcagtgtcctggcaggcttggtgggacatgcgaaaacttcataattgatttaaattccagtttagacggctggcacaagcagaatgtttgctttcaaagcaggacagtgcccacttacccgaatctgctttcttgtaagtagagacctctgtggacagccttgccctgtgggaaatgaaccattaaactagcatgcttagagctctgtagattgtaacattgcatggtagaggtgcatggtctgcgacccttagttgtgtattatcaagcacccagtcctgtctcataaggaccagggattttatttttaccctacttttaaaccaaaaggatgacctgtcatagttttgtggcagtctgatgcatcgtctcttttcatatttattataaacgattgtcactaaagcagtaggggtgagtgtcctcatactgtcgtcttgctctccatgcccccagtgcagcttacagaaggtgggtaagagctgcacgtgcagtgtgttgtattctaggactggagccctgagtgtgagactccatggaaaacagtggccctgattcacttctgttactgtgacaggaacaccctgacaagaagcggcttaggagtgaatgggggcctttcgctcagttccagcttacagtctgtcgtggggaagtcaaggcagcaggaattcagcatcgctagtcaggaaggaggaggaaggaggcgtatgccctcttgcttgcacttagctaggtctctctgtcgtcttttaaaataggctttgagcaaaatgtccagcttgacttctaagggaggcatccttgctttgtgtgacagcagactgccccctgccgcagagagagacagacatccatgacaagacagttcacagcagcaggctgctcatggctctgctctttaggggatgcctcccagaaatctttctttgctgtgtatttctgatgctagtggaaaaggctgtcagtgttttatgggaaacttgtcatgtcccctgtggcaccgtggggttccttggtgaaccacccaagaaaagagtgaccctctggctgccattattgtccagagtagtcatttggttgatcccacttggactctctcttacctgtgtatccattggatttacgtcttggaaactgagtggccacatcagtcccttgattcccacccacatggatccttatgaatctctagctcactgttggtgttcagtcttggaagccttaatctaagtgaccttgatagatccaggatattttgagtgaaatattatatttggtaaaaattatattgcatcataaaattacagatttttttaaaacctttaaaaatcatctctgacaacttttcacagttggcatatggcagtgtggagacttagagttaattatgattaatccacgtagacattattgcaggagcagatatagaagtcagtttgttcagctcatgaaccagtattcatacaacaaaagaaagaagaaagagctaggccttgcccacgcttattctcgttcattttctctcttcctcactcccgctccctcctactactccctcccttcccctccccatcaatgtattaatgtgctatttggcatgaagcaaattagattcatttttattcctttgttt

SEQ ID NO: 854 - DNA, 1975 bp, Mus musculus
gttggtggctttggatcatgcctcttctaggtggctggtggctttggatcatgcctcttctaggggtgtggtatgtctaatactttacctgaggtggtgggaatacaatgattcagttcttgctgaaggactcctttctgcaggacaattcattagtgttctctctctctctctctctctctctctctctctctctctctctctctctctttctgaggaaactgtagcagcaggtcaatgtggggtcagatgtcccatgtgtcctaccccctggaagcatatggaccactaggtttgcctggctaagtgtgggatttctgtcatgggagcatgaaagtgactaaccaaaggatgtggtccacctgggctgcctgtgtgcaggcatgtgatcctctgcttatgtcttcataagtgctttatgccagctgttgctgacctcttcagtctgagcatttcttaggagacactgcgggtccagggtagccctccatgctgtggttgagtctttgatgagagttctcagttaatctgggtagggggcacatcaggtagaaacgtggctgtgggctggagtgggtgccagaaggtctcagagaaggcactgtgagtcctggggagagcaaacacctttgcacttcaaatgagaggtgtgtactgggtagccagtcaggaatgggcagcgtggcctgtgaccaaccctactgcatagggcagacaagccatgaggcatctggaagacctgggggggcggggtggcaatgcctccaagttacctgttcacttccaaaaggaaccaggcagagccgggaaggctacctcgggaagatgagtaccaggaaataagagtggagatgtggtaatcagatgcactcatgtccttgtgccagagcccatggaaatggcaggtctcatgccaaaaggccctcccctcagcagatggagaacaggctgcctgcatatcagcggccttggatgaggagagggcctggattaggtgggctctagaaggcccccacttgggccttcatgagcaaaaggggagtgggaaagcagcagagggcatatcctgtgggaagtgtggctcctctggctactttctttatgctgagctgtgggggccagggagggtgggggttgggggtgggaactttgccagattcagagaattccccagtgaaggtgcctgggttaaggcagcagtcaggcaggactgagcggagggtgggaactctagattggaggactccaagaaatcctgaaggagctgactgatcccagagggattttaccagcccctgggcagcttctgtggaaataggtgctgatagaaccatttttaatgctagagaaaaatgtaagagttttggaggaaggaaacatttccatgctatccacccacaagcagcacccgcaagggaacgctgctgtgaacatcgggggttgatttaatggaaaacacgggaagatacacaggccagcactatttgatggaggtggggtagaggtagaaaggacagaatgcccactttcattgtgggatactgagggatgctctaggagtgaacaaaatggaacctaccctgtgacctgtgctgtgtccccactgtgatttaacccccacaatgatggttttgctgttgttgttgtgcaagctactggtctgtggtattttgttatagcatccccagctgactaatgcaccatgttatatagagatgggccagcatagagcacaagaagtagctaaagcagttgagagagattcacttccagaaattggggttcagtgtgggaagaactagagtaatgactacatattttcattatcaagctttagttgctttttatttttcaaagcattcatatatatgtatatatgaatttcaaacgctatgtagttaaaatgggagaaggctacattttattgacttgggttgtgagaaacacaaaggcagagggtgaagttttcagccta

SEQ ID NO: 855 - DNA, 4775 bp, Mus musculus
gtccacttcatccggtgtcacctccaaagatttttatttttactttcagagtgttcagtctcccgtacggacatgttctcatgtggcccaggaagctccctccctgcaggcgattgtattgttatttacaaacagattctgtctgccgaggagacctgctcccccctgcttgagtgtgtagcttgttttgttcctgtgaatgatactcaagtgtgaactcacccagcaagatgtgagaagacaagagccgcacgcacggaagctgaagctgggtcagatggtttcccctcccccttccttgtacccatcgagatgtcgccttagtgtgggctcccaaccaaagtaggcctagcttgagcaagtttgaaaccggtgggatataagttgttactgttgtgcgcacagagagtctgggttcatttgttattctagcatgatagagcctgttctgactgatacacctgctcagctaacccctaggaattccctcctgctagtactgatgtgttagaatagcagcttgcgtctaaacatagcacaccaggccgaagcagttccacatgtaagaggtttattgggagagagaggggctaggtggtggcagaaagagaagggaggagagaagaaagagagagaggagagagagagagagagagagagagagagagagagagagagagagagagagagagagagagagagagagataggagggcctttatatatgggtgatgatgtaatacaggtaaaggtgggaggtgagccaagtggattctggaaatatggtggctgttgccttgacaacaggtcttcaggtcctgtctatgtaatgtcaccggtttcggtggtcctgataccaacaagcacccactcctggatttggccatggtcagctggcctgtcacaactgtccttctctctggacatcctgtcaagctttgagacaagccctgtgcttctacctgtccacatccccatccttagaactgcttaggcatatagtagattcttaacttcgtgagtgcccacctcgttccctccccgcacctgagacccccaggccacaagttctggtgctttctccacccccctaataaccagtttcttctcaaagctattatctgatttgctttgccgtattcttgttttttgcttgtttgtttctatccatgtgctggaaagacagtgggaagtcttggtttgtgaacttctaggctggggaagggtactagagaacaaagagcctaatcaccaagcccacaagtaagtcccatcagtgttcctccctggtacccgagttaggttacacacactcttaataagtgggatcttgtctgccttgtccccaaataacaaaggactggaccagaggacctcttcaagtctttcccaatctgaaaagccaggagtctggctagggtgttcctagtagaggaatgactggcttcaggagctgagctttctgtcacagtcttggtggtgttaaagggcagggccagaactgtgatgaggccagtgaggtgcctagggatcaagcttgaacaagaattcaccattggggcatatgcagttgcttcaatggctaatgcttacacccacgagcctccctcccttctttcctttagtgtcagtgctatgaagagagtaggaggtgcaaggctgtcaaagaaagaaagaaagaaagaaagaaagaaagaaagaaagaaagaaagaaagaaaggaaggaaggaaggaaggaagaaagaaagaaagaaagaaagaaagaaagaaagaaagaaagaaagaaagaaagagagaaagaaggaagcaggataaatcaggtgggaatcaatgggtgaatcctggatctctctgtccaaatatctttcctagctcacagcaggggacaggccctcacttaacctcgatgcatctgtctggcgttggctttaggattctatagctacctatgagaatgtagacctgtcaggtagtcagggtgtcatggaggctagtctcatctgagtttgcacactaggatacatggcactttaaagaaattctgtagggtaaggggtattggaaaggagcgactcaacaagccctggcctctgggcccaggtcatccgacacctccacctgagcaggtttccaagcgatactccctggtcttgggaaacataacagaatttgatctcacggacacagggagagctcctcaccccctaggtcattgtcctcataactctcattgttcaagttgtattcattctgccatccgagggccacttctgcacagaccctgttctttcaggctctgtcttcagggaccaactcctttcccctgccttcagcgttaaagaacaactcccacctagttcctcggcaagcatggctgacagcaagttaagacagggtaagggacaaggggagaaaagttaatttaaggggaaaattatcttccatttcgccgctaatggaacctgtaaattagggcatttaattaccagagaccacttgctcattttggatgctaatatttacattagccactgcttcgaaaacaggaaatctgatgaattggcaaaacatttgtacccctcttccccaaattaatcaaatgagctgtgatggggctatttataagtctagttaagcgcgtctcccccgtgagggagtctttctcccacctccctcgcttttgtgagctcaagcagatgttccgtttctcacctacatactcagttccagaggacctcagtgggaaggtgtttgatctatttctatatttaatgacacatttcatcagagtggaatacagcacggtaccacctctgtcagaattctatttcgatgataatccctactgttgtgcaacccctggtgactcccaagttgcgctaacgaagaaccgctcacctccaatgtggctgaaagccccagctttagacttcaggggggatggctgatgcatttgtatggaaccctttcccttacaggaacatggttgctaagaaatcgatcatctgggaggacaggggccaatgggcagacctaggaggaacaccgtaggccttcttcagagccaaagtcctccatccctggctattcagatctcaagcgagctcttgtcttggatgtttagcctgatggtaacctaccttatccttgctcagtcagcgctcaagggctcccctccagtccaaggatacgatgagaggtgacggaggcctctgcttcattctgctctcttactagctattctgctaatgtaaacactgctcctcatggttccttaggctttgagagcatagctagtccagtccatcacaggaaggatgactgccataagcaagggatgcttacttgattttttttatgttaatgaacatctggggaaggaatcttggctgtggctcttgctgtttggaatcaccctagcacatttgtgaacctgcatctccaccacccccacccccatcgtgtaaagtgggtgtaaagcaaggagctccatgcacagagtgtggctgattcttactgcatgctgtaatctgaatatttgtgtgatcatttgttgcaatcctgactccccaggtgatgatattacaagatggaaattcagaggtttcaaagctaaagttctattcccaaggcccctgacagctgatgctccctccacctgagtgggattctggtatacatgtgttggaactggaagggtcagggggggggggcgggatgtgggaccaaggctagggctgtttctcttggggtttgacaccttgtggacagacagacagcttgggctgtaggcatagctgcagtatgaacaccagctcccacagtgttcaggggcagctgtggagtgcagccatgactccctcagctctggctattgcagctagaggtttaaactggagtaaacacttatattaaagtggtccactgtggcctaccaattcccacctgtcatggctggtcattgagatgttactgagcacgttcagagtatcattcttggaagtccacctgggtcacacacgtggagcttcacaccacttttgccagcatctctctttgatgctatgccatttttttttcttattaccatcgagatgtttttgttccctgtatgaattctggctggtcttctcatttatttgcttaaagcctgcattcctgtttcaggtcactcacgcctagatatcttcagaaggaaaccttttccatccatagggatactgctcatttactttgaaataaaagtaggagatggcagggggcagggctaagatagtttctttaccgaaggttttctgtacgttgttgccccaactgattataatttcacataaatatacacgcaaagttggaagcccagcagccatgtgtgcttagaattaagagttgttctgtgtctcagaatttttcttccctaaagaactatggtctaaggaattgggcctaaagttgccaagtgggcttgggccccacaaaccttttatgatgggagcacagacaaagctcatgagatttgagaggcttatcttcaaaagctgtgtggaagcctgtagcatgagcacaattttcaggaaagggaagagtagaggtcagaggtcaccatctcccgggttatgaggaggcagatggacacacagttatgtccggtcatgcgctatgcattcatgctccagatcttggatgttgtaagctgcttatgtgctgtgcgcagtgcatcccctctcagtggcttccaatgatgagcctttgttacagcaaacaaggttaggaatcca

SEQ ID NO: 856 - DNA, 3250 bp, Mus musculus
aggctcctatagcttatatgtctgggtgcttactttgaagttggtggagctgttttggaaggattaggaggcgtgtccctgttagaagaggtgtcactgggtatgggcttttgtgggggatgcagagttcaaccttgtgaaggaaaagagtgggatggagagcgagctgccacaggtacctctaagagtcctgatccggcatgcattagatctaagatggctcccggcacacaggtgagacagcagaaagggactgaggcctgggcagtggctgcttccccattttcacagaagtcctcacaggtgatgatattctacacccctacccccactacttctgagttacctcattaggcagggctttcgttgttgacaaatgatgggccaaggatttagggacttggaattggctcaaacactgatatataagcttataggctgggcaatgaactcagatctgcaccttgatgctggtcgctggagttagtcctgggatatatcacaccatcaccgctcaccctccaacctcggtcctattgccacagactttgaggttctaagagatcctgttgttcccagtgagctctcgttctctgaatcatggtcattgtctcggcgtgtctgttcttggctactgtttcagttcaacatccgcctgccaccatgctgctcaccatgttggccatggaccttactgccctctggaactgtgagctgctgttaaatgctttgttgttgctgctgctgttgccttggtgatggcatctcttcacagcaattgaaaagcaaaacagcagttcttaaatcactgaaaatggagtcacccctcgttctgtgaggctcctggaagacacctgaagtcagatcccgaaagccaggccacagcttttccagctggagaaggacaaccacatcttagtaggtaacagtgcacatgagagtctggacatacagagctgggtgccacatcaggggacagaccatggtatcgggagagaaggatggaatgagacagaggaggtctcaggtgatcttacacctgcaggaaggggacatggagccactgagggctgacagtatggtattagtgatggtagaactaacaaaggtagtgagagcaggtaacagagctgaaatataagagacataaatcttgcctcattaggacccagactcagccatcaacacggtctcactttggttcctgcaatgacccacgcagtttgcgtctgaaaacctgactggggcagtgagggaatgaagaaaggacagacatgtatagaaaagctgcagtcaggtgggttgtgctagctctgatggagagacaccaaccaccaccacaacccgggacttcagtgtgtttactgggaacagcccaggaagaggggtaaactgggtttggtaggatgtgtctgtaggtgagctgtaggcatccaggaagaagctgcagttgccaatatttgtacacactggtccgttgttcacccatggaccccagaggaaggcttgttatccccgagtctcacctggggaaggctttgtcatttgcatgggtctgaggctttggggtccttggcatggctgtgcccaaggcaaaaatatatattcacacaggacttcacttcccaagggtttcctctgccctgtactcgttctaggggtggcctcatttcccaaacttagcggacagaccaacattgctgctgtcatgtccactctaaagatggcaagttgtgtgctcagtttcacctgagtacctgtggagaccgttgatgcataggctgggggaagatggacactgttgttctggttctggcaaatgcagactggatctgcatagccttttctcctgattagacggggagctgacaagcctcagccatctgtgttggtgcagaagtgacacggcgtcagccacagagctggcagctacggatgatcaaggtgtgtcttcccggggacggctctgaatcgagactgaggcggctgcgtacgtgttcattcccacactttcctcctgccttgggcttgagctgtgagttatcaccttctctttcctccacttttaagacatctgacactttctggagaactgagccatttcaagaaagcacccgagaacagttcctggcagccaccatggtaaccctgaggggtttgcctttgcccgggtggcccgctttggtaccactcatctgggaaccccttcctgctgactgcagacctttcttcccccaggctctgaaattccctgcgagccttcccagcctcgctggctgcagacacccagagcctcctggcttcaagtgcccgctgccagctttcccttttccatggcaaaacataaaccatgaatttttagaaactagtaacaaccaaatgatcttggagctaaacgctgccagagactggtttgcattgccacagaagattgggacgtgggaagagccacccacgtaggggacgcgtaggctgagatgatacaccctctgctctcagccatctttttaaaaaaagaaatgagtctcaagtgcaccatatataatttcatttatgtgactttctgaaaaaaaatcaaaacaatagagacagaagcagatggtttctaagagctggaaaatggaagacaagaactttacttaaatatcatcattaagaaaaaaatttaaagtctctagaataaaaccaccagccagatgtaactatttaacgctataattaaagttaaataaagtggcctatggcatttctctgagtgactgggcgtctgtattacggttagcacaggttcattgtacagcctggcctcttactgacagcatcactaagtatatcgtttatacaaactcatccattgctctgtcctgtcccattctgtcctcccgctagtccataccatgctgtgtgtagatgagggaaatgggtgagactggtctgctccactcaacgtgatggtttccagctccacctgccttcattatcacatcgataacatcgtattctctatggtgaaacgatgcctatgggtacacttggcacatttcctttatctatttacttatttagtaagtacttgggattgcatctaagggcctcctgcacgccgcggatgcatctgtgctccatgcatcagtggatgggtaggtacccaggttgactgccgtgagcatgggtgtgagtagctcttgtgagctttgattcctttgggaattcagaggacgcagttctcctttaacgggggtgggatggg

SEQ ID NO: 857 - DNA, 2475 bp, Mus musculus
ataacaaatgaaacaggcaaaggatttggctgtgtatttctctagaggacgctcattcgtgtctcagcacagggagatgatctgccatcaaacaacccagcctgaaggtcacaggccacatgtggagggaatgatgtaaatagtgcagccaccaggaaaccctcaacaagttcacagagttgtgagtttgtcaacctcaacacagactaagtatgcaaaccagttaattccgcttggaggtcagagaaccgaaagcacaggtatgtgtattcgtagtgcattgttcacgatgggcaaaagtgtctatcaagggctggagagatggctcagtgcttaagagcactgactgctcttccaaaggtcctgagttcaaattccagcaaccacatagtggctcacaaccatctgtgatgagatctgatgacctcttctggagtgtctgaagacagctaccacgtacttacatataataataaataaatctttgggctggagcgagcagggccggactgagcagaggtcctgagttcaattcccagcaaccacatgatggctcacaaccatctgtatagctacagtgtactcatgtacataaaataaataaaataaatctttttttttaaagtgtctatcaagggcctgtcaatattgagtgaacaaactctggaatacatacataatgaaataatattcggccataaagtgaataaatctatggctggcacatgttacaacccagatgaatcctggaaacagtatgctgtttaccagaaatgatacaaaatagctacacattctaagagtccctgtagtgacaggtgtagggtgtgctattagagacacagggacaggaaggaaatcggtgggtcccagggggattgtggtgactggggtcacagagtatctgattcctggatacaggatttcctcctggggagaaggagaggttttgtaactggtatgtggaagagctgtgtgatatcgtgaaagtgttacatatcatcagattattcacattgaaatgactcattttatattatgtaaatttcgcctcaattaaaagaaacaggaggatacagttgaatgaaatccaaaggaaacctgaagaaatgttaaacattacaattcccaactaccaaaatattagaaatcgaaaggttgtgaaaatttcaatattgttgagacccgagttcccagcgagggggtttagtcatagtcacgagtttctgagactgttggcctcatgtggtaaaagtgtcctcaaatccctgcgtcccgtgagaggtcagagcccaggaacgcccatggagcccagctttgttcaggagccgtctgtttcatcttcacagacagcaccacaatggacgctgccttgacccctatgctgtaggcgaggatgacaagctgagctactggacctacagaccagtgagagccctgggctcattcttggatcctttcagcatttctttgtgtacaagataagaatacatctgaggacaggacacagatctggacaatgtgtgtggctctgccctgctttgtgagaatacctgcttggcattgtgagggggcaccacacatatttgttttatgtctttatggaacagagcatcaaaaacagtttatttctccctggctgtggctattttaatttttttcgtaggagggccagcaatcagcactgctgactcacatttgtttgaacttgcatatggaatatgtatcacctgtgcttgtagattggttgtaggcagaaaatcgtgaaggttggggccatctaagttctctgacatcagacatgggtttagggtttaccctggtgggctttgatcttgctttggtgttcactatgtccccattttctcctttgggatggtaatgcatattccatagcattgcatggttgaagtatgtggtttcctgttcagagtttcattttacaggggtttgcaattaagaggttgccttgtgctgggagctgtgtctcgtgcctttaacttgcaaggcagaggcaggtaggtgtgtgtgtatctgcgagttctaggttgtcctgttcaacatagtgagttataggacagccagggctgtgtagagagatcctgtcttgaaacaagaaacatataaacaaaaaccacatcaacaaaaacttttaactgggtaaagccgggagtggcaaaagtgggccaccctccccagggatgggcatgccaattggttgcccagcggcccaagtgtcagccctgaaaacatacatacaagcgacattttatgcattcaatgggttatatttgggcacatacatttatacaaaatatatatgtacatgtaataacaattgattttaaaaacaaggccatgaatttggaggagagtggggagggctatgtaggaggttttgtggagaggaaagcaaagggggaaatgtcataattaagatacaatctcaaagtctcagaagagacttcagacatt

SEQ ID NO: 858 - DNA, 1950 bp, Mus musculus
gaaagttgttaggttttcatgagtttgtacgctttctgatgtttctatcattgttgatatacagctttaactcaggatgttctgataggatgtagggagttatttcaattttcatgtatctattgagactggctttgtggctgagtatgtggtctgttttgtaaagttccacgaggtgcagagaagaaggtacatccttttgtgtttgagtgaaatgttatgtaaatatgttaggcccggtcagaggacaccaggaaaataaggccctccaaatcaactgagtaaaaatcatgtgaactaacagactgaagcagctggcatggctctgcacctgatcctctgaatacatattatagctttcagtctagtatttttatgtgaatgaatggtctgatccttgtcccttctcttaaggtgtttttccttttgttgatggaccttggccaactctgatgtgatgggttttgttttagcttaatatactttcttctctgtgtttactgttatctcttagaagcctgttctcttctaattcgagacagaaagtgctggatcctgatgggagtgtaggtggagaggaactaggagtacagggaggaggaactgtaattagggtatattgtatgacaagagaatctatgtttaataaaaggggaaaagaaaacaataaaatctttatgaggcaaaagaggggaaaagtgtgaacaaaaactaaagtgcctactttatgttttatggtgtgagaacaaaactatcagaaactaaataaataaaaatttcagaactaaaggatccttagggaaatagagagtggttttctttttctttctttgtttgtttgtttgtttgtttgttttcgagacagggtttctctgtatagacctggttgtcctggagctcactctatagaccaggctggcctcgaactcagaaattcgcctgcctgtgcctcccaagtgctgggatcaaaggcgtgtgccacccagtttgagagtggttttcaagaggagaccagtgggagcattattacagtagttccagaagagggctcctggacacgtagggctatgtgctaactgggtaccagaatcagaagaaaaccccctagagggctattggaagataatatatagtaaaagcttcctacatgataccgtgcttctggtggatactactaactaatagaggtgacattcaaaaatatttgtgaataactgaacagagttaatcagacaaatcctgtagcccactattccagttgacgatgcctggaagtctcaggctaaggtgaaatcaagatttatcatgctggcaacttccacacagagtctatgaacccccttttttcaggtatggatccatgagaataccattgtcacagtaatatgtcaccaacactgttactcaaagcagagagaatttatgtttgaatgatccaatatagaacattccaaattggtgattctgcttaattgtggtaagccaaattagtgtttgttattttgaaatttcaacagctaaacgttaaaggatactgagtgtttcatgtctatgatatgctgccatttgtaatttgacatttataaatgtgatatagacctaaaatgtcagtagaatccccaaaatgtttctctctcttaggtttttcctctgtactatattctgatctctgaaaaaattcaaatacttgagctgtggctcacatcatatcaacaatcatgaaacaaaggattttctgaagcaaaaatatgtgaacattgctttagagacaaaagtactatagtcatcaatataaaggggagattgaaaaagtcttgtaagttataaaatagaatgctaaaaagtgaaaggacacctattttatacctatacttttttcttttttctttattttttgtcacaaaacaggcctcaacagttacaaaaatattgaaattgtcacatgcatcc

SEQ ID NO: 859 - DNA, 2125 bp, Mus musculus
actcctattatccgtaggtttggtcctctcattgtgtcctggatttcctggatgttttgagttaggatctttttgcattttgtattttctttgattgttgtgccgatgttttctatggaatcttctgcacctgagattctcttttccatctcttgtattctgttactgatgcttgcatctatggttccagatttctttcatacgctttctatctccagcattgcctcactttgggttttctttattgtttctacttccctttttaggtctagtattaattttttcatttccatcacctgtttggatgtgttttcctgtttttctttaaggagatctctgtgtttggttgtgttttcctgtttttatttaaggatttgtaactctttagcagtgttctcctgtatgtctttaagtgagttattaaagtccttcttgatgtcctctaccatcatcatgagatatgcttttaaatccgggtcttggttttcgggtgtgttggggtgcccaggactgggtgaggtgggagtgctgcattctgatgatggtgagtggtcttggtttctgttagtaagattcttacatttgcctttcgccatctggtattctctgaagttagttgttatagctgtctctgtttagagatcgttcctctcatgagtctgttagcctctatcagcagacctgggagctctctcctctcagtttaagtgctcagagcactctctgcaggcaagctctcctcttacagggaaggtgcacagatatctggcattcggacctccctcctggcagaagatgaaggcctgaaacaagatctgtcccagaagctgtgttgctttggcctgtcacagaagctgttagcttctgtagtccatactctcacctgcgcagactagtctcagagggatccgggaaccaagatggctcccccaggtgctctggcaaagccctcccgggcagtgtagacacctctcctctggcagggaaggtgtccagatgtctggagcctgaaattgggtctgtctcagaatctgtcctctagggaccttggggggtgtctgcctactctgcgcccaggtgacccagtgctggcaccgactggaagggacttgtgaccctggtcaggccgggtttcctgttttcctaatgctgtctcaggtcccgagtgtttggattggaacagaagttgtgttccactcacaggtggtcctaagatcgtgtaaagagtcctctaggggaccttgggattgtccactgactcctcgcccaactatatgtttatacaaatgtaaaatataaacattaattatagaaaaagcccaaaagtatattacctagttatgtcttaaaaacaccatgaatgtacaaattagattttagaatcagtgttaaaatttagaagtgcctttgcttagttaataaaaataccagtattttgggaaaacaccaggcaagcagatgtcaagatgccttgtggtgctttactcacctccactgatgctgagcctacagaaaatttgacaactgtcctattaaaaaaatgtgtgaaataacataaacaatttccaaaggcttttcagaaaagcacaagtaattcaattcgtttctttttaaggaaaatgttgactttgtgtttggaatttcaaccaagttctgactgattaaaaaatgtttctgaattgcttaatgcctctgcttcctctgccaagtcctggcctgccaaaggttgtttgaaaggccacacctccttcctagctgttcttccagctgtgctcttgactctaagatgaattctaagttctgtctaagataacactacactagagtcatagaccaaaatgcaagtttatctctgcctattttaaggttatttttgtaccttgactcattggcaaattgaaggagtatacagtatgcagtacttagtagtgtagctcataagcaattgcatttctaccagaatatcgaatatgagtgaaatttttggatccattcccctgcagaaacattcatatatcactatatgtcatgtgtagctcaaaatatgaatgttgtatttggacatggtctgtagagaagtgatgaaatttgaataaggatcttgatataaagaccttgtgtcatt

SEQ ID NO: 860 - DNA, 1900 bp, Mus musculus
caatgttctggaatgtccctctccacacagcaaggacactggagaagactgctagctcccctgtcttcctctcttgaggggctctcaacaccccagcagaagctaggaaggtcctctgagccacagaggctggggtgtccacgcaagagggtcctcatctccattctctaatctgtgagacttgtgcgatgatgtcacaagtgctgctgcgggattgcatgttgcacacatttttgttcctgtcattctctgccattttcctttcatctgtctttacttagcctcctccagagttcttacttttccattcttttgtgattttgtaaagtttcattgtagaattaaatgttggcatcattgtagctttgtctaagtcctgtcacttcccagcttgcttgaagagatccggatcagtagagagatgctgctgcctcctgccaggtctttgtgtatattgcctccttcactgctcagaccagaggaggtagggagttctgggaagcaggtattattagccccattttactgggaaccaagacattccagagaagcctgcctaagccagctgcacaaagggaaatgtagactgaagagctagattgcctggacttgaatcacattctacacagttgtgtgacactgggcaaatgacctagcctccctgtgctttgttttcctcttcttgagtatcttactataattcctgcctctcagggctgttgtgagttttgacagtagcgtgtggttagaaggatcctggcaaagctcagtagatgctagctgggtaaggaacagacaggccagaggaggccctccccacagcatgaccaatctagaggggctgtccatggtgagactgacactgaccctgaagtgaggggggcacagctctgatcccagagtcctgccatccttggccttgtgagggttttagcagcctcttccaatcttccattccggctctgacctgttcatctcatcagtgttacatcgaaatgctataatctgctgcataaacattttcaactttgtggaaaccgtgtcagaacacctgtcatgaaacttagtttgccttcttcatctttccgtagtttggggggggggggggaatgaagtctgggtaattttttgataatgaaggtggaacacaattccctagagttgaagaattgttagacttttgaaatcaacaggaataggaattcctgggccatttcatgttacttcaagagtggagaggaaggaagcatttcagatcctagaggagaagttgcaaggcagatgaaaaccgactcgggtcagaacgtccagggacggcctctctctcaggtgcacgcagatccactcagggctttctcggatgctcagatccgccctctggcttctgaggcagttagtaaagcacaagtatgttttattaactttagaatcctccagagtagattgctcacagccatctcatcaccatgggaagaatggtgggaaagctgtgtgggagtggggttgccctctttcctgagtgtatcggtaattagctatgcggtgtttggatggctgactcatccagtctccactgtgggagcatgcaggcagcaggcaacacattctaaccactagtgaaatagagatgcattgctgagggcacagtttttgctacaggtaagttacccagccacccccatcagaacagcacagctgtgcccactggtaccatagcgtccacaacagctcagctttactgcccccacccgtgacaacagtccagccttatccatccatcacagcgatgcaacttcgcccttcatagcatcacccacagcctggccactgactcccagtgacagaaaatatataacatatatgattgaggaatgcatcctacacctgtacattttcatta

SEQ ID NO: 861 - DNA, 2150 bp, Mus musculus
tgcatcccttagtcatgtcagatcaagctgactggaaagcctcggcagtatttcaatatgcctgggtgtttactttataaagtcccattcccctaactggagaattctaggccacgttaactcaataatttgttattcactaaactatcctgtagggtattccttatttcattcattatttctgccaacatctgggctcttggttagatataagtgttccaataaacaactctatgcaacctaaaattccaacctaaaatcccaacttacaacaccagatgatgaccaggaaacaatggagaagaatgtgggaggaaaaaaagtgggctgagaaacaggaaaggtgtgatggtttggatctttaatatctttcaaaggcccacatgcagaaggctagctgtcaatctggggtgctggtgggagaaggtgcgaatgttggcaggtagggcctagtacaagcaagtctgaccactggaaacttgtccctgagagggatattgacatgctggtcttttcctgttttacttcccatgcaagatgagatcaacctgtgtcacaccgtccccgccatgacgaccgcttccacagacccaatggaagtggagccaactgaccatggcctgaaccctctaaactgaggaggcaaactaagtctaatttgtcacagtgataggaaactaatccaagataggccatcagattcttaaaggggtgagtgcgacacggagtcagtcaagctaggtcaagagcagccgctaggttttatgggattcaagggagaggattaccggatcgtgggtcacacaataggggaatgggaaaggttgagatttgagaaagagacttaatggaacataatctttctctaccaacaaccctgttctcttgaagacagccattctctcctctgcttttcctcatccttgatggtaagagagtcaacaaaagctccccttcacactcaactatctatctatgctacagctaacctgagctaaccctcaagcggcccacacaaaaggaaagaggtactgatgggccagagagctctcattcccagttcagcgacagagagcttcattagctcctctaaccccagcaacaactccacagggcagccactgccatcgcctctcctcagcctaagaccggacgcttcaagagtgaagtagtgttctcggtatcaacaaaaccaaacctaaccagctccgcatctgactcttctgcttgatgtatttcatagccaccaacccaggctgaacagcaattctccatcttcttatgatttttgtctgtaacaatgatatatctgaaagcaaagcagtaaaatgttttaaagaaaattatggaagaaaaacaaaaggtaagtctgttgattaaaggatcagatagactgttccttaatactttctctgaatcatcaaaagtaacttaaaatctgtatttttacataaaactaaaataatcagatgattttctgttaattaactctatttagatggaggtaaatatacgtgtttggttcctcttccctaccagctgttagagacatagacagaatcactcccacacctagtccaaaaatagtttcaactgaaaggccatttgtatcattaactcatacacatacaaagttaacacattcattctatgaataattctgggactcaagttctcaatggctctttctttaattcagtaaccatttttgaacagtggggcttggctctggaaattgactcttatttaaagttggtggataagggtaagctaaaaaaaaaaaatcaccttttctctgcagttattttcagagagaggctcttccctccccaagtttagaaaagttatatgtgatatgatctagtcctccaagcataagctgtagggatgagggaagcaagagagcttgtgaactaacctggacaatgaaacgaagagtggagttagagagaagatactcccacccactcaagacttcttaaaactgtcaccacagccctttcgaggcaggggcaacctgctgaatttcctgccacctggtgctgcctgaatagaagggtgtctcttccagaagttaaggcactaaagggaaaattcttccagaactgagaggtgggtagtcctgttgagtgaaaacagtcatgctgata

SEQ ID NO: 862 - DNA, 4000 bp, Mus musculus
gtgagcccttttgccttgaaattccagttataaacccacaaatgacacaatcttgttaaattttctgaagccctctctcacaactttcctccccaattaaaacagtaaactcatttctatgttaagaccatgcatctattcttctcctcgctccagtggaacaccattagatagattattagaccttggtttaaatcttccattcccttactaaagtcaaactgaattaagtttaacctaatgctgcttccacacctattttaactttggctgcagggtttatctaagcaatctgcatttgtactactatgttcaactgaggtctttctatcaataataacttcagtgggcttatcatttggtgataaatatttccttccttatctgtaaccactagaacatatgccatgggagagcagaacctgaatccccaaggcctagagcaactcctgacacatagcagttattccataaatgtctgcctaataaacaaagctgcaaacttacttattggctataatgatactccttacgaaaacatccgggattctttccatttatggctattggtggaaagcttaattattatgtgagcacatttgtctttgatgttaagtgatattgctgttgctttgttcttctggatttggttcacgttatctgatttgttattccaacctaacttcccattgttctggtttattcaacataagcattctgcctgcaccagatagcacatttatatttggtacacttacttcattttgatgccctagcaccaaatgtatgggactaaactgcctgctcccttttgtacaacatctgaacatctaaacgtctaattgaaaatgggacttagagactggggagatggctcagcaatcaacagcctccctagaaatcatgacagccgaagttcagatctccagctctcctgtgaaaggcagacatggcagcacactcctataatcccagtgctgagggtgtggagactagaggatgctggggctcagcatccatcaagactagctgaatcagttagcttacagtctgtgagaggccatctccaaaagctacagtgaagagtagtagaagacattcattgtccacctctagtctccacactcccatctgtacaccatgcacctttatgcatacacctacaagaaatggtacatataatatatacacatatgatacaagaaaaagaaaagaaaatacagccccaaatactaaaatacattgtgagctactgtggctattgttacataagacagcacaaacactttcacagctgtgaagaagaaaaaaaaatgattaaaggatttcacgggctcttagttctgttttgctttagaaagaggttgattggggctaatgaatttgtgcttcagtttgatttctttgaaacacacacccatacatggatatcacacacagtgagtatatgcatatgtgtttacatgtatgtccgtgtttatgtgtgtgttgtgtatgtgttgtgtgtgtgtgtgtgtgtgtgtgtgtgaatgcaagtaaacacacattcatcagagagttcttccctgtattccacaaagataaatgaaagccgaaaggcccaccgggaaaagcagtttccatttacagaggttacaggtcagcacatccagagagaaatacacccagacttcttgtgatgaatttcttttatacttgaacatagaagtcaaatgcagccatgctctggttcactttgtggtcacacatgaaagagatcaataaatcataggacagctgacttcaataagcctcaaagaatttatgaatggaccacagatcttccagtacagcttctacctagagacagaaatatccttaatttctcccatgtttggccactcaaacaacctaactccaacaactcctcaacttcacaaaactaaagtccactgatcctacaacttctcactggccttacgcaattcgaattccagaatcaaacctcttgatctttcttacatgtgacctcaattacctcggaaaaacaacagtcctggttaagaccagttgtctgcctctctggaacctgactccatacaaaaagaaaaacaaagagagacttgaaatgaaagaaaaattgaaccaggcatgatggtggacatctgtaatcccagcactttggcgattgaggcaggaggataatgagttcaagatcagcttggcctacaaagcaagacccctgataaattaaacaaattttttttctctatgtagtttaatttagataagaaattgctagcatcaaattgggccttcatgatacttggtaatctcaccacatttctaaacctctatttcctcccaccatcgatctccataagccattcagctgtctacccctcccccattctgtttttgtccctgctttctatatcaccaaggaaacaaaatgttcagtcaggatttgcatagctctgtccactgcatcagcccactcactccacagacagccactgccctgcctcttctggaacgcctactgtcttgtgcagggtgctgttcacaccccactgtatttcctgggctccaaccaagcaccattttccctgtccacccatctaccttctctattgctgttcttgccttttaaacaaaattcaactgcaaggacttttggcattttcccaggttccacggggccccatttactctcctgtctcttagagctgaactctcaagattaaatcagatctttactccatgccttcccattcattcattcattcactttttttttcagcatagatcccttttcccccttctgttacaagtaaccatatatatgtatccgattaataagacttcatttgtaataactaagccaaaagcattttatatgcatatactttaatgtatataaatgacattttttaattgtatttattttatttgtttgaggcttttcctcggcattctactccattttcgtcatccactatactccagcatgctcagttacatttatgctgttttagtaagtgttggctgataccagttttcacagtctgctaagtcttcctccatgtttggtccctcagaataacacttagataaccaacagccctggtcaaacattgctccaagccatctattctggggagagccctaaggattctattcttctatatcctacctccctacactcccattcaccccctttaccccaaatatacccctctcctaatcttctccattcccatttatactaaccccaccctgccttgtattcatgtgaagagtctcggtgacatatttgattcccttgtcttcttccatcatatagtgtaacagcaaagtttctgagttattctctcaaagccaattattttctgccatttttttcttcaaactcctcttatgacagtcaacaaagtgaccatcatttcttttatcatcattctcaatactccccatcgtgggaaccatgataaaagtataagccaagtaattctattaatctgcttaaagccattcaatggcttccatctcactctaggggaaagacaaaatacctgcagtggactaaaaaaggctttgcatgacccacccgtccccgtgtaactttatacagcttcacacaggtgtatagcacaccttcctgtgactcccagctccaatctcactttaatgaggaatcacactgttttctggatgtccccggccactcatcccaggcatgtttcacagagggtttccttagcccctggacatgcctctcatccccattcaaccaacaactctgatgctatttactcattcccaagactccatcttttctcaaaccccacttattcttttccacagcatttgtctctattacatatgggacaaatgtgcttaaaacaagcctttaagaatgtatgtagtgccgggtgtggtggcgcatgcctttaatcccagcactcgggaggcagaggcaggcggatttctgagttcgaagccagcctggtctacaaag

SEQ ID NO: 863 - DNA, 2575 bp, Mus musculus
gggcagagcagcacagcatctatgcttgcagttttacagatagctgaaagctcactaacacatatcctcagttacacatcaaagacctgtgaaatacaaatgccagcagccaatgagaaagaggcgatcatgtgcttgctcactacacagccagggctcagtgatcatccccttctgttctctggacctctgaggtaccacacttgttagacactaaaaaaatacggacgactttaaaaagatcaacaacaaaggtaattttgaacttaacagaaggcaactattaaaatgtaattcgattcagaaggcttggtaagtaggtctatggggagttcaaggtcattcctaactgtacatgtaggagagagccgacgcccacaagtcatcttccgactgccacaggcaccgtgacatgacacaaataaatagacaaacaaaaataaataaaacagtgacatgaaaaatttagactccatttatttggcttatgtgactttctacttttttgttcagattattagcaaaccaatggcttagttactagttcctctcttggtcctgggaaagaatctaatctatgcacaagtccagggcacataaaggcctcttctgtcttttctcttccgtcggtcctctgagcactgcactgtttctacattcagcctggaagcaactgtggactctaattcttctatgtgagctgtaaaagcaatcagtgttggtcattcctgcataaataagccaaacactcaaaatgtattggtctggtgctgaaggtcagcactgtgggaccccaaccttatcccttactgctattcctaccctaagctgccctccagccaaacctctaccatatctacaacagaagcaggaaaaaggctggggagaaagatcagaaggtgtggccctgttggagttgttggagtagttgcatcacagtgggtgtgagctttaagaccctcatcctaactgcctggcagccagtattctgctagctgccttcacatgaagatggaaaactctcaactcctcctgtaccatgcctgcctggacactgccatgttcccatcttggtgataatggactgaacctttgaacatgtaagccagccacaaagaaatgttgtctttataagagttgtcttggtcatggtgtctgttcacgctaactaaaacaatgcctaaatacacacacacacacacacacacacacacacacacacacacgcacaccaaaacagaaaaattaaggggaacctaggaagggaaaagaactcttcactccataaccagttgcaagtctctccccagctaagaataaataaattccagtacagctaataaaatttgctatgaggctgccaactagagacagtatctctttttctataaagaaatttcattaagaatgttaatttttcgatacaacatgtatgaattgctcatgtttgctgtgacacaactccctgcaaacagcactgtaagggagagtatgtcttggctcatttccagacacggcccatcatggcggggagagccccaaagccccaaagcaggggcatgaggtgcacacactgcctctacagcttctcatctcttccttcctccttttttgttctttttgaggcaccatttctctgtgtagccctggctatcctggtattcactctctagaccaggctggcctcaaactcagagctcagcttgcctttgcctccagaatgctaggattaaaaggtgtgccctcactacctggctccttcctcctttctattcagcctgggccccaatctcatggaatgatgcctctcacatatagggtggatcatgctaccttaacttaatagtctaaaaagttctgcacagacatgcccactggtagatatttcatctgagcacaattcctcctgtgtgggctacgtgacagcaaagaagcttgccgtcactgtcttagccttctgaggtaacccaggtcacaccagcagagagaaaagaaaccacggtgctttctccacctgaaaaagtacaatgagcctttaaggccagcctggtggacagagaaagttcaaggacagccagggctacacagagaaacctgaccttgaaaaacaaaaacaaacaaacaaaaagtataatgagaagaatatctcatttccctgatcctgcaaaaaacaatctaatcagaaaattctgaggccaatcctaattgtaggtcagtataaacacatctgaccagtactcctcaacactgccaaggccatcaccaaaaagaaaaaggagaaatacaatctagaagcctctggataggatgtggtgttggagtttgtcaaaagaaccttactcacaaagaccacagagactgccatcgctgcaaaacgcatgaggatttttattgatccaacatgttggggactcccctctcagcaagcaggccagaggagagacccagaacaaagaaagaacacactttttatacctttgtaagggacagatttgagcaacagggttttcattagtgtagcaagtaaccctttcaggcattggttggtttgtatagtgactaagtaaccctttgg

SEQ ID NO: 864 - DNA, 2500 bp, Mus musculus
tgtattggtcatatggttaggagggacgttatggctgttagagtgttctgtgggatggggcttagcctgtgagcttagggtcttcaggagcaaggcctgcccattggcgggattgcatggttgaggcttacgagccccattaactacggagggtcttgaactgaactgttgcactccagccagtggaacacagtgagactgagaggaagcagggcatggtgggaagggagagaagagattgtggccgggcacagggcacaggcttgtaaccccagcatgttgggtgatgtgacccaaggggatcaagcttgggtcctctgcatgagaagtgtgtgcgcttaaccactgagccatcactcccaccccactgctccctctcttggatgcagtttagagatgatgaggcacctggtgttgtgctctgtgctttcctgtgcgccatctcattgaattatcccaatagcaccacaagagaagcattgtccccgttttatgtgaagaaacaaactcagagaaggcaagtaacattcccagagtcgcacagctgagaaaggtaccaggactcaaacccacggttttcgtttatggctgcatgggagaagttaccgggggatgaagaattctgagtccaaaggggcctgagaaagcagacccttcaaggagacccaacccactatagctgaggcaggccagctctctgatttcagcaacacacactctagaaggcagaaggccatcgatgaacaaatacatggacctgtggttgctatgaaagaggactttctatgggaaagggagaggtactcagagccacctctgtggggaggggagaaactctctcctcttaggctttgtttctgttgctttcaggctgtgggaatttggacacaacccaattcctcgtgcttggtttccctatcagaaaagcggatggggagggttacatagaagattgctcaggtgttaggtgcaaagggttctgtgccgtcacaagggaacagtacaaggtcccctttctatccctaaacacagtgatgtgggttgctggggctccccacatttataaactgttgcagctgagagtaatcctcaattgtgccctgaccaccagcgcctgtggacacagttctggaaagctatcaaccattccccacgactccccaaatcagcgcagacacagaatggctcatttgcttgtaaataaaacagcgatttctgtgattggaactaaatgacatggctctcagggccacagttccttcccaggctcacagaagtcagctggcagcccttgaggcaggacgggggaagggaccggcttctcagaggacagcaggtcagaggctctgggcggggggtgtgcactttgtgctctgggtgcaggagaaggaagtgagcatctttgggagggacctaggggcaggaccgtggagggcaaacccagggcatcagtgtttggggttgggaccagctgttgggggaaccctgggcagacaatggcctcattaaggagagggtgcaggcaggcaggagctgggcatggctacagcaagaggagaatgtgaggaactgaacctcttcttgctaggccagccaatggagcaattgtcctctggtgggagggagccggaggtctgagcctgggaatggctggacagttgcccttgggggcaactgaggtagtcccggcccttttacccggcttacaataactcctccactggttgctgagaacttgggcctcagaagggatttctaggcttgaaagtccagggtgtggcttctcttacaaggctctttgaaaagggattctcaattcttaattgcccccttctggggagccattcagtttagggttgtctctggcctggctcaccaggcttctgtagctctcctgtgtatccccaccctgctcctctgtgcacagtgggtctgctcggtgggtttcaagagctccacctgctcttgagttgaactgacagtgcttctctgccgggtgagcagcttgctccacccgagctccatccatcagcacggctggtcctccacttaagctgagcgggagacttcctgtacaacacggtgaccagacgtttctggactcaaatgctgacagagctcccactgagatgtacccagagcccaatgacagaggtggcatggtagagctcaatagagaagacaggggcaaggaagttagggctggcactgagccccaaagttccacccagctgtggatactgcctcgggggaccctttactagaatacctgatggttctggaagctctaacaggtcaaacctctgttgtgatgggtctgtgttggttctgatcgacagatctacagatctgctggaattggtctgtctgcattgtagcgaatcctggttcttactcctggctttggtttttgcttcattctgagagaggaggtgggcagctaaagtctgaggattagcttcctgcagctgggaactgttgctggtttcctggctcgcca

SEQ ID NO: 865 - DNA, 2650 bp, Mus musculus
tctgaggggtaactcaggagcttccggttgctgctactaggggacacatggctggtgcctgagcacccgggggagcctgggcctctgtctctgctgagtcttcgggtgtgtgtgggtgggtggggttggtgagctgctccggtcggtggcagggaggtcctgcttgagttctgctttggggggaagttggctgtagcttgaggtcaggtttaaacctcagccaaactttagagaggaaggcctgcagatggtgggggatttccaaactggcaaaaattcacccgctccccctacccaccaccttgcttgactggctgagaggcattcagctctcccacttttaaagggcaaggatgaaggagataaaaagggtagccatgctggagagatggcccagcagttgagagcacttccagagggcctgagttcacttcccggcacccacatggctgatcacgcctgtgactctagttccaggagacctggcaccttctgacttcctctggcaccaggcacacacatggtacatgcaggtaaacactcgtacatattaaaagaacatttctttttaaggaagaaacatggtcgtatttgtttgaggcttatcgtgtgtgcacgagactaagccaccacataattcactgcttgggccttctggtgaactttccatggtgtgtgttactatacccattttacagaggaggctcacagaagttaaatgaccccaaatcacacaattaagtagcagagcttggctttggatctaaagaggaggctgcagactgcagaaaggcacatgggtgaatctagtttcaagggtcccttagatactcagagaccagagtcgtagattcccaaggaaggacctgggtctatttgtgtctctaggttctgaggcaggcctggcacctccatgccccaggagcacagaattatgggtgggctgtgtgcacaggcatgtagtactcacagggacagctcagtgaatggcaggggagacctgattttgcagatctggtgaagtgtgtggctctctctgctgcctcagtttttcaagcggtggcctgtcccctctggctggtcgcagccatgtcacttccccttgctaagcagacacaagccacaaagggcaggtcttccctggttccctctgaagggcacagccatcctgacacactccacgcaagtttcagtgcattcattgcctttcttcctttggtcaaagacagcctgtgtgatacgaagactacagggtttctataagttcgagtgccgccaagtggtgggatcatgtactgcagccaagagccaaaagactactgaaaagccaaccaccctaagccagtatagctgttgtggcctggaagttctttgcggtgtctagaattgtgagtccaggcagagatcctgcgacaatcactctttctccccacagtcagcttcagctgctccaggccctgccaggttccccccagcccccgacacttcctgtgaggtccccgaaggaaggaccctcacctggcctttgccttctattccaaggacaagctagtgaaaacgtggctccaaacaaaatctggctttgagccctgacttcaagatgtgggccagcattagaggcagcctcggctttctccatcatcacacaggaaacacttcacacaaccgttcagacctaatcatgagacctggattaaaaacactggctccacaaaagtaatcagacccagcctggaacaagttcaaagagagacgaaattgtctatctgaggtggaggagaggaggtctggagagctggtagcgcaccgggccctcacttcttaaaaagtcagtgtactgaatacatgagctctgtgcatctttctgtgttttattgtctgataaaattaaacaaaaaagtgtatttgctccaaggtaggaaaagaaagcaaaacactagaattcatggtttactgaagatctattagcatgcctcgtgttaacccaggcagttgcaattcaacatatgaagagtgtgtgtgtgtgtgtgtgtgtgtgtgtgtgtgtgcgcgcgcgcctctcctgtttgctgtttattggggatatttataaaagtgtttgatatcttcccagacagctctgccaccaactccatagtcttttcctcccactcacagactctaaggggagcctgggggggggggaggaaagatcagaatattaattgtgtctttcttaaacattgtggcttttaagtcattattaatatttttttagttgtaatttgaaaaaatactgcactcagacaatcttgttctcgactcctgagtttttaggtgccctccctcagctgttcctacctcctctgctcccttctctgatttcccctcctgccattgtctcctccagacaggtcctgctggagaagccatgtggagcacacccttgaaccccactttcagcaccgacctaacacttgtctgctgtccagtgtcctgtggggctttccccaggatatctgttaaggcatcaagttaaggcatcaagatgcagtaatagcctgccaatgttagagactcagagaaacaatccacatgtctgcatgccactccacccttagcttcagtctggatgtagtcaagtgcttacctacctagcacgggatacggc

SEQ ID NO: 866 - DNA, 2275 bp, Mus musculus
agccagatcatgccattaataccagtaccggggagtcagaggcaagtggatctcttgagttcaaggctagccggttttcgtagttccaggctagccaaggctatgtagtaagaccctgtctcaaaacgaaggtcccaccagttgtgcatgctgtacttgggaggttgaagcaagagattcatggcaagatcctaccttaaaaagatggaaggaaaaaaaaaaccctaaagtcaggactgacttgtaaagagacagcccctgctgtgcacgtcatcctgtgctgtgtcatgaagagccagtgaggtctgacgagagttgctcatcatgacacacacacctcgaatctgagctattctctgctttgttgggtggaggccaatctgctccatcacgtgttcattcataagccacttgggggtgacagtgctgctctcgagtgagcccctcttctccccccaggaccaatacacagaaagacgcacaagatgaagaccatcaaaaggaaagactgcctcctgcccctccaggtggtgacccacgcaggattcttatcagaaccgattgatctttttgttaaaagacctatgggcttttactgtatctagtcctttcccttggcagtggccacattgtttttcctgggtactgtgacccctaaggtagacttggtctgtgatcaatgtcactggcttccagtggagcttagagaatggtagtgtaaggtctcctggccttgtttaggtaaaaacaagcatgtctgctcccttaacaggagaacccagagagttacagggacagggtgtcagcaaatatccctccattgctaccagcagctactagataacagcctgagccatctggctcctgagcccaggacagagtctgaggccatgagcctagaccttaagcctagtgtcagaccctgttcccaggtggaggtgcgtggcctgttctaggcgacagccctttggtggccctttttaaggctaggctgtagttcctcttccctttaaacctaggatcgaccgggcagccatcagcaatgactaagaggagactttgcttcttcctgattggctcttgccaattaagagcattttattaggctgctaattaaaggcacttcgttagcagcaggagaggccgggtgggtgcctggtgagatggagctgaagccaggagaaattgttttcctcccccatggaagcagaacctctcggaaccctgtcagtcctccagcctttcctgctgcgcccaccacgccccttgctttcaattagtagctctgaggggagcgaggtcattaccaagcccaggtccagagctctcaccactacctcaggccacaggaggccttgaggagctgtccagggccccaagcacctcctccaaggaaagtggccaagcagcccaaagaaaggtggcactttttaccctctatgcctctagtgaatatgtcatgtggtccccgtggctgaggctgcccccagcagtcacctagtagatgacaacaatgtaacttccctcaccaggagccccttgctgcataaggcatgacttttctatcaggaagaaacaactctcccaacccccatcgctttcctagagtagagccccccatagggtcaccaagaggggctggtggctgagggaatcccatggggttcttatttcaaggactgggaatagaactctgggctttgcacatgccagggaagctgtagcacgtgagtgcatgaccttgctcaggtggccccgagctcactgtgcacttgaggcattcattcccccacctcccggcatggcccaggtaggcttaccccaggcaagcctttgcttcctaggagagaggagggcttggctgagacttagcacctgggggctggcatacagggtcatcaaggacacccctctccagagctcccctcaccccttcacttaactgcagaattagcaccagcctgggctgagagggcagatttatggccgggcccacctccctccatttaacccgaggccggcccaggctccagacactaaattagatttttgacaattagagagactaatgggcacacagccatccccagagccagatatccagcaaggccatcctataacatccaccactggttagtcaccctcccccactgtccctctggtctcccatgggtggcatctctccctccgagctctgttctacctgcactttggagatggctaccagcttccctccctcttcaagcctctggcccgatgctggttggcgctggtc

SEQ ID NO: 867 - DNA, 2775 bp, Mus musculus
gagataggatggcgccctcaggaaagacagatttgcagggggagtgcttgtctcatagctgccccctccccacagatcctttgcagacgggtggctgtcagaggaaggccaggcattgttgctattgctgctcctgagcttggggatgctctaggtctgggggctttacgagaatagtgaactgacttgtgtatttgctcttttacagccagacatttatataagggcacaaattgtgattaatattattatctgccccgattgtaattgttcgtttgctctcttctgcctgtaagcagtgtgtagaaggcaggtcagggtttggttttggtttttttctcctaagtagactgtggggtctgccgtagactgccccttgttctttggaacattgctacgtaggacttacaagaaaccaactgctaaggctagttcttctctctcaaattaaagaaagagaaacagccggtccttacaaagtaaagcagataaacaaagaacaaggttctgtacttggtagtacgcaccagtgagaatgctgaggcaggagaatactgattgagtctaagactagcctgagctacataaatagccagtctctttctaattaattaaaagattaatcagatttattttgtggatataaaattggcaataagcaataaatcggatgaaacagaccactttcgtagtttctcagatgtcagaaggctggcccattcctccagtccccggacacctacttcagctttcccggatcacaggagaaccttcaccagacagatgcgttcagtgtcccgaatggcctggaagtccttgtaaacccgtcctgtgggaacattaggacttgtctgtacctacttttattacttatattttgatacgttttcttgctctgctaaacacagatagcgtgggaagtcagaagctgtcccgagtcttctcctcaggatgctgtttattctgcactcgggctctgctgagaggagggcagccctgcgaggggccagggcagggctcttccttcctcctttatgtgtcctgtcagatttttggtgctcctttccagatttccacacagcagcagggaccttgagtagggccctacgtaagagtctcatttcttagcatccgccttgcgaggagaaacgaaattaaacacgagggaaagcaatgcacttgcttctctctgcctgtgcggcacatattacaggatggtaagcggtgacccagagagctgaggacatagtgtcaggctggagctgaggagaggagaaaatggtacagctgggaactgccttgcacgcagttgttttttgagctgtgtaaaaacagtttacttcacacataatgccttggaattaatcagccgtgcaaccacgtttgggggaaggacccttcatggtctctacatacacgaatcaaagatgggatttatctgaattgccccatagccttcattgttgaagtcagtattagccctttgtttggcgaagcattagtagcaatccttggttgggagaaggtctgattgctggcagcattcggcacagtgtgctgtttacctaagggtttgattcaggcagctctctgaacagctgggctgattattgaaagcgcctcacagtagcttctagcctaggctgatcgatactggtgcgaagctttacgtgggagggagctatttaaacattgagagcccgggggataaaagagaatgaaaaaataatgccgaacaaatgtgctgagacgctcgaaaaagagaggtgggtcctgttgtggtacagggggaaattccgaactaaagtagggaatgtgtgactttatctcttaacggcatccccaaacttacccgacagatagcaacactcttgcaacatactaaatgctgaatgaggagagaatcgagagtaccaaagacctatcttatttttattgaaatataatttgttatataagatccccaaaaaccatctagtgctacatgagagaaacattacttgattattagatgggttgagctcccagtttacaagccttttctctctccgaatcactaggaaaatctcctcgtgtcagggcgctaagctacagcacccagatgtagaaagaaaatccattttctccaacaacaatctaaataaaaatattaacttctccttcagcctaagagtagatcacgtgggttttcctattttaaacagtttagtaaagtaaataacaggctgtagtcatgacagatttctgtcttctagaaacagttggtgcaaattggacaatgggaccaaaaatattaacattaaagagcctgtttcttccaaccaacatgagagacagagaactggtccaagtgtgcggggaagtccttgtccatcactgtggacgtctgtctgtctgtctgtctgagaaactgtgcatcttgtggcatccttgcttccttactccgtactgagcggcagacaggaagttcagaaacacaaaggcaatcgatatgaaagcttgaacatctcttaatgaatcagcacacacaaactctccaagtaagaggatcttacaagcatttcaattaaggctttccctttttattatcagatatcatggacagtaaaaaaaaaaaaaaagcataattaaagttgacaaaatataaagaaagcagagtcttccctgaacagtgagcttttaggcttaccagagcctctgctttcccagtgttgattcttctgggggatctcttagtggactcttgagtagtctgtagcagtgttgactcggaac

SEQ ID NO: 868 - DNA, 2825 bp, Mus musculus
gttcaaacgtgattattttaaatgggcggggtaaattttaaagcagtccagtgttcgtgctgtggtatggttattgctagttgctttccgtcaggtttgcagtgagattttgtgaaaaagcaactaaattatgcacatcagctcaaagacaagagtttctttaactagcactttgcaggccgctctcagtcttgtcttcttcttttgaggataagccgttgcctcttccatacagggacttcatgtgtacattcataaacttctctcttactctccagccaaatcctcctggctctctctgatcatactgacctctctcctctctaggtgtgtgtgtgtgtgtgtgtgtgtgtgtgtgtgtgtgtgtgtgtgtgtgaagggaccagtgtttaagagcactggatgcattttagaagtcctgggttggattcccagcaccacctggtaactcacaaccaagtgtgccttcagttccaggggatccaatgctctcttctggtctctaagggcactgcacaaatacccagagcataaaataaaattttgaaaaaaagaaaataaaaaagtatatagcttgcaaaatctaagacactgactgtctagtccttcttctgggaagaaaatgttttttcatcactgttctgtggtgcacgttgcatgatttgagttgtagatacatttcatggcgacgtcattcggagctgccttcgtgaggtctgaggaccttggcacaggatgcgtgatgtgtgtgtttgcttttagagttgttccatcctggagtaacatagactttagtccagcaggcgctgtgaggagcagagttgactttttatgcagccttttccttcatgcccagacttcagtggcatgcaagaatctttgctgtctctttggtcccctctccatgtgctttggtaatttgtttaccgtatgggtgcaggtgataacatgaggttatgtctgtgactcagtttccctcccttcctggaaggtggccagcagttacatttgctggccttgctagagttgggaagccgtgccttctgatgcttgcttgtttattctatgtagagtacagatttccttccaactcagtctctgcctcgaatttagtacccggcaatttccttttcctttaagataagctatatattgaaaaaggtggtaggtacatttatttttggccttgaatttctgtgtaagcatgttggaaatttactaataatgtcacgaagatatttttaaatgccgccgcacatctgtgtacagagagcccatattttcagaactacatgcttcatttgcatatcaaatgatgagtttgtcattatgttttattttgattttttttttctgtttgtgtttccataaataaggagccatctggggtagatttaaaatgcaggcaaaataaaagtgatggattatctttagttttatttttgttctttatttatgtttgatatcaggccatttaagttcatcctggaagaattattcagtgtcaggtcatgctacctgtgggtgcagtctggtgccagtgtaattacaggcctaggagcatagccttcccttttctgtgtttgctatagctgtttacagtcagccttgtccgttgtcattgacagtgagttagttgtaagcataccagttgccagcaccctcccttccacagaatttctccctgcagtcgggtctaaatccccattatgtctgagtgatgcatcctgtttattagatctactgtgacgcaccagccatgtggagctggatccgagacacaggcttcttggctgcccttggatttttcttgttcacacaggaaagattgactggcctttggccagccatggtctttgattttgttaggtgttgttggtcattcctgtgctgtctgtttgtgtcactatccccacacccagagactcttgtggggacatccctcgctctgccatttcaggcataacctgtacgaggcgttgggtgtgaaacgcacccttcctacccagaagcaggtgcttccacttagataattgttttcatgtggtttgaaggttcaccaagaatactagcctgcctgttcttcttattttggttcttcaggcaagtccttatgtgtagtggatattcatgtttctaacctgaatgaattaattatggacgaattaattatgtgtatggcgtgtctctacaaaacttccccttaaccattgaagcatggtaatagaagttctaccaacataatgtttttattatgaaagaactcccaagttcgtcattggtgactgacgatacagagatctgctgagctaagtttgctgcccctaaccttttgaaaggcatgtttgtgaactttaaatttgaaagaaaaattgtggtgttttaaatatatattatcttacacatttgatttttttattctgaactttttgttaatagattcttttgttttatagatggtttaagaactgtctcgttgttttaaggagtacaccattattcaaattaagattccccttgcttatcacagtaaacattcatttttttaaaaaataaagacctgttgacagaagattttctgtatttatgttttgtcattaattataagtaaaatatgtttatgatatattaagaacttactaccctttatcaaagctatattatctaatcttgtctttatgtaatttaatagataagacattcataagattctttaatgagtatattaaaatattccttatggcctataatctttatatttcacattatttgtagctcctacaccttatcagtaccaaggtcagttgtgacctataataccatgt

SEQ ID NO: 869 - DNA, 1875 bp, Mus musculus
accacaatcaatatttttagggaacggaggcagcagggaagtggggtattcagccttttgtatgcgactgagctgtggaaacaggatggagatttgtaagtctgtccagtaaatgcctctaagtgctttaaaaacgtgacttagagcagaatggagggcctagggagcagccgagaattagggctaaattagcacatttcaatgcctcgatagaggaaatgtcaagaacaaagtagccagagaaacaagcagaggcaacgtcagacactctgcctctttctcctcttcttgagcaaccctaacagctgggaagtaagtagtttggtttttaagtgggtaaattatgttactttgacagaggatttattattattattttgttatttatcaacatcgaggtgtagtctacccttaaatgggccagataagattcaaatcaaagactgtccacttcaatgcatgctgtggtgacctggcatgagcaatcccttcctgcagaatttacattctaattcagctgttttctaaatacagtccacataaaatcaaaaagtttaaaaagaggaaaaccagagagataaagaaaacgattgggcaaagtagatcagtcattctgcatatggattaaaatatttctattatattaaagtattaatatttacaggcaaccgtgggggaaaaaactcattcgttcttagacttgcaaatgatagagcgtccatttgtagacgaaaggcggactgctagcgccccctggctgtggaaaacgattctgtccttcccagtgtacgtaagacattaactagctcaacaagaaacctgcaggaaaaccgattcaaaatgagcatccaccacagccctctgacactactgtcccagcctgtggggctgtggtcctgtcagcagcactcagtgcattcaaacctccatcctggccctggagacccttgaactccactcacagcgggctaattataagacgggagacatcaccctttctttccattttgatggatctgaattagacggtctcccggatgcacaggtacagtgatactgactgagacagaagatactggttctgcccggcacagcctgagccttaggacagattagcagatgcgaacatacagcccattaaaaactacaaaaaaaagaaaagaaaaaaagaaagaaagaaagaaaagaaaagaagagaaaagaaaagaaaaaaaaagaagtgattttgttacgtttttgtgtgcactgagctttataaacctttaaataggcagcttacacaattagaaaatttcagatgaaaccagatatggtagcaaatgcctttagtctcagtacagggagccagaggcaggcggatctctgggagttcaaggccagcctggtctacctagagaattccaggacagctaaggtttgttacactgagaagcctgtctcaaaaataaatcctatttccagcttcttttgaacaatccagagatctgacattgggtatgaactcacacagtacctacagggagctctcagtcatgtggcatgtacaacttcatccatccaattcctcctactttatgtgtcaggtaatatgggactatcttgatgaaggctcacattgcctgctaggtggctatactagttagggtttgctaaaggaatagaaccaaggcaatgtatgtgtatgtacatgtatacacacatacatagatatgaatctattaagccatcttattttaaaataggaacatcaacggattcccactagagaggctgagaactgggtagttactttgtccttggggtaggtgcctcagtagtcagagtagcccacagtagcagtttcatagtgggggagttaattatctagcactttct

SEQ ID NO: 870 - DNA, 2042 bp, Homo sapiens
cctaacccccccagaatcacccagtgctcccccaacctgctgagcgtggctcaagagggttttcctaaatagcgtgtgaaatccattaggagaaaatgggttcagaaggaggaaacaggactgcttctcaaacaccctggcctaggaagctacatttctaacaggctctaaggggattctcacagaaaggggcccaaggatggtgtcactgaaaaacagcacataaataataacataaacgatgacgcactacaggctgcacatccacatacaagggaatgtcccagaagtcacttctgggacagtggcagcaggtaagacttccagctaaagtctgctcatactctgcgtgaacaatgtgttgcacgcttggaccgacactcctatgcacagcagctagagcagcaacacttggaggaagcgccacacaaaacagacctagacagttcacagtcgtgcgtctggtcttctctgcagtcaaccaaacgcactgcacagaccttggcctgacacagaagtcatttccttggctgctctgtgctgtctgggtgccaggtcctgagagccagggcttcatgtcgatgcttcaccccagtgtaccctagaacctgttctcaacctctgtgccatgaccctgtccaccccccgcccccgatctctcactgcagcacccactctctgccccaccttgcttggcaccattttcctgatcctcacaccaccgtcccagactcttgtcctgcactgggacgcctcgccagacatggagcctgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatatctggagtcaagggcagagtggaaggggaggggaacgtagatgggtgtagtccaaatggaagctaaagtttcaaagtcccatgaagccttacaaggtcacagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagttacgggctcagtaataacaggaagtggtatctgtgcaaaggcttaaaactgttgagccccaccagggctatgtggtggaggcctcgctcaggggacacggaggccatttgtgtaaggggtgccgctcttgtccctgctcaggcttctggtgaacaggggccaggaaatcccacagcccggtctaatgacagtcactcttgctgactggccaaagagcaaggcttgggagcaggcagagtggtgtttctgaaagtgtgggccatcatataagagttacgtgcacgctaatctaatacattcctgggctcaatcccaggcctgctgagtgagacactttggaaaactgtaattttaacaagcgccttcagtgactcttacaaaagtttcagaagcacgagcaaagaaatattcaaaaagctgtgcgggcgggaagacctgggtcaaatcccagtaccacgaccttgctgctgtgtgacactgggcaggtttacttaacctctctgaacccgtttactctgtttacaaaaatatggagcataaccactgcagtgttgctgggagggtgaaaggtactcaactacagaggcacgcatccatggcttcatccaagctatgagtgcctgtgtctaaggcattcgtgaatgcctacgtttaagaggcaggagccactctgaccctcctcttttaggggaacaatc

SEQ ID NO: 871 - DNA, 3042 bp, Homo sapiens
ctttctgcaaggcacaaagtcttcttctgataggagatctctgcttcctgcctgcagaactgcccgccactctcccagcctgggctgagtccctttgcccttctcttcccctctcctcctccagccctgcccagcaggacccctgaggttgctctgctgccccctcagctctcggccccgagggatgcccaccctgttccagctggacactcagtgttggagaccgatgtcagctaaagggaagtccaagcctcaaatgaaagccggaggccacatccccctcgactctcaccagggctcactgagtggcagggtctcaagcgcaggcagcccctttcttcccacccggggctgtgggaagatggcttctctgaacagccttagccagcaccgaggtccatatgatcagaggggcttcccacaccctcccatcacagtggaccacagcttagtgacgctgggtgggtggcccttcccccctgcaggcgccacaggcaggacctaacccccccagaatcacccagtgctcccccaacctgctgagcgtggctcaagagggttttcctaaatagcgtgtgaaatccattaggagaaaatgggttcagaaggaggaaacaggactgcttctcaaacaccctggcctaggaagctacatttctaacaggctctaaggggattctcacagaaaggggcccaaggatggtgtcactgaaaaacagcacataaataataacataaacgatgacgcactacaggctgcacatccacatacaagggaatgtcccagaagtcacttctgggacagtggcagcaggtaagacttccagctaaagtctgctcatactctgcgtgaacaatgtgttgcacgcttggaccgacactcctatgcacagcagctagagcagcaacacttggaggaagcgccacacaaaacagacctagacagttcacagtcgtgcgtctggtcttctctgcagtcaaccaaacgcactgcacagaccttggcctgacacagaagtcatttccttggctgctctgtgctgtctgggtgccaggtcctgagagccagggcttcatgtcgatgcttcaccccagtgtaccctagaacctgttctcaacctctgtgccatgaccctgtccaccccccgcccccgatctctcactgcagcacccactctctgccccaccttgcttggcaccattttcctgatcctcacaccaccgtcccagactcttgtcctgcactgggacgcctcgccagacatggagcctgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatatctggagtcaagggcagagtggaaggggaggggaacgtagatgggtgtagtccaaatggaagctaaagtttcaaagtcccatgaagccttacaaggtcacagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagttacgggctcagtaataacaggaagtggtatctgtgcaaaggcttaaaactgttgagccccaccagggctatgtggtggaggcctcgctcaggggacacggaggccatttgtgtaaggggtgccgctcttgtccctgctcaggcttctggtgaacaggggccaggaaatcccacagcccggtctaatgacagtcactcttgctgactggccaaagagcaaggcttgggagcaggcagagtggtgtttctgaaagtgtgggccatcatataagagttacgtgcacgctaatctaatacattcctgggctcaatcccaggcctgctgagtgagacactttggaaaactgtaattttaacaagcgccttcagtgactcttacaaaagtttcagaagcacgagcaaagaaatattcaaaaagctgtgcgggcgggaagacctgggtcaaatcccagtaccacgaccttgctgctgtgtgacactgggcaggtttacttaacctctctgaacccgtttactctgtttacaaaaatatggagcataaccactgcagtgttgctgggagggtgaaaggtactcaactacagaggcacgcatccatggcttcatccaagctatgagtgcctgtgtctaaggcattcgtgaatgcctacgtttaagaggcaggagccactctgaccctcctcttttaggggaacaatctgccactaagagagcatagggcttcctagagtctccccatgcataatggaagccagataccgctaatgttctattcagaagcccatctcagtccctgttccggggtcaagcaaggtgaggcaggaggtaacgatgggctgagctttggaggaaagctaagacgacccacctttctcagggacagggccttgaggtggtccaggctgctggacacagctccaagatggatctaccaaggggctctcctggggtggagagcataaaggatgaaaaggccgcaggcctctggacaggtccgccggagactctaaaactcagggagggaaaaagagcaggagtggtccatcgcagggtcacccctggtactgcccgtggcagggctcacaaacaccccacagcctctttcccccaggaagcaggttaagatgaagaaaattaggcaggcagctaccgggcggtgcctggctcgcggctcatggctcacagtggaggatggacac

SEQ ID NO: 872 - DNA, 3553 bp, Homo sapiens
gctgacttctgatttgtggctgcctctatggtttaacatcctagcaaatttttcttacacgttccgtcgtgttcctgagctgctagagagctatctgagtcagcggttaactgaggcttaggcacacatagtcatcagctgggaggaacaggctaaacagatatctccttgcactacttagaaaaccaactttccatcaggaactctgggacttttagaaaatatgtatacagcttccatgggtcccttaagttattctgttattgcagcatgcagcacattgggtggaaacctaaaatgcacactgagtgactcccctttcactcttttttggggggtgaagcagggcaggtgtaaaagcagttttttgtttttttgagagagtctcgctctgtcatccaggctggagtgcagtggcgtgctctcggctcactacaacctccatctcccaggttcaagcgattctcctgcctcagcttctcgacgagtagctgggattacaggcgtgtgccaccacgccagtctaattttttgtctttttagtagagacggggtttcaccgcattagccaggatggtctcgatctcctgacctcatgatctgcccgcctcggcctcccaaagtgctgggattacaggcgtgagccaccgcacccggcctgtaaaagcagttttttaaaatgtgcgtttatgtatgttgacccaggttactccgttgtcccgttggtaaagactaccaaatttaatgtggctgtttcgtaaagataccttctcagagacatcgtcaaagagcatgctttaaaactctgttcaggcacatttgcagctttccataggaaactataaaggcagataatgtcatagcacctttttctaaagccattcttagggacttcagcattgacgatatgattgagggaagagcagggaggaaaacagtgtgtctggagggccccctgggcttctgccatgagattgaagcttggcacctcagtcatggccattctgcacaggtaaatcttaaaatttcatcttgaatttttcatggcatcatcaactggtgtagatttgggtatcattttgcagctgccaagcggatctttgtgtcagttcaccccaaactacatcacatttagcaaaattgcccatagtatgcaggtaatattttgagtagttttatgatagattttgacatttatttcttttcttctcttttcttttctttttcttttgtgacagagtcttgctctgttgcccaggctagagtgcagtggtgcgatctgagctcactgcaacctctgcctcccaggttaaagcgatgctcctgcctcagcctcccgagtagctggaattacaagcaagattttgacagtatttctaatcaaattcctgctgcctttataaaaaatccacatgtttactcttgtgaaattatttgttataattgttaaactcttgggttttttttttaaagacttagaatatcataaaggtataaagagaagaagcaagttatgtttagaattttagctaagttgttttgtggatgacattctgtgttgggtttaaaatgagattattgaagtgggctacctataagatagagttaatctaatgtgggttttggtgtgctctatggttaactgtgggtctcaaaaagttaagtgtacttcaagtgcagtatttatgtaaaaccactaagataagatcttgctgtgtaatctttgctggtgctcaagctaactgattacaatggctggcattttcactgttctcacacttacaaaaataaaatcagaaagcttgagaggatagggaaagacatctggtgtacaaaatgaagacatttatcaaaagggatgccttttttccttttaaaaactgcaaaaggtttgtttcatctcattaggcttagaagtataaattttacataattagtagaaagttgaatgaataacagaaagttggaataaatatttgctcttgtattaaatacatatgaaatgccttgctttagtatattgattatgctaatttatagtctaaatgtacaattagattcaggaggcataacaggatgtagaatttgataaagaatacattaaagaaaaagaattcttgtgtagacctgagtcttaaaaaaattaaaaaataacatttaaattttcttgtaggcctggtgtggtggctcacacctataatctcagcactttgggaggcctaggctggtggattgctagagcccagaaatttgagaccagcctgggcaacatggtgaaaccccgtctctacaaaatacaaaaaaaacattagccgggtgcaggggtgcatgcctgtagtcccagctacttgggaggctgaggagtctgaggtgggagaatcacttgagcccaggaggtggaggtgcagtgagctgagatcatgccactgtgctccagcctgggtgacggagtcagaccttgtcttaaataaataaataaataagtaaattcccttgtagaactataattgttttatgatacagaatattaatcactgcattaaatttggatattattataacgatatttagtaaaaaggacaaacttgaatttctgttcatcccgtcacacctctcgattagagctaggtgagttacatgtagttataaactaaagggactagaccccaaagctatgttcactctactcttcacttttaatcacatatatattttcttttcttttttttttttcgagacagggtctcactgcaacacccaggccggagtgcagtggtgcaatcacgggtcacagcagcttccatctctggggctcaaacaattctcccacctcagcctcccgagtagctgggactacaggcatgtgctaccacgcctggataatttttctattttttatagggactgggtctcactatgttgcccaggctgatctcaaacacctgggctcaagcaatcctcttgccttggcctccaaaagtgttgggattacaggcatgagccaccgtgcccagcccacatatgtattttcttctctctgggaaactagccttcgttttctccaattattgacttatttctttttcacccaggctttgtgttaagctcctggatctctatgaaaccgctgctgatacttctattagcttctgttaaaagaaatgaaaaacttcaccttacaggtttctttcagcatctctaaaagtctctgttgttaatatagtattgagacttatccccaccatagtcatttgcataaaattattatactgtatataaaagtttaagatgtaactttaaatgaacatgaattataggtatggataattgcattaattttggaaatttgtgttgaattttcttctctaagtggatatctcttagtgctgctcaacagttagcccattttatctcttcatttatgttggccatttttcatttatatcttctgaaaaaaattcatgtatatgttctgaaaaaataacacactgtatacaattaattgtatttgcccaattttttagaatatttgtttatatgtatacttacaggc

SEQ ID NO: 873 - DNA, 4553 bp, Homo sapiens
ttttggaaatgagatactcctctctactctttgtgtcttcagtacttttaaccatagctacatcttagaatcaccagggagcttgcagagaacactaatgccaggattttgccccaaactaattaattcagaatctctagacataggaaataagttttaaaagcctccctagtgtttgtaaggcacagtcagggttgagaagccactggtttaaatctggtcatccttcaagtcccttctcaggcatcatctactccagggaaactcagatccctcatttctcctcaggacttactagtaggtagtgaagtgattctatgatcaatacttatttcattattttcggagttccattccagctatgttgtaaggatgcattagggctgagattatgcattatatttaggaatttgctgaggaccaaaaagttactttataatttccttttatttgacccatgttcacttctcactttggaaagacttcaggttgataagcaagctgacttctgatttgtggctgcctctatggtttaacatcctagcaaatttttcttacacgttccgtcgtgttcctgagctgctagagagctatctgagtcagcggttaactgaggcttaggcacacatagtcatcagctgggaggaacaggctaaacagatatctccttgcactacttagaaaaccaactttccatcaggaactctgggacttttagaaaatatgtatacagcttccatgggtcccttaagttattctgttattgcagcatgcagcacattgggtggaaacctaaaatgcacactgagtgactcccctttcactcttttttggggggtgaagcagggcaggtgtaaaagcagttttttgtttttttgagagagtctcgctctgtcatccaggctggagtgcagtggcgtgctctcggctcactacaacctccatctcccaggttcaagcgattctcctgcctcagcttctcgacgagtagctgggattacaggcgtgtgccaccacgccagtctaattttttgtctttttagtagagacggggtttcaccgcattagccaggatggtctcgatctcctgacctcatgatctgcccgcctcggcctcccaaagtgctgggattacaggcgtgagccaccgcacccggcctgtaaaagcagttttttaaaatgtgcgtttatgtatgttgacccaggttactccgttgtcccgttggtaaagactaccaaatttaatgtggctgtttcgtaaagataccttctcagagacatcgtcaaagagcatgctttaaaactctgttcaggcacatttgcagctttccataggaaactataaaggcagataatgtcatagcacctttttctaaagccattcttagggacttcagcattgacgatatgattgagggaagagcagggaggaaaacagtgtgtctggagggccccctgggcttctgccatgagattgaagcttggcacctcagtcatggccattctgcacaggtaaatcttaaaatttcatcttgaatttttcatggcatcatcaactggtgtagatttgggtatcattttgcagctgccaagcggatctttgtgtcagttcaccccaaactacatcacatttagcaaaattgcccatagtatgcaggtaatattttgagtagttttatgatagattttgacatttatttcttttcttctcttttcttttctttttcttttgtgacagagtcttgctctgttgcccaggctagagtgcagtggtgcgatctgagctcactgcaacctctgcctcccaggttaaagcgatgctcctgcctcagcctcccgagtagctggaattacaagcaagattttgacagtatttctaatcaaattcctgctgcctttataaaaaatccacatgtttactcttgtgaaattatttgttataattgttaaactcttgggttttttttttaaagacttagaatatcataaaggtataaagagaagaagcaagttatgtttagaattttagctaagttgttttgtggatgacattctgtgttgggtttaaaatgagattattgaagtgggctacctataagatagagttaatctaatgtgggttttggtgtgctctatggttaactgtgggtctcaaaaagttaagtgtacttcaagtgcagtatttatgtaaaaccactaagataagatcttgctgtgtaatctttgctggtgctcaagctaactgattacaatggctggcattttcactgttctcacacttacaaaaataaaatcagaaagcttgagaggatagggaaagacatctggtgtacaaaatgaagacatttatcaaaagggatgccttttttccttttaaaaactgcaaaaggtttgtttcatctcattaggcttagaagtataaattttacataattagtagaaagttgaatgaataacagaaagttggaataaatatttgctcttgtattaaatacatatgaaatgccttgctttagtatattgattatgctaatttatagtctaaatgtacaattagattcaggaggcataacaggatgtagaatttgataaagaatacattaaagaaaaagaattcttgtgtagacctgagtcttaaaaaaattaaaaaataacatttaaattttcttgtaggcctggtgtggtggctcacacctataatctcagcactttgggaggcctaggctggtggattgctagagcccagaaatttgagaccagcctgggcaacatggtgaaaccccgtctctacaaaatacaaaaaaaacattagccgggtgcaggggtgcatgcctgtagtcccagctacttgggaggctgaggagtctgaggtgggagaatcacttgagcccaggaggtggaggtgcagtgagctgagatcatgccactgtgctccagcctgggtgacggagtcagaccttgtcttaaataaataaataaataagtaaattcccttgtagaactataattgttttatgatacagaatattaatcactgcattaaatttggatattattataacgatatttagtaaaaaggacaaacttgaatttctgttcatcccgtcacacctctcgattagagctaggtgagttacatgtagttataaactaaagggactagaccccaaagctatgttcactctactcttcacttttaatcacatatatattttcttttcttttttttttttcgagacagggtctcactgcaacacccaggccggagtgcagtggtgcaatcacgggtcacagcagcttccatctctggggctcaaacaattctcccacctcagcctcccgagtagctgggactacaggcatgtgctaccacgcctggataatttttctattttttatagggactgggtctcactatgttgcccaggctgatctcaaacacctgggctcaagcaatcctcttgccttggcctccaaaagtgttgggattacaggcatgagccaccgtgcccagcccacatatgtattttcttctctctgggaaactagccttcgttttctccaattattgacttatttctttttcacccaggctttgtgttaagctcctggatctctatgaaaccgctgctgatacttctattagcttctgttaaaagaaatgaaaaacttcaccttacaggtttctttcagcatctctaaaagtctctgttgttaatatagtattgagacttatccccaccatagtcatttgcataaaattattatactgtatataaaagtttaagatgtaactttaaatgaacatgaattataggtatggataattgcattaattttggaaatttgtgttgaattttcttctctaagtggatatctcttagtgctgctcaacagttagcccattttatctcttcatttatgttggccatttttcatttatatcttctgaaaaaaattcatgtatatgttctgaaaaaataacacactgtatacaattaattgtatttgcccaattttttagaatatttgtttatatgtatacttacaggcttaaaaaaatcattcacatggtccaaagtgactgatgtttaaaagtgacagctatatgagggaaaacgtatatggacagatatatgtcatataatcatgccatacacacacacacacacacacacacacacacgtgggtgtgaatgaatgccatcttctaagatctgtacatttgaccactattaatctgtggttcttgaaaattaatgagattaattcataaaccaagtgatttttgaagcctgcagtctggcgagtcaggttggttctgttcctttagatagcttaactgagtacaaaatttggggtatagcatttcagaagatcctgctgtttctaccattagttttgaatgtttattgtaaagatacttttcaactctaatgggagagacagcaggattctcccaaaaattcaagtaaaaatctgcacgaggaaaagaagtctcctgagatggattgaattcttctgaagagaaaaatatataatttactaccacc

SEQ ID NO: 874 - DNA, 1989 bp, Homo sapiens
ctcttattacactatagttattagttgttgatttatctctagcatctctccctcttcgagcacaaatcctgcattttgtttatcttaaagtgtttgttacttgcaggtgtttgggagacttactaagtaatctgcgtttgttgaattaattccatttcttcatcaggcataagagaaatatatgtattaaatgaaatcagaaaagattacattaagtttaattccacagacaagcaaaactaaattgataaagacggtagactgtagaaggggaaaaagagaagaaagttaaataaactcaaatatagttaggtaaagaatatagttttaaaataaaaaatgaaatacaatattgttcctagggttcaaaaatgaattaagacctaatagagtacagaattctagcataataacagtataaactaaacaaataaaatgatgccaactatatcgtaatgcagtatgtccctactaaaattaaatatgctgtaactctgaaaaattggccatttttcatatggctgtgtcaaacagcagcatagacaaatcaccaaataagtattccacagttaaataaatgtgtatcccgaatctaactcaaattatgtgcttgggtcttgtatgttacttccaaatacaacctgcgacttcattgatttttcagacaattcacaggtttcactgaacttattcttttgcaccaattttctggcatttgaaaggctgtattcataagtttagctagaaaatatttataagccctatggtgccaggcactggcaaatgtcctcccctggacatgtactgaagggaacaagccacacaactcctttccctcccacataatccctatgattcactggaattggatgaccttcctgggaactctttactgtggcctctgtgggtgccaaaagcccaagaaagcttgctgagttgttctcattcaaatactgcgcttgctgggttcttattcaggcctctttagacacacttccttcttgctcagcaaaactgctaattggcacagaaaatatcctagctttgtccattttctatagaagttgaaaatgcttctacctgactgtgctgacagaattatattttcaatggtatgaatactccagacatttcaatgacaactttgggaacaaaataatacatataatagagttggttggtcttaaacagcctcatgcctcagtataagtgaccagaagcaaaaatcctccaaaattaggggctaagacatgagcgtttgggatataatcatttacatttgacaaaggctgcacatagtgcctttctgtttctgtgatttttaccttaattggttcattttcactattatacatttaatctgtttgtcactagtaataaataagcagggctgttgtgattggttgccaataattatttttccatcagctcaagaaagcatgttgcaatgccaggagtaaagaaaattctccttgtatttgtcattggccaggtgcccaagtctcatatatgtcttggtgagggtgctgtggggagaccctttaattcatatttttcggtcctgcctccttctcacggacttgtgtagagggaaaaaagagctataattacttgtaagagcacttggatcaggtgacaaaattattgaaaaccttttaagccatgattagccatttgaatgtttacttatgtccacttccaagaactaccttaaattatttgcatatgtttgtatgtatgcaacttgtttgaatttatggagatgtataaaggttttgttgagtcttcagaagacagaggataatgatgctctttagctgtgatattttatgctcgtcagatatattgatacatactgcattcagaaatatcaggagattattaatattttgccttgtatttctaattgcatattgttaggttttgggctattcactgacaagattgtaattcatgacatcattgtccttgtgtttaaaagatcatgcc

SEQ ID NO: 875 - DNA, 2989 bp, Homo sapiens
tataaagcgttatggagataaataaatcttggaaaaggggataaggaatgctggcgagaggttgcaatgtaaaattggtgttcagggaaggtctcactaagaagacagaattttgagcaaagacttaaaagaggcaggaaagctggtggcaatctgggtggaaagtgaggcaagagtgtagttatcatgttcaatatcagtatgtcattgaagaacaagtaaactagtgtgaaggaacagggagaagagagggaaagaatgataggagaggggagcaaattaaaaacaggggccatgccaggcccctgtataagtgaacatacaaatatatatatatttatttatatataaatcaaaaaataaaaacaggagccagattatacaggactttgtaagccattgactctgaataaagaatttgggcagagaactgacaagatctgacttatttttctaaaggttcactctggttgctgggctgagcatagactttgggggaactcttattacactatagttattagttgttgatttatctctagcatctctccctcttcgagcacaaatcctgcattttgtttatcttaaagtgtttgttacttgcaggtgtttgggagacttactaagtaatctgcgtttgttgaattaattccatttcttcatcaggcataagagaaatatatgtattaaatgaaatcagaaaagattacattaagtttaattccacagacaagcaaaactaaattgataaagacggtagactgtagaaggggaaaaagagaagaaagttaaataaactcaaatatagttaggtaaagaatatagttttaaaataaaaaatgaaatacaatattgttcctagggttcaaaaatgaattaagacctaatagagtacagaattctagcataataacagtataaactaaacaaataaaatgatgccaactatatcgtaatgcagtatgtccctactaaaattaaatatgctgtaactctgaaaaattggccatttttcatatggctgtgtcaaacagcagcatagacaaatcaccaaataagtattccacagttaaataaatgtgtatcccgaatctaactcaaattatgtgcttgggtcttgtatgttacttccaaatacaacctgcgacttcattgatttttcagacaattcacaggtttcactgaacttattcttttgcaccaattttctggcatttgaaaggctgtattcataagtttagctagaaaatatttataagccctatggtgccaggcactggcaaatgtcctcccctggacatgtactgaagggaacaagccacacaactcctttccctcccacataatccctatgattcactggaattggatgaccttcctgggaactctttactgtggcctctgtgggtgccaaaagcccaagaaagcttgctgagttgttctcattcaaatactgcgcttgctgggttcttattcaggcctctttagacacacttccttcttgctcagcaaaactgctaattggcacagaaaatatcctagctttgtccattttctatagaagttgaaaatgcttctacctgactgtgctgacagaattatattttcaatggtatgaatactccagacatttcaatgacaactttgggaacaaaataatacatataatagagttggttggtcttaaacagcctcatgcctcagtataagtgaccagaagcaaaaatcctccaaaattaggggctaagacatgagcgtttgggatataatcatttacatttgacaaaggctgcacatagtgcctttctgtttctgtgatttttaccttaattggttcattttcactattatacatttaatctgtttgtcactagtaataaataagcagggctgttgtgattggttgccaataattatttttccatcagctcaagaaagcatgttgcaatgccaggagtaaagaaaattctccttgtatttgtcattggccaggtgcccaagtctcatatatgtcttggtgagggtgctgtggggagaccctttaattcatatttttcggtcctgcctccttctcacggacttgtgtagagggaaaaaagagctataattacttgtaagagcacttggatcaggtgacaaaattattgaaaaccttttaagccatgattagccatttgaatgtttacttatgtccacttccaagaactaccttaaattatttgcatatgtttgtatgtatgcaacttgtttgaatttatggagatgtataaaggttttgttgagtcttcagaagacagaggataatgatgctctttagctgtgatattttatgctcgtcagatatattgatacatactgcattcagaaatatcaggagattattaatattttgccttgtatttctaattgcatattgttaggttttgggctattcactgacaagattgtaattcatgacatcattgtccttgtgtttaaaagatcatgccaacacaatgactaaccaggtagatggttatatacggaaaaatccagtcattggtattcatttctgtactccatgtaaaagaagttcatttatgctgtcctgttttcagtgctagaagttatttgattccatgaaattctatgtgctcacaatatgcccggaactgtggtataaatacttgaatggacaaaaaagaagtctcccagagaacttttgtttagatcctgtttgaattgtgattcctaattcttgccaagttgtttgttgaaattaacttttaaagaacagtttcaaagggtaatagtttattctctccccaacttcccccaaattaaagaaccattaatttgtgaagcaaaattaaaaacaattttcaataacacagtgagtcaaatggatgggtgcttgagtaggaaaaaagtgccagataaaatagaattgacagttctagaaataaacccaaaatacacatgggaatttagtgtgtggcagatccattat

SEQ ID NO: 876 - DNA, 1355 bp, Homo sapiens
aaaaatctattatctacagtttagtttgaaattttatttaatattttatcttacctcgttgaagaaacaacctaactactaatgttttcttttaaggtaagtagcagggtttggggcattgtgtcacctattgtataagttaaattttccaaagaaaagggatgcaaaaagtgttatcacagatattcatccttgtatttaactaaggatattacgttacaaaggcatcagtattttattgtactgaatttctttgacataagcacctaagattcatgaagcatattctatttggtcacttttgttaaagtactttctgcaaagcaaatttaatatccaacaccatttatctcattagtataaatagtataaatatttgttttcaaattctttaagaaggtactctaaacacaatcatttgaaaaaatatatagattgaatatctctaaaagcaagggtattcatatgtcaccatttttctaggacaatcctggatataaacctgttgcctagtctatatactcatgttatctttatcaaaaatgtcctgggttgggtagaaaattatatggcaaccctagtaatagccaaagagcaatgagaactcaaaggtttcacaatttctgttctttggttccttcactgactcaaatatgcagattgaattaaataccctttcaagatatttatgtaattataaaattctgtgattcttcattctaatcaaagtgtaactggatcattcagctaacactaatttagaaaatctgacttagttttcagactgaacttgtaacattgtcttaaaactcattgaaaagggaaggcatataacttttatttaatataagctagtatttaaaatacatacacattttttaaatttgtgaatccttaaaaggatttttgcattgcctcaaagtgggatttaagagaaaaatcccacattatcaaaataaagccatgaaagcaattatttgtaggattagatgaactcctttttggaataagaaattaacaaaaggaaagagattcaaaaagacaaaatggtatcctgcaagaaaaaggtacatttcattagtattaatttgttaaaacttgatgctttccataataaattaccacaactctcaatccagtattaagaaggagaaatactaaagttgtacttttacgtagtaaagctctacagaaggaattacaataaaacctgtagattacatatttatatgttcacatacaatattgttcataaacattctctatgttttctgcatagtggtccaaactcttttttttttttttttttttttgtaaagagctgtttctacagtgctgactttaattaacgattt

SEQ ID NO: 877 - DNA, 2355 bp, Homo sapiens
ttttcttagatctttgtcaaataagccatttaatgttttcatgtgtcaatttcaccatctttccaagagccacttactcactcaggcactaacacaggcttagcaaagctccactgtgaaacacgaacgagtgattggtgtaatctggactgcaatgcaaaactcacttgttctgatgtaaaggatatcttttatatccagagattgtgatttagtgacaacagtcacctgattattcacaaaaagttatcaaatcacttaccttgaataggtaaggtattatttaattcttgcagctagccagtaaattttcagatgatcaaacatttcttctagggttaattattattacttacttcaagaaaaagtgctgtgtaggagaataatgtcaacctatataagaatctattatcagcatggcacatgtatacatatgtaactaacctgcacattgtgcacatgtaccctaaaacttaaagtataataataataaattttaaaaaaatctattatctacagtttagtttgaaattttatttaatattttatcttacctcgttgaagaaacaacctaactactaatgttttcttttaaggtaagtagcagggtttggggcattgtgtcacctattgtataagttaaattttccaaagaaaagggatgcaaaaagtgttatcacagatattcatccttgtatttaactaaggatattacgttacaaaggcatcagtattttattgtactgaatttctttgacataagcacctaagattcatgaagcatattctatttggtcacttttgttaaagtactttctgcaaagcaaatttaatatccaacaccatttatctcattagtataaatagtataaatatttgttttcaaattctttaagaaggtactctaaacacaatcatttgaaaaaatatatagattgaatatctctaaaagcaagggtattcatatgtcaccatttttctaggacaatcctggatataaacctgttgcctagtctatatactcatgttatctttatcaaaaatgtcctgggttgggtagaaaattatatggcaaccctagtaatagccaaagagcaatgagaactcaaaggtttcacaatttctgttctttggttccttcactgactcaaatatgcagattgaattaaataccctttcaagatatttatgtaattataaaattctgtgattcttcattctaatcaaagtgtaactggatcattcagctaacactaatttagaaaatctgacttagttttcagactgaacttgtaacattgtcttaaaactcattgaaaagggaaggcatataacttttatttaatataagctagtatttaaaatacatacacattttttaaatttgtgaatccttaaaaggatttttgcattgcctcaaagtgggatttaagagaaaaatcccacattatcaaaataaagccatgaaagcaattatttgtaggattagatgaactcctttttggaataagaaattaacaaaaggaaagagattcaaaaagacaaaatggtatcctgcaagaaaaaggtacatttcattagtattaatttgttaaaacttgatgctttccataataaattaccacaactctcaatccagtattaagaaggagaaatactaaagttgtacttttacgtagtaaagctctacagaaggaattacaataaaacctgtagattacatatttatatgttcacatacaatattgttcataaacattctctatgttttctgcatagtggtccaaactcttttttttttttttttttttttgtaaagagctgtttctacagtgctgactttaattaacgattttagaatgtgtatctatcttctttattaaaaaaaaaacagagctactaagctatttcctttattgggtcacctttaggacttattatttgaagtacttcttagaagctgctatgccaaagtgcctagaattttaactgtttctcaaacagatctaaaactggatgtcaaacccttcataaatagagtatgtgttagggtgtgtaatatccacgtatatccaacttctaacttgtaaaatatatttaagtcagttacctctgacttaaatatatagattatatatataatttaaatatattatatataatttaaatatattataaaccatataatgctctgctcactgttaataaactaaatatttttgtaaaaaacagagaccaaccactttgggaaaacctgttcacaaaatataggttaaagtaatttgctctaaggatactacattaaggccaaacctgctaaggtatttgatatgaatttattcacctaatttttaa

SEQ ID NO: 878 - DNA, 2561 bp, Homo sapiens
aataactttagtgatcataatgtccttaaatgtaaaatagttaagtttaaaaaatttcaaaataccttttcctattgtaaatgaattaacaatagttattagattccccagtgttttttgtcaacacgcttttttctatgggatttagaaaatacaattagtgatatttttcctaatccagaataaattttctttttgctttgtatgcattctagccagatgagtgggcaattattttgaaggttgacaatctgctccaagtcttagaaagcaggcaagtccccaaagaaagaaggaaaagacttgagatctcagcttagagttacggaaattacatggactttaatgataaagaaacacttacagaaaaaaaaaaataaacctggctctgctatttattgattttgtaatcttgggcaaattgtttttggctttgcttccgtttctcaattttttaaatgatgacagtggaggggagggggagatcaccttccagagatgtcctggcaattaaatgacttatttttatattaaacatctgattttgtgcctgacttttcttcttcacatgcttgctttcaaacttactgaccttctttttccccctgaaacaagtaaaggaataaaaaaggtttccctgacttctaaaagttatgaaatctgtggtgccacagacacatcctgtttctgtgcagcatgagttattcagcattattagtagacacattgctgcttccaggcacaggagcatttctgaatgtggttcaatagaagtgcttttagtaaaacacttcattaattccagatactccaccacagcatagtgttatcactgaattctgttgacctagttaagccatctctaattttattcctgaaagtctataattaggatggtctgaaatagcctgaaaatattcagcgccagcacttgtctcaaaaggcaagtagcaaaaccttcaataaggccttttctgagatttgttcttttatgtcactggatttgacaatctttcagcatggagagagagtgggggaaaggggagggtagattaggaggaaaccagagagaagagggaaagggaggggaggagaagaggcagaaataataatctgtcagttttgtgagtttcatcaaattgttgaccaggtcattactcaaattcattactagatatctgaaatccgtgagtaaaggttgagagaatcatccctaataaacattctcgtttaaaaaattatttatttttatttttaattttgtgggtacacagtaggtgtatatatttcaacgaacgaacagatctttacatcaacacggcttctgcttttgtgattggggcttttaagaacacaataataccacttttcagaaaaagctagacatgaatgtaacagtattttccaactcaagtgtccctcttatcccccttcctccagcaaaagagcttcagaaacgcaacacctatcaagtagttcctcagaaatgccagattgctgggattttagagccctacttttttttcctttttgacatttagacagattgagtttgagagaggaagtgactctgagtccagactgccccgcaccactgtcagaggaaataactgaagtaaaatgaagtgataatatactgtagaatatttaacagagagaaaggcagaggaaaatggcaatctgggaatatacagcgaatccccaaaatagacacaggctccagtgccagaacaaatgccaagtacagtagatcataaaatggtaaaacgaccttgccctgtgggctctgtgttgacacaggaaaaatggctccccaatagccggcatagccgggtctttattcgcagtttctgctatcgtttgtcagggactctgccaactttcctctctactcttttctgtatattcatcagtgagagagctggtaagtaaccaccttaatgactgcagcatgttgcagtaggattaatgacagataaagtacaactctgggctcttatgtcacgttgtgaatgaaatcagagggttctggggaggatattagcaaagctccttccattttgtagaagactcaaggtgactagggacatttagatttccctcccaaggaaagctatgataaatagagcggtgaaggaaaaatacacccccttctgtgcgcttaatgagtgacctgccaccttctgggaaatgggataagaatgctgacgtggtgtcttagcttgatgcaaaggttgaaaaattgacaaaacaaaccttcgtcatttgctgaaagccacagagaggaatgatgcttggagcagggaaaacatcttttaaaagaatactgctacctcatattcatggtagcattggagagatttacattcgaagaaggcctgtttgccttttttactgtgtggatagaagagagtagtcgtttttcctcacattccggcaaaatttcgtttaatctttatactaaggctttcgggtacgcaggtgactgctggccagccattgaggctgagatcatcatcaacattaagaattaagaagacttcatcctagcttgcttgctt

SEQ ID NO: 879 - DNA, 3561 bp, Homo sapiens
aaagagcccaagaagaggctcaaatatacaacctctgctatgtaagtctcagggaaggacgattcctgttgagttaaggagtaactcataagaaagcaggagaattgcagcgcctccaacaactctgcttcttccaagaagataactgaattattggcagttcttctggaaaataaccccacattggaaggatgagaagcgaccctgaatttttcataaaaactctgccaaacttgggagaaaaaaaaaaaaggaaacactgctttggaaattttattgatttaaaaatacatatgaagagacattaaaaataaggttcatacttgtcatgaattgaacaaaggtgatcctatgtactttcatggcaatggatttttaaaacatacagaaactatttttagttttatattttagagctagagctgtagtgttctaaaacctaataccaaattttggctaatcttttcatatgtcctttttttattcagtgcttagaaataaataactttagtgatcataatgtccttaaatgtaaaatagttaagtttaaaaaatttcaaaataccttttcctattgtaaatgaattaacaatagttattagattccccagtgttttttgtcaacacgcttttttctatgggatttagaaaatacaattagtgatatttttcctaatccagaataaattttctttttgctttgtatgcattctagccagatgagtgggcaattattttgaaggttgacaatctgctccaagtcttagaaagcaggcaagtccccaaagaaagaaggaaaagacttgagatctcagcttagagttacggaaattacatggactttaatgataaagaaacacttacagaaaaaaaaaaataaacctggctctgctatttattgattttgtaatcttgggcaaattgtttttggctttgcttccgtttctcaattttttaaatgatgacagtggaggggagggggagatcaccttccagagatgtcctggcaattaaatgacttatttttatattaaacatctgattttgtgcctgacttttcttcttcacatgcttgctttcaaacttactgaccttctttttccccctgaaacaagtaaaggaataaaaaaggtttccctgacttctaaaagttatgaaatctgtggtgccacagacacatcctgtttctgtgcagcatgagttattcagcattattagtagacacattgctgcttccaggcacaggagcatttctgaatgtggttcaatagaagtgcttttagtaaaacacttcattaattccagatactccaccacagcatagtgttatcactgaattctgttgacctagttaagccatctctaattttattcctgaaagtctataattaggatggtctgaaatagcctgaaaatattcagcgccagcacttgtctcaaaaggcaagtagcaaaaccttcaataaggccttttctgagatttgttcttttatgtcactggatttgacaatctttcagcatggagagagagtgggggaaaggggagggtagattaggaggaaaccagagagaagagggaaagggaggggaggagaagaggcagaaataataatctgtcagttttgtgagtttcatcaaattgttgaccaggtcattactcaaattcattactagatatctgaaatccgtgagtaaaggttgagagaatcatccctaataaacattctcgtttaaaaaattatttatttttatttttaattttgtgggtacacagtaggtgtatatatttcaacgaacgaacagatctttacatcaacacggcttctgcttttgtgattggggcttttaagaacacaataataccacttttcagaaaaagctagacatgaatgtaacagtattttccaactcaagtgtccctcttatcccccttcctccagcaaaagagcttcagaaacgcaacacctatcaagtagttcctcagaaatgccagattgctgggattttagagccctacttttttttcctttttgacatttagacagattgagtttgagagaggaagtgactctgagtccagactgccccgcaccactgtcagaggaaataactgaagtaaaatgaagtgataatatactgtagaatatttaacagagagaaaggcagaggaaaatggcaatctgggaatatacagcgaatccccaaaatagacacaggctccagtgccagaacaaatgccaagtacagtagatcataaaatggtaaaacgaccttgccctgtgggctctgtgttgacacaggaaaaatggctccccaatagccggcatagccgggtctttattcgcagtttctgctatcgtttgtcagggactctgccaactttcctctctactcttttctgtatattcatcagtgagagagctggtaagtaaccaccttaatgactgcagcatgttgcagtaggattaatgacagataaagtacaactctgggctcttatgtcacgttgtgaatgaaatcagagggttctggggaggatattagcaaagctccttccattttgtagaagactcaaggtgactagggacatttagatttccctcccaaggaaagctatgataaatagagcggtgaaggaaaaatacacccccttctgtgcgcttaatgagtgacctgccaccttctgggaaatgggataagaatgctgacgtggtgtcttagcttgatgcaaaggttgaaaaattgacaaaacaaaccttcgtcatttgctgaaagccacagagaggaatgatgcttggagcagggaaaacatcttttaaaagaatactgctacctcatattcatggtagcattggagagatttacattcgaagaaggcctgtttgccttttttactgtgtggatagaagagagtagtcgtttttcctcacattccggcaaaatttcgtttaatctttatactaaggctttcgggtacgcaggtgactgctggccagccattgaggctgagatcatcatcaacattaagaattaagaagacttcatcctagcttgcttgctttctttttcttttttcttatcttttttcctttccttcttttcttccttccattctttctatcttttttttttcttggtttctttcaacttaaagacaatctttaacatcttgacaaaaggaaaaacaaaaagtaaatcagcttacagagaaaaggtttaggtggagaaataaataggaaaaaatatacaaagaaaagccaacagaaatctggtcaggacaattccctgggatgagtgttaggagacggtatgcatttagaaatacatgtataaactatggaaagtttcccactaaaaaaatgattacttctggttactaaatgcagaaaaacgaagtgatttttaaacgctggctgaagtttctacccacgtgtgaatctatacagcttcaataaaaagcggttgtcatttgtcaaagataaagttcctgtgatttggggtagaaattaaaactggaaaaatggttgtccagagtttctattcgaattgtatgtagttttt

SEQ ID NO: 880 - DNA, 2681 bp, Homo sapiens
actgattaaaaaataaaataaaatgaacttttagtaaaggttcagacatagttatgccatacttcttccaggtttatatatttaaaaatgacagatcaatatcttctgactcccaggaaggtaatgactcaaccatatgacaccatttcctttgcttcactataagaatgacccttccagcagttaaatctgtccaaaagtagaaagagctatgagttccatgttcatacagagattagagaaccaattttaatagataattgagggtaatttatgcactggactggtggctaacctgaagtacatttctgagatttggggccttaacaatctaagaatgcaaaggagattaagaaccagtggagatagttcctaaaaaagaattagattaccattgggctttgagtccagaaggaaggattaattaagaatactggctttggagttgctagagttgaaaaagtgttaataataagttgatcaaatcaagaatagtttctaaatcaaggaagaaggctggaggttaaaatgacatttaaggtttttaaatgcaataattcaattagcaagtacaaaaccaaaaatacggctagtaaaaagacacaatgacctgcaaagctagcataatgtacacttctgtgctgctgattacattataactccataagttaagatgtttgattagtataataattaaagactgcaaaactggaattaattgcacttagataccttgcctaatgccaatatatccagtaagctttttaactatgttgagatttatgagaccaaaactactttattcactatgccatactgccttaatgaatagtgttgtctacgtctcaagtgatataaatgttgtacaaagcaggtcctgttgtttgttagttaaataaagtacttcttaattataatgctggggaaacaatgagtggcttttagcctaagactgtgtttcccatgttctggtaaacaatccaggtgatgatttgatgattcggttgttgacagaggcaaagccacatctgtcttatcactattttgagacccattctccaagctactaaaatgtacctgacttcaacgcaatctgacttttatttttaactttcacatatatttgttattttgcattctaaaaactgtaacatcctttttctatcttcatctgcctgaaacttacccattttctccccattcttttcatgtcatttgccacagctgatttgaaagcattctccttcattgcctgccagctggaactgtccttcaatgtctaacccttcagatcccttcttctttataaaacacattgcagagtataattaaagtgggtgctgttctgctgtatgttgtctaacattttactttgtgcctgagagagctatttattttagcgggtacagaatccttgggaattggtagctcccaacgagggtcagtaggcagcatgaagaacagatgacagcctgcaatacctccttcgcatttctgtaaagagatttgacatttacaaagtactgcatgttgcctttccccgcaaatctctgaagacttcatgaaaataaaaggcttaatgatttaaatgattttaaaagcatttgatatgcttttaaaagtgaaagataagcattcttgattaaactgaaggattgtagaaatggtggaaacatgtataagaatatccaaatgcaggaataatgcatatcagagaatccttgcttagaaattgcaattccaatgaaggacctgagaattctgttcagggcaggtctctgtgtcctgaagaatcaatatacctctctctacagtactcttaaatcaggtagcactgaaagtatctgagagttcgttgttcttccatttctcaaatttgaaagcaaactgaaatccacccttacatgagagaaataaacttcctttaatgatagagaacactttaaactaaagattcaaatgcatcccaaagttaatcgacccttgggtcttttaaattgcatataaaaatctgtctgcattaataaaaaatgacttgactttattaataatgcttatttttaactttctcttctaagcacacatcaccaaaaatgaaatttttctgtaatattttcttcatgcagtatttaggaaagtgctcaggtaaactaatctcttttatagtaaataatttaagttgggaaaaagttaataaataaaaagtaaaattagctttcgtgacattttaaagtaaaacccaaggacaattgtgatataaattaagtcccatttatccttcaaggtaatatagagagcatggaaaagcgtctaaaataaggtagtgctgaatttggtaggacaagggggaaatgaccataagttcatgagtgggagaaatagccatttcgaaggcatatttattcagggagactattgccaaaaagactttaagagaaggaatggtggttccttgactctgcttccattctcttactccctgccctagctagtctccatctaaaaaactcactacaattaggggccaggaaaaattttaaaatgtgggcaatcttttaaaactggctcttgataataaaacctcataagtcacattttctatttaaattgttacattctttagaatgtcatgcaatttctgaattgtaatagaatattgcgaaatatatcctacgaaaaag

SEQ ID NO: 881 - DNA, 3681 bp, Homo sapiens
ttctttgtatattgtactctgtcagatagatgacaatttttttcataatttcttttatttattaatttatttagagtaattttattatataatttaaaaataccttattatgattttttcattttaaagtttccgagttttctattttgtattgcctctttatccatgaattacttcagaatacatttcttaatttcacagtatttaagtttttgcaaacttttcattgttccatagtgtttacatttttaaatggcagtcttaatcttctgcatttattttaaaactagtaaatcaggggttctcaaactttggtgtacattaaaatgccatagaatattttctaaagtaccaattgctggacctgacctctcaaatttctgtttcagtcactgtgctgggcagactattgagatttttaactagttcttaagtgatgttgaccctactggtatagggacaagactttgaaaccactttcaaaacatagtttgaaaaatactgattaaaaaataaaataaaatgaacttttagtaaaggttcagacatagttatgccatacttcttccaggtttatatatttaaaaatgacagatcaatatcttctgactcccaggaaggtaatgactcaaccatatgacaccatttcctttgcttcactataagaatgacccttccagcagttaaatctgtccaaaagtagaaagagctatgagttccatgttcatacagagattagagaaccaattttaatagataattgagggtaatttatgcactggactggtggctaacctgaagtacatttctgagatttggggccttaacaatctaagaatgcaaaggagattaagaaccagtggagatagttcctaaaaaagaattagattaccattgggctttgagtccagaaggaaggattaattaagaatactggctttggagttgctagagttgaaaaagtgttaataataagttgatcaaatcaagaatagtttctaaatcaaggaagaaggctggaggttaaaatgacatttaaggtttttaaatgcaataattcaattagcaagtacaaaaccaaaaatacggctagtaaaaagacacaatgacctgcaaagctagcataatgtacacttctgtgctgctgattacattataactccataagttaagatgtttgattagtataataattaaagactgcaaaactggaattaattgcacttagataccttgcctaatgccaatatatccagtaagctttttaactatgttgagatttatgagaccaaaactactttattcactatgccatactgccttaatgaatagtgttgtctacgtctcaagtgatataaatgttgtacaaagcaggtcctgttgtttgttagttaaataaagtacttcttaattataatgctggggaaacaatgagtggcttttagcctaagactgtgtttcccatgttctggtaaacaatccaggtgatgatttgatgattcggttgttgacagaggcaaagccacatctgtcttatcactattttgagacccattctccaagctactaaaatgtacctgacttcaacgcaatctgacttttatttttaactttcacatatatttgttattttgcattctaaaaactgtaacatcctttttctatcttcatctgcctgaaacttacccattttctccccattcttttcatgtcatttgccacagctgatttgaaagcattctccttcattgcctgccagctggaactgtccttcaatgtctaacccttcagatcccttcttctttataaaacacattgcagagtataattaaagtgggtgctgttctgctgtatgttgtctaacattttactttgtgcctgagagagctatttattttagcgggtacagaatccttgggaattggtagctcccaacgagggtcagtaggcagcatgaagaacagatgacagcctgcaatacctccttcgcatttctgtaaagagatttgacatttacaaagtactgcatgttgcctttccccgcaaatctctgaagacttcatgaaaataaaaggcttaatgatttaaatgattttaaaagcatttgatatgcttttaaaagtgaaagataagcattcttgattaaactgaaggattgtagaaatggtggaaacatgtataagaatatccaaatgcaggaataatgcatatcagagaatccttgcttagaaattgcaattccaatgaaggacctgagaattctgttcagggcaggtctctgtgtcctgaagaatcaatatacctctctctacagtactcttaaatcaggtagcactgaaagtatctgagagttcgttgttcttccatttctcaaatttgaaagcaaactgaaatccacccttacatgagagaaataaacttcctttaatgatagagaacactttaaactaaagattcaaatgcatcccaaagttaatcgacccttgggtcttttaaattgcatataaaaatctgtctgcattaataaaaaatgacttgactttattaataatgcttatttttaactttctcttctaagcacacatcaccaaaaatgaaatttttctgtaatattttcttcatgcagtatttaggaaagtgctcaggtaaactaatctcttttatagtaaataatttaagttgggaaaaagttaataaataaaaagtaaaattagctttcgtgacattttaaagtaaaacccaaggacaattgtgatataaattaagtcccatttatccttcaaggtaatatagagagcatggaaaagcgtctaaaataaggtagtgctgaatttggtaggacaagggggaaatgaccataagttcatgagtgggagaaatagccatttcgaaggcatatttattcagggagactattgccaaaaagactttaagagaaggaatggtggttccttgactctgcttccattctcttactccctgccctagctagtctccatctaaaaaactcactacaattaggggccaggaaaaattttaaaatgtgggcaatcttttaaaactggctcttgataataaaacctcataagtcacattttctatttaaattgttacattctttagaatgtcatgcaatttctgaattgtaatagaatattgcgaaatatatcctacgaaaaagaaactatataaactagacaaataaattagaataaaatagaatgaacactgctcaattaagaaacagactgctgctataccttaggtgctttctgtatatccctgtatgattgtatcatactccctcccctcaacattgacctgcttttcatttttagttttattgtgtaaaaaatatattacgtagcttgtttctgaattttatgctagtagactcatgccgtatatattttgtgacttttttcgtgtttttatattcattcatgttgatgcttgtatttgtaatttatttttactactgtgtatcattgaatgacataccacaatttttatacattgtatcattaacacatatttgggatgtttccagtttctaaaatccattttttccaatcaaattttgttttgtaagatatgtgagcctctcaaaaagctgaataaataatacaatatacccttcacctaaaataactatgtatttaacatttttatatatttgca

SEQ ID NO: 882 - DNA, 1518 bp, Homo sapiens
cactttaaatgaatttgaaccatggggaagatgcaaatggacttttaaaaagcactatgggctggcgcagtggctcacacctgtaatcccagcactttgggaggccaaggcaggcagatcgcctgaggtcaggagttcgagaccaatctagccaacatggtgaaacctgtccctactaaaaatacgaaagttagctgggtgtggtggtgggcacctgtaatcccagctactcaggagactgaggcaggagaatcacttggacccaggaggcagaggttgcagtgaaccgagatcgcaccattgcactccagcctgggtgacagagcgagactccatctcaaaaaataaataaatatataaaaataaaaataaaaatgactttgtatcaagggctgccccttgtatattcattgtatctgttaaccctcaaaggaactttgggaagcgggaatcctatgctcatgttgcagactagaaaaccgaagactgatgaggtgaagtatcttgaaagggctgtacatttagacaacagcagagtcagagttttcattcaaacatatccatctccaaagcccaagctattttgtttaagctgtctcatgctgcttgccaggcagaggcaacctctcatctagttagactgatcaaatcaaccccgcagatcagcaaaggtaacttccctgaccaaaccacacttccagggatggtcaagctgtggctcagagtcattctgctgggaactcaaatcacacagcttaaaagaggacagcagagacagaaccagatatcattttatcacatccataccctgtccactgtgtgaggtttcttttctcaaaaaccatcaatatactcggacattcaaattaccttctaaagggaaaatacattaaaaggcagccaaatgacaaaagtcactaggcaatcctagtgactcctgctaatgatttcccctcttttatcatttaaaataacactcggcattagaaccaggctcagtcgtcactgttacttgtcataatgcaccttttctgtcatctacattgtcttgttcaaaaaagggaaatgccagttttgacaactgatgaatgccacagtgagcagctaagagtctctttaagttgtttttggaaatacagaggaattcatccaaaccccgtctctcccctcacgcctccacccacctccactctttgcccactctgtgaaatcggtcagagcagctgacttttgagtcttcagctttgagttaaatatactctaaacctgactctaaacctctaggacttcaaacatggccccaagagacaaagacatttggtagcactccattagttcaaaatcaggaacagtagtaacaaacacaaaacatgctcatactatttcctttgctgtgcttacagggagacccagccccattgtcacctcccctgtgaagctttgcttaactttcccaggccttcctcccattgcctatactacagctgttcacgcctacactacagccattgtcatcat

SEQ ID NO: 883 - DNA, 2518 bp, Homo sapiens
ctttttttttttttttttgagagagagagaggggtctggctctgtcatctcaggctaaagtacagtgacaggatcatagctcactgcagcctcaaacgcctgggctcaagcaatcctccagcctcattctcccaagtacctgtaggcacatgccaccatgcctggctaatttcttaagttttacagacagaatcttgctatggttcccaggctggtcttaaactcctggcctcaagcagtcctcccacctcagcctcccaaaatgctgggattataggccacacctgggagatttcacaacctaaatgctagagtccactatggaccaattaaatcagaatctctggggataagccccacacacggtaatcttttaaactgcccccacgagattcaaatgtggagccagggctgacaactactgacctttgtttcatagtaaaaggtttcagcatcatgcagctattcttccccgaataactttctctatctaggtcttccactttaaatgaatttgaaccatggggaagatgcaaatggacttttaaaaagcactatgggctggcgcagtggctcacacctgtaatcccagcactttgggaggccaaggcaggcagatcgcctgaggtcaggagttcgagaccaatctagccaacatggtgaaacctgtccctactaaaaatacgaaagttagctgggtgtggtggtgggcacctgtaatcccagctactcaggagactgaggcaggagaatcacttggacccaggaggcagaggttgcagtgaaccgagatcgcaccattgcactccagcctgggtgacagagcgagactccatctcaaaaaataaataaatatataaaaataaaaataaaaatgactttgtatcaagggctgccccttgtatattcattgtatctgttaaccctcaaaggaactttgggaagcgggaatcctatgctcatgttgcagactagaaaaccgaagactgatgaggtgaagtatcttgaaagggctgtacatttagacaacagcagagtcagagttttcattcaaacatatccatctccaaagcccaagctattttgtttaagctgtctcatgctgcttgccaggcagaggcaacctctcatctagttagactgatcaaatcaaccccgcagatcagcaaaggtaacttccctgaccaaaccacacttccagggatggtcaagctgtggctcagagtcattctgctgggaactcaaatcacacagcttaaaagaggacagcagagacagaaccagatatcattttatcacatccataccctgtccactgtgtgaggtttcttttctcaaaaaccatcaatatactcggacattcaaattaccttctaaagggaaaatacattaaaaggcagccaaatgacaaaagtcactaggcaatcctagtgactcctgctaatgatttcccctcttttatcatttaaaataacactcggcattagaaccaggctcagtcgtcactgttacttgtcataatgcaccttttctgtcatctacattgtcttgttcaaaaaagggaaatgccagttttgacaactgatgaatgccacagtgagcagctaagagtctctttaagttgtttttggaaatacagaggaattcatccaaaccccgtctctcccctcacgcctccacccacctccactctttgcccactctgtgaaatcggtcagagcagctgacttttgagtcttcagctttgagttaaatatactctaaacctgactctaaacctctaggacttcaaacatggccccaagagacaaagacatttggtagcactccattagttcaaaatcaggaacagtagtaacaaacacaaaacatgctcatactatttcctttgctgtgcttacagggagacccagccccattgtcacctcccctgtgaagctttgcttaactttcccaggccttcctcccattgcctatactacagctgttcacgcctacactacagccattgtcatcatctatgattctgcctccaccacctgctagatgcatgagctcatataaatggctttacttctttaaacctcagattcctcatcaaaatagatataatgctagctctgaatccgcaggagactttgggaattaagtgaggtatgcctataaagtgtctagtaccttgtctattgttattgattagttattgatactcttgttttacgattacttaagtgtctgtgacttacctcaatcacagtgatctccttaaatagcatcttcttggtgcttaatatcatccttcttatacagtagaagcactaacatttattaaatgtctctattgaactgatggggtgagaatgcttaaatctacactataaaaagaatttttaaaaaaatttttatatttttaacatttttatgggtacatagtataaagatacattttagactccaggaaagggtgtgattattcaagatttagaaaatagaacctcctaacacttttaaagaatta

SEQ ID NO: 884 - DNA, 795 bp, Homo sapiens
tctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaaaggataacaagaatattaattttgtgacccatagttcatgaactttaaaagtgtttacagcatttaaagtttatttaacaatttaagtatttgagcactatactaattcatatggttacatttgatcaactccttcatgaagccataggctttatatctcctagctgccttttaccttcagaacaaatctggtttatacttagattgctccaaaagttatgcattttaattttatgttgaaaatgtctttcttagataatcacggtgcatatttgcagctaatactttagtatattttatattattggtaatgcttttgttagccatcctggtgctgccttcttataagagctatgtatgagaaccaactaatatatttcttttttttttttttctttttcttacctattaacccactaaaatttctaatctaaaagcaatattcaagttacattttattacagaaattggaaagcaatttgcctgggaa

SEQ ID NO: 885 - DNA, 1795 bp, Homo sapiens
agaaaaatcattgcatttttaattataaaatatattttactggtaaaacatttaaattaaactttcttgtctattgttattatcctactgcaatttattatcctctaaatttaatgacaaagaataagctaattggcacaaaatgcattcctgatgaaaacaggatgactgaaaaatcatctgaaatgtataatactaaaatgttattggtaagataaacttcattttagaaaatcagtattctagaaatcagtagtataaaatttcagaagagaggtagtcaagtggcatattgcaagacaaaatatgtttgttctcaactatctatatagtctttatagccatcaacatttgcaagagaaaaaaaattcactaagggcatgttggtataacacttttttctttctctcctcaggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaaaggataacaagaatattaattttgtgacccatagttcatgaactttaaaagtgtttacagcatttaaagtttatttaacaatttaagtatttgagcactatactaattcatatggttacatttgatcaactccttcatgaagccataggctttatatctcctagctgccttttaccttcagaacaaatctggtttatacttagattgctccaaaagttatgcattttaattttatgttgaaaatgtctttcttagataatcacggtgcatatttgcagctaatactttagtatattttatattattggtaatgcttttgttagccatcctggtgctgccttcttataagagctatgtatgagaaccaactaatatatttcttttttttttttttctttttcttacctattaacccactaaaatttctaatctaaaagcaatattcaagttacattttattacagaaattggaaagcaatttgcctgggaagcaaaatgttgatatgattcaggtgattttaacattaaatctaacttgtaacaaaaacggattatataaagataaataaattgagactattatttgcatagcaaagaaagtcaaacatgacccacacatttatgcacatataattaatttcaataaaatgtttatatttattcattttcatctctgctatgtttgcttttagagttttctctttgaaagagtctaaagttttaaaaatacctgtgtatgcaggaatcttcacattttattttgtaagatcaataatgctgctaaataaactggggctaatgtgttcaagtctcataaaaagtgtgttggaacttgaatggacattaaggaacatttaatcttatcactcatgatgatgaagaagttaagaaccagagaggttaaatgattagtgtaatcatacactaactaataacctaaggaactttaaatgcaggtttattaacttcttagctagtgttcattctata

SEQ ID NO: 886 - DNA, 956 bp, Homo sapiens
ggagttacaaatattgtttgggctgatgtttttcattagcggtagtaatttgtgtgttttattgtttttgaaggaaacatatgggacagtgctttgggattatgttgaccctacttttggtctaaatattgaattaaatttcaatgtggaaaagtaaaaatatcataaagacagtatcattcttatatgtgagggtctgtgtctacaaatttaataaaaatcaatataagaacaattatctaaatagtgtggctgaacacatggacccccaaattcttaaaacctaaatgttctttgtcattcgtattccatgataatgtatgcatcaaagacagacttggttgatttttgttcccttcaattattcactgagacctcaactttcagtcagatcagttgcttcccactcaactcttgcagattgcaaatcttccctgttgagttgcacagcaactgccactcaacctcacctgcaaaaggttagtccaacatctttttttaaaatatatttttgtggctctagaaataagcaagccagctggcagtattctaaaccaagatgctcagatcttgttgttaagtgtaacaccattgccttcctaatttttgcaactacaagagtacaataaaaagtacgttctataaggaagaagggagcttgaaatctaagcttatctctgccagttactggccatatgattttataattatctcccttccccttttttagcttgcgtttttttatttctaaggtgaagtagttaaatgagatgatcgtttggattgcttccaggtctgacattctgatgatcacatgaaataaaacctttgtgagtgcactgtgctaggtggtcttatataccactccaaggctgtttcattatgcaatttatggtgtcaatattccttatactgtattctatagtaacggtgccttctggaggacattgcagagg

SEQ ID NO: 887 - DNA, 1956 bp, Homo sapiens
gacctaacactgaaaattaaaaaccaggagacagagaagaaccacctagtatcttcccaagagctagatatttgcctcttggatgtttgctggtttttctgtgagatcccaagatgataatacattcttgtgggaactggatttaatatagacaggttttgatgtaatgttgaagaaaaacaaagctcaattaatgaggcttttcaatttgaagagtggaaacacagtgggggaaagacactggggctttgggtaactaatgaaggcacaaagaactcctggtacttttcaaggaaaacaaagtacaagagggtaagtgaatcataaaaaggagatgatgaaaaatagtagcaattgcatatttccaaacttattagatggttggctgtttaaacatttgtattaaaatttaagaaaatgctgtgtttcaaaaatatctaaatttacttgtgatatttagatgattatttaaaattataaaattctgtctttttcttgctggagttacaaatattgtttgggctgatgtttttcattagcggtagtaatttgtgtgttttattgtttttgaaggaaacatatgggacagtgctttgggattatgttgaccctacttttggtctaaatattgaattaaatttcaatgtggaaaagtaaaaatatcataaagacagtatcattcttatatgtgagggtctgtgtctacaaatttaataaaaatcaatataagaacaattatctaaatagtgtggctgaacacatggacccccaaattcttaaaacctaaatgttctttgtcattcgtattccatgataatgtatgcatcaaagacagacttggttgatttttgttcccttcaattattcactgagacctcaactttcagtcagatcagttgcttcccactcaactcttgcagattgcaaatcttccctgttgagttgcacagcaactgccactcaacctcacctgcaaaaggttagtccaacatctttttttaaaatatatttttgtggctctagaaataagcaagccagctggcagtattctaaaccaagatgctcagatcttgttgttaagtgtaacaccattgccttcctaatttttgcaactacaagagtacaataaaaagtacgttctataaggaagaagggagcttgaaatctaagcttatctctgccagttactggccatatgattttataattatctcccttccccttttttagcttgcgtttttttatttctaaggtgaagtagttaaatgagatgatcgtttggattgcttccaggtctgacattctgatgatcacatgaaataaaacctttgtgagtgcactgtgctaggtggtcttatataccactccaaggctgtttcattatgcaatttatggtgtcaatattccttatactgtattctatagtaacggtgccttctggaggacattgcagagggaggcacttacatatattaacatgtgccactcagccacattctatgccctaataaaatacttgaggaaaaagcaaaggaaaatttgaaggggtggggtctatacattttatgtagggaatctcaaattcagaatggttaagtccattgcgcaaggtcatccagtaagtaagtggcagccgtggtatttgaacatttggtagccagattcctcaagcagtgcccctttaatcaggctttaacgttatttttcactggattatgacactcatatattgtatttttcaggctcatttgcaaatagaaaaaaaagacagtcaacgcaatctagcttaagcgctccataatagttaattaattaaaaataattattagtttaaataaatgaaaggtccatataaaaattgcatcaagcttcaaatcaagacttttctctctacctctgaatcctgttcctcactatgttagttttgttctaaggcaagcatgtcccatgtggtaa

SEQ ID NO: 888 - DNA, 786 bp, Homo sapiens
ttctgggttgtcaggagaaccacatgaaatcaggcatgtaaaggtgtaggcacctctctatgcctagtacatttcatggtaactttccatgagatcactggctattataaaaagttgttaagtgattaataaaatagtaaacagacacacatacacttgtacaaatatatataagtgatatatctatacacatatcacaactgtttatctgtccacccatccgtatactaatctaaaatgccactgatagccacccatgatctttgactaacatttttttcttcatctgcttaaggcgacagtccccgggtagctgactcacagaaagtctgattcacatgtctgaggaggtcacccagccagttggcaggaggcagcccagaatgagtcagggctgaccctgcatcccccaggttgctgtcccaggcagggcatttgctgtggctgctggagcagaggtggaggaagggtgggcagagcagccaattactccatgttgacatttcaatatttgagactgtgggcagagtccctcccctgggtacttagttcctgaacagccacctacactcatcacaggccagatcccagaaaataccctccccactgcagaccgcagagcaaatcaccgccaacaggctccaagactccctggactctcctgctcagggtaactgcaggaaagtctcaagcttcagatttccacgccttgtcttctttccctccttacaacctctttcccttcagcagctgctgaagtctttgcttctctcactcccgtatgac

SEQ ID NO: 889 - DNA, 1786 bp, Homo sapiens
caaaatcacagtttgaattttcctcttttaacctgtgatgttattgctaaaatactcctggcattgtgttcattcatttggtgtttactgagcccttgttgtgtactgggctttgctgagattgtatttcctgtggttgaagcaagagcgctggcatcagagggatctcagaatcccagctctgctccttacttactgtatgtcttgaggtgggttacctcacctctctgggcctcagtttcctcatcgatcaaaggaaactaataatacttaaccctgtagttgaatacgaggattgaatgagataaaagagttggaaacaggccttggcatccagtgggaagtatagcacagtggttaggagcatgggggcttagagtaggactaacgggttagaatcctgatctgtcatttagtggctgtgtgaccttgggtgggtgcattaacctctctgagcttcagttttattatctgcaaaatggggccaacagctgctgcctttctgggttgtcaggagaaccacatgaaatcaggcatgtaaaggtgtaggcacctctctatgcctagtacatttcatggtaactttccatgagatcactggctattataaaaagttgttaagtgattaataaaatagtaaacagacacacatacacttgtacaaatatatataagtgatatatctatacacatatcacaactgtttatctgtccacccatccgtatactaatctaaaatgccactgatagccacccatgatctttgactaacatttttttcttcatctgcttaaggcgacagtccccgggtagctgactcacagaaagtctgattcacatgtctgaggaggtcacccagccagttggcaggaggcagcccagaatgagtcagggctgaccctgcatcccccaggttgctgtcccaggcagggcatttgctgtggctgctggagcagaggtggaggaagggtgggcagagcagccaattactccatgttgacatttcaatatttgagactgtgggcagagtccctcccctgggtacttagttcctgaacagccacctacactcatcacaggccagatcccagaaaataccctccccactgcagaccgcagagcaaatcaccgccaacaggctccaagactccctggactctcctgctcagggtaactgcaggaaagtctcaagcttcagatttccacgccttgtcttctttccctccttacaacctctttcccttcagcagctgctgaagtctttgcttctctcactcccgtatgacctcaagagcttctggagaaactaccgcaccagtttggcacagctactaaagtgaaatatacatacaaataaccctgatatggtttggctgtgtccccacccaaatctcaccttgaattgtaataatccccaagtgtcaagatcagggccaggtggagataattgaattatgggggcagtttcccccatactgttctcctggtattgaataagtctcatgagatctgatggttttataaaggggagttcccctgcacaagcgctcttgcttgccaccatgtaagacgtgcctttgtttcccctttgcctcccatcataattgtgaggcctctccagccatgtggaactgtgagtccataaaacctctttcctttataaattacccagtctccggtaggtctttattagcagcgtgaaaacggactaatacaaatccacaaccagcgattcttcctctaagtaagtacccaacagatatgaattctcatattcacccctaca

SEQ ID NO: 890 - DNA, 1457 bp, Homo sapiens
ctggagtggacaaaagcctcagtaggaggagtttttaaaggatactttaaatatatgtactgcctgaatagtttagtatgctcttagcaaatgaaacaattgttagaactaaaataaattacaagaccatgaaagcctactgagtgctccttgggagactgaggggccagtctggttttaaatgaaaggaagttgaaggttcaatggcaggtgggcacagaggagaggcagtagtttcctgggccagctccacctctccctgttctcagcccttattttggatccatgtgtggattgtacctctggaccagaggagctcagaggtcctcaggatcgagcacgggaagctcctgtgtaattgttaggcaacatcaaaatatgcaaagcaatagccacaacagaaaccaccaccaccaccaacaaaaacccaaacaataaacttgaagtttgatgaccagttctgaaggactaacagatacaacctaacattgttaacattgttctgttgttttgttttggttgcccaaacaacgttattgaaattaagggggaatccacttacagacctcatcacctgaaaacaaaacaaccttttttcaatatttcctttattttggaccaaatcttgccatgtatttgcttcactgtaaaaaaacaagaaaggaaaaggaaggagaagaaaggggaggggatggaagaggggagaggaggagcatggagtggatatgctatgctggattcacctgttctgttgctgtgggatttaggggcgtttgttttgcttttgttactacaaataatgccttgaaatttcctttgcaaacactgagacaaccatgtcaatctattgcttgagataaattagctgtagaacgttcacatgcagtaggagatgagagcaaaaaaagggttaaaagaatcgattttaattaagcagaatgtctttagccactcaagtcagcatccttcccacagatttttgatgctaaacttagccccttctaatgctctgccatcttcattctgtgcctgaacttattagctaaaccttcaaatgaagaacatcaaccatgtgacaggttggctggttaaaatggaaactctgaaacgatatttctccttctgccttattgattgcacacagacaggtcttgattaccacatgttacacagcagccctgctgactgtcgatgcacatctggagccaggtctcacccctcttcctcttccctagggccatgcaagggccctcccagagagccaggggcagcctgcacatctcccaccggccttgaatttagactttggatgtcacaccctctgaggttacacacacacaggcacagaagcatacacaggtgactgagggaataagactcttatcttccagctttaagcttctgcccattactagactatactgctttcagtgtactgtgaatgaatatttccacct

SEQ ID NO: 891 - DNA, 2457 bp, Homo sapiens
tgcaattggcagtgatctggaatgtggggcatcatcaccagcatcctggaacattcagaagtcacatggatgctgcctagttctcagcagaaaaccaatttaggttttctagattttggtgaatacacagtggccaccaggactgtagcacagggaggctaaaatgttagtttctgaggttttagaggaggatttggaccctcaagaccagccactgggttcctgcccaagggatgcatttaaaatccaaattatagactaaagcagacgcgggcagcaaagaaccagagaggactgcactgcacagaggattcctttacacctctgctggggcttaatggttatttaaaaatctcccccgttttcttctctccctttatttaagcccccatttctctgactcttgtctccataaatatcaaagaggtacagatgtgttgcctcccaacacatgggaaaggccccataacactccccttgtcaggaaaatgggggatgctctggagtggacaaaagcctcagtaggaggagtttttaaaggatactttaaatatatgtactgcctgaatagtttagtatgctcttagcaaatgaaacaattgttagaactaaaataaattacaagaccatgaaagcctactgagtgctccttgggagactgaggggccagtctggttttaaatgaaaggaagttgaaggttcaatggcaggtgggcacagaggagaggcagtagtttcctgggccagctccacctctccctgttctcagcccttattttggatccatgtgtggattgtacctctggaccagaggagctcagaggtcctcaggatcgagcacgggaagctcctgtgtaattgttaggcaacatcaaaatatgcaaagcaatagccacaacagaaaccaccaccaccaccaacaaaaacccaaacaataaacttgaagtttgatgaccagttctgaaggactaacagatacaacctaacattgttaacattgttctgttgttttgttttggttgcccaaacaacgttattgaaattaagggggaatccacttacagacctcatcacctgaaaacaaaacaaccttttttcaatatttcctttattttggaccaaatcttgccatgtatttgcttcactgtaaaaaaacaagaaaggaaaaggaaggagaagaaaggggaggggatggaagaggggagaggaggagcatggagtggatatgctatgctggattcacctgttctgttgctgtgggatttaggggcgtttgttttgcttttgttactacaaataatgccttgaaatttcctttgcaaacactgagacaaccatgtcaatctattgcttgagataaattagctgtagaacgttcacatgcagtaggagatgagagcaaaaaaagggttaaaagaatcgattttaattaagcagaatgtctttagccactcaagtcagcatccttcccacagatttttgatgctaaacttagccccttctaatgctctgccatcttcattctgtgcctgaacttattagctaaaccttcaaatgaagaacatcaaccatgtgacaggttggctggttaaaatggaaactctgaaacgatatttctccttctgccttattgattgcacacagacaggtcttgattaccacatgttacacagcagccctgctgactgtcgatgcacatctggagccaggtctcacccctcttcctcttccctagggccatgcaagggccctcccagagagccaggggcagcctgcacatctcccaccggccttgaatttagactttggatgtcacaccctctgaggttacacacacacaggcacagaagcatacacaggtgactgagggaataagactcttatcttccagctttaagcttctgcccattactagactatactgctttcagtgtactgtgaatgaatatttccacctacattattaagtgatgcattctattagatgggtataatatatacttattataatttaagttataaatcttttaaaaggttattcagtgcaaacattttaaaacactttttaaggtctctgttgtaggatttttagtattttttaattcaccaggagtcttaaaaattggataaagcttgggcctcccttggtgggggtctcactgctcacgaaattcattcaccttcacaggctgtgccttgagtggccaactggaagatcacacacagcatgagacagtcccttcctgacagcagagacagagaagacagagtccaggcagccctagcagagctccagggacagttaacacccacccacactggttattcattcttttgttttaatgaatccaaattttttttaaaaaaagactcaaccatggtaggtgtattgaattatctagattatccattgattatgacatgaaactacaggtccatgatactttttctataacc

SEQ ID NO: 892 - DNA, 829 bp, Homo sapiens
tctttaattatacaaagaagcactgagaatgacgaacttcttacaaaccctgagtacattgcatgagatccaaaatctgtaaatcatgtttgatgatacgctttgtagaaattctagatataatttcaaaaagatcaagtgaattaacattcaaagatgaacgcgattattataagcagtcacagcatccctgtcacctgccattaacaacatttacaggcagaatacacatgctattcatccatctgtggatacctgcaggtttattggactgaaagattatgaggcaactatatcccgataaaacttggaggaaccacacattgaggagaagatttccacaagcatagagctaatgcagacaatttgaaaaggattggcttcatgctgtcatgaaattacaattgcaattgactctgggggaacacttgagtggacttgagggaaatggcttatgggataatcccagggccttacatggattgactagccccttcttggtagtgatgtcattcctttcctctgtgctacacacgttcatgtgcaaacacaaacacatcccacactccaacaggaagcacagttcccccaagtgcagctgcttaggttaccatagcaacccttgtagccaagttcccagctgaacaagtttcacaagacaccagaatgttttcttgcactgctcttccagaattgggctgagatggatccaagaatggcctgcagtgagggcagtgggaaaggccccccaaaaacaccagactgacatcaagtgtggctacagggaaggaagactgcctatgtacttggagtgacttacctgggaagg

SEQ ID NO: 893 - DNA, 1829 bp, Homo sapiens
gcaacagaggaaagtattggggaaggctctgagcagaggttctgttccttcccccaccccaggcagactcctggtttggggaggactcagagatggggtcatcagattgggtggtggagccggaccacttggtttgaatcccggtttcaccatttcttagtcttgtgaattgggtaacttgtctctgtgttttaatttcctattctttaagatggagatagtaacaataataataatatctactttatgttgttatcttgagggttcaatgagtaagtacatgtaaaacacataaagcctggtacataataatcaccaattaaatttattgttattattaatacccgagagaagagggatctgtgtagggtttcactttgtctctaattttaaacatctctaatatgtaacatttcttccacattttttttcagttgcatatgattcagactttttacatttgggagtttaaaattttattaagtaatactactcattgctctttaattatacaaagaagcactgagaatgacgaacttcttacaaaccctgagtacattgcatgagatccaaaatctgtaaatcatgtttgatgatacgctttgtagaaattctagatataatttcaaaaagatcaagtgaattaacattcaaagatgaacgcgattattataagcagtcacagcatccctgtcacctgccattaacaacatttacaggcagaatacacatgctattcatccatctgtggatacctgcaggtttattggactgaaagattatgaggcaactatatcccgataaaacttggaggaaccacacattgaggagaagatttccacaagcatagagctaatgcagacaatttgaaaaggattggcttcatgctgtcatgaaattacaattgcaattgactctgggggaacacttgagtggacttgagggaaatggcttatgggataatcccagggccttacatggattgactagccccttcttggtagtgatgtcattcctttcctctgtgctacacacgttcatgtgcaaacacaaacacatcccacactccaacaggaagcacagttcccccaagtgcagctgcttaggttaccatagcaacccttgtagccaagttcccagctgaacaagtttcacaagacaccagaatgttttcttgcactgctcttccagaattgggctgagatggatccaagaatggcctgcagtgagggcagtgggaaaggccccccaaaaacaccagactgacatcaagtgtggctacagggaaggaagactgcctatgtacttggagtgacttacctgggaagggtgaaattacacatccagcccctctcaggacactctgcaggactcatggttcaaggaggtgagaacggctctgtgcagaaccatggctgctaatacccaagttccaggctgcagataggtactcactttcagcctcgtggttggagggcttgagctgaacagaaaatccccatcttcttctaaaaaaacaaaacaacctaaacaaacaaaacaaaaaatctctaataaaattcatggtcaaaacagatgaatgtcccttataccttgtctcaaggttttttgctgccagttgcctgttactgatttaaaccaacagtccccccctcagttcccagcacattcattctgtgaactggaccctgggtatggggacttggcacaagaactagaacaaggtaaaggaattcactgtgagatcttgtattccatggcctcctcatactcagaccatgatcaaaatctatttaggcctatttagggctggccaatacgatctaaaa

SEQ ID NO: 894 - DNA, 2040 bp, Homo sapiens
agccatcacaggtcctcattttatttgaaaccctgacaacagggccgggctcggtggctcacgcctgtaatcccggcactttgggaggccgaggcgggcggatcacaaggtcaggagatcgagaccatcctggctaacacggtgaaaccccgtctctactgaaaatacatacaaaattagccgagcgtggtggtgggcgcctgtagtcccagctgctcgggaagctgaggcaggagaatggcgtgaacctgggaggtggagcttgcagtgagccgagatagggccgttgcactccagcctgggtgacagagcgagactccgtctcaaaaaaaaaaaaaaaaaaaaaaaaaaccctgacaacagatgtgttacaggatgtttagatattaagtatgtaataaattgtacctggcatataataaggaatagtatcggagagttctggaccatgccctgtaataaaacacgacaaagcatatacagcaaaacccacgaataagcaccttgcctcactgacgttcaggttttgccactaaaggaaggggtcagtaggcctttctggaaagggccagataggaaatattttaggcttgcagccatacagtctctctcatgtggtcatggttgttgacccgtggcttatcctgttacacaaccactttccatgtccagagctttgaggatctgggaattccatgcaaacaactgtgggcctgtattctcatttgtatctcgtcatttcctgcaatcaaaagctctgatagctaccctcatgatctatgattagcaggaacccagaagacaaatgtatttttcagcactacccatggtttgtttggtaaagcaaaatcttttccaaaaacatggtttcgaaaagagaaggcattattaatgggggcgcagggagttcccatgccctcacagagctgagaaatgtggggactgatggccagatcgcaaggaaatgtacaatttccatcacatcttcaaaaatatgaaaaactgccacggacttttgtggcagcctcccaaaggttctaggggtctcagctactgtgctagtgatttatattttaggcaaaatcaattgatataccagcagtgtcctgctaccccagaaaaacatcatttgcaatgcatttgtaatatattctgagatatgcacagtgtaattgtcaatatcttgtgttcatgtagctattttattgccagagaagattgaggactgatacttgtaaagctccataagattcacagacgatgaacattacatcctacaatactacactacaccacactacatccaggtggaaacgagcatttaaaacaggagaggaaacaggactgaattcagccctaggaacaaaggagctgcttctttgaaaaaaaataagccatatgtccatatgtgcatgcacgtttttgacctgtcagaggtgcagagtgctgtctgcagaggctgttattcaagggaagagtcctgttagtcagacaaacatgaacttgaactcagccctacccctacaaactgtgtgaccttggacctcagtttccacatctgtgtaacagggaaatactgcttctcatcaagttgctgtgggcttatatgaccaatagctgtggaagtgtggaagctcttatcataagtccctcattcattttatttcatttcaacaaatatacattcagcacctgctgcaggacagctgctcagaccacctggggatttgcagatgaataggacagaaaaggcccccgattttatgaagcttacagtgcactggaggaggaggcatgaaacacacacacaaataaaaacgtcaccccaaattgtcagaagtggaatgaggtttaaaacactaagataaagagagaaagtgagtatggcagtgggtggagctgatttagacagggtgctgggcagccacactagggaagcagcagctcagacttgcagagtaaacagaaactgaacagaaaagaggtactgatgaagagttccccggccaaggaagggcaagtgcctagatcgtgaggcag

SEQ ID NO: 895 - DNA, 3040 bp, Homo sapiens
ataaatggctctgaatagttctgggcatacagtaagttctgtgtaagtgtgagctaccataattaactaaataataatctctaaaataaccccaatgattttgattattcccatgctgcagataaggaggctggagaggtgatgttttgcctaaagtcacacacctggcaagaggcagggcaaggcgtgcctgaccttgaaagcccacgttttccctccttaggcccagcatctacatcattgcatcggaaatagctgtttctgagaagctgtccggagaagggataaaagcacagggtctcgaggctaaatgtggggttaggatgtgattctgtcacttactagtgacttactttcggtctgctgacttctcttgccacaatgtcatcatttgtaaaaaggggattataatatgatttgtctggaagagttgcaagggaaagagttgatacatggatgttacttaaaaccgttttggcacagagaaaacagtccgcgttagccatcacaggtcctcattttatttgaaaccctgacaacagggccgggctcggtggctcacgcctgtaatcccggcactttgggaggccgaggcgggcggatcacaaggtcaggagatcgagaccatcctggctaacacggtgaaaccccgtctctactgaaaatacatacaaaattagccgagcgtggtggtgggcgcctgtagtcccagctgctcgggaagctgaggcaggagaatggcgtgaacctgggaggtggagcttgcagtgagccgagatagggccgttgcactccagcctgggtgacagagcgagactccgtctcaaaaaaaaaaaaaaaaaaaaaaaaaaccctgacaacagatgtgttacaggatgtttagatattaagtatgtaataaattgtacctggcatataataaggaatagtatcggagagttctggaccatgccctgtaataaaacacgacaaagcatatacagcaaaacccacgaataagcaccttgcctcactgacgttcaggttttgccactaaaggaaggggtcagtaggcctttctggaaagggccagataggaaatattttaggcttgcagccatacagtctctctcatgtggtcatggttgttgacccgtggcttatcctgttacacaaccactttccatgtccagagctttgaggatctgggaattccatgcaaacaactgtgggcctgtattctcatttgtatctcgtcatttcctgcaatcaaaagctctgatagctaccctcatgatctatgattagcaggaacccagaagacaaatgtatttttcagcactacccatggtttgtttggtaaagcaaaatcttttccaaaaacatggtttcgaaaagagaaggcattattaatgggggcgcagggagttcccatgccctcacagagctgagaaatgtggggactgatggccagatcgcaaggaaatgtacaatttccatcacatcttcaaaaatatgaaaaactgccacggacttttgtggcagcctcccaaaggttctaggggtctcagctactgtgctagtgatttatattttaggcaaaatcaattgatataccagcagtgtcctgctaccccagaaaaacatcatttgcaatgcatttgtaatatattctgagatatgcacagtgtaattgtcaatatcttgtgttcatgtagctattttattgccagagaagattgaggactgatacttgtaaagctccataagattcacagacgatgaacattacatcctacaatactacactacaccacactacatccaggtggaaacgagcatttaaaacaggagaggaaacaggactgaattcagccctaggaacaaaggagctgcttctttgaaaaaaaataagccatatgtccatatgtgcatgcacgtttttgacctgtcagaggtgcagagtgctgtctgcagaggctgttattcaagggaagagtcctgttagtcagacaaacatgaacttgaactcagccctacccctacaaactgtgtgaccttggacctcagtttccacatctgtgtaacagggaaatactgcttctcatcaagttgctgtgggcttatatgaccaatagctgtggaagtgtggaagctcttatcataagtccctcattcattttatttcatttcaacaaatatacattcagcacctgctgcaggacagctgctcagaccacctggggatttgcagatgaataggacagaaaaggcccccgattttatgaagcttacagtgcactggaggaggaggcatgaaacacacacacaaataaaaacgtcaccccaaattgtcagaagtggaatgaggtttaaaacactaagataaagagagaaagtgagtatggcagtgggtggagctgatttagacagggtgctgggcagccacactagggaagcagcagctcagacttgcagagtaaacagaaactgaacagaaaagaggtactgatgaagagttccccggccaaggaagggcaagtgcctagatcgtgaggcagtgtagttaaacaatggtcagccattgttctggaagtcataagatgtgtaagctccccaatcactcttgtggattacatcacatttgtagaacctaagatcagccttttgagacttttctttcagacttttgcatttctgatgaccatctcactccatctggacccgtgactcaacaggccctgcagtgcccacccagaggcggactcagcactcacagactttcccctatgattctatacaacatccccattccctagccctctacccaccaaactatccttgaaaaactctaacccttgagactttgaggagactgatttggtaataactccatcttccacgtggctggcctcatgtcaattaaactctctctctttattgcaatatcgtggtctcagtgaattgattttgtctgtgcagcaggcaggaagaacctatcaggtaatttcaaaattagtgcctgatatagtttggatgtttgtcccctctaaatctcatg

SEQ ID NO: 896 - DNA, 1445 bp, Homo sapiens
agttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcag

SEQ ID NO: 897 - DNA, 2445 bp, Homo sapiens
aaagaccaagaagagcatacagtacaggaggtaccaaatggatacagcctcaacattctgagctttgccagaaatgtctgtctgtcttctcccactgtttcctcaattctcttcccctttttcatcttcacctacctccattttcttgagttttcttgtgcagttttggtcaggctttttattgagaacaacctcaactcctgccaatgactttacagccttcctctttctctctggatgttcttaacaggtttggatgaagctgaaatgtaaatgtatctgattcttaattagaagaattcaattccagagtctgttaggactttgggagtaggagatttgttttcacagtaaatattctcagaaggagaagggaacctagtctgatattcccagaggtgaccagtaataggaaatcatcttgacagatgaaaccactcgtatctagaaatcagatgagtagcgggatgagggaaagacagtgaagcctcggaagtgggagttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcagtgggaaccactgaaggctcttgaacaagtgattctcaaacagatttgttagaaaggtccctgcggcaaaaagagtgactggactgaagagggttgcgtgtgggaccaaaagagcaggtggaagaggccccccgctcccactgcctggtgttcagaagatggtccattgaagcttaggaaatgatttgagcttgtggttggaggttcaaaattagagagaatgcatgcagggaaataactagctcttctacagcctggctagagtcccttcctacagagaccagttaatagagagcatcatcaaaggcaccaagagtttccgtaaaggacttagataattatttgcccagtgttggttgaaggaaattactttggaatgaaccagctgatgcagttcaagtgcccgaggatacattcctctgcctgacgttttatacctgtgcgaccactgccccgcccccatctgctcccccaatccccgtcaggatcctgcctgctcct

SEQ ID NO: 898 - DNA, 2197 bp, Homo sapiens
aaattagggtgttgttatgagaggaaggccagattgttgtgagataataacaatagaatatttagaaagagagagagagaaagaaaatgaactgcgcatttgccttttagttctaaacttagtcttgaaattggatttgggacactttggacttcagatattttaaacttaggatttctattaggtataagctatttgaaatttcacatctagaaattattgtttgaatggtgctttgtatgtgtgtgttcaatatctctaaaaggacttgtggatgaattgagatgtttttctcaagttagagttactgtgaacaacaatgggatttcctcagagtaagtctttttttttttggtttgatttcttccctttacacttatttccttattataggtgggttcttttcctatatgtaggccaaatactatttcttccatgaggagatatgctgcttcatttagccctgagcatcttaacaccttattttaatttttttaaaaaaagaaacaaattgtctgtatgtacctcaagtaagaaatggttgtcttcatagaggtcatcatacatagacgaaagtactttggccttgacaaatttcttcattagctccaatgatctgtggccaccaggcagttaatttatatgcctagacatttaatatgtacatttgttggtgagctggccagaggatgctaaacacacgagtatgcgctggcaaatgctgcaatgcagtatttttttcccaatgtcattgggaattttggggctaggaagggacatgaacattttcaagcttttatcttactattgtccagtcgatgggccatgttgtacagatttggtcaattctccttttgaaagtaaagtcaaccttttatttaccactatccattcccccatccatgtaatgtatatgtggaaagtgtgtgtgtgcgagaaagagaagcagagagactctgtgtgtatcagtataagtgtgttgcagattcctgcacctgtcttaggctttccttatttggtattactaaacatgtatacacacttacttgcaagtatatgtgcatctataaatggagagaaaaccaaactgggctgcttcccataagaactggtttctcttcatgactccaagagttctcatattagaaaaatatgaaatttcaaatattcattaaaaaatatatattcagaccctgcagtctgttagtaaccaaacacctttctttagctgccacttaagaaattataagtgtgcaaatgcataacaatgtttgtgagctaaaagccatcccttcaatcaagggcctgggtatgaattaaaatgtgtgtatgtgagtgtatatggatatgtgtatatgtatggggggcggtgggcaggatgtttttctttgagggcatttgaacctagtctttaccattggtaaaaataaggaggcggtaagatggaagtgttaacatctgtgctttgctttgtaagttggtgtgcaagtgtgtgtgtattaggaacatccttatatttgtgaaatctccacgtattttaggggtaaagggcttttataggtcactggctttctaagggtaaaaaaaaaagaaaaggtgatctgtgggtgggtgggagtcacaagcagtaattgtcttaaattagctatttagcagtgaaaaggaaaaaaaggctggaagacaagagtgtagaagagtaccaacatgtgggtctgcatctttccggtataggagataatgagtgataaatttgaactggtgcagtgcaagatgcccgataatttctctgaaccttgactttgcaggtccattacttccttgcttgcttgttcacacctttaattatatccagtttgggatgctagctgggggcaccacagataagccattttgtttgttgtttacttcattaagtattcaggcagtgtattcacagtagctttggagcatcagtgttaggaattgagcagtttggaaatggaattgttaaaaaagaacaaaaaaataagacagcaatcagccagctagcttgctttggatgttcacatccactctgcttaatggtaatatttatgctttcccttgcacattaattaagaaataacttacgcagtgtcagggctcttaataggctggtgactttctctctctttctctgtctctgtctccgtctctctgtctctctctctctctctgt

SEQ ID NO: 899 - DNA, 5011 bp, Homo sapiens
atactgtgactccaaactggtttgaaggacttgacattttctttcttttttaaaaaacaacttcctttcagattataaaactgctgtattctcactgtaaaaacaaaacagagttgacaaataaagatggagaaaagtgtaacaatcacctgtaattctgccatttattctagtgttttttatttttccctcctactctgtacttgtttatataattgagataatcaatcttttatttcacttctttttctacattgatcatatacattttctcacattataaaaacccattataaacataactttagcaattgcagaatactgtatcaaaaaactgcacaatgagttatttagccatcccccttgttagactcctgggctgtttccgtttttctcactcctcttaatataactcattgtatgtacttctggtctgcagaattttggattcttttctgagtttcagaatggaccagtgggtccaagaatatgaacataagaagagatgtgccaatttatccttatacccataattatgagaaagactatttcactgcatcttagaacttgacagttgcaaaccttaaatttctagtttccatgtaaacatgttgcccacaaataattcaaaggcacacttctcctcacccaggcctgaattctcaccaacattgatttggtggagtccagttttactcctgcctccactaccttcccagggaatgtttaggggcaatggtatccaactggccctcagaggaagtttgagggataaagttctcctatcaagtcaaaatgttctttttttctaacatttatctcttataaaaagaaagaaagagagagagaaagaaagaaagaaagaaaagaaagaaagaaagaaagaaagaaagaaagaaagaaagaaagaaagaaagagaaagaaagaaagaaagaaagaagcagtgaagggagaaattaacaataaactttcaagtgtgataaagtaattttcagatttaaaactactctatcagaataacattcaggatcttttcatgaatgaacatgtagctatatgaggctatatgaattgtccatgagtataatttatcacggccagttatatatgcattgaggtgctaagaaccattttatttcacttattatcttcaccttcagaatgacttaattttttgaattgcacaattagaagagccattgaccttacacaatttctcttaaaaagaacaagacttctacacagatttttctagacacaaactccctctactcccttttactcctcccctcttcctcaccctggttatgttaagaaaacaagtgttaattttcaaaataaaatatatttctatgtagatttctgaagaatttaatctgagtgtgcataaaacttaatttcagagatgtgacctaatgctttagatcatgatacatatgtggaatagcacattgctgtttacaagtaaacctcaagagtttgctgcgactgagccactagccaggcattttataaatatacaatactaatgtttacatgaattgtgccattggctattgtttatgcatttaattggaaagataagtctggcttaatcagtttgtgggcagtttttcaaatgattcattaattatgagaaagactgttctttgtatggaagatgaagataatgtatttcccatcacaactggttcccatcccaacaagtatccagagattattattaggcattttagttattttatccacattaaaccttcagagttcagagggtcttagggagcagaatgggaagaaattgttttccaatcgattttctttttattagagctgatacttttgcaggaaagctgagcttgcccacaaaattgtatttttattaaaatgcaaacatttgtctttttcaaatctgacttaaacaaagaaagcttattgaaagtacggtactgtatttatttactggccattttggaaaggagaaccgaattgtgggggatgaaggaaacgttccctcatctttataatgtgctgaatgatcaagctgtccctcagctatggagagtttgttgtaaaagtcagttaaaaccaaatacccaggggtcttaccagaactgcatcaggatggacacaccaggaaatcatcttaggcccaaaatgaagctctaaagaaacactgtaaaatgtaaaggaggccagtatttatttaggaggggaaatgggtgtgatgtgtctggggaagaagattaaaacttggatttccgtgaatttgagaatgatgcctatgagaaattaaattttgattatgcttttcatatccgtgctggccctgctattttaagtattaatgcctcttgttctctccagtggctgctgattttttaaaagccctgactaccaccactgagaatacttttggcatgcctggtgttcatctccagagcagaagttgctgtttgaaagaagggatgcctcacgcttacctcattgttacaaatataagttccttttagattataaagcgctatattctcattgtagaaacaaaacaaagagttgacaaataaacaagtcatttgtttaggatgtaggcatttataccaggaaaaggacagtcagttcagtatcaaaacaggtaggattagtctgagtgtatacgatttatatgcttttgctgaggagggggtgtcatttgagaaactctgaaggagactgcttaaaacaaagggatatacaattgattttaatgaattatttgtttgcctgccctcctctgccatcctcccagcttcaaccctctacagggagggaccagattatttttgttttcccaccttctagaagaatgccttggcttataattgcattcaataaacttgtgttgaattgaatacacttgttttaaggatatgctgagaatttattaccacataacttcccagagtaaataggtctttcaggttatttgtgcctctgcccaaaggtattattaagctgtcagcatgtgtttcttggatggaattaaatatttttttctagagttttctagttaccttctggcagaagctacagaaacatggtatgaatggttttgggaaacatgagtgcagtctttagccacagtcccctagtccagtggtctttgtgagtcatcacctgtaatttggttggaagggtggtatttccaagttcccttttcctagagttatcagatcatcagtctcagctcctccccttgggtcccattaataacatatgtctccttcacagttgaatcataaccaggaaagtgttgcatttcaaaaaaaaatattaacctgaagggacttgagcgaattaaagcctcttgaaaagaaggacgggagagaatagattttatgagctgatctaagacactttaaagaaatatgaaattggggaattgtaacgacatttttagtatcttttaaggagcaagaagagaagtgaggaattttacaaaaaaaaataatgtctgtcttcaggaacacagagcctgctgtgtaattttctaactttgggaatttgtttttcaggcttggaaaggtgggtgagatgcagtagtctgggctattgcatccaccagagtctaacatactacatgtcagaattttacaagggttaagtgggaaattcctacaaagagaattaggacttttatttttgttctcattaataatttaaatctatttctttaatggttcaattcagtgactgcccttggtaaacattattcttcatgcacctgagagagcttgttctattacataagggttagctttatacatatattttcaaaaatccttccaacatggtaaaagaaaacacctttacatactcattaaaatatttaataaaatacatgcatgagtctcaggtgtacacacctgagacatgtttgcaatcagtacattcctttaacatctttctcgtttctgggaatactgacttttaaaggtagctgaaagtagaggataagggtatttgtaaaagaaacatcatgttctgtgaccttctttggttctttcctcttgatcctttcgcatgaattgtgcagtgaggctatatctccgccagaaaaccaggagttaaggactgccaaaagtatggtgacaggtgtacaagaaccctgcactgggctcttagatgatgaatgtcagtactgagttctgtatcaggtcagattcctgtaatgtaaagttgtaacctttgatttgcctcatgaagtaaatcctgaaagtaggtgtaggttaactagattaaaatatctaaatgcaaaacaataacgtggggtcgtatgtaggtaaagtggaggggatagggtaagacagggttctaaaccttgctattaagaagtaaaagagtgttagtctacactgaagtattccaaaaatgtcacaggcttgaatgggaaggaacagtttgtggactttccatctttatttttatactaccatttttagggaaaatattaggacaaggacacaatatggtgtggttggcaggatggtaagaagactatggtagcaacaatgattctcctccactgtgaggagggggatcaatcctgtaactctagcctgattgccccaaacttgagaaaattaaagctttgtgaagagtggaggatggaaggaggtgtaagaaagtcatgagctaatggaataaatattaactactcaggaggttgaggtgggaggatcacttgagcccaggagttcaagtccagctggggcaacatagagagacccagtcaaaaaaaagggaaggaaggaaggaaggaaggcaggaaggaaggaaaaaaagttttaagggagctttaaatacatttttagtacatccgtacacttttagattttagaatagtcttgcttaatatacttcaaagattttcctagtcacaagacatgctgctgtctcttctctgacatgtggacccttcatcaataaatatttatttgattagtaaattaatgaattctgagagcaagaaat

SEQ ID NO: 900 - DNA, 4195 bp, Homo sapiens
atgtaggaaagtcaagaggagaaaatatctcccagaatcacagcaccctaacacaaccactattaacattttgagatacaattcttgcctgttttataggagtcatttttattttgtttatttttactggaataagtatgttgcacatgcagtactaaaatctgtatctttcacattgtggtaatattgttttttctacactattacatactcttcataaaatttggccattgacctattattgttagtcattattccagttacaaataattttgtgacaaacatctctgtgtgtaaagcatttcatatttgagtatctccttacaatgcatgcaaagaaataaagttatcagatcaaagcatatgaatatttaagactttcctttttcaaaaaagatcaagtcatcataattaccaaaaaagttctatcaagtaggtcagcccattccccaagcatctctgtttccggaatatgtaattctagattacaaaactaaacagattttgctaaaggaaacatctcaaaatcaccaatgtgcaaagaatgccttgaacaggccacatggaaagctcattataaggctgaatctgagttgtccttgcagtggtgctgtggtgctgacatgcaggggaaagcttcacaatgagggtctttccacagttccagtgaactctcaggcctggcagggctgtgacaggagcacccccccacccccctccacacacattatagtcctcctcctatgaagggaagaatcagcccttccagggcagacacacattggtcagggttcgcctgtgtgggtgatgaggtgggaaaagaggagctgtctccctgacagaaagagagaagaacctcaagtgagcactcattattggagatctcagattctcctggagaaataatgagtgtcactggagttctgtgggttccttaaggagcaaaacaagctaggtttgattaggctaatttgacaacaatagttcagtggggaaggaggaaggaggaaaaggagaactggaaggggcaaggtgaaatttgggggaggatattgaaatgtaaggaaataatacatttaaatatctgacatttaacagtatgttaaattcacagagcatctttccttgtaagaatttggttgataatcacaggacgctttgagttggtagacaaatgctgtccaattcctgcgctgtttcccctcagctcacctctgcgaccacttgcatctattagtttcaaagatactaatagcttcccatctcaagtctttgcatctcaccattcctctgccgcagggtttctccagcacctagtgggggttgcttggctgcagaattgggaggatgttaacaccccagagccacctccacccaatggggaatgaaggtaaaaggatcaatacccctgcttccagctcatctctagagactgtttggaggcatattctacatggtttcttgtaggatctccagcagaatcaggcccaccttgtctgcagcagcagcccattattaatgcccacagtattgacctgtctctctcccctgtctcacttttttacatactcctcccttgtattgtgtaagaccactttccaaataaactatgtaactcaagtccttgtcgagggacataaatcctacttatgggagaaccaaactaagatagcagaaaatttgtatgcccatttggcagattagaagactgagtttcaaagaactccaatgactttcccaaggtaattgggttgtcatgtggcaacatcagaaccaaaagctgactcttcaactagtgttttctctactctacaaggaagtctattttacaaatcaaacaataacgttttattgactccctattaggcactatgtggggtactaggatctccaagcccagtaaaaaagaaagaaaattactcaccataaggcaatgtcttaaaagtagcagtcatctagttctgttccattagttactatcagcatttatttagggcctactgcatgccaggcagtctgttagacactgaaagcctgaagatgagtgaaacttggcccctgcccttcagaagtttagaatctagtagtgaaaacggagaggtgagagaggtcgacagacatagacacactttccaataaaagggataactgagaaaacaggcatagagttatacagaaacagagaggactgatatctaactcaggctgggggactggtgtcagaatttcttggaggagattcattctttcatgcatgcaaccaatattccctgagtttctactagattccaggtggcacgccaggagcctggattacactggtgaatcatccagctgtagtccctgtctcaggccagagctaagtcttggaagaaatgcctgaaagttagccagaaagagagtggggaaaggtcttccagatggagggaagaagcatatgcagagcctgggaagcatcagcagcattttgggggtgaagtgagtgctgtggggagtgggggtggaggaggggaggaatagcattgctagagcataaatacccaggaaagggggccaggaaatgagctgcagacttggccagggaccacatcagagtagagcttaagctaacaaagtgctataggaacatgaagaaaggaggatggataattctttggggacacaggaggccatcacggagaggtccacagaggcaatggcactggagcgagagaccttgaagaacatgagaaatttacccccatgtagaaggagaaaggagactctagaaaaattcagcttattctgcagtgcaaattctgttcactgtgcatacagagtgacatttcagtgaattttcttccaggaaacacattgctccagggtgagattcagggctgccacatatagttgtgcagaacccagtccacatagctaaacacagtggccttcacatgtttggagattgctgggaaggcctgacctcaaaagggatgccctcacatccttttatccaagcatctgaaagccttctcattagatatttactcctttggatgaagctgcttgctcttcagtgagtcactttaaatgcaaatattctggcttccaggggatgagtatggggttggggggagtgatgtgggcatgacacctgacaccacaaccctgcctcaatggatcagaggcctagagctaggacacccaatttgttctccgacattctcctctttcctccttccacagtggaagcacctgtccctcccctacaggcttaagtaagtcctcagctcccagaatgcatgtgagtctcaagcagaaagggtttaagtagatgcacttagcatccagccactctgaatgtctttaaggattctctcatttagataaccaggctttagtttgctatacttagtcctcaaattactccttgctggattcagcaacctgctagctagcttggaccaatgttgctgccacttcgctctccctctgtgcagaaatcactagaacacttggctgtgttccttacccggtaaaaaacagcctcctttactacctagagctggacaaagatctacttcctgcagtgagactcaggcgctccccatattccaaggtctacctggtcaaatctccagagagaaagatgacgtttattccttcatttatttcacaagcttttattgatcacctaaattgtgcgcaacctcaaagagtagctgaaggatcttgtggtccaatgagtgaatgaataattatgcaatatgagatgagagagactggaattgagctgaagaagaaagaagaagaaaaaagcttagccttagagcctctttgagcactgtttttcttagctataaaatgcggatgatattgtttctttgtgaagtattgtgagatttgagataatcctaaggtaaagcatgcagcagatataaatgttccatacacaaacaatctcatggttttcctaagctaggatgagatgctggacaggcataatgtgtcaaacaatggattatattacaacatcactttcggagcctcaaatgtttggtatttagcatattacccttcccatgggccgcttgaattttaatagagcaactcttctcaactgtgccaccacaaacacattataggtatccccagatacttaacatctcattcctgtaggtcactggaaaggatgagggttccagacgggtaggga

SEQ ID NO: 901 - DNA, 1098 bp, Homo sapiens
gagagaactaataggatagatgaacttatgaaggggaatttattaggagaatttacttagacaatcacaaggaggagccccaaaacagaccatctgcaagctgaggagccaggaagtcagtccaagttccaaaacctcaaaagtagggaagctgatagtgcagccttcagtctgttgctggaggcctgagagcccctgccaaatcactggtgtcagtccagagcccaaaagctgaagaacttggagtatgatgtttgagggcagaaagcaacaagcatgggagaaagatggaggccagaagatcaaccagtctgctcttttcatacctgtttttatgctggcacctgattagattgagggtgtgtctgcctttccactgactcaaatgttaatctcctttggcaacatgctcagacacaccaggaacaacactttgcagccttcaatccaatcaagttgacactcaatgttaaccatcacatatattattatacattgtagaaaagaatacaaaatggtacagccacatgggaaacaatttggccatttcttataatattagatggatacttaccctatggcctggcaatcttactcctatgcccttaagaaaataatttatgttcataacaaaaacctgtacatgaatattcatatcaacattatttgtaatcaacccaaactggaaagaaaaaagaaatatccttcaataggtgggtgaattagttgtgaacagccacacaatgaaatattactcttcagtaaaaagaaatgaactatcattcacacaacagcatggataaatctcaaatgcattatgctacaggaaagaatccagtactatataattccatttatataatattattgaaaaggcaaaattatggggatggagaataggtcaattttagctaggagttgggtgggttagggagtgactccgaaggagcggcatgaaggaatttggtggattatgggattgttctgaatcctatttatggtggtggttgcaaaatctacatatgtattaaaacgcaaaactaaacacataagtgaactttattgtatgtaactaaaacaaccataacaaaaagtaaa

SEQ ID NO: 902 - DNA, 1812 bp, Homo sapiens
tttataatatgtaggatttataatatacacacattttaagtatacagttacactttagacaaatatacacattcacaaaactaccaccccagttgagatataggataaaaatattactggagaaaatttctgtcttgatttcaaataatatggatttgttactcccattttaaactccacataaatgaaatcatttggtaactgctcttttgtgtctggtttcttttccttatatgtttgtgagattcaattacctcaaaaccttatggatatgtgctttcatttctcctggaaagatacctagaagtagaattgttgggtcttacaagaaattgctggagagttttccaaagtagttgtaccattttatatactcattagcaatgtatgaattttcaagctgctcaatatctttgccaacatttatgttttcagtattttgaacattagctattctagggggtgtgaagtaatatctcattgtagtgttctactgtactttctaatctcacctaagcatttttctctcttttacctaggttgtcagttcttgttcagtgctttcctttatgtaagagaatactattcccaatcaaaggacagactaccaaaattatggtgatgtgcaaggtcacctgtgtgatgacatataagttgattatgacaacagatgcatctgccaaaacatttccttgatctcctcctgtaagcttcctttgggtttctcaggaggggcagaatgattcactatcaacatagtatcacagatagacttatcagaatcttggtgaattcattcaacagaagtcttctccattttggtgccaaagcgataaaggaagaataagggcaagggagtgggtctagagaatgtctgtttctcaactataccttatttcccttattcaactgccacgttctataagccttagctcctacctaaaccacctaatgcatacctcttagtccaaaaaatcatccttgaagctcattagaatcaagtgcatctcttattaattgattcaaaagtgggaaaaaccatttcatataatttaggctacataaaatttttaaatacagtgcaaatcaattgaactgtcctttcgtgttgcatctttcaacagctgaatattctatatggcatttcacagaaataagatttgatttgagaacatctgcagcagtctggaacacattttcccctgtacttgacttttagctcattatagctctcagatgttctctcggcaatcctgtgacatattggagtgttactgaacaaacatcagtgaagcctatgtcttgagtagtgtcaatctcagttgaaaatgtttcagctttcttagcatcaacactagaagaatttaattaacccactgaaactttcaaagtggtagttaatgcatggaagaaatgagaaatcagaaaagtggggggagagtggataagtgcttaacctcccacaagctgatgcctgccatcatcagcctctgcttaggcaggccatgagaagccttgctgctctgtgtagcctcctgcattctgccatgaaatctctggcttgctctattgcccctatggagatggagaaggtgtggaggtggcaactactgctgtcatgctcccctggtccccacacaaggtcagcttccaggctctaatcagctctcatccagatgctctcatgtttttagtaggtggggctgggagaccaaggtcagaaaagagctgtcgggagtgacacggttttttgcccactgctgctattacattaaggaagcagctggtgagataatgtatgccaaagtgctt

SEQ ID NO: 903 - DNA, 1587 bp, Homo sapiens
caataaaaattattagcatttatgtaaaacaaactagctatcacttatcaagcacttagtgcatgtaaacatttaactcttatcaggtatcaggttaagtattatttcaattttacagattaaaaaaactgaggcttggatatgtaattttaagtatttgtgtctgaacttccgaagggcagagatatgccttacttactttagaagcccaggcaatagcactatacctattacatagtagatacattgtcgtctttcaaaacttttgcaaataatgtgtttgtggcacagtaccaatttaaaaattaatatgatacacgacatacttaatacatggtatcagctatgctccctagaaacattatttatttcaaagtacaaaatgaacgagatgattctttctaatcatgttgacaatactcagagcttattgaaatattttgaaaacagccttgggtattgcattaataattagttaggagaccattttacatttttttaatctttgctattctttctataggaaaatcaggaaaaaaagtataaaaatcttactcatttttccacaccacagactaaggctggcaaagtagtgctgcaagcagtgctaaccatctccaatgaccaggtagctacataacccatgtaacctgctcacattatattttccttatatgtatgaagtggtttattgtctccacagtgttttctcaaccatttcattctcacaacagcactgaaaagtaggaagaaataagtcaatatttttcagataaggaactggcaagagaagccacatggatagtgagcaatgaaagacagagggagagacaggaacaggaaagagagagaagggtggaagaggtgaagggagaaaaaaacactaactggtgttatggttctttgcttttccctcagcatcaccatctccttagcagtatgcaaaggagagaaaataagtggaaaaagagacaaagaggaatgaagagagaaagggaaaaagaaagggagggaaacaggaaagaagggagaaaaatcagtatgagtgaaagtatctaagtgaaccaaaatcctaagaggcacaagaaggagtcactgcacccccaaatctagtgccaggtctcattttaaaaagcatgccttagaaacagaagtacctccacctctccatataccacggtttgcagatctagaaccagagggtggttccacataaaggtggtgcttatagcactgtagtagtgtgtgttactgagatgagacacatgcctttaaatcaaaacaatagaaatatctttgaatcccttctgctgccacctactcctctacaacatttccaagcttaataggaaacaaacgatttcctacaccacccattgaaatcatcatctacgatagaacacgaagttttccatcgaagcaggaacattgaaatcgaggataaaaggtttgagaaaattttgactcctggtactgaatcactatgagtaaaatctttaaagactaattaacatgttaggataaaagtatataacaaaaaatgaaatgcacagcctttggtgattctgccattgccatcacgggact

SEQ ID NO: 904 - DNA, 4350 bp, Homo sapiens
ttccccaaaatgttatcttgtaccccttcctactcctatttatcatttctagccaaggtaatgtacaatccatttcataccagttatatacataaagccatgagctcaatttcacaaaccacatgagaaaatttgccttgttaatttatatttgcttttcatacaaaataatatttttaattagtagagatttagaatcttgtcaataataaaattagttaattcagtgatgctaaagagagtcaaataaggtaatgttttactttaaaattaattacctgtgcacattctttaataataaagaagcatttcacttattttgtaaaactgccgttaaatatttaatattttaaaacatcctgttaagatttgcttttgtccataataatcaccatatttacaacattattctccattgcagctcttttctttgaaagcgggtggcttgaatttcataattagtaaaatagagcatcaaaatgcaacttttgtcaagatcctaaaagaataaacttacatcagaataaggtccaaattatactggtgttagagccaatgaaatcagcaaaacaggggctccctcttagtgctccatgtacaactttccctttagaggtcttcacctcaccatcagagtccctgaagctgggtttggaatcagcatttgctctgagaaatgcaggaaaagaatgagcttatctttgacaagaatgttaatgcaaaagagacctcaaaacctgtataaccaatttacagatttgaaccactatcacagctctaccacttactagctctttggccatttaagctgtctgaaatgcagtgtcctcatctgcaaaagtggtatgataataatgcctattacctagaattatcatgaattaagttcttagcacagtgtcctactaaaagaaagcaattcaatacagacaaaagagccaaatgaatacacgaatttattttccctccttcctgaaaccatatgatattagttgcgttgttttgttctgttgttttgttttgcattactttgattttttcaatatgcaaagccgagaagagaaaagaagaggagggaagaggaggggaggggaggggaggggaggggagggaagggaagaagagcggcaaaagtttcaaagccagaaagtaaataattgactaatggtaactgacagcaaacccaagaaagcaaaatacaaagctggtactgggagaagtgagaagcaaccctatctatttacagcaggtaactgccctcctctggaggtgtaggtgaaactaaatccagaagacgaaaattggtcaaaagtgtttttaagaaccacttatctcaccacgatattgtcagatgagctctgatatggtttggttctttgttcccacccaaatctcatcttggattgtatgcccataattcccatgtgttgtgggagggaccagtgggagataattgaatcatgggggccatttcccctatactgttctcatcataatgaataagtctcacaagatctgatggttttaccagggggatctgcttttgtgtcttctctcattctctctttgcttgctgccatccatgtaagacgggacttcctcctccttgtcttccaccatgattgtgaggcttccccagccacatggaactgcaagtccaattaaacctctttcttttgtaaattgcccagtctctggtatgtctttatcagcagcatggaaatgactaatagagtaaattggtaccagtagagtgggggcgttgctgaaaagatacccaaaaatgcggaagcaactttggaactgggtaacaggcaaatgttgcataagtttggagggctcagaagaagataggaaaatgtgggaaagttttgaacttcctagagacttgttgaatggcttcacccaaaatgctgatagtgatatggacaataaggtccaggctgaggtggtctcaaatggagatgaggaacttgttgagaattggagcaaagatgactcttgttatgttttagcaaagagactggtggcattttgcccatgccctagagatttgtggaactttgaacttgagcgagatgatttagggtatctagctgaagaaatttctaagcagaaaacatccaagaggtgacttgggtactgttaaaagcattcagttttaaaagggaaacagagcataaaagtttgaaaaacttgcagttcgacaatgtgataggaaagaaaatcccattttctgaggagaaattcaagccacctgcagaaatctgcataagtaacaaggagccaaatgttaatccccaagacaatggggaaaatgtctccagggcatatcagagatcttcacagcagccccttccatcacaagcccagagctctaggaggaaaaagtggttccatgggctgggcccaggggccccgagctgtgtacagcctagggacttggtgccctgcatcccacctgctccaaccatggctaaaaggggccaatgtagagcttgggccatggcttctgatgatgcatgccccaagcctgggcagcttccatgtggtgttgagcctgcaggtgcacagaagtcaagaattgatgtttgggaaccttcacctagatttcagaagatgtatggaaactcctggatgaccaggcagaagtttgccacagggatggggccctcatggagaacctctgctagagcagtgaagaagggaaatgtgcgataggagcccccacagagagtccctactggggcaccacctagtggagctgtgagaagagggcaccgtcctccagaccccagaatggtagatccacctacagcttgcaccgtacacctgaaaagccacagacattcaacaccagcccatgaaagcaggtgggagggaagctgtatgctacaaagccacaagggctgagctgcccaagagcatgggaactcacctcttgcatcggtgtgacctggatgtgagacatggagttaaaggagatcattttgtagttttaagattggactgcccggctggatttcagaattgcatgggccctgtagcacctttgttttggccaatttctcccatttggaatcattgtatttacccagtgtctgtacccccattgtatctaggaaataactagcttgcttttgattttacaggctcatgggcagaaggaactcaccttgtctcagatgagactttgaactgtggacttttaagttaatgctgaaatgagttaagactttgggggactgttgggaaggcaggattggttttgaaatgtgaggacatgagatttggcaggggccagggatgaatgatatggcttgcctctatgtcaccacccaaatctcatcttggattctactcccataattcccatgtgttgtgggagggacccggtggaagataattgaatcatgggggtcatttcccccatactgttctcatggtagtgagtaagtctcataagatctgatggttttatcaggatttctgcttttgaatcttctatcattctctctgcctgctgccatccatgtaagatggaacttgctcctccttgccttctccatgattgtgaggcttccccagtcaagtggaactgtaattccaattaaacctatttcttttgtaaattacccagttggatggctgtttcaccccattgaacatttacatcctgaatgccaagatctttgccttcttaccccatgcacatcacagaggttgaaagccaggcctataacctttccagcaagagattggaagcaattactcaaaaaatctgacctgtacactgaaaaataggatcaaaacaaaatgaaaaggcttcccagagaaacataaactatccagagagaagagattttcaaaatattattattaagatactcggaaacctaatacaagataattcatctatgaaaaagagagcagaatactatttttaaagagaaacattagaaaacaaagaagggcttcctgatttccactctaggcagtgatacagtaagtggagttaatatgcccccgtatgatttccaaaatcacacaaaggccacatgtgaatatcattcagctctgacatcctgctttaacatcctttattcatattcatcttccctgattccctattttggtttgaatgtcccttatgtgactgtacaacatatcctgtgcatatatctttcatagccatatacaatataccataaatttttatgtttagttgtccatctcccacacagagtgtgaagatcctccagggaaagaccgggtatcaccaacacatggcatgatgtctgacatattagtatgtgcttaataaacgtctgttgaatgaataaattgaat

SEQ ID NO: 905 - DNA, 3042 bp, Homo sapiens
taaaaatttggagagttttagttacaaaggcatcaagtcacttggaaaaaagaaaattggattcaactttgaaaaccaattatatgttaacattgaaatatatgtgtgtgaattatattgtataggagattatattagtaaagtcttaggttagtatgagatttagcatactttaaaaaataattttatttgcagaatccaaagttctgtttcaaaacttcaggtaggtgtagattttctcatatatgcgtttgagaccttagatctctgaacttccctgcatgagaattaaatatttgtttttcatgtggtaattaaattccagatttcttctaggcttaactgattctgaaatagttttgggtattatcccatcctcaatcatcctgcaaaacatgtgctatctaatttcttgaatcagtcttctctcaatgaaaatagagatctttcaattaccacggtgtgttatttgggtttattaagaatctcatgatagacagttgctcataatacccaatcaagtgtgagtaagctatgccaatgatgttgcagtacatattaaattccttatattttgagagacagttaacaaaaggatagaagcatatgttttccattaagttgactagaaaatgctttcttcagaacaaatagctgcaaagagcattgaatacatgttaaaatatcttatgtaataaatttcattatgactgttggaagctgctaattttgataggttataattttgtatatctttatctttttatattttcactcaatgatctatatagtcaattttccttttgttccttcccattcagaaacatgcatatttataaaattcttaatgtgaatgaggaatgagtcaatagttgtgtatttcaggtacccctgaaaagctgaatatttatgaaaaaaatagcttactaccaccattcccacctgctagtgagattatataataaaatgaatgctgaaaaccagctagattaggagatttactgataatgtcttcctctcagttgatgaaactggcaattgcttttggaatataattgcctgtaatattaaccattattacttccatgtaatattttgggaggctttttttttctggtgaaagaaagggcctgtgaaaatggcttctgcaaaattaatccaaggtggaagggaattagctgcagaatcctggacaaatacatgttttgtgtgtgcaaaggcattttatagcccattttagtcctgatcaataatctctatcaacttgagggccatgacttaattttaccttttattattggttctgcaaatttatacaccggaggtctatggggtactcacaacctattaatgggtatttttatcaaaggagacttctcagtactttagttcccaagtagaggtggtagcatttttgattacagtgagttcccaaggtctgcaaagtgaagaggtagaactggagctgcccagagctcttatgaatctgttcttatttaggtgatacggacacctgagacaaatttaaaggccacgtcacttcacaattagttcagttatgggccagaagggataggtttagtatattaagtccccaaatatgttattcactgtccttctcataattggtttccctagctatttgctgtgatgacctagcttttaagaagctattgataattttaacctgtttgaaagcacagcagatagacacagtgccattaaatagtggaggttaagttgtaaataatattctatttttacatcattgtattttctttgaaaactctgtaattatactttaataacaaattcctgattttcagaggctgcttttccattgtgtgtcatggaagttcatagatttaatttcttactaatttgaagttaagaggatttcctttgaagtatatgtgacactgaaaagtaagaagaccctgaaatgcaggatacataacaatagtacaaatataaaaattagaatgaaatcaaataattatgttaaataacagcttagtgtccctctgctcctgatctgtaatacgccgtggtcaatatctttttctgtgtcaatgggagctcattaaatgtaaactctgcagactaactgagccatgccatattagtgcttgccaaagcttgacatttttaatacattaataatatgtctgtaatgtaatggaaaactattaatcacaactggttatgtgccagaaatttaagctataattggctgcctcttgtcaagaatgtctgttgcacagtcctgcaactgcctaatattcaaatatcttgcactcttctgcatttttccttgtcagttctctaaattcgatcaatggtgtagtccataattctgtgtaatgaccatcattataatcctggtatactttaatgagaattcgttatattgggattgctgttgtgtcaggagatagcaaagggttcacatatatttccttagtgttcaaatttttcctgtacaaatgtatggtcaccctttattttgtggttgcagtaatgcaaaatgtggttgaggacagagtaaccgagaataaatggatgaggagaatatcatttgttggttaaaaaagaaagtgaagactaatctcaggaagcactcaaatatatttaaagtggtattttcaaactaatattaaaaataaacacacaatgctcactccattcaaactcaaaacagtcaattccgggtcttcaagattatatcattcttgataaataaattactgtgtatttgaaactaagaattaaagttaataatttctgacctaatagattttacactgcttcagttataatgcctccatcccccggccctttggaaagtatttgtttcctcttataaaaactagtaaacacagttgaaaaattcatctcaaaaatgtaaatttgtatcattttaacacctcagattattaattgtcaaattgttggatgtgtctgaaaatatcaacttaaaattactaatgaatctgaaaaaaagcagaaggctatagtagccacaacacatgcttctctgat

SEQ ID NO: 906 - DNA, 1473 bp, Homo sapiens
gacggagtttcgctcttgttgcctaggctggagtgcagtggcatgatcttggctcactgcaacctttgccttctggtttcaagtgattcttctgcctcagcctcccaagtagctgggattacaggagcatgccaccacacccggctaatttttttatttttaatagagacagggtttcaccatgttggccaggctgatcttgaactcctaacctcaggtgatccacccgcctcggcctcccaaagtgcagggagtacaggcatgagccactgtgcccagcctctcctcttacctttctaatcttagcttctctattccctttcctctcacacatccagaaaattcactcttctatgtccatgccacaaataagtttttgcactcctccctagattcttccttcaggctggttgccatactcctaactatgattgctcccttcagattattaccaacaccatggtccccactacccagagcttgcttctaagctgtacgcatcatgggtatttgtctaacctgatagggcaaagtcctctgattacaataaattacgtcacacatctagatgttcggggttctgacatgataccagtcttgaatatgattttcctatgatacttttctggaggagttcttctgccagtagcttctggattaaaagcctagaaaaatgttgcaggtattgaactaccatgttagactttaaggaaaacgaaagttaatgttatgtttgaacaaacaaatcaactccttcccctcttttccatttctaaagcagtagctagtggaatataaatgtttctctttcctttttcaacagaaagatctgcattgatcagcatggtagaaagttatggttaaaatgattttagaataacagacaatgctaattatctggaaaaattccttgattggctgattcattcattcttccatcaattgcataaacactgattgagtaactgctttgggtcagcctcaactctagtagctttgttttaacatttatgttcattctctggatatatttctttaatttgaacaattagtggtggtggtatgatttttgctcttatcactcagacttcataactcttgctattttgtcactcttaatatttatatgacatctagtgagtgattgatcttctgtaggaccctgtagtcactcacatttgcttatcactagcacatagggggcaatccacagatttatggctgccaatagaagttgttaccaaaagtaccatttctttttttttctgtgtgctaatttctaataactcttgtgcaggagagcaattactgacaaaagtcagcctctgttaatagagtttatcacacttcatcatatatcctttgtcgttggaagcattttgacaagcccagggttaattaaaaccaagaagacaataaaatacacctaatcaaacataacaggtacagaaatcaattagcagatttatagta

SEQ ID NO: 907 - DNA, 1707 bp, Homo sapiens
tagaattatacatccacaatctcttttccaaaaccatttggactagacagttatgttaatatttctgcagttaaacaagtgaataggccgggcgtggtggctcacgcctgtaatcccagcactttgggaggccgaggcaggtggatcacttgaggtcaggagttcaagaccagcctggccaacatggtgaaaccccgtttctactaaagtacaaagaaattagccgggtgtggtggcatgcacctgtaatcccagctacttgggaggctgaggcaggagaatcgcttgaaccagggagggggagattgcagtgagctgtgattccaccgttgcactgcagcctgggtgacagagtgagactatctcaaaaaaaaaacaaaatcataccaagtggtataaagactataaatagccttatgtcagtgcaggtcagactttactgccagaaaagttgcatacagtcttttgcttttcagagcttttttgatttaggaattgcagatatggaattgaggatctgtacaaatcttcagacataaataatacaaagttctagaacacccctctttaagaatagtttgtgtggatatcctttatctttttcagataataacatttactgaacacatttttaaaaatgggccgggcgcggtggcttatgcccataattccagcactttaggaggccaaggtgggcggatcacctgaggtaaggagtttgagaccagcctggccaacatggtgaaaccttgtctctactataaatacaaaaaaaaaaaaaaattagcagggcatggtggcacatctgtaatcccagctactcgggatgctgaggcacgagaatcgcttgagcccaggagggagaggttgcagctagctgagatcgtgccactgcactccagcctgggcaacagagcgagactcagtctcaaataaaaaaaaaaaaaaaaagttgtacagttgtgtttcctactatagtgagtgaaatttctgtggtttgctaagaaaaagaaaagagattcacatgacatagtaggctttaccaagattattaaggaaatggtggcaaggtagtggtttcggatcctttgtttcattagaaggaaggatgaggtaagttgaaatagagggtttatgtaattgttctttgcagttgctttcttcagtagcacaaagtgatttgatcaccttttaagtaggtgaaccacaaaaaagcattcaactaatgacagttaattcagaaaaacttcagctgtttgctcccttgtccctccctattggaaaaacttttaactaactagagagttgtttggtcttgttaaccaggaggaggagtttgaagtgtgctaagggcactgctaaaattgcttcaccctatcttggtagagggataattgctgtctgatgtttgtaaaaacacctttcttcccaaaggctgtcaagtacttcttaaggctagcatgtagaaaacccttttgcaaatttcatgtagtttattttatagtgagagggcagcccatcaagaagtaatgtggttcacaagtagaagggaaaagagaagtcttgaggcccagtgcagtggtgttagtgagtatacagtaaacaaaagaaataaaaattgaacccttaaaggcataaaaacatttcatttgctagactatgatacagaagttatcactttcctaatctctacagctgggttcagat

SEQ ID NO: 908 - DNA, 3658 bp, Homo sapiens
atatgactagggaaagctaacttcgtgctaaatctggtgtgagattgggggccactgcagattctcgatggtctagaacttgggtttcacgtgaaatctatgtgaaatgactcagtcaaaaccatcttagatcaaagctgagtgaatgagattggaggttggagacccttgctgggattggaggcccccatatgaaaccaccagaaccctcagaggcttggttcctagtgaaaaaataaaacccaccctgccaagcgaggtggagggaagaataagttcctctcccagtcttggttctgagtggaaaggaaaaagaaaaaaagtccctctgggaatatctacatgcccaccctcctgcaggttgagggctggaattcacatcctctttctaacctccaaaattataatccaaacgtgtaggttaaaatggtcctgggttggttgtgtctctaagagttacttggaaggagatgcaaatcctctcagaggaaacccggacttcacagaattttcacaaagttccaaagattatgcatacacacacacacacacacacacacacacacacacacacacacacacacacagtttccaaactacagcaaacaaaacctgctgccagatcctgccaaatctttttaaaccactggtcagaccacgccattctcctctttaagcccttcctagtactccttgcacagaatattaatttctggcagcgaattccagggcccctctcctcattctgcatgggctgagagtggtcttttcctagccatggtggggattgcctgggacggatcagtgggtgggactgggaatctgggctctatgtggctaattcagggtctaatttgtggggccccagggagcagctgaatgcttacccaggtgcacagctggcttcttgtagtgttgctattatgggattactggaaatggcaaactgagcatcaagcagcaggacctctttccttggactctgagggaaagttagcagcaacagctcatgctcatggcaatcttaggctggaggaagggagtggacagtggaggggaggatgctcctattgtgaggagcatccgtttcaaagctctctaaaggataagtctgtattttgtggtcattcctagccagtttctaaagttattttgtaagacccaaatatctcttctaacatttagcaagtagataacacttcctgagcactgcctctgtggagaatgtataaagagatacaaaggaacacaggcatgtgctccttgactttaaaacgtacttgatttccatttccccaaagaacaaagaattagaattgttagagttagtgatagaaggatcaaaaatatatgaaaggagctataaaaactgggacatgtcaacattgttctatttgctacacagcagtgtttgttaaaaaaatcgtatttttatgtcaagatagaaaataaaaacagaaaaatcatgcgcacatgagaggttagacaggagtagcagggtttgaacagcaggccagggatggccttccatgtctcgggtcttttctacctttccatcttcaccacaggttggagtagcctagctttctccttgcttgtttcttaagtcttcttaaaactgttctgtccctagagcctgtcaatcccaaagccttcttttctatttttctcacgtggcctaggggccctcatgcaaacaggtcaccctgcagcctgcctacacagtccagaggccccaagagggttttgcagagaagccctgtctagacatccagtgtggatgtcaacagctgagggcagtttgcctgtggggagggctactaacacaaagagggacccatcacccaggaccacagtgttgtcaagggaagacactggaggagatgtgctgtcagcaatgttctgccagtggtgagtatctttacttggggggcagagggtagagagagacctggaagaaagcaggattgagcaagactgaagcatcagaagggagggggcaaacaagtgttctggggatggtgatagatatttagaacttgagcccctgctcctatcatcatgcttccttttctctttacttctccctcacattccaaatacacctgtagctttttattacacagcactcagggggtgggtggatggagctggaacaaacaagcccattggatttttgatggaatattctttcttgcctaacgtaaataataagttgaggattttaaatatatattttttaattctaaaaagcttggctttaaatatcaagatccaaagtctagatagctgagattttagacagcagaatgatataatttatttcccactgaaaggagagaaaaacgtgacaaactgggggaaagaggagaaccaaagtggatattgctagagcttaggtgttgcctgagtttccataaaggagctcagaatctccattcccctgggatgaattaggggacatggggtgggactgggtgattgaaacaataaatggattgaaaagagttccaagaacagcagacacttgtgcctctcttcctggtctgtggccaaagaccaaatagtatagtctttccccagcatggcacttgggctgcagagtagcaacaactggggaaagtcgaggttggcaggtctgaggacagccttatggagtcccacagagtgttctgtactctccagcgtggaggcagagagcatgcaaataattcccacggcacctgcaatggctgcagaaggggctggtaacaagctgggaggccctaagagcctcaagttggtctctacaaggaggctgcagaatatgcatgcctcctggtgagaagctatggcaggatgatgaatggtgaggaccagagaagatgagatgtccctctgtggagttagccaggacagaggacaagtcaacaatcagatgtctctcttagaagccaggacaacacccacctttccctaacgtaggaatttagagcatcctcagcaggaagggaaggaaaagagatggagagtgtacatgtcacattaactgtatttatcaataagttcaaaagagactgagtaaccttgaattggaaagattatgatttctgctacagaggaggaaatgagggctcatgaactaagttctgttatagacaacaaaaatatcgtgctttttgtgcagtctatggttgcacaattttatttgtcatacagatttgcctcgatggggtgaagacaccaaaatgaagttgagtaggagatgaatgtagagaccttgagaggggaagaaagctcaaggcacataggagctaataatgatgagaacttgactagtttccaagaggggcctgggaatgggagaaagcatgctgatgttgcgtgttgcacagtgagggctgcaatcagactccagccaacttttgttttccgacacattgatctgtttaattggtgcttcttgtcatgccctcaaatagctgtttacagagaatcatgatgaacccaagaatggcttcagcctctccaaacactcctagctctgagtatgcaaagccatctattagcgctgtgagaatgactcccatacatatgacatggagaagtgacagttgtgcttctccaggtactgtgcatgacccaatagggccagacccagacatcactgaggctttct

SEQ ID NO: 909 - DNA, 1373 bp, Homo sapiens
agagaggtagtcaagtggcatattgcaagacaaaatatgtttgttctcaactatctatatagtctttatagccatcaacatttgcaagagaaaaaaaattcactaagggcatgttggtataacacttttttctttctctcctcaggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaaaggataacaagaatattaattttgtgacccatagttcatgaactttaaaagtgtttacagcatttaaagtttatttaacaatttaagtatttgagcactatactaattcatatggttacatttgatcaactccttcatgaagccataggctttatatctcctagctgccttttaccttcagaacaaatctggtttatacttagattgctccaaaagttatgcattttaattttatgttgaaaatgtctttcttagataatcacggtgcatatttgcagctaatactttagtatattttatattattggtaatgcttttgttagccatcctggtgctgccttcttataagagctatgtatgagaaccaactaatatatttcttttttttttttttctttttcttacctattaacccactaaaatttctaatctaaaagcaatattcaagttacattttattacagaaattggaaagcaatttgcctgggaagcaaaatgttgatatgattcaggtgattttaacattaaatctaacttgtaacaaaaacggattatataaagataaataaattgagactattatttgcatagcaaagaaagtcaaacatgacccacacatttatgcacatataattaatttcaataaaatgtttatatttattcattttcatctctgctatgtttgcttttagagttttctctttgaaagagtctaaagttttaaaaatacctgtgtatgcaggaatcttcacattttattttgtaagatcaataatgctgctaaataaactggggctaatgtgttcaagtctcataaaaagtgtgttggaacttgaat

SEQ ID NO: 910 - DNA, 1841 bp, Homo sapiens
gagtttttaaagtttcaatgctaaaaatcactaatacttaatattttctaataccttaacaatgaggttttggaccaagtaaaatatccaggcaattgtgggtttgcttataagtgcaaacttaggatttttattttaaaaatttcttttagatttgaacatataaaattttaattcaaactttttttttttttttttttgatacagagtctcactctgtcgcccaggctggagtgcagcggcacgatctcagctcactgcaacctccatctcctgggttcaagcaatactcgtgcctcagtctgtcgagtagctgggactacaggcatgcaccaccatgccctgctactttttatatttttagtagagatggggtttcaccatgttggccaggctggtcttcaactcctggcctcaagtaatccacctacctcggcctaccaaagtgctgggattacaggcttgagctaccatgcttggccttcaaacactttttctgtttgtgctttcagtaaaattttattaagagtcttccctgtgtttggtgctgaggatacaatgagaaatcagatgatgttgttggccttttgggggatctctgctgtcacacttggctgattttactggaattgtttttgaaatttttttttatgcttccttccgtttgtgattagaggatatagaacatgatctcttaataaccaagtaattatgaacaacatttttcttgcacttaggaaccccgaggcaatgagtctgccccctccacccctccacgctgctgtgctatcgcaggtggtccttctctgttcgctttcccagatctccctatcatttctccccgcccaggttctcttacttccctctttctaccattgtgtttgtggtagagcatgctggtttgttctttctttgccagctttcccctttcctcttgtctgtctgctttcattttcttgccacttttgcattgcccagccttggctccagtggaatttggttttgatcatcattgccagcccagtgcaagcacttgttttgttgtgttgctttgaacagttggattcatcagatcaaatgaaataatttacataaaatgtcacagagaactaaaaatgtctatactatttatatagtgacatgtataaagggaacttgtctaggtttggaaagctttttcaaacccagtaatttgctatgtaaagtgatagcttaatatctgaagtattgctattctttcttacataaaaaatagcatgacacgttatcatcaaaagtatagtttatactgtatactgtttttaaaaagcatcaaaaattttatcctcctttcatagatttttaagaaaaaaaatgatcacatgtgcattgtcagacaacacattggaaagatttactcgtttattctctcattctgtaatttttattgagtgacttctctgtgagggccgcattacagatgcagtgactgaaaatacacgtaaggatttttatgcagatgaagcctgcaatctaacagtcgtctggcaccaagtgtgttgtctttttgctgaatttgaacatcccatagtttttggcaaaggatgaaattgtattataatacctataatacactgacgtgatgattttagtgtcagaacccaaaccccctttactcaggaacctgatcatgcaaataaatcatgtgtttgtttggttctggaacctggaagagttgcattatcttctctttaaactcttcagctgttcctcctgtagcctgagactcagagggagctcctagcatccaaacttgaacgaaatgtgccatgtaaactcagagtgccaggatgacccacggg

SEQ ID NO: 911 - DNA, 1407 bp, Homo sapiens
gcatcaccagatgtccctccagcccccagatatctgcatcactggatgcatatcttccttcaagcacttgctccatggcccgtctatagtgacacacacagcagctcctgccctctgtcctccctccgtctcttgccttgcgtttatttgtgtttccttccttgcccgccatgctgcagcctgactgctcatttcttccttccccacaggaagctcagctccatgaggcgagaaagcctccttgctttgctcactgctgcgctcccacagtcaaggtccttgctgggcatgcagtagtgctcgatgcatttttgttgaaagagtgaatgaacagttagggacagctaaagctcgcttccctctgcttgcttcagggtttgtgtgctaagcattaatcatccccatccagggcctaacccaagagtgtaccagtcccttcaaactgtcatcattttaagctctccttgctactatttctggcagtctctgaggagaagtcaaatggtgaacagtcttgaaatcaagcctgctctgtgattgtttccagcacagcagcacggcccccagagaactcctgacactggcaataaagagcggctgacctcagagtagctgtgactcatgcttccaaatggaaggtgctttatgtgctgcaaaggcagcttttatgaatatgatctattagaaatcattaaccattccgaaacattctttacgttaaaagtcagcagagttttcaaagccatttctttaattattttatcatgtttgttggagcccgaatcgtaaaatttgaacttttgcagtgatctggccatgtttatatttagttaactatatttccgaaagaaagaaagaatagtgaaaataggaacattttggcttctggaagttgtaggataattttataaaggtaattattcacaatccaccttagcagaacattttctgttgtgatttttcaaattagtttgattttcttccctggtttgttttgtttttgtttttgtttttattgtttttgtttgatgcatccaacatttgatggtgtcccagtggatcatgccatccagatatctatttttttttcctttaaaggtagtggattgttggcactgaaaataaactataatttttgctatggttgctgttttaatgttgtatgttaatgaaaacaggctttgacttacattcttgaaaagggagagagatgagatgatttgatgaggaagaggctgagatttctctcactgaggctttgtgagctgtcgtcacagtgtgaaggtgacagtctccatctcaattgcacaggggccaactcatcactgctcacttagagcagctgctggtctcagttcgagcagcgagggaggctgccaatactcctgagtgataggaaccagcagg

SEQ ID NO: 912 - DNA, 1936 bp, Homo sapiens
gtaatttaaattattttctttagtgctctggttcactttcaaaagtgttgcagtttgtacattacattatgtggttgcctaactaagcattatcaagtacttgtatatcagatatggatgtggttatgaattgtgctatgtcaacctatcaacagagaacagagagtttctgccaggaaatgataatggacagaactagtttccaaagggccttaaatgccctgtatcaagattacctaaccctgtagatgtgggagcctattgtggttttgaattaaaaagtgatatgacaaaagtggtattatgggaagtttaaataaggaatgaatatcatgggtgagttatcagtggcttgagtggtaagcatggaaaacatagaatgactgaagcctcattacagaggaaattttctgggacttacacattgggctggcagtattgagggagacgttggaatcagagaggaggccagttttctcaattttctgattaaaaaggaaaatgtctctattgatagccatagggatttaggaggaagggaaaatatcttttgccagcaaggtgatgtggttttggatgttgaatatgaggagatggtgctgtattgtagcagagattgttgctagtccattggagataaaagccctagtgaagcccaacagtgaggcctgagcatgcagatggggcttttctgtggaagttacttgaaaccatgaaagtgagttcttcacagaaaactgtgttggaagagaataacaggcaatgtcctgagctttgggcatctcctgaagttggaagaagataggataaatggcaccagtgaaacaggactcaaagtacatcagagtcttggtcagagggatagaaggaaaccccagcaaggggttcatggcacctaaaacaagagcaaatgtcagcgagttatgtcacatgtagtgataaagtgcagagggctatgaagaggtcattggatttggagctcactgatgacattcaaaaacagattcaggagagtaaagggtgagtgatagatgaagaaatggagatagaatctatagactgttccttttaggagcacgtcagagagatgagagacaaatgtagagtgttgtactcagaggggcagaaaagtcaggtaaaacatttcaagatactggagacctttacatggaggaaggcagaaatgaaagactcctgtggataaaggagagattgaatattgtaaggagagaggggagataaatagggaatatcattctaggggagagtggaatgaggagaagagatgaagatattagctttggaaataaggaatagtattaaaaatgagactggaaaatgagaacattaacattataatagctatttctattcattaagcatctatattctaagctcttatgtaagtatgaactctttgtaaaccattgaggtattgagggggatacaggagaattgtgttaagacacagactcctgccctccaggggtttatataggttaaatggagagaggaggcatgaatagcattgtgtgtagccaaggaattgagtgaataggcaacatgctttgggtgcctggcaatgcttttgggtggccttgtaaataaggatgtgaatggtcagaaaaagcctgatggaagtgaatattggtgtgaactaccaggaatggttgggatttggataggtggaaaaaattgggaaaatatgtttcaaggaaggagactagcggatgtaaaaaccaaccctgcagagagcagtttcttggtaactatcagttttggtggtttatattttattcagttataataatgagaatagcaactaatgctgagtatttactcagtgccaggtactgttctagaagcattttccatatatttttaattctctgcagtcactgagttacttattgtttttaccctactttcataaatg

SEQ ID NO: 913 - DNA, 1382 bp, Homo sapiens
ttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagt

SEQ ID NO: 914 - DNA, 4030 bp, Homo sapiens
cagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataa

SEQ ID NO: 915 - DNA, 3450 bp, Homo sapiens
cggggtctggatctcagctgctctcacgcatcccacccctgagcagagcagcggagacctgggctgaggggcatgctgcgtccaggtgggttctggggaatcccattcccagtccagcgctaagtcactgtcgtcgaggcccctttagctgataccccaatcaaaccctttcgtccaacctgctaccaatattcaaattctaatagacaaagtatatcatgggcatgtaccacgttcacagctatttaaaagcacagcccccctatgggtttaggggctcccgctttagaggatacttggggaaatggcttaatttgccttttctaccatccctatgaaagatctgatacacgtgctcccttgaaatagtttttgccactttacagaaaggaaaaacgtatttggatcaaccatcgagctgtgttcagccaagtttaggttctcaagtacaatgacccgtgtgaactggattggtctctttcccatttggaagggaggaattaatggtatcccatgaccgtagatgacgctgggaaatagagagagagaaagagagagagagagagagaaacagccccattcccctaaaggctgagtcactggcctcgtgctgtatgtagtaaattaaacagcgggctaatgggataacgagatgccagcaagcagaagtgcagaccggacaacccatgtccacagttcatagctatagcagccctagagtaaatacacatcataccaattccctctatgtgttctgatgtccatttctctaacaatgggttcgtttattttctattgggaaatatgcagggctttaggagacaactaggaaaatctgctagatggctcatgccttttaaaagttagcagtcttttaagaaacatttttccaagcaggttgagagaactctgccaatcccatcctcatatcggcaaagttcccacaattttttttttatgggaagttgtctgaaaaaaagagaatgggatgggtacattcctgaacacaccaggcccagggacaatggagtaacagaatcgtaatgaggaacacacagttacaacacagtcataagaagtcatgttcatgtgtgtacggagggggaaaagaggcttaaaacaagaaaacactgtatttcctccctcagtctctgtgagcaaagtactacaagcaggagaggatggggcctgaggcttctcaactccttttcaggaaggcccgaaataatcccagtacctttcagcaaactgtgtctgtgaataaaccacctcatttccttatttctccaattggaattatacctaagccatctcccgccacttcctttcaagttctcacttctagcattatgattatatacaatatgtacttattgcatatacaaaaatggtatttaaataaacagttctatatctacagaatgccctgggaaaaactcaactacttcacactttctgccatggccagtgcaaatgaagaactgtgttcacctcacttcttagcaacctttgtaatgtgttggttccagcctttttgtaggtcctaaacaaagagaggatagcaaatgggttcaggaaggaggtaatataggcactggaagagtttctggtttaaaatctgtgagaaatagaatttgcggtattcctgtttattaagttgttctcaaatgaagattaaaaagaacattttaagcatcagttcaggtatgtagagaacattccatcagcacgtcaagcctgttacaaaaacttacttgaggattttaagagacattaatgttcttagtagttcctcatttaaaaaaaaaagatcatgaattcatcttactattggaaatgtgcatgttattttatattaagattttaaattttagagttctggatacaaaatatcatttataagtgatatcatgttggctaggttctcatgtttctattgttcatcagcttcagaaataatattttatcagaaggcgtcaataagtcaggagactaagtaacctgaagaacccatctcccagtaaatttatttaactttgggaccatgtaaatcaaacataatctgtgatttatcaccagatgtttgcactcctccccattccccatttgatttaagaaatttgaacagacaagtgtacagtatccaccattaattctgtctgtcaggatgcaaaacctaattacgctaagagcagcatatactgagaaattaaaatgaatactgtatataaaacctacacagttgcactcatagctcctaataaaagagtaatagggacacacagaggttttatggacatttaatagggtggagtcgaagtcaccacatctaaagctggcatggcactggggaattatttctatctgtcttgagcagcattttggattcagttttggagaaacctaatccaaaacacatacagtatatcttttctaagttcagtgacaaacatcaagttctcaaggtaccgcacgcccaccccaccccacctcctatgtaatattctccaacatcctttctcagtggattcctctagccccactctctccttcccacccaaactggcttttcagaaaacattgactttctttatactttagaaagataaaactattcttgcctcagataaaaggcatgacatgaaaaggccacctcacaggcactagggcataagaactgagcgacaaaaaatgctaccacaagaagacaacagaacggcttttgttttggttttttacaaaaataagaacaatgtcgtattcattcatctacactgggaacagggacacgatatcacagaggtatgtgtttagtaaagcaaatagatgctgcaacatgcagtatttgtaaaagtgacaacacagatttctaaggatttttaaaatagacctaactggctggtcagaagataattgaagggtattcccgcccttatttgctgtcatccaggaagaccctatcaaaacacctaaagtaatctgtagcatctagggttcctgggatctcagaaccacaaggcaaaccactatgcatctcaggaaatcagtggctgattccaaagatttcactatgtctggctacacccctagtggctgctttcttttctttcgtctctctctttttttctccctcttttttaaacaaaacaaaacaaaacaaaacaaaacctgatgcctttgtttccagatttttagatttcaaaagtggggttattttgttatgagaaaagactcttacatggaaaccaaagagctgattttttttaaaaaaatcttttttacattatgttctaagataaagcaaggatgggagaatagaaaagaacttttagacaacaagaacagcaaaaaatttaaaggaaataaaagtttaagatgctattaccagcaagttttttcacttatgtttgaatggatttctgctaagagatggagtaagtttttaacatc

SEQ ID NO: 916 - DNA, 1849 bp, Homo sapiens
ataacaaaacaacaatgacaaattaatgcttactgagcacttgatgtgtcaggtattgggctaagttctttgcagacattattctttattaaattttcatatttctaggtgaaagagttgttgacacatttgacactgaattaaaaaatcattattggaatgagatagtgacataaatattcctttagtggccctagaggacagggaggatccgaggcttgggtttacaagcctacgtggagactgtgagacaattacttagacttgtctatggagcaaggttagaattaagacttctgtgtgaagacagggctcttcaagagctgaaccttggtgaaagggtagaccagaaaacaaatctaccccttggtatagggagatgataaggaaacctttttatcatggcatactaaagtaaaatacagttttacatttttcaccccctatccctattcatttaactatatattgggcattatttcttatccatatataaagcacctctttattagtatcctattaaacaactataaaaaatgacacagtgaataatttggtaaatgcatgtaagtatataaatctgtaggactgagtccctggagtggagctgctggatcaaaagacatgcacatcaaattccctcctcagaagttgtatccatttatagtactacagcaacaaccgcgtatgtgactctctcgccacaccctaagaaacagtgtgttggtaacttctaaaagactagaaatcgaatgtaaaaccccttttaaaagaatagaaagagaatgtaaaacaaccatttgctggaaaaagaggggaaaggggatttaaaaaacaatcaaatagaagacagagagactaaggagatatgatgattgaatgcaacgaggtatcctcaactgggtcttaaaacagaaaaatggcattagtagaaaaactaatgaaattcaaataaagtctacagtttagttaatagtaatatatcattgttaatttcttgttgtgacaaatgtttcactgtaataaaaaacagatgttaacattaggagaaactgagtaagggcacacaggcactcttaaatactgtctttgcaacttttctgtaaatctaaaattattcccccaaaagtttatttaaaaaaacagagcgaaaaagacaaggctatcccagcaggggaggaggcagtagaaggaaagacatgaaggaagaaaatagcaccatccacacaaggaactacagggcagtttggtgttgctggaaagtaaagttgtactcttaatgtgtaagttgtttcattattccattttccctgccattccctttaaaaatctaggtttacttaggttgtcatgttttacagaaaaagtgtgaatttaggttttatgttcactttgactaggtcataatgtcattaccaaagcactctcattctggcagcacttatgaagggactaacttcgctcattaagtcagtagacctggcacatcagtgaattggttttcaaggtacagtatgtgaacagccaagtggtgattattatatatatttgacatctctgtcagtcaattaaataatgtcaaaagcaaaaacaagtgttttaagatttgggaatctgccctcttaaccagaagcaaatttgttagataggtaggaagcaatggaattgacaaccactatataaaaccaaaagaattatatctgcattccatacattcatagctgtaatgctaacattttaaaaccaaaatataaaaaataaaagataacaaaacaagagaagcaaataaaaggtatgataaatagcacaataagatgttaaaaaggaaaatatgacagcaatgatctaa

SEQ ID NO: 917 - DNA, 1951 bp, Homo sapiens
cttattggttttattccagacacactctttcctttgatctcccccatgcgggatctgttttatgaatgcccttcctcccatctttgcatagccatctccttttcgtcactcaagtttcaatttagaatcactgcctcagagaactcttccctgaccactccatctaaagaaggcatcagatcattatcatagcacctgctttcatgttctgccatggcacatattactactggatattatgttcctatgtatgtatatttctctctcttccccactaaaatataagcttcatgagaacaggggtttcaatgcttctgtcccacctagaagaatgcaaggcattaaaaatatgttcattaaatatatgtcaaatgaataaatgaatgaaagactatgtcacttgccaagtgaggtttttcagacattgaacactagtgtttctagaagagggaagaatcactctaggctgaaggggagaagaattgattagagaggaggagatacctgacttggatactgtagatttgcaggatttatagctatggaaagaaggatgatgagtttctttcaggtaaggaagtatttggcaattaaatgatctaatccattttggcaccaaaccagacattcaagtataggtgaatcctttaaccttagtctccacttttggtcttggaggcaaaactacttgccattctaaagtagaggtaaatctacttgccattctaaatctgtggttcttaaagctgttttttgttttgtatttttcctgatcagagaactttgttatgtcactcaccataacaaaagcagcatcagagaaatcttgtttaaataactgcctctttctctacaatatgagaagggggaaaacattttttcccttcactggcaaagaagatggttatggctgattaatcaggccattagatacagttttgctgcattcagtagaagccatgatgagaatttagcttgaatattcatgttataagtgctacatgagtttggaatgcttatagatttgcaaaatttgagagctaaaaaggaccttagagatcactgagattctgcagcccatcctccctagcatttatcattttacagcttaaaatgccaggacccagagtagtaaagtgattggtttatggttacattggtagctggtgggcaaacagattatcaaccccacccttgtgattctccgtccagcggtctttttattgaaccttagtgagcttcatgcatttggtcatgttacataagcagaaagaaaatctggaagcaatgactaggcatactcatagaagaaaccccatcatcattttcaaagtcgcagtggtgaaagtgagaaatacatattgagggaacttgctggcatttgaaagggaataaagcagtatttgtaagcccttctaagagtaggtagagtacaaattagggaaagtggatgctattgttttactacctctatatattttctacattatccaaaaactgccatgctgaaataataacacactgctataattttgtatcatttaactggcagtacacagtacatggagatttattatttttactaatgagtttagctttgctgttgcaaatagtgtcaaatgtcattcttttcatcctccagcagatggcaactctagtcttcttgtcattttatctatttctatacttagaagatgttgtcctctgccatccctgccccccttgcctctccctgagaagttcatctttatgtactgctcagggtgatatgggtaagtggatccatccctctgccaatggaatcaactccattagcatctgactgtgaaggccaatctaagtgtgcctagaaataacaaaatcacaaattagccaatagttctaatttttttttaaaaaaagagagggggagaagatagagattctaaaataagatgtaccacagaaaact

SEQ ID NO: 918 - DNA, 1571 bp, Homo sapiens
attaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaact

SEQ ID NO: 919 - DNA, 1385 bp, Homo sapiens
attttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctg

SEQ ID NO: 920 - DNA, 1974 bp, Homo sapiens
tctcctgcctcagcctcccaagtagctggtactacagacgtgcgtcaccatgcccagctaagtttttgtatttttagtagagacagggtttcactgtgttggccaggctagtcttgaatgcctgacctcaagtgatctgcccgccttggcctcccaaagtgctgagattacaggcgtgagccaccacgcctggcgaaaattaagattctttatgaccaccaccactactattgcagatggtgctctgtgtcttgaagatggcaagaccatgcattgtgtggttgaagtgacagatttaggttatgttcttagcacttccacttattagttgtgtgacctttgcaaataaacaacctcagtttcctcagcagtggaacgagaattaaaatacctgcctttcaggattggatgagtcttgctcatataactaactaatctagagtctgtcccagaccatagtggttttcttcatgaaaggttttacatatgtcatcttattgaatcttgaagaaactgagtcatagaggctaagtgactagttcatagtgacagaataagattttgtttggaccgggcttggtggctcatgcctgtaatcccagcactttgggaggccaaggcctggctaatttttgtatttttagtagagacagggttttgccatgttgatcagactggtctggaactcctgacctcaggtgatccacccgccttgtctggtgctcaaaagggggaagtgggccaggcatggtggctcacacctgtaataccagcactttgggacgacaaggtgggtggatcacttgaggtcaggagttccagaccagcctggccaacatggtgaaaccgcttttctactgaatatacaaaaaattagctgggcgtggtggcaggggtctgtaatcccagttactcgggagtctgatgcaggagaatcgcttgaacccgggaggtgaaggttacagtgagccaagatcatgccattgcactccagcctgagcaacaagaacgaaactccgtctaaaaaaaaaaaaaaagattttgtttgtacgttttctgacattgccttcaattctgtaatattgctgcacatctcataaatgcaaggcaaaattgttttaaaagccacatttttagaaactattgacttgaatggttcccagtcattttcttgagtcactgaatgaagtgttttgacttctgatgtgagatattttataactaagtttgtttatttgggacttagacatcatgtagtgaattctcatttagtccagctgctacttgaaggtatacatgaatgattccacctccaccataagtgcttaagtgggaagagcaatctgctgccttggtgtattcaacattatccttttagcctgagagtagtagagatcatatatagaaatggggtgcatatgttttaagaacttggaaacaactgcacctgttttataatgctatagctgctacatttctttgattttgtatcttacaaaaaatatacacatctgagaaaggagaaatatatttatcaattataaaaatttaaggtttttcccattcagttttttctaatttattgaataatgtgtttcatattttaaaatatggaaattgaagactttatatcaaatattaagccaagcactcataatgtttttatttccttagagcaataacaaaaacagctgtgagctcagaacttagaaccgaagtggaagagaatcagaaggtattcaccgatagaaaatactgacctgttttgtattctatctttaaagataaggaaatctgagtttaatcagcagcatttaacagtgtcactcttcttttatctaagatggtgattttttcatttctgtgatctttgcatttttagtttttaatgaaagttcagtatgcacataactgaaagcatgaagtggtgctaccgtgttgtttaggaaagcagcacccctaacatgtctcacc

SEQ ID NO: 921 - DNA, 2019 bp, Homo sapiens
gcagtttagaaatagctaatatttattatttctatgtatcaggtactattattctaagtgatttgtatatatttactactcagtctccgtttaccttttgttatttctatttaaaaactgaggcacaaagaaaaaaataactttctcaaggttgcacaggtaggaagtagcataaccaagatccaatcccaggcagtctgattccagcatcgaagtgcttaattacatacagtaatgtagcaaattaaaattcttaatttgctacacacatttatcaaatcctatgattttaaatagagtttcctgactgggagggggaagcaaaggagaactgctaaaaaaatgcaagaatcaaatgttatactgctgtgttcatttttttaaaaatcttttactgtcctcatgagtacaaagaaatgtgtcaccacccagatacacactaaattggatgttccagaaatggatttgaattcaaaattcaaataagagacatgggagaacctaatctaaacaaaatcatttgagctaaacacaaagctcaaattaattgtacaacctagaaatgctctctgaaaggctaaatctttggattttcatactatttggaaaaggagtaggttctgttaataggacagacttcgtgcaacatatgttaagaaaaaaaattggaagcacttaaaaaatacaagcttggaagctcaatcttgcaaaaatggaaaaaaattccttaaaatattttggagcttttaggagaaagtcaatattaaaattagtacggaacatagagaaagggctttatgagtcgagtgactgttgtttttctaaatgtcagcatggaaacccaaacagaaagaggtgagttgggtccctggaaagactgactgggaaagctgagtgttaagtttgtgacgtggttgatggcaaccaaaaattgtcaagtgcatgatgacaaagtatttcctggaactaggggctgctttaagacatataaacaagggtaatgttgtgggggcatgtgctctaaaccaacataggatctatatgtggttatattactagcagtttgaacaatgtcagacagagctctctggaatttggaaaccaataacagatagtttgagctgtatactgaattgacaatccttttgtacagcagggaaaaataaccaactttaaaacataacttatactgtacttttatttttgcatcatggaaaagaaccggttttaaaatataagttgcactctgctttcatttaatgttatggtcttgaaaatataatccctatccattaacaaaggagtaactttgttgtagctttagtgtctctccctgaaaatcatatttaattcagtaattaattttaatcaaagataactttgtctaaaggtgtgaccacgtactctaagtcaggcagggaagtgtgttctattttaaggttaccaaacctctctgggccttagttttctcatctgtagaaaggaaggattggtccaaactgtctataagagtttatggagcttttttttaaccctcccttgtaaccaaactcagatggtgatattttctagattggctattagttccagtagacgaggagcctagaggtgtgtgtgtgtgtgtgtctgtatcagacacaaccacaatactaacatatatacttatagaaattatactcacaaatgaatacagtgcttgagaaatttaccacactgtaaacaaaataagaaaccctctctttgaaaactagaaaagggctgggtgtagtggctcactcctgtaatcccaccactttgggaggagcacttgagcccaggagttcaagaccagcctggacagcatggtgaaacctcatcactataaaataaaaaactagaaaagaaacttgtctagttttcccaacatgctctctccaaaacatttttctccccatgaaagtaagaaaagcactttgtaaaatatctaaaacatcaacctaaatagttgtgactctttctaaagctttggctgtttctggc

SEQ ID NO: 922 - DNA, 1663 bp, Homo sapiens
caggaactgaagcaattagaccaatacgaatataattttctaaaactgggattaagatgggagaagatttgctctgccgtgtaagaattgggagattccctttagccaaacttttcacactatgaaccagagaagcagaaaaagctaaactagaactgaagtaataatgagtaagaatgaagtagctataatgagagaagaaagatggagagagagagggagagaatatttgaatccttggttgcaaatcatttctaaagattatttgttttccattgcttgccttatgagacacccccacactcttaaatatgtatctttcccccctaaagagaactgaaattgttttctgttaaacaaaattaaacaagtcttaagtatttccatttcagatcacatcagtttcagtctgtctgaaaatgaccacagcagccccctctcatctttaaaatggaacagttccttgtctacccaggattaaaaacctaatcaaagttagcctcaaatgcaaccctctaaagattattagagctgaaccattaaaaaaaaaagtcaaaggtaacagttgcaaaggtttttcaaaaaaataatgtttaataaatcacagaagcaaaaaatatcgtgcagtaagtaaaaacagccaccttcatctatcaataaaacaaggtggtttttaaaaattctacaacagtagcttaaaaaaaagatttgtgtttaaagctctgctgagcagtggcctccctagtttccacgagggtggtattttgaaaaaggtaagacacaggtgtgcatcgtttgaaatggaatttattaacaggttgtattattttactctgcctccatggaacatcacaatggactgataagctgccacacttcaggcagagggaggcacataaacaaaagttttaaaatgaaaaagctgtggggctaggaacatacacaatatgccccatgccagctgatttatgcagtaggaaaggagaaaagatgatcttttcttaatttcagtgcattttcagtgtgatagagcactgaattcagtcactaaccccattaaattacttggcaagggctggaccctatttttctttggaaaaaaggtgccagggcaataagacaatttgcagttctgggtttctaatatacaatattctgaccatttaaaacagtttttgtaggaaatattttatagttagagaaatagtttttgacattttggggggaaaagaacaatgggccgtttacaggtctacacagcagattaatgaatctaattgagtctgtagggaaatgtttcagtttaactactggaactaatttatacattcactacatcgtaataagtcaatttaagtttctggaaataaaactggatatcctgggtatagatttgaactataaatttctgcaagaaaggagtctgtgtgttcattatacattgtaaaattaccatatggacctgtcaacacttcttagcacagctttgtaataatgtcatttagtttaacattgtaatgtgccaactgaattaatgtgtatgacacaaagcatgcctccctctcaacctctgcttctggggagctgtgcaacttttaaagatttttctcaaggcaagaacctcctgcatttgcatagagaacttcaagatgatgattgagtg

SEQ ID NO: 923 - DNA, 1483 bp, Homo sapiens
ctctagcaagagggacatacccaaatcatttcaacagaataagaagaaacatttcctgattacagatgtgaaaacttgttagtgaaaagttctaggactatcgaaggacaaaccgaaatcccatggcagtaggttgtgctaaggctgtagattaccccagacccacactgtcttcattagtgttactactctaatgagaaactgcacttcaaactgctgctagaatcatgactaaatgagttctaggccaggattttcctgattgcatcaatatattcaaaatgaattttcttcgaggttttctcgggggtattggagggtaggggagctcacctttgaaaatgtagcccagatatcttcagcttctgtaataagtgtattttcatcagagaccaaagcaaccaaaatgttctaataagggttctaataagatgttctaataagggttgtcttaaaatcataacagatgtcctgatacaggtaaagaaacaaaaatagcctgtgtgggaatgtagttaagctcttgagctttaacataatatttttgtcatttaaacatgttccagggaaatcccagaagctggaagtcagtggtgctctggaacttaacaggtaccaagagttatggggatatttggagggcaaatattctgctttttccttgcaaaattctaatattcaaaccacagaatggagcgtgtataataggaaacctaataatatagtgggaagcatttcctttcagcagaaaaagaggaagatacaaaaggaacagatggtgataagtttgtggtaatagggcgaagcactaaatagtctttgacagagcttgcccccagataaaatggcagtggcagggcttaaatcattttttacattgcttattgactttctttgcctactaataagtcttcagagactgaatttagtttgcagcttgattttgcctttctctgttaatgttacatgtgctatgctgaatttgttcaaccttatgaccccaatcttgatttcagtaccctcttttcaatcctttcctctttttaaataaatttttatagaaagaaactcttgccctcaactattactattttctatttaaaatttttataataaccagaaatacctggagaaggaagtggttctcaattctaactacacattagaatcagttggagagtagtttggttttggttttgtttttttttgtctttttttttttttttccatttaaattctgatgtctggtctccacccacgaacacttaaatatctaaaaatctctagatttctagcctgagcattctggacataggtatgttttcaaggtcgctgacactcaatgaggcctgataactgctaggttaaagtcctcaaaagtaggaaacattgtacacaggctactctaaagagccatttgatgcactgttgagaaaacaaggaatttaacttaattggaagccattccctcttgatactgcag

SEQ ID NO: 924 - DNA, 1791 bp, Homo sapiens
aaaaaactacatactatatgatactacatgaaattctaaatatgataaaaatgcaacaatagaaagcagatcagtgagtacttaagcataagggttaggggagaggatcaactgcaaaaggacacaaataaacattttaggatgattgaaacattgtgtattttgactgtgacagtagatctacgactgtgtacaataaacttcatcaaactgtacactaagaatatatgatttttgttacatgtatattttaccttaatgatgtctggagaagacaccatacagacaaacttgatatacatacattatctttgataaggtttcatacttgattactaaagttcaacattataggctgatatgaaattaactaagattgaattttacctattctgaaatcttaatatgggagaatagcagtttataataatttgctgttaaatgaatttcaaaaattattttggcctcaggtttctggaaataaaaacaaaagttgatttaataaaaacaaaaattggaaaaaatatcaatttaaaatacatgtcacaaatatgcataataaaaaacaatttgaggggaaccaatttgctataggggattaattactttctacttctaatgatttggggattttcctagactcattctcaatgaccaggggcttttctaaactccttctcaggtgcccctgtgcttatgcaagaaggctcttgaaatagtactctaggatattaaaagctaaacatttcaccgtggtaaggtcttacacctagagagacaaagagctctttaccacaaaaaagtgggaggtatggggatgaattaaaataaagtaaacaatgcatgtttctgcgaaaactttattttcaaaaagaaccattttattttagatgctaaactcatcaattcaaaattttgttttcaaaagattccctcaataaagcaattcatttctgtgctatttagtttgctgtatttttacaagcaccagactgagcaaaccatgattgagagaagccatcttatgcacattgctgttgtcccacatcattcagaacaaacctttttagatcgttaactaccacaggagtgctgattacacaggcaccagcaatttcctaaccaatgaccacctgaacaatgatgtgttcagcttctcagaccctgcagcctttcaaaggtgaatcatttcacagtttggaactagatctccatagcaacttccctttgagggttttagaatcaccatccagtaattctatgatcatcaagctcaaccattcccaatggttcttttcacagcagatggaaaaggaagccttgaaattttacagtctatttcaagcaattcatctggcagcctattagaattcaaaatatttcgaccttcaatcacaaagcatgttatctgaagctgtggtgatctcaagtcaagacaagcagacgttttagtctaatcatccatgatgagaagagactgacaaaaactcttaattcaaccaccatcaaaatgcttattttaactgcatgaaagtctttcaacaggcaatgaaaacataccatgtgccattttatcacaaccttctgttcaaggaaaatatgaattctgaatattgacatgcatctctgcacttcttagactgcttggaacaaatatgtttcttaaaagttagcataaatccaatttaagagcactattattcactgctgcaaaagctagaaaccttaagcaaatagcaatggacttttgacaaagtcagctagcttaataaaatcaagtacatttggatt

SEQ ID NO: 925 - DNA, 2099 bp, Homo sapiens
tagacagacatataaggtatagttaaagggcatataaatggctttcttttaacacttgtgtatgtatgatattacattaatcagatgtaagagagttccttatccatttaaaaatacttcttttagaatacttgatgctttctggtcaggtaagtagatcaaaatttatacaaactgggttttatttcttctattaactggtgatttagcactgaagatcacatctatgtcacctggaattgtacaagttaccttctaaggggcttagcttccttttctgtgaaataaaggtaatgctaccgatttgtgcaggtaaaatgcttaaaagcctacctgcctgaggttaaggatcttaaggtcccttcaatctatggtatctatctatgattacagaatacaaccagactattctttaagttttccataaataacaatttgtgtaattggtaatagttattggtcactattataagtaatagtataaatttatttatacaaaatctggggtaaagatctaccttttagatcacatatttgaaacgtctgggcatgcctaattctatgtgttcaggtgtttctgagggtcataggtaaaagcatgtttaaatgtgaatgtacatttatacatatgcatagtaatatactggaaacctagttggtatgtgtgcaggatgttctttattaagcaataaatgttagctacttaagcaaaagatagtgcaatgtgataaatgtgccatccccatgtgtttccttcagttgaatgttggctagtatccaggagggagaaaacacacacacacacacacacacacacacacacacaacatactcaaaactttaaaaagaaaaaagaagtgctacaaccttcacaaaaagcataaagtccttgactcaaataatgttatgaagactcttctgaatttctctttttctctactttgtccccgtcaggatgtgaaccctgccattatgtatggcttgcggctgtttgggagtttcctccccatctgggactaagaggcaaattgcaggtttccagggaggggaatgctgttacagtagggatcacctcagcacttcacatggattgtgcctagcctagtgataccagctaccttgatccctgtgacaagctagccaccaggttttgtactctttgttactgaaattatgtaaggtattagttttagaagcctaaagtctttgttttctcaaaggctataaacatatgaataaccattaaaagttattttaatcttcttccacctttaaaatgaatgcaattatttcaggagcacaagaattcccgaatctacgtttttgtcactctcatcttccaaagcccactgtcttctttcacactcctagcaggttgcctttgttcaaggcagcacatgcttactaaaagcacctgacagcaattaccgcaatgaactttaaatctttttcctctaactactgtagtattctagaaataatgacacaacttctcactgctttaaaatgtcaagctgaccactcagaaattcaagctatgtttctccaggaaggtccaaatgatgagacattttatgtgccttccattttatctcctgttccattactacactgcctaacaccttcacagtatagcaacacctcctgggacaagctgaaacctaaatgaaacacaaaagctgcaacctgaacaaagttagcaatatgtttttggcaagagtaagctgtttttttcttttctttccatgatctgacactatcagctgaattaattttattttcttcctcacagtgctatttctaagtagattaaacctattgcatgactaatttacctagtggcaaggtagcctgcctttaattgtgcgatatttttaaccataaacacctaacacactccattattttcatgcattttgagattaagtttatattcaaatgtctggtttgactttcacactcagaggaaaaaaaaattcctttcagaaatttgaactaacttccttaaactcaggaagctttaaacttccagctgacacaagaattatcagtttacaaggttcatatgaatacagtaaaatcctgatagtttttcaaat

SEQ ID NO: 926 - DNA, 1652 bp, Homo sapiens
tatatttgaagcttctgcaagtgttatactcaccattttcatgaataattgatggctcaaagagtggagatggctggggtttggtgtggggccctttggagcattttccttagagtatgaacaagtttttcctctctcattcagtgtgcaaaggaaaacatcttgtttctccccccaccccattttttttttaatcagaaagagacttagaactagacaatcctgattgaaaatgacactttaggactgatttgaccatggtgataggtgagctaaaaagcaacttataaaacatgccagaagcctttttttattaggataataagagcacactaatattttttttgtattgagttcaaaggatgcatgaatattctgttgttcatgagtgacttctagactatttaaaattattcatgaccattgataataaaaatagtaccacggccaacctctcccctcagcaaacaacatgaggtttgtaaccctttgtttaaattttggcagtgtactaatgttgttaagatgacaatctatttcttctcaaagctgtattaaagtggcacaaattagcttaatgtttaagattgggtctcaggccagcctgcttgattttgaattctgcatcctctacttattagctgtgtgactttgggaaagttacctaacctctctgtgccttggtttgtcatccatctaaaggagaaaataataatccatataactcatggggagatggatccatgtaaatactctttaacgtatccatgtaaagagtatttacatggatccatcttgccatgtgttatatggattattattttattacaagtacagtgcctggcacataatagacatgacacaatacataacagttatttattactgacatttggatggtgttcctggtctgatggagatgtatgtttcatgtgcaagcaggacaaattgtaatgttcagacattcaagttgtgactacacaagaacacaaagccaaaattaacatgatattgccgcttgaacatccaatcagttacctgcatgtgttttgaaaagatttgattatatgctctggaaacattttattgcactttaaggacaagggggtccttggtgtgatctgtgggccagtggtcctctgaaggtggtcctgaggccacctcattagcacctgggaacttgctagagatgcagaatctggggctcactgcagatgtctcatgctcttgaggtggggcccagcactctgagttttaataagtccagtgagtcagcctgcaggatgacgtatagtttcctgtgtgagaaactgtaggaactgttggtccttagtttgtaactgccatctctcctgataggtatggtaggtctatcgtgaagttttgaaaaaaatgtgaacggtatttcaagagtccatcttgattttaatttttactgaggttatctctatggtggtcattaagattccattaaattcatcaggcccatttgaaatttttgagagtaaagaccatgaatagaaataattgagattattgattaaaaacatgaaagcaaagattgacatagttaaacaagtaaatcctagaactggacaaatccttagctatctctctgtgaaggtcccttcctttgggcctgccatggagat

SEQ ID NO: 927 - DNA, 2686 bp, Homo sapiens
gttaaaatgctggactgaaccccagaatatgtccagtttttcttatcactgcttctccggtgctgcatttaattctatgataattaactgagatttttaaaattttcttggaatatcgtggcaaaattatgtagtgcccatggaaccccttggatttaaaaaaaagttagaacatgattctggttaaactctattaccgaatattcaatttcattgcatttcctcccatctcctgtttgagtatgtcaagaatttcttgaactatagggcataatcacttgaagactttatggatctccttgggttaaaaaaatactttttctgactaaatttaaataattaatatttgattatatcccacctctatcctgtacccatttttgtctgattctattattggccaagattcacatattcaccaccagcataaataaaaactcagttcttttaaattgtccacaaggcggcagtaaaacatcttgcttccccccaatatcttgaatttccaagtattcattttccaaacatttagtattatgtttccctgaataaaattaaaaactattctgcctttaaatttctactttgccattccaatagaatgtattagtaaatatgagttagtcatgatgagatacttaattttctcctacaatagatgagtagaaatccttcaagttttgctaacatagattggttatttatattgacaagcaatactcctttcctgtttttccgggttacagcgggcctctgtaaattttctgataagagaatttgtttctgaccaatgccaatattaagcttgacatcttggtttgtttttttctcactaattgtattatggaaaggcagcttcacgggtgatttttctactcagagttttcaaatgaaatgtaaaatcggatgttcccatttgtttagcagacaccctgacaaaccactgcagtacagaaaaatacacttttaataggttttcttcacaagtgagaaaacatctaaagatagtcaaaattgaaggctcagtagcagtgcagtactctagtaggaatctcacccgcaaatgggtagctccaattgctttggtgctttcgcttacatggtgtggacccaaattggagactaccttccatgacctcatgtgtcaaaccattgaagtgtaccttggaacacatgccccacacaggagaaggggcgggggacctgggggatggatgaccttgtactattcactgacttactgctgccagagcaatggttgccctgagggcgagaagctgccaaaggcacctctggcataatctgtcatcccagtaaatgcctgccattcctgagaaaaacatgcaggtgtgcatgcattagagaaagagatagacagagaaagaagggatgctttggcaaaacaaatttgaaacacaggagatctaagctgcagtcttcatgctgtctgcattcctgtgaaaactgcacggaacttggcccgagcaagattgtgagattgagtccagcattttgccaatgcaggcgtggcgtgctagtgtgtgtgcatgtgcctgtgtgtgtgtgtttgtgatatcaaagcaaatcatttatgaagtgtattcatatggcaaaatgcaagacagtcagtaatagtttcagttctgtccattggttcgtttaagatgcgtactgcctaatgccattagaattgaacattgttttcctagtaataaaagacatgaagttcttagcaatttgtgccttcagaaggatgatttcctatttaaaatgctctaaagtaaaacatacatcacccacatagcacttaatttttgaaaatgcatatacttttctaactagctactctaggaaaatgtgctgaatgatttaatttcatattaaggtgcaaatgtggtactggatttgcgttgagacacaagtgttttgcctctgagagcaaagctttctgaaagattttcaccaccagattcaaaactaccgaattcaacatctgatagtaatgacatgattctctcactttaagaaaagcacattgattttagacatattgaaactcagaagttttagaagtgtgtttgggttaaggttaagtcgtccttgacagtattaaaagaaaggtttgaattgttgaataaccacctttcacccatccttaattgtaatttaaatgacaatatgctctcaatcaatagctctttgtcacactgtgaagatcaagggatgagattttaccccatgagtttacaaggcaaaagctccttgttcacatccctaaagatgttgcattagaatacctgttctccaacaattcgtcctggataaaggcatctgagtcacatcttaaaggtgtaacattagaaaaagtcaaaacctttgtttttgaaatttgctccaagctagatatcacaataaaaataccaatttaaaaagctaaattattcttatgtgaatttgactagtttaactttagtcattttgttctcatagataatttctgtgcatttgctgtgttctgggcactgtgctaggcacatttacattaagtttctttattctttgaggagtcaacctctgaggtaggacctagtatttatccccattgaacagatgaaactcagagattgagtcatgttccctcgtcacactgctagggaagggagaagctttgacaaaatgaattcta

SEQ ID NO: 928 - DNA, 1702 bp, Homo sapiens
ttaattttgtgaataaaccagagaaaagaaagtaaccatacacagcgctgaagttacaagttacctgcaaattcttggagtgaatgaacaattcaaatcttctacttattctatgtgagaattaatatagtctgagcctgcctaacatttaagttgcagaaaaagaatgtttaaggaccccttgtgtaaaaaaaaatgcttaaaagtccattactgaaaatattatattttggaattatgcttaaagtttcactgctgaaattactttgaaggaaatggcgtcttccaaaataaagtaacacgtaaagctgcctttttctttgcactatgagaggaataaactgaaaatgaatagagatctaagcctctgtttgaagaagatccaagatctgcgaagaggccataaggagaggggaagttgatagggacttaagagggagttggccaaaacaaacttggctgctttgcaagtttctctgacttggtgatgctgtgggtgcccgtcaatacaaaactaattctgacccagttggttattttcatcctttattattggcagcatttatggcatttaacaataatcctatgctaaatttgtaggcagaggagcatctagcttttaagtaagattgttttctcagtgttttggcagagcacaaactacacaccataagggacattctctaactccgttgagcgttatccttattattattattatttcttaaggatatcacaagtctagattgtctttttgacactgtgattcatcgtcatctaccttaaggatcccataatgttaaaaaatctcttggccctcaggggcagatagactcatatctcacttgctcccctaaaaggcacaaaatcaaattacaccaaaagcctccttagagtacagctctttgccaattacttgaattattttcagccactttggcacatttcctctccagctgaaatgaaaatcttttactctgccccagtgaaggatttcatatttcttagtgcttccacatatactgtataatgagaataaaagcttctctgcctcacagatcttttcgtacagtgccataatgcagggaaaataacatccatttctaacacatgaagcccacgtattttctaaagaagaagagaaaggcattaacattacacaagaaaactatttgctctttgctttaaatttccaaatttgaggacaccggagatttcagacttcaaaactacatacatctgtgctgagacatagaccctctaaggtgcttcattattggcacttaaagctggtttcatgaaacacctggtctgagtaagcaatatgatcagagagtgtcagcagggcagacagattttaaatggaagattgttacttacccagaagccattttgaagcgaaaaacagcattatcagcaaaccagtaacaataacttaaacatccccaagtgcattattaacacttctagccctctaaagattagatgacttctttataaaagtttttatgtctcgagagaacatattgttctctgcatttatcattttacaaaaatattatttttcaccaatagtcttacttttattattccgtcatcttttatttttgcttctgataagtgttatttcctctctaccagtgcctgcagcagcctgcactgcaatcactacccattgctcagtatttgtccgttttctcaa

SEQ ID NO: 929 - DNA, 1966 bp, Homo sapiens
tacaagaatagactttggcacactggggcctaaatgtagacagtgatttccctgactggccactattaaaaacaatttacattaataacaaaatgcatggaagagaagatgcatcatgagatgacgttaccatatagaatacagaggcaggtgtgagatttacagttcattaggcatgctgattacattcagcattaaattaatatagagagataagaagaatatcaattttgcaagtatattttggaaatcactttctgcttaatctttaagctaagtgctgcaggtgaggttaaaatttttccatctataacaaaatttaatgaacatattgaattgcagtgcagttagtagcatgccttaaatatgcaggcttctctaaatgataatcatttaagtcatatatatgtgaatgagaggcactgtatgatttatgatatcagaacggcataacatgttaaagctgaaagtgaccttagaaatcatctaaaactgtctgcttcatctggcaggctatgaaattaacactagtggagtcaaatgatttctcaaattttcatgataaatttctaaaaagttttccaccattttattcctattaacccatttaacttcatagtagcacagagaaaaaaattaaatagcatatttttacttgcaaatttgaaatgaagttttgtttcattgcttcttaactgttaagtgaataatttcaggttaaaattattgcaaaaacgtatcaacttattatgcaaatagctgatacatttcacacagatagcttgttttggaggtagataaatgtgctaaagggctcagcatgcattttgcaatgtgtaagaggcatttttattttgctgttgatctgttgcttttagccatgaaagaaagaatgcactttggtttgcttttttcacagcttcatttgtcatgtgtcttagagtgacacaaatagacaggctgacaacagatttattacctaaagctcagctgaaaaattaaacgatacagctaaaagtcatagttggcctgaataccctctgaccatcacaagattgaatgagcactacaaagcccagaataataaagtggtgaaatatttgggagaaaaagaggttgggaataaatcactaatttggtcagtcttgactgactaaagagggaatacttcttaaaacatctatcccatctctaaattatatgcctttctaaataggaggaaagtcgactctttcccagtaatctactaggtaattgtctcacagttttacaaagcaatataattatttactgtaacttttccatattcagattatctgttgagcattaaaagaagctagtttcagattatctgttgagcattaaaagaagctagtttcagtggtacgtgaaggtgttgctccaaactgaagtcagaaacctgaaaaatgtttgttttacatatgttcagttgacattgtgtataaattattaaataatttatattagctaaaaataaacatttatacagtaaaaatggcaagaacactaaatttttctagtttgtatttgatatcttttaatagtttctgaaatgtgattgattccaaagctttcttttcaagaaagagacaaattaacattctgtgttgaatacagatagtcctgaatcccactttgttaaagtcattttgcatgtttttcctttatattgtttcagggggactatataatgagtcttctgttatttatttatttttgtaattttcacaatcagggaaaaattataaggaaataaatgtatcttcagagcctagaagattttggtaggtgtgaataatatgcccaaaggtaaaattaatctcatgtcttattgaatatgtgccaacactttctcccctttatgattaaataaagaagttatttcacaaaagcttcagggtttattattctggtgtcactatgcaatgtgagtgaaataaaatga

SEQ ID NO: 930 - DNA, 1582 bp, Homo sapiens
ccataagttaagatgtttgattagtataataattaaagactgcaaaactggaattaattgcacttagataccttgcctaatgccaatatatccagtaagctttttaactatgttgagatttatgagaccaaaactactttattcactatgccatactgccttaatgaatagtgttgtctacgtctcaagtgatataaatgttgtacaaagcaggtcctgttgtttgttagttaaataaagtacttcttaattataatgctggggaaacaatgagtggcttttagcctaagactgtgtttcccatgttctggtaaacaatccaggtgatgatttgatgattcggttgttgacagaggcaaagccacatctgtcttatcactattttgagacccattctccaagctactaaaatgtacctgacttcaacgcaatctgacttttatttttaactttcacatatatttgttattttgcattctaaaaactgtaacatcctttttctatcttcatctgcctgaaacttacccattttctccccattcttttcatgtcatttgccacagctgatttgaaagcattctccttcattgcctgccagctggaactgtccttcaatgtctaacccttcagatcccttcttctttataaaacacattgcagagtataattaaagtgggtgctgttctgctgtatgttgtctaacattttactttgtgcctgagagagctatttattttagcgggtacagaatccttgggaattggtagctcccaacgagggtcagtaggcagcatgaagaacagatgacagcctgcaatacctccttcgcatttctgtaaagagatttgacatttacaaagtactgcatgttgcctttccccgcaaatctctgaagacttcatgaaaataaaaggcttaatgatttaaatgattttaaaagcatttgatatgcttttaaaagtgaaagataagcattcttgattaaactgaaggattgtagaaatggtggaaacatgtataagaatatccaaatgcaggaataatgcatatcagagaatccttgcttagaaattgcaattccaatgaaggacctgagaattctgttcagggcaggtctctgtgtcctgaagaatcaatatacctctctctacagtactcttaaatcaggtagcactgaaagtatctgagagttcgttgttcttccatttctcaaatttgaaagcaaactgaaatccacccttacatgagagaaataaacttcctttaatgatagagaacactttaaactaaagattcaaatgcatcccaaagttaatcgacccttgggtcttttaaattgcatataaaaatctgtctgcattaataaaaaatgacttgactttattaataatgcttatttttaactttctcttctaagcacacatcaccaaaaatgaaatttttctgtaatattttcttcatgcagtatttaggaaagtgctcaggtaaactaatctcttttatagtaaataatttaagttgggaaaaagttaataaataaaaagtaaaattagctttcgtgacattttaaagtaaaacccaa

SEQ ID NO: 931 - DNA, 2122 bp, Homo sapiens
acagggtagatgtgaggattcaataggctaatatatgtaaagaaactactatagaaaacagcaattgtttactgtaaaagtgaactcctccctctgcaagtgggtgtacctggcctataggtcttatgatctggcttagggatcagctcacttgaaagtcacttgtttatgaggttgaacctcagttctaaaaataatggtgcagttttgacattcagttgaattcaataaacatgtagtaagtgtctcttgtatacaaagtactgtggttagttgttatggaaatggagaaaatacataatatgaatgaaaattgttttctgccctgaagagcttcaaatttactgggaaaagagggatatattaatttgcaaacacaataaatacaaatagtacaacagagaagtaattaaatctaattaaatctaatgtggggttgggggaacagtctataaaagctagcaaaaagatagtatttgaactatggttgaaggattagcatggtttttttaggttgagatagtagcaagggatttctggtctaaagctgtgttaggacacttttgcattgctacaaataaatatctgaggctgggtaatttataaagaaaagaggttaaattggctcatggttctgcaaactgtataggaagcatgctcagcttctgaggaggcctcagggagattttactcatggacaaaggcaaagtgggaacagacagttcacatggtgagagcaggggcaagagagagagtaggaaggtgccacacaattttaaacaaacatattccatgaggactcactcactgtcacaaggctagcaccaagctatggggaatccaatccatgactcaaacactccccaccaggcctcatttctaacaccagggaccatatttcaacaggagatttggatgggacaaatatccaaaccatatcaaaagcaatagcatgagcaaaccctggtaaaccaactaagtggtgataatctgggcaagaaaggatgatagtctggacaaggataatggcaatggaaatgagaatgagaaagggagtgtggggaatagtttcagagtttaaaccaaataactaaaaaataagacacgctgaagacacgagcaacatactttgcagcgacatctgtgagtgctttgggtttttacatagatctattttgtctattaaagccattttctttctagataacttccttcattttctgactagttgactttattgtctaaatatgtttcatacactagctacccccaaaattttaagaataaactttattactgcttcccatttcattttcttctttgctttaaataaaaatttttacagctcaaatcacattgaccttttttgttccaatattgcattataaatttatttttatttagctaccctcttgctcagtgccatctcacataccagatttctcagaaggacaatgaatctgagtcaatttctttccagatatactagtttacactctcccaatttaatctcattttgatttgagtccacatttataaccttttcaagttccagataagtatttcctaagtcattacccatatttacaacattgcttaatatagcatcatttcaagatacattaatgtactgctcattctgcagctattaattgagttgaaaaagagaagtagaaacagtaatttgttccataatgtccataataccctctatcccctttgcagtttatcagattgtatagtctactattctgttgataactgttattatttattatttctttatccagtctcctttgaactacattccaagaaaaaatgttttaaaatgtggcttataactccaagaaatatgggactatgtgaaaagaccaaacctacatttgattgttgtacctgaaagtgacagggagaacggaaccaagttggaaaacattcatcagaatattatccaggagaactccaatctaacagaacagaccaacattcaaattcaggaaatacagagaatatcacaaagatactcctcgagaagagcaaccccaagacacataatcatcagattcaccaaagttgaaatgaaggaaaaaatgtaaaggcagccagaaagaaagcttgggtt

SEQ ID NO: 932 - DNA, 1073 bp, Homo sapiens
aatattttcataaagtcctaaaagctgagtttggtctaacatatcaatcgggaataactgagagttccagatacgaatttgcacacactcacaagattctccatggttcttccctgggtgcttattagaaagacgtggcagaacaagagatcagagaagccttccttgggtggtgcagacatgcagaaggtgattggctatggctgaaacaccacctatttccttcatctcctaccttatacaaaccaaaagcctgaaaacattgggatggggcagcaagccttcacacccctgtgctattagaggaggagtaggaacatgtcctagaacaaagtacactctagacctgccttgcaaatgcctaaaatcaagccctaatgagatccttagaggaaacagaatttggaggttgagacccaataaattagaagggcttcacaaatatctgggatttttatagatttttcctgacaaagtatataaaaccaagcctacataagttcaaggtggtcagctaataagtgaactatctactagaacaaaaatcaccattctttagatgatgatagcagaatctggagtctctacaggatgtcattcataatatccaacagatactaaaaaataactagaatagcaaaggaaaacgaaaacatgacctaaagtccagaaataaaagtaatcaagtgaaattgagcatgagatggcccagatgttggatttagcagacagaaaatttaaagtagctattataaataaggaattataaattaaaaataaggaattaaaggaaaatatattcaaacaactaaatgagaatattattttaatgagtgaatagttcaggagtctcagcagtgaaatggaagttattaaaaaaggatcaaattgtatttctgtaagtgaaaaatataaaaactgaaattaaaaaaatcactggatggtcataagagtgggttaacagaagatggcagaagaaagctaaataaacttaagacagagcaatagaaattatccaatctgaggaccacagagggaaaaaaaatgaaggaaaatggacaagacctgtggaa

SEQ ID NO: 933 - DNA, 1915 bp, Homo sapiens
cactaacaatatttggcagtgtttcttgaaataaacatttatctatttggagaagtagaatgaaatgaaatctttttgaaaaaaaacatttaaaaaattaaatttgaatttgactcatagggattgatcacaattgaagaatttgacctgcagggacgaattgttcaactgatccaataatttaaattataatgtatatgttctcattctaagcacacttccgagagcagcagaagcagttcaagaggcataagggaagcttcacaaatagctcattagctcaagaagtagatgaagtgggggtaagaatgaaaaaatggtgaatgtcccaaattggaagttagaacacctggttctgcaaagactaattgtgtgtcctgcctctaaagtagatattcaacctctcttggcctttgaaagaacctgtaaaaagagaatatgagaattatgttctctaagattctatcatacctttaaaaggctatggttctaagttaaattggagtttggttttaataaggtcttaaaaactcttcatctttccagttaaaaatgttcagtctcctgtaaatgtcactactgatctgatatcctgccatgacattccagagatgagacaggaaaaaatgtgactggctcatatagattctattcctatcctctcactatcctgactttgccaggagcagttcagttctggaacacttcagaaaacatgtcttaaaccactaaatttttagaatagggattcaaatttaaagtgtaagagaaggctggttgagctaggtggctcatgcctaatcccagcactttgggaggctgaggcaggcagatcacttgaggccaggagtttgagaccagcctggccaacatggcaaaaccccgtctctactaaaaatatgaaaattagccaggaatggtggcacagtcctgtaattccagctactcgggaggctgaggcaggagaatcacttgaacccaggaggcagaggttgcagtgagccgacatggcgccactgcactcctgcctgggtgacagggccagactccgtctcaaaaaaaaaaaaaaaaaaaaagtgtaaagaaaggcctcggtttaggtctgagcctaggctatggtttcccacctagctcttctaatacgattcatttgggcctcagtttattcctctgcacagtggaaaaaacgaataattttgatgaatggtactagattttagtagggtaggtaatgtttttaggatagaagtagaagaggatgggaaaaacagcttgtagcactttgggctcttgagaaggcacgtactactctaaccatcaacagtcgatcatgcatcttcctgcaacttattattcccaggtgctcaaaaatacctatggttgaatgatgatgacaaagcagatgtcaacatttaaatttggtaaacatctaacaggaagaagtgtgacatatgggaagaggttcaaatccaagccaacccagatttgaatcctaccaccatcattaactacagagagggttatttgatctaagacaaattacttaccatctgcaaatagggaaataattttttctcattgactctattttgagtattaaatgacatatcacatgttaaggtctcagtagagtgcctggcacacaatagatatgtgagaaatggcaattattattatatgtcaaaatgaattttattaagaaaaatcaaatatgctgaacattagattccatgtacctgctactaacatatcatgggctacttttaagcctcccacagtcatctttgtaatttgccagaatcttatctttaagaaaagacaatctctgcagaagataggtattaagtatttttctctccatctgaaacttccaaatcctcatcaccataatgactgaatgtacagcactataagc

SEQ ID NO: 934 - DNA, 3646 bp, Homo sapiens
gctgggattacaggtgtgagccaccacaaacagcttctactattcttaagatttagttctttatgcacagctgcataattctaggtgtttttacaagatattgagtatattgctttacttatcaatctttatttcctcatttttggctctttgcaaaatgggaaaaaaaagggaaaaggtggtgctgaaggtaaaaaaattaaattatctggtttaattaagttcaggcagtaaacttaaaacttctttaaatttaaacttaattctctggttgttttataatcatggctaaagaatatagaagccaaacatacttttaatacccagttacaaaatattttgtagtaaaattaaaatctatgttgtactaaaactaagtatattgcacatcttgcacaagtgatgataattgacacatctttatcactcagagtccctggtgtaccttagggttcattctcggtgttgtacgttctgtgggtttggacaaatatatattgacatatgtacaccattgtagtatcatacagaatagtttcaccgtcctaaaaatctgttgtatctgcctatttctaccttcctcctaatccctggcaatcactgacctttttactgtctccgtagtttggggatttttccaggaagacatataattggaatcacacgatacatagctttttctgattgtcatatttaacttagtgatatgcatttaagtttcctccatgtctttttatggcttgatagcttattttttttttagcactgaataatattcccttgtctggatgcatcacagttgatttatccattcttctactgaaggacatcttgcttacttccaagttttggcaattatgaataaagatactatatctcagtgcaggttttcgtgtggacctaggtttccaactcctttggataaataaaaaggggaaaaatgctggattgtatggtaagagtatgtttagtttggtaagaaacgccaaaatgtctcctaaagtggtggtaccattttgcattcccaccagcaataaaagagggttcctgttgtttcacatcctcaacagcatgtgatgttgtcagtgttctggattttggccattctaatagatatgtagaaataccttattgtggttttacttagcaattccctaatcttttcatatgcttacttaccatttgaacatcttctttagtgaggtgtctatttaagtcttttgttcattttaaaatcatgttgctcattttcttactgttgagctttgaaagttctttgtatattttagataacagttatttatcagatgtgtcatttgcaaatatttctctcagtctgtggcttatcttgttcttctctttaccagatgcttttcttctgttgaaatattagctgtacttttagggggatttgctatatattatttatttaacacctttaaaaacatttgtaatattagacaagcaaaattttattataaggctttaaacatagagttcatctgtgattttttttgccagataaatttatatactagcttgaatatttctagaacagtttctaaatttgttttagatgtgttcattacctagagttaggttttagtagatatcttttaacatattcattatttatttcatgcagaacttgagttagataaattaatctttattcttaaagtttcatagtttgggtaaatggtagtaatatttattgagcatatattatttgctggatgtattttaagtattttatatgaattattttattcagtcctcaaaaccctaggagacagggaatattattttcatccccattttatggatgaggaaatgaggcaaaaagaaagtaaatttctgaatgtcatacaacccatacatgagtggaagagtagtgtccaaatccaagcaatatggttcagcaatgggcttagccattactccacgttactatatgtcatcttccaccttctggaacattaaaattcttgaattgctcttggttgacaatatcctctttagttttccatgtcatggattattttttaaaaatcagtgatttttacaaagattaaattttgaagaaggagctgggtgaaagttatcatttcaattaggctattcttttattaagtgttcacaaattttatagccaaaagttgaataattttgtataactctatgattgggaaaaattatattagttaatgactcaattttgggaattgatgttagaaatttatttttaatctctatattaaagtattatcatttgttatttctagaatagttaaaagccaaatagtgcaatttcagttaaaggaaaattttaaaatgcttatgttaaatgttgtttaatggcttcttagctcatcttataattgttacacttcacttaacatttttctggttttctttagtaattaagtacttcaggcttttccatgccatttaagtaatagtttttacactgttttatattaagaaattaacaagaaaaagacttttttttaaaatgcaagcaaatcatttttcaggcagttaacaggaataggattatatccttcaggaaatttataagtaattttcctatccagtaataaaataaatgagaggaggttgctgaagtgtttcctaatctttcatcttgtcacattaggattcatttaaatgccaaaattcaaaatgtctcatgtgaagaagaaaaaaaatcgcacatgtcaatgaccaaatatacaaggaagaacagtgggtgcatgtatgggaaatttggtttgataagaaaatggtttcattcactgaacatacaatgttgaacaaatgtaattgaaatctaagatacttaaggaaaagatccatatgtacctgaaaatgtcttcctcatagtactctggagctatatttgtaataaatatctgctggtggttcattaagtcaacaaatatgtttagtacctactaattgctagagagtctcctatcctgagctctcaaccacagaagccacgtgccagctttgtgaagcctgcagtctgctagagaagtggggagagatgaacaataaatagatcagcattaaattaataaggtcatttcaggtaattgtaagttatgagaaaataaaacaggatatgatacagaaggactaatggtttatattttagtttttaaattaaatgttaaacacatgaaaaatgttattatttgatactacatttatattatttatttcatgtgtatatcacatatataaaaccaaaacacacggcttcttaaaatctagtgaagaaatcaaacatttaaatcccctatgtacccttctaatctcaactttccccctaccctcacctctagaagttgccaccatttttacttttgtgtttatcacttgcttagtttccctaattattttaccacatatacctgtacctaaatatatagtatcattttgtatgtttaatatattgtataaatgaaagcatactcttgtttaataactgccttttgagggtctacattttgttttagacattcatctatgttgatgcatattcatttgtttttcaatactaggcataataattcactatatgaattcatcagagtgtatttatccattctttcttgattggcatttagtttgcttc

SEQ ID NO: 935 - DNA, 4112 bp, Homo sapiens
gaaaattgcagtgaatatatcatattgtctgtccagaggtcttgagcattatcttggtttctaacatcaaccctacaacttaataatcacatttgtatatatacttatgttttcatgattttaaaacaggaaacatctttgaaatgtttatgattctattgaatttaaattgagttaaagttggctcataattaaaatcacaatatgttatagtataactttttttcaaaaatcagctacatattgagctctgaagattctgaaattggccagttacagtggctcacatccataatcccagaaatttgggaggccacagtgggaggagcgcctaagcccaggagtttgagatcagcctgggaaacataatgagaccttgtctctacaaaaattttttttaagccaaacatggtggtacatgcctgtgctttgagtgaattcagctgaatttctctcctttgacttagttgctatttttccaaacactagccaattcaaaatggctgtgaatttctctatttgtgtattttattgtctttggcattcacaaaagagtgaaccacaatgtaaccaaaataaaatgtaactgtgattcacttccatatgtggttaatggcccatggcaaaattttgatgataattcatctttattgaattatattaggttattatggaatcaggaagacatctagaactatcatcattctttaagaatagcatttttttcttctcaaagttgacgtcagcagaaggcatcctggacagaaaatgaatcaccaaagagtttatgcttcattttataaagaacttcaataccagatttttaaaaataaattttattatttagggtgatagtataaatatacttttaagtgctgtaatggaaaaaataagattgcatttccgtggaagagagtgacaatatttcccatttaatctagggctccctgttctcaaataaattgttccgtaggtgacacaaagtaagtgatttggtcctttctacacaagatttttcacatcaagtttttatgaaggaatattactacaaggaattttactgaaccggaaagtgtaaatgaaggatcattgatgaaatgtgttacaatgagagcaaaatgtgaaatgttgctgaactaaaatgaactttgttttgtctccagggcagtcatgacttaatgaagtacagctataagcaagataagtcagactttgtgcagaaaactgacaatgaaagtgattacataggaaaaatgccccctaagtagattgtgtgtgtgtatatgtagatggttgtgcatatgtttgtatgtatatgtatttatatacatgcatgtgtatttatagtatatatgttgtagataaagatattgtagatagatatatagatattgtagatagatatattgtagatagatatagtatatatagtagatagatataaagattttcattttcattttatattaagatatttatatttaatttatattttatatataatatataatataatatataattatatataatatattatattatatattatatatatttatatattgatataaatatataaaattataataatataatttatatattatttaatataaaatatttatattattttaaatatttaagatgttttatcttaaatatttggaatgcttttgttacacagttgagagatctaaagcccatcattttaacatcaaatagcataacttgcattttttttattaaaaatacttgcccttactatgtcttttctcaaagacaagacgttgatactctaggtggaggctgtttatgtttttttctttcaagagatgcttgacagctgctccctggagaggaactcagactccttaaatttttattaggctacagtatttgaaatttggaaagtagacattagtctttgaggtacagtgtttgatggtatgaatcttttaagctgtagtactgcaagagaagattgcagagattagctacagaccatttgtcaggggagactgaagcattcgtaacaatgtatagtgaaaatatacttgcaaacttttcattagacaatatagggaaatcttattgtgtgtttttcaggtttcaatgttctatcaaataacatagctactaaggttgtaatggagttttttttttcccatttggttctcattttcagacaaaagaaatgtcttcctggctaaagatgccttatattgcagaagtagcatatagcataaattgctttaaaaataagcaagaacatgcaaagtgaataaagaaatatcgaaatgagtagggaaataagggtaccaagaactggagtgtgtatatgctaacgttatttttttgtaattttaaaaaataaaaggcttgtggtgttttcagggagcaaagccaatcttagtgaaatctattttgtaagccttagagcaaggacataaagttattcctttaatttgtttccttacaagtgtttctgtcttcatttataatctagctacaatactttgaaacacctttacataataacataaactgtcaggaggctaaatttaaggcacatattggttattttaagtacctaggctgtgagaagaacatttactacatttaactagttaaggtataaagagcagtggtacaggtcttggtagaaaacgttctttttaaacatataacatcacgccctgcttcttttctactttaacgcatgtatggagtaaaggtggctgaaacttgttatttgctagatagtgactttaggaataccatttaagccagttagctgacttaatactatagtaaatgtttttaactaacagctatttccggaacattgtatttctctgggaaagctatctaggagatatttctggcagggtcagctgggctccccgaagtatgttcagccttgttgcctgtgttttctttttgacctaatgttttgcttcgttttgtttttttaacgctgcccattctcgaaatgaaagtaagacgatgttatttgaatggaacacttggaaacacctttcacgcaatgactctgtataactagtcatttgtcagggaaaagtgagatttttctctaaaattaatagatttgagagtaagattccatatttagtgtatcaaaggtattgttttaagaatgatatgaattttaaaatagtctaatataaaacataagggggttctcacttaaggaggtcttcatatttaagaggtaaagtacagtttgtagtgtgcaaatctgaaaaagtatgatattgataatattaacaaagtctgacttttgcccaaaatttgtgattaatgtcaaaatgtaaaacaaaacattatcaaaaatagcactattgcaaagctacgtggcaagttaattgtaaactacatttactatatttctgcactatagcaacacttactctagaaaatataaatatcccactatcatttgcatagattcattttaaattgcgtgattttaaaaattaaactttgtctttctacatagtcttatttaaggaatatatgtatatttatatatataatataaatgtagaaaaaaatatatgtatatatattccttaaatgaaatgtaaaaggcctgtattttaattacatattacactaatgcaagaatttcaaaggcacttggtgagtggtggacctgaggatgtgtggatgtgttggaggaaaaaacggatgtttcagtgcaaagccaagttgaccaaagtgctgtgaacaagatttttagatcatttatattcaaggatgcttcttaataagatgcttatttaactaaaaacatacacacaaaacccagtgtaactggtaaccttagaacacgtttttccccctctttctcatcattgcgtattagcatattaaggaaaataaacagtgtggtatatttttatatgacatctccacttgtgcttattaataagtattataagtcactattaaatatgattgatgaaaggtttttaaaaaaattcatcaatgggtttagataattcagatattcattttttttaatgtgctttgaatttttctaccaacgatagttgacgtaacccccctccacccaaaaagactaa

SEQ ID NO: 936 - DNA, 6785 bp, Homo sapiens
acagaattatcgctgaacttgaatgtatccatttacatatttttacatgaaaaatgtgaaatgaaaatttacattcatgtcaagggaaacaaatcacaaactctattaatcgtcttactcaatattttaaatttagtaaggtggtaagtttgttgaaagaatagataggcaaataaattaatagacctttaagttcacttttttctttttaagaaatcagtttcaaatgtacagtgatgttatgtttctgagagtaataaatcaaatatttttgcaaacaaatgaaatacatatcttttaccactctaaaataacttaaaatcaggtgtctaattggttgttattagagaattgtatggaaaacatagatttgaaagaccgaatttttattttaatttgcctacatttctcttctttattaaaagaaattaaatagcatcacgaacaaaattaactataggacaaagcctgttatttctattattgtgaatatgccccttctgcgtcattttccaaatgtaggatttgctcgttaaaaataagtagtggcacactttatgatattggcaaagaaaaacatgatctagaatatgatcttgtaaaatagtttctacccttttctaataactcatttaatgtcttaaagagatctttaatgttgaaaaattaaatattaaagtctttaatttccttctgaggctgctaataaaattgggtaaaatgaattcataagcatttttacagagttgtcataataccagcactacaaatcatatgatagtttggaattttgaatctttaggtattttattacactctacctgtgaaacatttagttatatcaatttaactcttctttaacagtcccacgaccttttcctcgtcaccaatttcccacctctcaccccaagtttgggaccttgagaagctcatgattccacatgtcagggtcaccagcttggatgacaataactatcctcttagtcctccctcagatttttatgtatctgacagattatttattattttggttattataataatcatttcaatatttacttactgagacccaaattctaatataatccttagatagaatttagactcaaatttttggatctttgcatgccaagagttttgttcaaggttttctctatttctccagtttgctaagtatctcttctgaagttctcttgatgtttttaaatttttttaatttgtatgggtttttaaattttcatatgatcatagtcatatgtcatatgtcatagatcatatatctatatgggttacattagatattttgatataggcgtgcagtgcataataatcacattggggtgaatggggtatccatcacttcaagcatttatcctttctgttaccaacaatccaattacactcttagttatttttaaattataattaaattatttttgactatgatcaccctgttgtagtagcaaatactgggtcttattcattctttttaactattttttgtacccactaaccatacctaccctccacttcatattttaaggtcttagttttaagtttttcacccaatttgatgtgatttttgtatgtggcaagagatagaggtctagttttattcttttgcatataggtgtccaattttcccagcaccatctattgaagagtctgtcctttccccagtgtatgttcttggcaccgctggcaaaaacaagttcattgtagatgtatgaatttatttctgggttctctgttattttctactgggtctatgtgtctgttctatgccagtacaatgccaatttggttacaatagctctgcagtataatataaagtcagggaatgtcattcctccagttttgttctttttgcttagaatagctttgactattctgggtcttttgagactccataaaaattgtataactgttttttctatttctgtgaagaatgtcttaggtattgtgatagggattgcattaaatccatagatggctgtgggtagaatggacattttgataacaatttttcttccaatccatgaacatagaatatatttccatatttttgtgtcctctgcaatttcgtgcagcaacaatgtttgaaagtttttattgtagagatctatcacttttgggggtaattcctgtgtatttaattttatttgtagatattgtgtatggtattttttttatctctttttcagatggttggctgttggcatatagaaatgccactgaattttgtttgttgattttgtatcctgcaactttactgaatgtgtttatcagctctagttttttggtggagtcttaggttttttcaaatatgagatcatatcatctgcaaacaagaatggtttgacttattcctttccaatttggatgccctttatttttttctcttatctgattgctctagctaaaacttaagtattatgtcaaataatactggtgaaagcagtcatccttgtcatgttctagatcttagaggaaaggctttcagtttttccgctttcagtgtgatattagctatgtgtctgtctcatataaatctgtcgaatttggattataggagggtatgttccttctatacccaatttttgaggatttttttattatgaagggatatgaattttatgaaatgctttttcagcatcagttgaaatagtcatttggtttttgtccttgattttgttgttatgatgtatcacattgattgatttacatatgttgaaccatccttgcatcactggcataaattccacttggtcacagtgaagatcttttgtgtgtgtgtgtatgtttgtgtgtgtgtgtgtgtgtgtttctcagttctttaatttaatcagcaaaattaattagcactctttccaaagaaaatctacatttttatgttcttttatctaatttctttctttctttctttttaatttccaaagcttattggggaacaggtggtgtttggttacatgagtaagttatttagtggttatttgtgagattttggtgcacccatcacccaagcagtatacactgcacccaattagtggtcttttatccctcacctctttcccactctttcaccctgggtccccaaagtccactgtgtctttcttatgcctttgcatcctcataacttagctcccacatatgagtgagaacatatgatgtttgttattccattcgtgagttacttcacttagaataatagtctccaatctcatccaggtcactgtgaatgccttaattcattcctttttatggctgagtagtaatccattgtatatatataccacagtttctttatacattcattcattgatgggcatttgggttggttccatgtttttgcaagtgtaattgtgctgctaaaaacatgtgtgttcaagtatctttttatataatgactctcttcctctgggtagatacccagtagtgggattgctggatcaaatggtagttctacttttagttgtttaaggaaactccacactgtttttcatagtggttgtactagtttacattcccaccagcagtgtagaagtgttccctattcaccacatccatgccaacatctattttattattattattatttgattatggtcattcttgcaggagtaaggtgatatcgcattgtggttttgattcgcatttccctgatcattagtgatgttgagcattttttcatatgcttgttgaccatttgtatttcttcttctgagaattgtctattcatgtccttagcccactttttgatgggattgtttttttcttgctaatttgtttgagttctttgtagattctgggtattagtccttgatgcatcatcaggttatttaaagttttctctttttttaatatataagcacttatagctgtaaactcctcccttagtacggcttttgctgtgtcccacaggtgattttagaatattgtgtttccatcatcatttgtttcaagaaatttttcaatttccttcttaatttctgaattgacccccaatcattcagaagcatattgtttaatttccatgtgtttgtatagtttataaaattcttcttgttattaatttctagttttatttcattgtggtcagagagatgcttgatattgtttcaatttttttgaatgttttaaaacttgttttgtgacttaacacatagtctatctttgggaatgatccatgtgctgaggagaagaatgtatactctgcagcttttgaaggaatatctattaggttcatatattttatagtacagattaaatctgatgtttctttgctgattttttttgtctggaagatctgtccaatgatgaatgcgggggagtctccagctattattctatgggagtctctttctctcttcaactctaataatatttgctttatatatctgagtgttccagtgttgagtgtgtatatatttacaattattatatccccttgttgaattagcacctttatcattatatagtgacatttttgtctcttcttatagttttgtcttgaaatctattttttcctgaagtaaatatagctactcctgctctttctgggtttccattggcatggaatatctttttccctccgtttattttcagtctatatgtgtctctattgaagttttcttgacctttacattatccaacccctattttagtggcaagaatattgcatggaaaactgtcattcaaattctactcctagaaccctctgatatctgttgattccatctcacacacactgagtgctatagcatttataaagtaccttaatgtgtaattatttttaaaaatttgtgaggtacaatttttttcaccattttcagaatgaggaaaattagactcagaggagattaaaagatttccccacggtaacatgatcctggtatttagttaagagctacaccaatcctgtaggtctttatgctagagatatcacagtaccttcctaataactcttccaggctcattactggcatgatttccatctagaatatcttcaggatatttctctcttcacatttatagtacaaatattagatttgtccttctcattcaccacaaagagcatatgtttttcatattaaatctgcctacttaaacataaacaactcaaaacatacacaattgggaggacttttgtacttaatatccatccatgagttctgttttcaggtcaggtttctggccctgaaatcaggcttgttgaatactttattttactatgtaatttacaagtcatgttgggaagttggaccctataattatatgtatttttagtgcaaaatatcatcaatcttttacctttagaacacctaatttagatctaatgaaatatatttaaatgaaatgtagaaagtactcaaacaagtctccccaattctgttacctataccaatatttaggatttttacaataaaaatcttcaaaaagtattaaatttttactgtcattggttaattctagttttttatagatgcaaaaaaaaatcatcagtggtatttttaaaagttccagccataatgtatgttgcaacagaactttgcatttacagtaaacagcttttctgcaggccatcagtggtgagactccctttctctactaagcagactgcctccttggaaaagagagagccattttagcttagcgcttcagttcagttttgttttgttttgttttgttttgtttttctagaaggatgtaaattgttctgtttgttcaaatgcagaacagtgaatgaacagtgaatagtaactttgtagtagagattgctgtccaaagggaacaggggaaagaaacgtcattttaattgaactcaaaaatcaagagtgtatctttaaatacaattgcatgtatgcaacaacgcaaacacttacacagttaatatcatttggcttcatctttagtcataatttatattcattacatatgggtaatgggtatgacttacctcaactgaaaggaacaagtaggggctgcctcaattttaatgactctgagttaatctacacatacttgtaactgtgcagtgctaagttgtgtagaacacatcaaataaagagttacctggttcagcgtagcataggagatgtttataatctgacaaattgaacatttaattttaaataaggctatcataaaactaagttaatgatttagaagagaaaatatacaaatattatttatgtgctcctagctgtgcacaatactcaaaatttggaaactatctcagagatttgggctgtatagacattctaattcaacaataaacattttcttattaaaatattcatggaaaagttttgaaaagatatatggtaacccattatttttctctaacagagggtattataggtactttttctcttctttctacatttttatttttctcaatttcctatgctgagtacttatttcatgagctttgaaaagcttcttcagaaaatcactagagatcaaaattgtaatatttacttaaatgtttaatgttaattaatattctgattagaagcgatgaccatattgtttggcaataaattctgcttgattcctctgtttggaagctccattattagttttacattaagtatatattacatataataaaagtgaaggaataactaattataagtcagtgtcttcagcaaggaagaacattagttaaatttatggaatagagttcttttcagtttaacagttaagagtaattgtcatttggacgccaactaaagaactgttcctagattagcaagtcctagtataaagaaaaatatgagatt

SEQ ID NO: 937 - DNA, 1613 bp, Homo sapiens
tcacgatcccggctctggtcatcagtctttgaggtttagaaactggttcagcacagccagagaatccatctcttgctgatacactggatggatggtatgaaagttaattccctgtcgactgcatcatggggtgccaagattaaactttatttcggggtgtgcctgtgagggggtttctgaatgagtctggcatttaaattggtggatcaataaagtagattgtcctccccaatgtgggctggtatcatccaatgtgttgataacaaaaaggcagaagaaagaggaatttgccccttttgcttcctgcctgtctgagtttggacatgggtcttctcttgcccttggactaaaacctacactattgacttctctggttttcaggccttgggacccagactggaactattccactggcttttcctaggtctccagcatgcagacagcagatatgggacttctcagtctccctaatcatgtgaaccaacctcataataaatctcttagtgtgtgtgtgtgtgtgtgtgtgtgtgtgtgtgtgtgtgtgtgtcccattgtttctgtttctctggaaaaccttgactaataacaatttctttatcctgtggtcactttctctttttttgaggcagggtctttctctgttgcccaggctagaatgcagtggcacaaccacagctcactgcaacctctacctccctggttcaagtaatcctcccacttcagcctcccaagtagctgggaccataggagcaaaccaccatgcctggctaatttttttatttcttgtagagacagggtttctccatgttgcccaggctgggctggaactcttggcctcaagtgacccacccactttggcctcccaaagtgctgggattaccttgtggtcattttcttaatttgcaaataagcttatccttttactgggatgagacaaaagcatccctttcctaaatatcaaggatcagccatcaaaatcatcacatggtcatgagaacaaagtacagaaggtctcaagccagatgtcgcctagactactgtcctccaataattacatttgcatttaatttttgtgttttcacttagattatagtctttaaaacataaatgtatattctagatttgcactaccacatgtggatactaacattttaaattcatattaattaaaattattaataaagtttaaattctagttctatcccattggccacagtacaagggctcaacagccacatgtggctggtggctgctgcacccctcagtgcagaaagttctatcagacagggctgttctcagtcatctggattgtttggacaacacgtgttgccataagatttcagacctccaattaggatttgtgtttactgacaaattagagctcaataataccactttgacaaagaacttaaagagaaccaagtatctaatcagcataatacattcccttcagcagccatattaaaaggtgccatagtaccatattggtgggagaacaggggtgacaccaggtaggggaagggacatggtaaagtatctgcaaccactgcagtaggagcagcagcaaaggtatcatctgtggcttctcaagccacccgagcctgacagcgaaa

SEQ ID NO: 938 - DNA, 1343 bp, Homo sapiens
attatttttatttttattttatttcattttattttattttttgagacagagtcttactctgtcactcaggctgaagtacagtagtgcaatcttggctcgctgcaacctccacctcccaggttcaagcgattctcccatctcagccccctgagtagctgggatcacaggcatgcgccaccacacctggctaatttttgtatttttagtagagccagggtttcgccaatgttggtcaggctagtctcaaactcctgacctcatgatccgcctgccttggcctcccaaagtgctgggattacaggcgtgagccactgcacccggcctatattgcttttaatatacaatttgtggttcttgcgttttgactatttttgctccataattcgttttggaaactacaacaaagtttggaagaaggacttagtaattgggcagctcaaatcatgtaacaggtgattcagagcctatttataaagtaccatctgttgtctcaagagacttctcagacttctcagccatgttaattgattccttatagtttatgagtggcttttcttaagaacatgattgagtgtgatttttataagaggctagaatctacagatggtaggagctgagttgctgtctgaaaaatgtaagatcagaatgcacatgatacatcacagtgttgttggtccatgatgttctattcatttatcctgtcatgaattgtattgtactatcttatcccaattcttctagttctcttccttttcatttttcctagtagtaatggtggtaatgatgataacgaccatgacaccaacaataataacagaattacaattaactgtttgatattggaatatatatgaagtcatgtaccctttggtttaaatatgccatttgatttctaggacttagaggttaaattatttgcccaacattttgtaactatgaagtggcagaaccaatagctgaatacaggtctctgagagattatagacttactctccaaaattccttttttcctgttattcctatttatcctttcttactcttgtcaaactgacccattctcatggcatcaattttaatctcctcttagataattcctaaattattggtatttattatctttttctttcttctgatctctgatctgtatctccaaaagcctgaccagttcctctgcctgaaaacactctgggaatatttctttctactaatatgtacttcatattattcttggttaatgatatcattttccccttaattattcaaacttacaacatactctttgtcaccaccacctcctcatttcataaaaataattatagaggccaccatttccatttggtatt

SEQ ID NO: 939 - DNA, 1270 bp, Homo sapiens
aggtacatgccaccgcactcaaatctgtttttgtttgtttgcttgtttgtttttgtagagattaggtcttgctatgttgcctagactgaactcaactcctgggctcaagtgattctcctgccttggcctcccaaagtgttgggattataggcgagagccacaatgtctggcctacaaaaatttaaaaaattattagccatgcaacatggtgcacacctgtagtcccagctatatgggaggctgaggcaggaggatcacttgagcccaggacgttgaggtttcagtgagccataattatgtcactgcactccagcctgggtgacagaatgagacagtcttaaaaaaattttggaaaaaaaagagagttgcatgactttgccagaatcagaagaagactggggaagagctgagagtgtaaattataagggtgttagaccaatggggataaagtataatattcaagccaaattaattgacctgagtgtactcccccaggatttagaatatagcatgttggctggagtactggggatggtcctaacagtctgaaaaagttagccaatgaaatcctggactcaatgatagtttggagttaatgaggttgaaatgccagaaatttcctaacatattatagacaaagagttacaaaattcaaggaaataggactcggtccattatgttcaatcttctcagccatttactaacttgactcttttgggaggattcaaaaaactctcctttcactaagacataaggaaatgcactagtgagtcagggactagcatcctcaaggagcactgtaggtcacagctgttgctggacaaggctgcagtgaaaatgtgtgctttcatttcagtgggaataatggggtcctggcatgtcaaaggccaagtagtaacttcactgttagggacaacatggtgcaactaccacagtaaaccacagagatggaatagtaatcgaactgctttgatctgctgtgccccctggcaagggctaatggatgatggggtcctgaaaaatcattaattcgctgcttcctaagatgctgcttgacatctaggcagaaaaaaatctaggtccgttaggcagaaacctaactcgagttgccaaattgtgcgttgtacctaattcccagacctatgtcagttaggagactgaaagctcttccatccactgatgaatatcatgaatcttccttcaaaccagtgtttctctcaaccttggccccactgacattttgggcagggtatttctttgttatgggggc

SEQ ID NO: 940 - DNA, 1743 bp, Homo sapiens
atatgctggccaactgttaggaacattggtgctaacagggataacacatcatagtgattcctgcccagaaataatataaaacacaatgcagaggcatgctggcttcatttgctgcaggatcttggaactaaaacaggagggaaaatagttgttcccctccctggaatgtccccagactagtctgtggtgagtttaccactgccctggcacctatcacaggacctttggtcatctctgcagggtgtgggctgatactcgacatgaccacagctaaacatggggatgcacatgacagagggaaagtaaatgaaaaggattttgtttttcacatcagtgtctgaggtgaacaggccagaccaagaatgagatacagtattataatctgacaacgaaatacagaaagctcaaaacttggggtgccatcaaagccatgcacagtaggagagaaacttcagatacataattgatgcatggaactggaaacaaccaaaaagctattccaagtttctgaaaagcagccaaatcacaatatcttgagacattcagaaagttcctaatgaagcctcatccaaaagcaacgtctaaaacatgtgttctagtaatttggtgatttattcaaccagcacctattagggacctatcacacacccaacgtgctgctcagttctgacagatgagttcctgccttgtaggaacttatactcaggtgtaggggataagagacacattcctcagccttcatggtttgagtgcagattatattgagatgaagtgatgtggtagggtgcaccccttaggaaagaaaagttggcattcagaaacaaaacaacgtaaagggctatatgtgcagctgaatggctcaaggaaaaccacctaggaaaggaaaatgtgtgttctctctgttctctgctatgttaaatagccattagactgtcctctatttcaaaatattgaaacactatagaaaattgctgggtaaatacagaacttgtaaaaggaatttgcaaccatccacacccctggaaatatgggactctgtttccgggttgtgacggttatataaattattttctttctcactgactttcaggttcactaggaaatggtgagctaacagcactaagaattatcttcaggagaaataatccttcctaacagagcctgtatacgtgttatctagataggtacatttgtcagaaacttgggtagaggttattctatctctcctccaaatttaattcttgaatctgattctctgttccatttatcttcaagaaaaaaaaataaaaaccatgtgattacaaaggcaaagacttgatgaacaacggaaatgagataaaaagtattcctccagaaagtaaaaataccaagaaatggtttttattcctgtgtatttgtacaagctaaacgatggtctagatgaggagaaagtgtctctaggaagattggcaacggaatgaactgacgtattctgagaaaaataatagaagataggctgatgaaagttcagatcccagcacaggcaaaaagtgtggaaagggaggaaataaagaggcctatggatacttctaagacaaatagttttattttaaaactctagtcaaaataccttggtgcagacaggaaaacaacttttgagaattacataaataacaaagatttgaaattggaaaaaaaaatttacagcacacagactccctaaaatataattatgtattgcttaacaatggggatacagtctga

SEQ ID NO: 941 - DNA, 1881 bp, Homo sapiens
attgtaagacacctgtgagagtctaaagtctgacaaaattgtaagtaagaatattactttgagagtatcataaagagtatttttatatcataagcagatgtatattatcattttataagggtattaatataggcttttaaaagattttcgcagcagactggttctaagtcatttttccagaacattcttaggaggataagctttgtttgatggaaaaaaaagcttaaaactgaatgcagggcaaatggaaaatctgtcttttgaagaaagcagagtctggagatatgtggttctaagctgaggcatgctgctgcatttaaattttcctttactgagaataaaaacaagcacgccatccatattggttgcaatcactgttgtatggggcaacatgtgcacatgccttactggttagaaacaaattagtgctggtatatggtcaattggttgcactttaagaaaaacaattctgcaagcacagcttaactgtgcatatctggcttgctaaaatcacctattgtgcagacacagcattttagttttagcatttctgggcaaatggcttctttaaacaaacaaataaaacctatttcagagagtataggtgtataagacaaattaaaaatggatgttgttgaggtataaataagagaattcaaaagatatgtggtatgagatagcagcaaataatttttcacagacttatgttgctactattttttactgtttatctttttttatatatttattttgattattattttcttattgcatactaaaaataatctttctcaacagtgtactcccaaaagtatcatctggggaaagtatgacagtactacatggataaaaatggtttatatatacaacccactgaaccttgaaatattgcagctcagagatatgcattgattcaaacaagcagagctttatctttcatatgaaaaggacaggaaaggaaatcttgttcaatggatgaattgaagaataagatgttcagtatgtgctaatttcagtaggccaattgcagcaggccttccaagagggcaccaaggtctgggtgccactgcttctggcatcaagcactctgggctgcctttatcttgttgttggcacttctacctatgtttctccctcaactctcaaggctctcaacttcattataaccaaacataaaacaagtctaaactttcttatctgttgtaaaaatatacaagcaagcttatgggcacgttcatagtctattcattagaaacataagcagtttttcattaacctgattgtcagatacaatacatatactcaaaatatgggaagacattatctatggaataaatctgtttaatgatgtatctaaagttcaaggaaaaaggaaggtttatgtatcaaaatgtataaatcttgataatagggaattgagtaaatataattgaactttatggataatccttaactgtgggtaaacacactgtcatagtgacaaatagaatggtggtaaataaattaggcaactgcttatccccctgagtatttaattgcaaattatacaattaattgttttttgtaacattttgtgtttgacttatgaagctgctaatatccaaaatataagaagagaagaaaaaaggaaagaacaaaataaaagtgagaggccttattttatccacaaaataaagcattactctccaggttgagtcagagtgttttcactgccaagtccagaatagtttccttgcttttcctacttgtatgacaaatagaatggtattgtaaactgtatgatcatgaatatcagtagccagaatatattatacagcatttttaaattgaaattaaaaatcatttttagagcatacatttttagttaaagtacacattgaa

SEQ ID NO: 942 - DNA, 1900 bp, Homo sapiens
aagaaatatttttataaaatgctacaaaccttttttgttttaaaggataaggtataatttgataattacaaatacttctaggattgtgaccaagaatttcatcagggattggtaataagctcattgtgtaattgttttatgcagcacagtaagctctctgtcagattcttcctgtaatattcaaaactacaggtaaacacagattagcacctatattttaaatgtgtttgctgcctccctgtcatttgaaagcacagctgattaaagtgagaattgtaggtggaggcttcaccttatgaaagttggtcttatttgttgcatggaatcttcttttctcttgagattcagaaattatgttcaatctagcttccttcattctcatgaaactagctgaaattctagctggtaacatgctccattttttcgtctgttagcttttatcacagcagagtgacagatctttcaaggggctttcttgcaacctccttgggattttgctcctgctcttataaagactcttgactttagtaaaagcattcagagcctgtaccatgcaaaccaccagttacacagtctttgacactcttctatgtggcatttctataatgcttacatctgtaaaaacccatgtctcttcggaataagttgaaaatattttaaaatactttttttttaagaaaagtgatatgcagatatcttagcaaatccatctgtctctggtataggcagtgggacaggttcaaataaagggtccctgagtgatagttggagtaaaaataaaatgtttgtgagggcaggtactacctcacctcttttcctcctatcagacaccctattttacctgtgcaaccctgtattccattgtgggtccagaaagagtttccatgttctggtagcattacctccccttcttcttttagttcagcagcttaaacatttctaggggtgtaaatgaaataacacaattaggttcttcattctttgactccatattctctttaattggacagctgtattcgaagagtggcagttaatagacagattgaacctaggcagatagataatatgaaggataatagaatcctgatcactttcatttcaacacattcccagaatagctacactatctgaataaaaaatagtggtgggattagctgctttagtgagggcagtgataaaccaaaagtgtctaaaggacaaggttcaggatagggaaaatactagagaaaaatactatatgaaaaaaaggtgaaagaactaagcattttttcccagagcagagaaaaagagtatgtgtgtgtgtgtgtttgtgtgtgtgtgtgtgtgtgtgtgtgtgtttatggatgtgcagggatgatggagagatttttaagggctatcatatatcatatgtaagaagtagaaaagatatcattagatgcaaactctgtggcttaagaggctgcaatatataaaagaaattttatttgcaattagttgatagcaaatagaaagttccaactgggaaaaacatcattgtctttcactaaatttatggtcactgatggttttccaataattgttaggaccttcctagaggtgctatgaaaggcatcctgcataccggttggtttactcagagtaaaagtctctccaactcggaactatcataattctccaattttagtacagtctggcatttttgttcctgctttcacctggcttcagttacgtaggttccaaaacagtcatgactgtgatattcttcctagtgtgctcttagatattgctattgaattatgactatttgacttcttggtgatctgaggtgattcagacagctggaaatttctttttcttttagcacagaaaagctaagcatggctaactgtggcacctctttcaagatggtggttcacag

SEQ ID NO: 943 - DNA, 1703 bp, Homo sapiens
tgctttctaggtctcaacatttttgctcttcttttctgagaagtgttcggcagtataccatatctacactcccatccataggcctcttagtgcaccagatccaaaatatcttatataaaggatgatataaatatcttacataaaatataaatgtataatgtctataaaatatctttcagtatcttttaatatctaaagtaccttgtgtaacgatcttatacaaagtatgacatcttatataaagtattatataaagtcattgattcactgaacaaacattatttagttttgtgtgcagcatagaatcatcttatgttttgatgtaaacactcaagtatttgttcctgatgtattcagaagaatatttagggaatatgaaaattccctaacacatataaaggatatcgtttatccactggagtgtatagataggataatttttctaaaaatataagatctctctcttagaaaaggataaatacattctgtgttgcttctaatgtttgtcaggggaaggaggccacattgagttctattgtgagaaaagaagcagaatgagaatgaggtcttttgcatggaagggataatgagagtttgggcagagcaggaagagactactaaagaggggacgaagtcagcaaaaggatggacttggctagggagagcctgtattcatgcccctgagaggtctgagcgtggttgatgacctggaatgggtgtattctttgtgtccaaacctgtggctcagggatgacctagctgggccagctgtcctcattaaatagtcattatttttattaaatggaggatcgtgcttcattcaaagtcaataacagctagtatcaatgactaagatattgactgcctagtagtagcaacatccctgcctacacccagagatattatcagccaattacctcatcatctggttatgggggaatctgtgttctgcgccatgccttgagcatgacacatattttggcaaacctatgtctaggtttcctttctgcaataccatatgaaatagtaaactcgagtgaccactggacttctaatgggatgagcagtgtggcagaagtttctgttttgctaggaccatcctaacctaagaaagtcatgaagtaaactccacagtatcgtgtatgaaattctatgctaggcattgtagactaaatagagatgaataagacttgattccttatgtctgattcctgtttatggggcagaatggatactatgggtccatgataaagtgtcaggtcaggaggggaatacattggggtaagtatttccctacttgagacagtaaatgcaaataaggttttgtaagtccctttactcttaaggtagggctcaactctgttttaatacatttctgacttctgagttcattggtttatgtgtgaaacaaaaagattactttcttaatttcttgaaaaagtccaatatcatctgtaaagtcttttgttgatgttatatgatatcacacagaggaagaattatgggttggatcgtaatactattagcttgatgagtttctggctgaacattgaaccacacattgctaatctgatatgttttctgctggtaaatatcagagccttgttgtggcccgtattctgttcaatacgttcatcagggatttggataaagatatgaaggacacactcaccaaacatgtggatgacacagagttaagaggg

SEQ ID NO: 944 - DNA, 1992 bp, Homo sapiens
tagttttatgatagattttgacatttatttcttttcttctcttttcttttctttttcttttgtgacagagtcttgctctgttgcccaggctagagtgcagtggtgcgatctgagctcactgcaacctctgcctcccaggttaaagcgatgctcctgcctcagcctcccgagtagctggaattacaagcaagattttgacagtatttctaatcaaattcctgctgcctttataaaaaatccacatgtttactcttgtgaaattatttgttataattgttaaactcttgggttttttttttaaagacttagaatatcataaaggtataaagagaagaagcaagttatgtttagaattttagctaagttgttttgtggatgacattctgtgttgggtttaaaatgagattattgaagtgggctacctataagatagagttaatctaatgtgggttttggtgtgctctatggttaactgtgggtctcaaaaagttaagtgtacttcaagtgcagtatttatgtaaaaccactaagataagatcttgctgtgtaatctttgctggtgctcaagctaactgattacaatggctggcattttcactgttctcacacttacaaaaataaaatcagaaagcttgagaggatagggaaagacatctggtgtacaaaatgaagacatttatcaaaagggatgccttttttccttttaaaaactgcaaaaggtttgtttcatctcattaggcttagaagtataaattttacataattagtagaaagttgaatgaataacagaaagttggaataaatatttgctcttgtattaaatacatatgaaatgccttgctttagtatattgattatgctaatttatagtctaaatgtacaattagattcaggaggcataacaggatgtagaatttgataaagaatacattaaagaaaaagaattcttgtgtagacctgagtcttaaaaaaattaaaaaataacatttaaattttcttgtaggcctggtgtggtggctcacacctataatctcagcactttgggaggcctaggctggtggattgctagagcccagaaatttgagaccagcctgggcaacatggtgaaaccccgtctctacaaaatacaaaaaaaacattagccgggtgcaggggtgcatgcctgtagtcccagctacttgggaggctgaggagtctgaggtgggagaatcacttgagcccaggaggtggaggtgcagtgagctgagatcatgccactgtgctccagcctgggtgacggagtcagaccttgtcttaaataaataaataaataagtaaattcccttgtagaactataattgttttatgatacagaatattaatcactgcattaaatttggatattattataacgatatttagtaaaaaggacaaacttgaatttctgttcatcccgtcacacctctcgattagagctaggtgagttacatgtagttataaactaaagggactagaccccaaagctatgttcactctactcttcacttttaatcacatatatattttcttttcttttttttttttcgagacagggtctcactgcaacacccaggccggagtgcagtggtgcaatcacgggtcacagcagcttccatctctggggctcaaacaattctcccacctcagcctcccgagtagctgggactacaggcatgtgctaccacgcctggataatttttctattttttatagggactgggtctcactatgttgcccaggctgatctcaaacacctgggctcaagcaatcctcttgccttggcctccaaaagtgttgggattacaggcatgagccaccgtgcccagcccacatatgtattttcttctctctgggaaactagccttcgttttctccaattattgacttatttctttttcacccaggctttgtgttaagctcctggatctctatgaaaccgctgctgatacttctattagcttctgttaaaagaaa

SEQ ID NO: 945 - DNA, 1879 bp, Homo sapiens
tgtattattgaacattcttctgggagaaattaggaagagaaagaacaggaaaaataggcaaacagcagatttctcttcacttaagacacagtcatgtatacggatttttttttcctgaggttattagcacagacgtaaatttacccagtgtaattaattagcacacactgaacagctaatcaacaccgattcactattgtcatttggaaaaaatttattaggaaaaaagtaattttccagttgagtcatcagattgaatatggatattacattgtagttgacaataattgttttgacaaatatttatgaaatatgtcaaattaaatcctcagaaacgtgtttaattttagtgatgttataaaacacaaaagcctcaaaaactgtcagtaggagagttagcattccgtgaaaccatgtcttccagtgaatttggaataattttgagaagagtaagatgcgttcttgttattcgtcttattgcactggaaattttgattgatgagactttaaagaaagaaagtagttggttagaagaaaatccactgtagccatatgtgaaattgtagctggtttctctatattcagaccatataagaaatcactcccatggtgagtagttactgagattttcttccatttcaaagtaatgccattaatgaatcatcaatggaattaatattatacagttttatgagtttcagggaggaaatcaaccgctgatatgatctcactaataaatatacagaataattaatctaaaaatttgttgttacactaacaaattttaatctgcagtatagttttgttgttttctcgttatccaaagttcacatcttacagtgtcgctaatcaaaagaaatgatatttcaacttgcagtactcagtgagtgaagctaagcagtgatgtgaaaatctcacactgtaccgacacagtactactgtggtttctttaatagtctcacttggttggaactctggaggtgaagaaccagtcttatttatcattgatttttccttcttttagttaaggttccctattgagtatgattctcagactcagtttcagctatattaacaactttatccagacttgtgtctgcctttaactattttttaatctagtgtattgtttcatctttggcaattatttatatatatatatatatatacacacacacaccgattttgctaattctcactttttctgaaactgccacttaaaggttataagctatgaagtttaaaattcagttacgaataaataagaatctctatatttttctcttagttcctcccccttttctcttttcagcacaaattgatagtaattggttacaaaatggcatgtaataacccttgaaaatctcagtgatttgtagacttacagtttatgtgaattgctggaaaaggcataaaaggattttctactttgtcctatatgtttcagtatagctatcattttgatttattcaaaagcattctttttcaccaggcagtttcttgcttccataaaaatgtttatttcctttctctaatgaatttaacatttgctcctgctggagacaatcaatgtgactgtgtactgtacattcccactcagtgaatagaatacttctggtctataatctccagtgactttcagatctcctagagtcacactgagatccaaaaatgcctttgcagttcataagcatctccttattatgtcatcatttcctattaacaatcggtccctatgtataataccaagtgcttgcttacaattttcctgaaaattccttttctttgagctcactatttgttatactttggattattcacttttagggcattggagagcctatagcttgccctttgtttattttatacttcagctgct

SEQ ID NO: 946 - DNA, 2543 bp, Homo sapiens
ctttggtcatgtatatgtgtgcatgcgagagaggacgaggagacagaggagacacgtggctcttcattttctgactcatctatcctggattttaaacaggatctagtataattccacattactttcttgttctccgtgccctctacaaagtgaaacacttgattcaagagaacgaggcatcgctcatttaatggattagcttttcccagagcagcaaacccaaaaaccatatgagaacaaaaaacgataatagcaatagtaaaactgacaagttcatgagaccctgaggcattgctcctctgtacccagtgtcttctatctccaagtcttctttgtttcaagggcgtcaaatcagaaattaaccttgtacatgaacctggggagggcagaggctgcacagagatggccttgggtggtggctgaaatggttctgcacaccccttctcttgtactatacacttatttagcctgtacactgtgctctttggatcagagggggcttagcaaggaatgggcaggaggagggggtctctttatcagtgaacacgggagcagcatgagaagttcaaagaattttgagacctgactccacttgccagctgtgtgtcttaggaagtcagttaacctctctgagtctctgcttcctcatctgtgaaatgtgagagggacaggactgaagctgtaaggccattgtgaagatttgtctaagatggcaggcctgatagggctttgtgctgggaggcgagcccttcggaaggactgagcatgggagctgttggcagggctgtgaatctgcaggcaaagcctttgctgtgggctctttgggtgtttgacttgcctgtttaatcggccttgggtaccttgactcatttccatttttataaatgcattaaaaatgccactgggctcagaacaaacgccaatttaacctaagcatagcttactctttgtaatggtgagtcttgaatctccaccaagccaggcatggctgcttccagcaagaggagcaggattataataaaatcagtatgtgttcatagacattaagtgtgttattagcatctttgaattggatgaaagctaatcttttccacattcaatgaacaaacatgaatgatgtcagtgagagagaggaggaaaccatgcccgtgggcagaaaccagtgacatgcaatgaagaggaggaaatggaagcagctctgccacctccttgctgtagaacctcgagtgaatcacttgacacctctggtcctcagtttccttaatctgtcaaatgagagaattcttggtttatctatccactgggatgaagaccttgtgaaaatatatactgaaaagatgtttaaaaagtataaatcatatacaattgtatagggttgttattgatggaaggacatggtggtgtatggatagtcattggcaacagatgacttgtaaaattctgtagttagattttaggtgcctgaagtgaatgagtgagttgaaaaatatgccaggcaagacagctgtttacatttctaggaacgcatactctgtggtttttccaattacacatcttttacttaaatagaacaggatattacaaaatttaacctgttcttgttgcccttaccattaaaaacattgtcaacagttgagagctcttaggggccaagcactgactatgtactttgactgtattatctaatcctcatcacaaacctaggaggcagatcctataattgccagtactattttatagtgaggaaacagtctcgccgaagtggggcaacttgcccagccagggtcatacagctaataagacacgggcaggtgattgaacccttgaaatctgttgccctccagtattgccagtaagtcaacacaaacatttgacctttccccgcttcctccctcttttcctcctcttttctgtagataatttaatcaaaaaatcattgggttctggtatggtggaatgagaagtttgaaaaatcctctcccccaaaagcaatgataaaactggagaaaatcagtaaaaatcacctgaaaggctctagaaactgagcaagatcatacatttcatacaaatataaaatggcacaaccactttgaaaaacagcttggctgattcttaaaaagttaaacataaatttactatccaaccaatatacacttttaggtatctacctgtattggttttctatcgttgctgtaacaaattaccacaaacttagtggtttaaaacaatgcaaatttattatcttacacttttggaggttagagtccaaaaggatctcactgggctaaaatcaaggtgttggcagggctacgttcctttccctaggctttagggagaatatttttccttcccttttccagctttcagagcttgcccacaattcctcgactcataaccttcatcttcaaagccagcagcagcatattgagtccgtctcacattgtttcactctgacctcctcttctggctcttccacttttaaggactcttgtgattatacaaggcctgcccagataatccaggataatcttgctttcttaagg

SEQ ID NO: 947 - DNA, 1561 bp, Homo sapiens
gaaactgtggtaaaatatctggttaaaatggtgctttctattctgacataaagaattaatggtaaacaaaaaaatctattttgggtgtgttcgcaaataatccctcataccagccctattctgtaaaaacacagccggaacactttctttttatcatagctatatttttatattttttactgtctgtaatttgccttggtaattcgcttctttttatgagaaaacaagttttcttccaaacaaccagatacaatgtagtcaaataattgcggtcttaacttgctactgaaatcctcctgactccagatagaaataatgtacaggtatgctatggtatatatttacattctgtgatgttagcaataatcatagctatccttactgaatgctatgtcctgtgtcaagtgttcctcatttaattcccacaaaaccccacaatggtaaactggggctcagagaagtttaacttaaccaagatcatactcttagggactgcttcagaatttccgtatagtagaacctagtagtatccatctggctttaagtttaagaaaagttcataggttcatattaagaatgggggtaaggatagaccaatgaagcagaattcaaaccccaattgccctgacccgaattctggcattcttcaccatcatgccataccacagaaataccagatggcaatgctatctttttcgaactgccaaaacagagctattcaagggagccgcctcacaagataaaatgagaagcccacataaagcctctagtggggtgtgtggatgggagaaggtgcttaacatggctgattttttttcttcttttcctcttcaaatttcaagttttatgaacacaattttctcatgatacagcttttaagaaattgaaccagattgggccgaaatctgacaatctgtcctcagttacccacacagaacttctgggatacaatctcttctcccagtgactcctacacagcattatttttaagaatttgatttcctaggtaccacggatatgaaaaggcacagaatttcatagtacaaaaaagatgtcaaaagaattcgaaacagaataggaagaatttatcattttcttcctctgctccaccacatacctaagcaaaaataaattgtgtgtgtgtgtgtgtgtgtgtgtgtgtgtgtgtgtgtgtgtgtctttaaaactaagaagtcatgttagagtttctggctctagaatcagtagcaagactaatatgagtgaagtagtcttaaacaagattaatcttagtgccctagcaggcatttgcctagagaaagggtacatttaagcatgaaacctatgactaacctgaaactctgtttaaatcataaaatattcagacaatgagcttcttttttagtagcttgcctagttttgcatttggggagagttatttgggaacataattttgttgtaagtatttcatgttaataacagctttccattactttagaagcctagctattatagcagcaagcttgcaaccaaaaaactagaaagaaaaacttattctttatttaaaaaccaattgcctttc

SEQ ID NO: 948 - DNA, 1482 bp, Homo sapiens
cattttctcactttctgaagaagccacctgtgggtctctgttcattggtactaagcctcaccctcggagcaccatatacaatacaatgggtctccatgtatttcccatttatactaccactgagataaatgaggcattcaagagaaaacaaagcaataaatgcatgttacaaatcaattttatcagagacattttacttcatcaaaaaaagaaataactacattggactcattagaaagtgagaaaaacaccattttgtcacagtcttaagcagctggttctggtttcaatgattaagtggaaattaatcaatcaaaaacaatcaagcaaataccctgttggaaatttacctttaaataagcagttgtctacagctaaccttacagaaagatggcagccaagacttgacatagtgtgagagggaagatgttttcatgtttcaggagcccagtgcataaactaggctcaacacatgaagctcggctcaagaaattcacaagcaaagatcaaccactcaaaccaaatacaataaagtgattctgtaatgaaaagtagtggtttcaatttctcaaaaaagtttgattcaaggggacatgtgaatagggatgaagacaaagaaaattaaaatgcaggatggttctaagtgataaagaaccttttaaaaaaaactgtcataattagatggaaaatttccacaccatcatttgcattgagagatttcccttaatttcctactgccatgacagtaatgaaagaaaaagaatgatgggagaataggattaatcaaaataaataattctttctctaaaaaaaaaaaagatagggaggaagctttaagaaagaagagagtagagagctagagatttcttaatttagtttggaatgtttccattggaatgaagtcagaaatactcattctgcttgtctacattcttatctatctctaggtgtgtcagtgttttctatttttagaagactctcaaagatgaaaatcatgatttatttatgtgtaatggaataacatttggtggataaatctacaaacaattctctttgcactaattagaagagttattaattttttgtcttcagatacatagtgctgtgtaattattgagtgagcctgtttaagaatatggatggtccgaacacctcccaaatagaaagggaccatcctcaggcctgaatgacactttgaggtgttactgccagtgagtgaaaatatctgacctgccagtatcgcaggagagtaccatagaactttttattctgcatagccattagggaacaaaccatcctatagaggacaggagtgttgatctttgactacgaacatttaaaatctttgaactttataaaaaaaaaacaaggtgaaaatgcttgaatgcttacatacattatgtggtatataattaaacctttttgggtgtaaaagtattatttcagctcacaaacatgttttgtgttcaagatagtgcatga

SEQ ID NO: 949 - DNA, 1482 bp, Homo sapiens
aactttctctatctaggtcttccactttaaatgaatttgaaccatggggaagatgcaaatggacttttaaaaagcactatgggctggcgcagtggctcacacctgtaatcccagcactttgggaggccaaggcaggcagatcgcctgaggtcaggagttcgagaccaatctagccaacatggtgaaacctgtccctactaaaaatacgaaagttagctgggtgtggtggtgggcacctgtaatcccagctactcaggagactgaggcaggagaatcacttggacccaggaggcagaggttgcagtgaaccgagatcgcaccattgcactccagcctgggtgacagagcgagactccatctcaaaaaataaataaatatataaaaataaaaataaaaatgactttgtatcaagggctgccccttgtatattcattgtatctgttaaccctcaaaggaactttgggaagcgggaatcctatgctcatgttgcagactagaaaaccgaagactgatgaggtgaagtatcttgaaagggctgtacatttagacaacagcagagtcagagttttcattcaaacatatccatctccaaagcccaagctattttgtttaagctgtctcatgctgcttgccaggcagaggcaacctctcatctagttagactgatcaaatcaaccccgcagatcagcaaaggtaacttccctgaccaaaccacacttccagggatggtcaagctgtggctcagagtcattctgctgggaactcaaatcacacagcttaaaagaggacagcagagacagaaccagatatcattttatcacatccataccctgtccactgtgtgaggtttcttttctcaaaaaccatcaatatactcggacattcaaattaccttctaaagggaaaatacattaaaaggcagccaaatgacaaaagtcactaggcaatcctagtgactcctgctaatgatttcccctcttttatcatttaaaataacactcggcattagaaccaggctcagtcgtcactgttacttgtcataatgcaccttttctgtcatctacattgtcttgttcaaaaaagggaaatgccagttttgacaactgatgaatgccacagtgagcagctaagagtctctttaagttgtttttggaaatacagaggaattcatccaaaccccgtctctcccctcacgcctccacccacctccactctttgcccactctgtgaaatcggtcagagcagctgacttttgagtcttcagctttgagttaaatatactctaaacctgactctaaacctctaggacttcaaacatggccccaagagacaaagacatttggtagcactccattagttcaaaatcaggaacagtagtaacaaacacaaaacatgctcatactatttcctttgctgtgcttacagggagacccagccccattgtcacctcccctgtgaagctttgcttaactttcccaggcc

SEQ ID NO: 950 - DNA, 1063 bp, Homo sapiens
ttttaactgtctcagggtgaaattccactttacttgtttaatgatgcatacttttgaaattttacaaaaataatcattcatattttgaatttttctgcaacgtaacttttttggcttcatatcaggttactgaaatgtatctatattgctcctatatagttttagatcattcactttcattgttgtattgtgttctgtcatttgatcatatcataatttgtttatttcactttaataaacattcaagtagtttgggtttatttttttaaaccattattaacacaaataaagctgtgctggagagcctccatgtctcgtggtatacagtacagaagtctctaggaaacacctagaaggaaaattgctgagtcacagggtatacacatttgtttttgttaactggataatacctaactgtctttctaaatggttgtaccaatgaatattcctatcagcagtacataaacatgaaatgccatttttcaaacttggaccaaaatattcattactgggaactccagatctcaaataagtcaagtgtcagttccatctatcgctttggtcaatttcaaactgttctttgaacaaatccagacttgaagaaatttccattctgttaaatttctagccaactcatcacaatcaactacgcaagcaaacaataccccataagaacaacaataagtaatcacatattgctggctccaggaagcaaaatgaagacatttaaattaaagcaaacatgcttacaaaaatattctggctatctcaattaatctgaaccaaactaagaataatctagatatttcccccaatcttctgttcccatttagttcatggcatttttataacgggacttgccagataagaagcatgtgtgtgtctgagaactaaggaaaaaaggattggttttactgtctcttcaaaaacatatccgatgtgaatagactaaaaaccattcaattctgcagtttgtgaattatatccccagaaagctggtattaataatatagcagctaagtgaaataagccagtcataaaaggacaaatactgtatgattca

SEQ ID NO: 951 - DNA, 2548 bp, Homo sapiens
tcttccaaatcacatcatgaattaggagtgctgaggtcaaccttgagttttagatctgagcgtctctaacacaaaggggcatattaatcatctggggagcttgttgaaatgcagattctgatcagtaggtcttttgtaagacctgaggagttttaatttcaaagaagctcccaggtggtgctcatgctgctggtctatacaaaacactttgaggagcaaggtcttagaaaacaaactgaaattaattatgtggcttacaatgcaatttggcatgcttttaagtcagaaccattgcctaaatacttctgcatgccagggctgttgtaaatgtacccttgtccaccagcacactggcagaaacactctagagaaatgagtcattccatgattccaccctggggaggagacttgagtgatttgtttaactaagttagggaagaaatagatctgctgtccaatcaaaaggtgtcttgggcaaaactaggaggttggaattttcatatttcttctttaaaaatatttatattgagcctatgtctggatgtatctgaaacaggtctgggcaaaagctggtcaattctagaacagaattaaaagcaatgtggtcaaatcacggtgtaatcgctagtgggttaaaatgcaaaatattctgcatacacaatgtattttgaaaaatgcaacataaagattgcttcacttgtaatatagaattatttaaagtagaaaagattaagaaaataaaaacggttagagtgcattattgcttatggtgtcaggacatggaaagaagtatggtatttttggcggggtggggatgatcttggtctccttatacacttccatcatgatgtgggtatgtctttgagttctactctccacccccaccccaagtccttggtggttctgaaccactaaaggaaactatcatcagataagctgaagataagtaaatgggaagaagaatggagagaacgctttctatccccaccccccacttttttttaaccctcttttaatccttgacttaggaaaataaaaggaagcttaaaaaagtacttatgaaaaatttacaaccagatttaaatctggttttaaggccttgctgaaaccaaggagcagaaactaggccccagtgccaagcaattctttagcccactttgggtgctcagaaaaattcaataaaagaacttatcccaataggatggccaggaaaaatatgtacaataattcagttgggtgctatgatcaaagtctttcagtagcatcattcaaatggaaaaaagcacatgtactttactccagaagaaaaacatactagaatatatccccaaatccactataatgataattatctactatgtggtagaatggtacctaagaatcatagactttcattggctgacaagaatcctgacaatccctggcctgactctatcattttacagagaaagaagctgacgcctacattggtgacgagacttgcctaatgtcacacaattgatccttaaagaactgagagttctaaccagtacagaaacctaggtctcatagaactcaggtctcctgaatatttctcaatttagagcatattgtgctatcccataaattttttttttcaggccatttgaagccaggaatactcaagcttctttggcacataagccactggctcaaaactttgggccaggttacaggaatctacttttagctaatcctggagccttaccttggtttgttctgacttgatagaaaatgatattaaagatgaaatcctgtgccagtgaagaatttgctaaactctccacagtaaggggatagtaagaatttgcccaaactagaagcttcactctgtgtcaccttcctatgagccagtcactctgagcaagtaagggaaataatgtgaaacattagtactggtattttgtcatggatttcagatgtcaggaattagagccctacttctttcttagtataaagggctgttgttacagagaatgatggaggatgtcatgggatctaatattgtattgtggttaagaatatgagcttcagtacccgacagaactggatttaaatccaagctccagcaagtactagcttggggacttcaaggaagtcaacctcctggtcttcagttttctttcttataaaaatgggaatagaaataatccccctgacttaaaaacttgtaaagattaaatagcatgtgtgtttgaaacacctagcaccatgtaggatacaaactgaacattcagtaaggtagtgatgttttactcagtcagaaaggtaagcttaaatcaaaatatcagagaagatcctgacatgtataccttatacggttttagaattagagaaagaagtccatagcataactttgcttgaaaatttccccaagtaatgctggtcctcacttttcatgttggcttaagttactgttccattgagattggagctaaataattaacggcaacatcttccaaacctggagcatgcacccaaaatgtacccaaaggaacactgtcttctgttaagaagcaggaaagtctat

SEQ ID NO: 952 - DNA, 1367 bp, Homo sapiens
ccttgtcttggatgagactttggactgtggacttttgagttaatgctgaaaagagttgagactttgggggactgttgggaaggcatgattggttttgaaatgtgaggacatgagatttggaagggaccaggggtggaataatatggtctagctctgtgtccccacccaaatctcatcttacagctcccataattgcgatgtgttgtgggagggacccagtgggagatgactgaattatgggagtgggtctttcccaggctgttcttgtgataataaatgggtctgatggttttaaaaatgggagttgccatgcacaaactctctttgcctgctgccatccacataagatgtgatttgctcctccttgccttccaccacgattgtaatagtttaaaaaaacctcatctgttaaatattttaatgaaacctgcttttttaaactgttaattacccaattcctatccaaaatgtttactttttaaaaattcacctttctaaaaataataaagaaaaacctatcagcaaataaaattagggcccaaacattccacctcctgtattaaaaaaataaacatttgtccctcttatttcagagattttactttaaagtgttttgttttgttttttattcctgcacagatcttcactttgtggtttctaatgaagaggttattattaaataatagtgaggcttataatgtcaggaacattttgatgacttatatatatgtctaaaaacgtacaaacaggttggtgtgaaagaaattattagaattcatcttaaggttttgccttccattcagaattacacatgctaaaactcaaggagcacctagaatttggaatgaatgaggtagaaatgagttctatcatttctctgatagtgttgacaaaacctgtcatgaaaaagtcaagtaaaagtatttacaaatgtaaattctactgtgaatcaacactagaaagcaataacacattgcacacgaaaataaaaaccgaaagtaaacaatgatgtagaaatgtgaaaaatattcacattacaatgaatgaaatatggcaatacaggtaaattccataactcaatactgcctaaataacatgatttgtggaaaatcatttcattaatagtactaggacaatatttgtctcctttgaaaaactagtatgttttctccatattaacctcaagatttatgtcaaatgcattagacggtatctactttcacaccgggatcaatgacagtgataccattaatactcttggctagcccatttgctccttccttatttctaaggtcttgatttcttatttttattggtagtttttttatgatttttgtgactaattttggtaacagacctctgaaagc

SEQ ID NO: 953 - DNA, 1593 bp, Homo sapiens
ccaagaattgtcatttgtagatttatcattagcacaacctatagataagggagagaccttaacatcacacatttgagttgaaagtgaggaccacaatcacccaattattccagagctgcccagaatgtccccagctattcaaattgtgcacatgctcttggcctctatgtaacttggcagtgtataagctagtgccaccagcctggttatcttaagtcccagcagtgtgccttgaaacttgcattttcttaactcaggaagagttgtcattctaccaacacttttaaagagaatgaatgttatcacctaattacagtaaatggaaactcaaagcattcataggtgtgggctgcctgtggggtccatgtaagccatctttcctccagattttggtggcatattgaaaaattcctgaggtcaaacaaggggatggaggcacagttgttcctaaggtatggtttttgttggtggtgatcttttgaggacaccactggatacaaataatttgtttcacacattcccctccttgctagttttcatgcccctgtggcttttatcaccttgtactgggtcattgatgttgcatctgtgggtggcaaggcactctaaagattcctgctgctccttatattgcaggacactgacaaataatatttttcctttttcaggacatactggggagagatgagtatgaaacattttatggatggataagcagaatagcagcattaggggaggaatctttttttttctaactatcatgccatggagatcagtcaaaatgtcccactctatcaataaggcagtgggctttacaccaattaggttgatatctggggaaataagtacctttaaatatatttttttctgccttagaaaacaaagtgttaaaaaatctacaagcttcctagcataatttagaaaatctgcttttatgaaatgggttaattatgcccattgaatgcattcactgtcacagtctcatcctcccacttctgttccaaaatgacaagtgaaaccagggactgtgcaattttggaagacaatcagatcacatattgagtattttgcttattcatacaaccataaacggcctatgcttgagttccctcaattacacagctcagtatgcaggccagaagcagacaagcccagctcaagtgaacactttcctggaatacacgggggaacgagtttgaaaaatgtccaaagtggcagatgtgaaaaattctcattcaacatccagagctgcctttgctgcaatccttcacctgttaatcgcactgcctctgaacttgtgaaccagggatgctagcgatatcttagactgagacacttaggagctatagatctttcaaggtatggtgccagtatatgccaaggtgggggaaaagctagcgagacaagacaagatcatggatcacagcactgctcagaattttcagacattcaccaagaataagcatgtcgctgccagcttccaactaaactgttattatcttttgtaggggaaattcccaaaagatgtccttgataaatgcttaaaccattgtactgtatcacttaaattcttcagactcctgcaatgctaat

SEQ ID NO: 954 - DNA, 1636 bp, Homo sapiens
agagtaaacaaaatcaaaattcttcttccaatatgggagccagaagcaccaggaacccagtttttctttaaatcaaataaatcattactcttaattgataaatatggtcctaaaactctaaattaatcttaattatatgaattctgaagaatatgcaatgttttttaagaataaagaaaaatagcaagatttatcacccccaaagatgggtccaggatagtgttatgtgttcaactgacctaagcagtctacctacgaatattctcatgcgtatgtccatcaatcgatgtcaacattccattggattccagtctgactggcaagcgatactcagttatctattaacattaatgaataataaccgtgccctttaggtttatatgaatataatgtacattgttttctgtgtaaattaccctatattcaaaagcagacttggttttgttattttctttcatattatacactacaaagtggtttttaaaaaaggaagaaaaagaaagtggctgcaataaaaaagtgtgcttaatgtgaactctggtatgtatcagtgttttgtttttctagtcaactttatcccagcttgtaacatataagcttaaatgagttgtattcacaggttcctgaatatgtatgttcttttacagatctaacatatagtttttgtctctgcaacagagtatataatgacagaaaatccttaaaaactaaagatcagaacaagttgtgtcagtattttaaccttgttcactcttacctcttcacccttaatctatcttcctggcagcaaaaactatttctatatattatttgtatattcttatttgttattggtctccatttctctttctcaaattgaaacacaccataacagaactacttcagctttcagaaaaaataaagattaagaactttaactgattaagtactcttataaacatcttggctgagttcctttacagtattgattgagagtggtaattctggaattatacaagtcaccgtccaaatgttacaaaagagactataaccttcagcattgatcaaagtgtgatttattttcttagctctataaaaaaggccagaattcaaattatgaaaatgtgccataccgtatgatttgtaatttttattttgaaattactatttatctttccattaaaggaatagtgtagaattttctcaaagataaatgaacatttaatgccagtgtctaaaacactataagagaagatggagaaggaaaaaaaaaagaaatcagatggaacagggattgaaaagaagagacactttattataatgaaggatgaggcatattagaggatgaatacatacacagtgatgtcctagtaaataatcttgaaaatcaacaagagagctgtttgaatttggagtagtaattgtctcattggaaaaatttacaaaggagggaaatgatccaattgttatgttcagctcttaaaaacacagttctcctgtatataatgtttgtgcagaataaacattagacacagtaaagaacatgtgctaaatagtgaactttaaaatttcctgtcaggtttattttgcaaactaaaacactgtctcaacataactcttgagccacgtgttttcccagttccagctcacagcctga

SEQ ID NO: 955 - DNA, 1570 bp, Homo sapiens
cttccagcatctctcttcctgcactccatgaaaagcaagtaggggaaatgggagcagcacagatccctatttagcatgatgttcactgtctttaataccagtttgagtagacctggtatactgcactttaaaaatattagtagccaacacactttttctatatggaatcttatcacatgaattaaatattaccttaaaggccagaaaaacctgtaacaaaccatcattgctagaaatatgagatttggtgggaatgttggcattagctttggttagtggatgagtcatatttccagttcttaaggacatgtacagcactaaaatatatttggcaaaaacaaaagggctgtgatcttgtgtatatatatgtggggctctgtttttgctagaaaagagtaggagggagtgtgggagggggcagagtggcagaggggttgatttatttttgaaattcacttttatgagcacaaagagaagagctgtcagcagcacacatgccaatgtccaaacagcagccagactctcctctttccgtctgggtaggccagacacaaaactacatctcacgacctaggaaaatcaagagtcagatgcaagagaactagagagagaaaaaaaaacagtcctggaaatgtccagctacatatgattgctagtgattagaacgtggagttttaatgaattgagggatcgagggatatttagccaatcaaaaccaaaaaaaactaacaggcaaaccttaaagcaagctggctccaaagtatcttcctagcaggtaataagtataagagaaattaatctcacctaaagagacaacaaggagtcagatactgctcaggtgctgcttagatgagttacagcattctaagtgcacatcaacagggtgacatgtcaggaactatagacaaagcaggatctcgagctgtatttccaggctcctatcatacaagagagacaatagtccctctctaggtcattgataagactgcatctagaaagctacatattattctcaacacagagttgaaaacctgaaccaacagttaaacaaacagctaaagaaactgactaaaaatatttttttctgtagttagaaatgccaggaatgttaatagtgactcttccatgggtctaactcaagtaaggatttatacgaggtaagttaaaaaaattaaggataatcgatcattgtgctgacaaaattatggtctggccaatctagtatgtttatgtttaacaataactatgttaaacaataattaaatgaatgactggctgagtgaaaacacacacacacatgcacacacacacgtgcgcacacacacactcacacacaaatcctgaacagcctgcacttactggagagagaatttggaaggagtaaaaagctgagactaaggcacttaatgatgattacaccccagatagctgcacagtgctttacaatttacagtgctagttcccataaattacttcatttaatcataaaaaacatgtggaaaggtcaagttgggtattattatccccattttacagaggagaaagctgagtttccaagtcaccttacctg

SEQ ID NO: 956 - DNA, 1936 bp, Homo sapiens
atacagaaatctcggtttagagaaagcaagaaacctagcagaaatgttggcctttccagcaaggaggattatgagccacctcctgcaagaaaagatagaccccaatgatattctctgaatgatacacatttgaataaaaggggagaattgaaaatcctacaaaaacagaattagagttgaaaatacagattactgaagtgttattagtgctgagacatagcttacaattgtcgaagaaaaatgttgtataccaactgtgtgtatctttgaaaggataaaaagcaaaaaataaaatgagatagtgcaaattaatgtggacatgttttattatgcttccttcaaatatttatagacatgtggggaaaagtatctcttagtataaaaagtgtttcactgtgtatattagcatagcaggtatgtgtaaaaaggtatattttcccttataaatggtctcaggaggatatccctaactgaaaactaaatactagagaatgttgatcaaaaggcatataaagagaaaaataatcactattcatgtattaaacctcaataaataaatagatttcttcatcaattcttattttggatctcgcttgtaacatctgtgtagtttaaattttaatgtaaagagataattaagtttaatcataaaacaaaatacataataaaaatgggatattttttacctcttacagagtcatcatagcatctcaaaaatctccatctacactaatctttctaatgacactacccaaaatttctttctttctttttttcttattaaactttcatttttcaggcaaagaataggtccacaaaaagtctgagtgtgaaccgcatgataagagaaaggtcttgctcactgttatatctctaatacacaacacaatgcctggcctggccagtagagtctatagggtctcaataaatggttgaaactatagcctgagcaacaaggagatccttattaggagcaattgtggtaaagtgggtgggagttgttgggtattatgttgaagtgggaatggtgatgacaaacggagactgagtctaatctaatgatgcctaagacgcatcaatattcagaaacacatagagaagtaaaaaaaagagagaatatgattaggcttctctgtagagttactaatgcagaatccctagaatgtgaaatgtgggattctgcatattactaacatttccaggtgattctgatgataagccgggtttagaaaccatgttttaagagagttgtgtgcagcagtgagcatctttgccacaggcttcctgcaaggtgcagtgcaatgggtgcacattcagcaacagaatggatagtatccagaatccagcagaaattcagcatttgaagaatcagatgcctgctctttaattatgatatgtcacatcatgaggaagacatcattcttcttttgcaaataaggaaagcaccaccttatggccatgagttttgtgctgttttatcctttttctccaagaaaaacatttggatgtaatggatacatggttagcagcacccagaaaccataaacccaagcctgatgcaatccctccttatttatagtgtgtcccaaaagtttcagatcaaggtagatgaataatcttcaaaagctataagcaacatataaattatggcaatattatgaatcttgtgagaattatacagtgcctttctaattcaatgtgtgaaattacttctaagtataaaagaaagagataaactagaagtgttcaagatcagtgaataaaagatatctaatttattggagtcaaataacatttatttaacaataagccccataaattcaaattaaaaactaataaattatgtgcagaaactacaattgattctgtttctatggttatataaaaataacagagaattggttatggaaagcaaatttttctttttgaaaaggct

SEQ ID NO: 957 - DNA, 2077 bp, Homo sapiens
actgtgtcttcactgggtctattcaacattgaattgagctaatgaggtttacagcttgtgatattttggctgataacttggaatgattgaagcttatgaatagaaaggttataaagggtcatagttctccttatcaaaatgtctagccttattaccttagagaaaataaaaataaaaagacatatcgtgttttcaccgtagtttctggtgtggaaattgatttgtttaagtgccttttcaaatcccaaaatattcatatctcatttctaaaatctagtctttaacaagaagccagagcaatggaaataatgaacaggctccaatgaaaaggttagatctttttaagaactgtatcatcaggatttgtttaaaatgtcatcttaaattagcaagcccatttcacttattcagttgttttctaatgagaatcaacatttatatgacacaattagaacacatttattttttaatgtatacagtataaacataagaagcatcatacccattaaatagaccattatgttaatatagttatgtagatatagtgacatatttatgtacaagttctccatattcttactaaaattaagattaggacattaatcttgtcctttacccattactatttcaaaaagtaaaaataaaaaacccagccagatgctttttaatttcaaagtgtccttaatatctttgtgagctagctagatacctactacaaagcattagtaattcctttcctgccaagttatttttagggtgttctagctttactgagctctctaccaaatgcaaaacattagatatcctgaatttttctctgctctgttcatcctagagatagaagctttcttgcttcaaacctcagtgcacacatgtaaacacaattactcaaaacaaggcaacaagtgagagggagggttaaaataagaactcaggtaatctgactcacaatccaggattcaaccccctaaaacttgctgttttctttgtcctctttgctgtgaaccaagacacttgttctgtagcagagtgtttctgctgcaaatccagtggctactgcattatgcaatgaagtcagaagcctgagcttgtgacatcaatataggttgctatggtaactctttccataagtattacaggttcagtgtaggctcaaaaaaggggacttcagcaaagtagcaaaataactggcattatttcagcctaaattacaatcatagttggtgcaaaaatgttttataattcctgtaataaaaaaagttctatattttatgtcattattgaaagtcatttttataatatatttaaaaatgaaagttctccagtagaaatagtaatgctactgaccttctaaagcattcatgtaatccacaaagaagagaatctcactataacatagctaattattccacatatttagtcattccttaagtcaggtaatgttatatattatatattatgataaattcctaataacatatcattctagcttttccattacaagaattataaaaagatctcacaaagttgcatatataaaaacagttttagatgagaagactatttttaacaaagcaatagtaaagatcaccttttgatcgcactagttcattattattttcctagaacatgtttgccagtgactccatttaaatagttaaatctaccttcctttgtaagatatgtttaaaaagattctttggccttcaaatttttttaacctgaattagaagcacatggctgaataattacaaaggctgaacttctttattacacagcccctttgttcttctcatttagcattctcaagaggatcttagctcaattctgtaaacatgcttgagctaggtgttggggttacaacaacatgttggacattaggtacaagatgcctaagacataatcccttctatgaaaaactcacaggtcgagttaataattacagcaataaaagtgcaaacaacaatttaaaaatatttactgagtatccgccatgagccagacaccatgctaaagacttcacgtaaattatctagatgatgtaatcctcacaacaatacaagcaggaaagtgggta

SEQ ID NO: 958 - DNA, 2513 bp, Homo sapiens
ttgaaggatttaatcttgtttaaagttggcaaaagattaactcaattaaaaatctcatggaaacaatttaaccattattctctaatttagaggcattgattaaaattgttttcaacaaggaaagacaaaaaaggatacttaaaatgtcttatagcttagaactttatgatgtcaactcacactttatatggtctttcaaacctaattctccagcatgtttatatagcacttgggggctgtcggcccaccagtgctggggaggccaggcttctctgacaaacagccaaagaacttgaaacaggctgtagaaagtccactcctgccaggataatgcaagctgtttagtgaccatctaactgttctgctagtttttttgccgtacttggtagtcccaggaatccggctagcttcagaagttaagcaaaacaaaatacaactgtgcacagccacatccgagggtgactctgtctccaaatatcatacaagtccatggctgaaacacttgaaaggcttgtatccctgcagatgaaatctttataagattgagtctttaaagacaacccttaagcacataaatattgtcatttacagcaccgtttcagtgctattttgcctttcccattataaaggtggctaatgcacatgataattacagttccttaaaatttattcactcctgagcagatcagctcagaaatgttggcacagtttcaggattcccgcttgccaaacaccctttgatccagtgaaatcatcgtatgattcaaaacaaggcctacagcctttcgagaatttatatcttaaatcctcatcttcgtcgctaacccctccatgttcgatctaaaaaaaaagagttttccttatcagtgacaaagaaataagatttttccctgtgggattcataatatgctttttttctcttcatttactcatcatttgaactaacttacattgagtgcttcttacgtactagagactgtgacctgccctgcagttatggaactaaactacctcccctaaactgcataaggcagagacggtcagttaagcagataatgctttgtagtgctttaacaacagggtcaagggaaaacagaagtaggacccaaagccttttggtgagggccaaacagattccaagtagaggtgaatgctgagcacagcattgggaataatagcagcgggcagatggcaaaaagaagtaagttgggtgttcaagagacagaagaaatagtatgtgcacacagatctggcagtgagagaaaacgtgaccaattttagagaaaattaaaaatgctttgcttgtcttgaaagacctccatggagtagctagaaaagaggagggatggataagcacaccaagattttaaatcaccattttttgccctccaaagaagtttgaattttattctaaagtcaatgtggtcccttagaagaattttgagcaaagatgtgacatgaccagtttggggtcttaaatagataattctgaggaactgtagaagaaagttaaagacaaaatatttagcatagaatgaccatgtttcagttcacattatggagcactgagaagctatctggcactgaaaacagtgctggacaaaaagctcagaggttgtgccattacttctgtcgatcaggactattataaagaaagaaaaactaaggagaaggataaagggaaagaaagaaagaaaaatacggggaatggagagccagagggagaagagaaaaagagggaaaaaactgtggaggtcattagaagtaaagcttactgtacatcataggtctccagtcagagatgaaagagggccagggaggacataagatatttacatggcattctatttctccaaaaaagaaacaaattattcttttattcaccttaatatgccaacaatgttgcatcagttactctttctcatctagcctgttctcaaaataatagaaaggtatttgagaaatttcttcataccttccatgattatgattgaatacatatcaaattgatttcatcaaaaaacccctgatggctctctttctgtcacacatgtcttaaatctaccaagaactattatcagctctcccctcaaattatatccagggtccaaacacttctcaccatcttcattactaccttggtccaagacaccattatcttttaactggtcaatttgaaaacttcctcttacctgcttccaccctgtaggcatcactcctttattcatcatcctccagtggctttccatcatcttatcataatctacagactgtgagtgatcttgtcccttgctacctatttgtccccatctcctcctactgtcccctcttctcactcttatccagctacgctgggcttccttttgtctcagatgtacagttatcccaggggctgggcgcagtggctcacgcctgtaattccagcactttgggaggccgagctgggcagatcacttgaagccaggagttcgagaccagcctgaccaaaatggtgaaaccccgtctctactaaa

SEQ ID NO: 959 - DNA, 1719 bp, Homo sapiens
aaaatattctccttgggccagaagcaacgataccactggcaaacttcttacaaatttggaaactcaagctttacgctagatcttcagagtcaaaatctaggttttaacaagatctcctgttcattgctatacacaataagatttgagaagtatgcttttaactcaccatgaagtttccatatgggaactatagacagcttttcttgtattatgtaaatgtagcattaagaaatgtacatgcctgtgttaatgtcctttattttatactgtatcatcaagaaaagtattgcacatacactggtttcatgatcttatgccatcttttctcagagttaaaaatacactagagaatatttctgtgctagaaagtatcctactggataactccagtaactcatataagtcagaaccagctatctttattctcattttacctgatgtcaaatcaagaattctttctatggtcacttggtaaatatgttttgttttccagggagtgttgacattcagggatgtggctgtagaattctccccagaagagtgggaatgcctggactctgctcagcagcgtttgtatagggatgtgatgttagagaactatggaaacctggtctccttgggtgagaataacttcaatatacaactcatattctacattaaatattttattttcttctgatttttttggaggttctgctttgcataaatgagtttcagaatcctgcttcaaaaagaaaaaattgggtatctgttgaggtagaaaatataatcttcaagatgtttcatcttaacattaatctttcccttttttgagctcatctgtatacttcagtctaaattagtggtaatatcagaaatttagtagcataaaatattgttacccacacctaaaaatgcaattttcacagctgatttttgattcagtattactgggtaatagagctaagaaccacaaatttaaaatactttctaaatattctaaagtttctgttaggaaacagtatattaaaattaattttctagagtcttctataatgttctctcttctctactgagcatagtactagattagtaatcagattatcctagcaagagtcatgtttttttttctaataaaacaggtcttgctatctttaagccagacttgatgacctgtctggagcaaagaaaagagccttggaaagtgaagagacaggaggcagtagccaaacacccaggtaggtgggagtgaatgaagcagatgacacaaatgacggatcccaatgtcaaggaggaagccaaacctttaaacatgcttccagaagctctgctccagtggaaatggtttctgagaaaccttcatttctttctcttgctttaacatagggacattttttgtcccattcttgtgaattttccaagcactgtacttccccttcagtaatgtgtgtgtgtgtgttgtgtgtgtgttttgttttgttttttgtttttagtttacagcaataatgaaagtctttcatggcttgacagaaaatgtgtgatttgactgcttttccattgctttggggaaacagcaatatctgtatttttgagaaactatattaaaccatttttttaagttctgtttttggataatgtctaaatatttaagttttggtgatattacagtttggatcagaaatcccaggaataccacaaaaagatgtgtgcttcctgctttataattttctattctatgga

SEQ ID NO: 960 - DNA, 1476 bp, Homo sapiens
ctctgtccccctggctggagtgcagtggtgcaatcatagctcactgaagcttcaaactcctgggctcaagtcattctctggccttagcctcccaagtagctgggtctacaagtgtgcatcaccatgcccttctaattttttaattttttgtagacacagggtcttgctaggttgtccaggctggtctcgaattcctggcttcaagcaatcctcctgcctgggcctcccaaagtgttgggatgacaggcgtgagccaccatgcctggccccagtattagtttcaattaggagcattaaatattatatagctgtaccctaacttccctcataggaataataaaattctataataataactgatggaattcttgctgtgtgccagatgtgtgcagagacattacaagtgcattatctcactgtatgttcacatctgtccagagaggctccacccatccccagttgagaaatgagaaaactaggtgaagggaggttaggaggctactttctacttgccacagacatacatgaacccactgaatctttacaatgacttgcgagatgggtgctctgacacccgcctgaacaacttgctcacagtcacccagctagtgagtgtcagagctgggaatcgaacctggaatgtcaggctccagaatggaggttcttagctcctgcaccagtgtcttgatcttcagcatgtgcatcagaatcactgaagagccctttaagacagatttctgggcctcccgcccaggtctcaggtgaagcctgagaatttgcctctctaacaaacttgggacagggccctcgacccactgcccaacagtctgctgcctacatcaagcagagtaaaggtagaaaacccatccaacctccaaagccagctcattttggggacttaagctgagagcttgcttcagatcaactggcgtctggcttccttctctgtggccttctgccctgtaaacagttcccggactggtggagtcaggtgctgtggggtgggaaggctgagttttcctgacttgcaagttggcagcaaggccaagttgagagcttttcctgggcaagctaagaatgcaagctgcgactaggcagatgttaccatcctgactgcctagtgtcatttgcagtgacatgaagcctgcagaaaaagagcagggaaaaattgtgaaatatagggggctcttcctctctctccacctggcccctcaagcaccttcatcctctgccggtgcttgttttgggtaatgcgtgtcccatctgttgatgccctccgcctgctgcagtgggaggctgctccgagaaggcaaagggctcctagtgcctggggagacacgtgctctcttgctctgcagccggtcttcattcattgctcccgagggtggagaaggaaaccttgaccttaatgttctttattcccttggaattaatggagaggctgctagagccagtgcactgtgcatgtaagagggc

SEQ ID NO: 961 - DNA, 2762 bp, Homo sapiens
gttacattgcttttggaacatacgtagactcttagtagcttttattccctcatgtggacactgtgtttttaacaatcagactaataatactatactttattgccttttacaaaatcatgaatgaaataataatactttgtgacatttcagaattttcttagtttaattttgtaagcaacaccatattttatgctttcaaactttttcttttatatttgacatctggacagaatctctcattactgagacagatcccaaattcctctcaaaccatttttctaagagtaatatatttaaacccccattagacatagaatttattataaatgaaagtgcccaatatcatgttttcaggaaaatacatacaaatcaatagaaaactcaagaaaattatagaaatggaagagattttcagatattatttggtttgtttccatttctcctttcagctttacatatggcacagcagagagaaatatggatcaatgctttcgttcactggtaatgaatttgaacattataaaatttgtatttattcaacatttattgaaaactgtgcagagagctggggatttacatttttctgtgtaaaggggtccatcgtatagttctctgaaggcacacatgtaggttgtcttgacttgggcatgttatggtagaagtggggcagaggtgctcaaatgaaggaatggccatttacagcagggattagaatgttggcaatctttacctgacaattcttactggtgggggtggggggtggaggggaagctactctatattaagaaaaaggagtatttaacttcaatagtgctacttctgtttctactgcaacacatttagtatattatcttttacattttccatgccccttcctgcctcacctcagttatttagcaccataggagtactaaaattagctgtaatttatataagttattgatgctatctatcagacactgatctcataaatgattgctttacatgaaacacctgatttgatcctcaagacaactcagtgaatggaaaactaacttttccaatgtcataactaaaatttctttgggtgagggtgggagatggaagtgctgaaatcccttgaaatatgctttctgggccgttttttcttaggattcctaaagttctaaatagcagtaagaaaatgtggagagccacatgcaaggaaagacttggcccctgtattcaacagccattacgtatccagcctttatgaagaataccccagaactctgaaattctctccacatcgctcttcagtcagagtccaaattcagcattcctaaatccctttgtattgaattccttgtactacagatatagtgaatatatgctttggttatacagaaagatatcaacatacagttaagtctgccagctagcattagagtcataatttaatatctagtatttatgcattcacacaaattatattcatgaggacacttagaagagaaacatttagaaactttaaaaattctctggcattcacatgataaggaaatatggatatatttggaagcctatttcattttatttgaattgtaatgccatctgccaaaattcactctctcaaaaagtactgcttttgacagcatcagaaagaaactttgtgtgaggaataggcatctatttttttacttaatttacaaaagacacattttgtttgtattcacaagggcattttgcaaattaattttacccaattaatatgtcattctgtgacaatgacagaaatatcagattcttaagtgagttcaaattcctttcagttttaactttgcaaagcatgaaaaaattatatggcataacacagaattttactctttcaatttatgataatgccatctttcccctataaagatgacactattggcatcacctaggcattcactataggtaatttctagtaatgactgaatttgtgttgagtcattcttacctgattcccactgcaatataaagtttgtattatttgtgaagtgataaatacatttacctgaagttagtgattgtgggaagaatgaaacagatcaagtttcagagaaattggctttaagatcttcaattccttgtaagcaggtagtgagagctgaaactggccagacatcggctcagctgttcgacagacacatcgtttcgactctgcatttaacatgctaaataagacagaagggatacaagagaagatacgatccttgcctcaaacactttaccatctacttggagacgtaaaagtatccacgggtaaaagtagaaatggatctgtaaggggtatttatgcatgaaggtgcaggtacgactagtatacataaatattgtatgatttcacaataaagctgccttaatttaagatgtcttcatgactttcattgattctcaggtagaatcatgaagaaggcaaaaaatagaagtgggggctgttaggggaaattgatgagttcaggtaaaagatggggaaaagtgtgtgagatagagagatacttttgcagagaatgggcaaaagtggtgtttgtaaattttaagataactatcctagttggaatagaagacttgtgttagaaaataataagagaaaagactgtatatataatatagatcaactaatggaatgtttttggatactaggttgaagagtctgaagtaactggaaaccattacaaggtcaaaaagaggaacaacataattgctacattttaggaaagacttatccacgcacttgtattcttatttttttatttttt

SEQ ID NO: 962 - DNA, 1928 bp, Homo sapiens
atgcaatgtactttttccttggtcatgctctgatgtatcccagtgttccatagtcagcttggagttgctaatgttttccttagggactctcttccctcagtttgtattctcaacatgtagctcagcgcagtacgtaatttgcactgaataataatcatcatcacgttaattgttgaattaaattatatttggtgttaaaaaatatttgaaacaagaaatatttaaaaaggcaatataaattaaaacaacttcaaaaataaaatgtactatttatttagaagcctagttttaagtatactacctagaaggctgcttacctgcaagttatttctttcttgtaatctaatgaaaaaaattttctaacagaatttctttcttgttgattagcacttaagctcttaattaaatgttatactagtgtttcttatccaataaaccatttcccagaatttcataaaaactaagaatttttaagtacttatgttctgagatctagataattttattgtctttggtctctaaggtgaatttccaaatgtgaatatttaagtctctaaaaatgattattatgtttaggaagcagcatttccaatataaccaagctcatatgggaaatgaagaaaacagaagcattaagaaaaataaccaactgctacctttagtatctttaatgtaattttgcacctcataaatctgagggctcttctctctgccccacttacacatccatcactcctcagagtattttcaccacaatgcctgttgctcactttttaaaaacaagagatttttgcagtctgcctgagcccatttatttcattgcaccatccctcttgtaactctcaaaatatggcattattaatatttaaccatcccttcacatagtttgacagtatgcaccttagaaaaattttattagctctttcccctcttttccctaattatccctaaggtattgggcaaatatcaaaagaaacaattctctagacttgcttgacaactttggtatgtgttgattacatattacaggtttatctgtatatcaaaatccctcaacaatttctcttagagagaaatgtctggtgataacaggaaatctgaaacagggagcacagattgaagtgaaaaggacctgaaattgaggtctgatcatgggtaacttaagagaaacacattttaaaatttttcatttgatttgatgttatatacaaataataatgttatggttaatagtaattatatgcatgtgtatgaaagagagagaaaccagaatttattatttgaataaaataacattggaattgctttccatcatttgccagaagaccaccatagcgtatttttaattacacagaaaaaaagagcttcaaatagacagtaagattatccccaaatctgaagcatttaaaatggccagcaccattattttctactgccaccagttcaagtttttcttccatttatgatacagaattttaaatgtatcctaattttttaaatccacagagcatatggttaaaaaaaatcagcagaagcaaatgttaaaataacatttagccagaaatatcccacattcatattcaaagagaacttcaaatattgctttatatataacagcctaattctgaattattgaaattaactataaaaagtgtgccggtttgttgaggccacaaagtcaatcttttcctcgttcataacctgtacaaacaagtggcaaaatataaaggagcaatgaccgctttctttactcatttttaaaaactgctaagagtagctgattctatgtactgaattactacaaaagatgtaaagcctacaaagaagggatatttaagagcttatattttacaaataaaaattttaaacctgtgcacatttgccttcattcctaaaatatcacaccaccaaatatgtttaattctaaa

SEQ ID NO: 963 - DNA, 7655 bp, Homo sapiens
gagtaattacaggcagtgactgtcattgtcaagatagttctgtaattagagaaacacaaaatatgtctcatttagaggcacctcaaatagagccactgggtcagccatcagttggaaaaggttaataaagtcagaatggccaggcgatggtgacgctgaggactgtagcaaaggtccgtcataggagaggatgttccttcctccttaaagcatgggctttcctttgaagccaatttggaaggagcagtctggaaggagaaatggatctgaattgaactctgcagtaaaattaaagggaggggcaggcaggaaaagcctcatcaagttcctaggcattcactggtcagggtttttaaaccctagttgctttcttaagttaatggagtaaaaaatacttcagggggaggagcaagattctttctttagactcgtgatatagttagaatccatttttgcccatgtataaatcttacgaaatgctttaagctgggtagctcacagtctaagcaatcaatattttaataagcctggagtcaaaatcttaactacctcacaatttggaaataaacaaggagcctttacccatgaaagcatgtagaaagcaaagcatgtagaaagccagcatacatgaattaaggtgcgagttggaggatatcatcatcatttatttaatgaatatgataagcagttggatgcagctgccttcaggcatctagtatagatttatggttgcccaagtagacatcctgaattctaataaaggcagctgatcagaataactgattgcacagacagtcatgttatgtgtggttttcattttgcttttaaatttagaaatgtctcccttgttcttatcacactgataataagtgcttaagaaatgaacatatctttagcttttaatggaattacacacctaaaatgattttcagaatataagaaaaatccaagaattttaaattctctataaagccaggtaatgtagtctccttttctcctttccctcttccctttctcccctctcctttctttgcattttatatttaggatgtgaaatctctctaagcaaaatatgagaactatgtgaaaattatgctaaaatggacttttgttcaagaaagctttattcatcagcccccaatggatgtgatctttaactactaacaccgtatcttactctggatataagaataatattaaaagtcaggcttaaaaaggaaacgaaagtattaagatttcaattgactaaaccaaaggtgtttgcccacatacctaactttttccttcttatttaatattcaatgtaacaatgtccacttttttttttattatactgtaagttctgggatacatgtgctaacatgcaggtttgttacataggtatatatgtgccctggtggtttgctgcacccatcaacccatcctctaggttttaagccccacatgcattaggtatttgtcctaacgctctcctttcccttgcccccaccccccaagaggccccggtgtgtgatgtccccctccctgtgtccatatgctctcattgttcaactcccacttatgagtgagaacatgcggcgttgaggtgtttggctttctgttcctgtgttagtttgctgagaatgatggtttccagcttcatccatgtccctgcaaaggacatgaacacattcttttttatggctgcatagtattccatggtgtatatgtgccacattttctttatccagtctatcattggtgagcattcgggttggttccaagtctttgctactgtgaatagtgctgtaataaacatatatgtgcatgtgtctttatagtagaatgatttataatccttgtggtatatacccagtaatgggattgctgggtcaaatggtatttctggttatagatccttgaggaatcaccacacagtcttccacaatggttgaactaatttacactctccccaacagtgtaaaagcattctatttctccacatcctctctaacatctgttgtttccttactttttaatgattgccattctaactggtgtgagatggtatctcattgtggttttgatttgcatttctctgatgaccagtgatgatgagctttttttcatatatttgttggccgcataaatttctccttttgagagtgtctgttcacattattcacctactttttggtgggggtgtttgtcgtattcttgtaaatttgtttaagttccttgtagattctggatattagccctttgtcagatgggtagattgcaaaaatgttctcccattctgtaggttgcctattcactctgataatagtttcttttgctatgtagaagctctttagtgtacttggatctgatttgtcaattttggcttttgttgcaattgcttttgatgttttagtcatgaagtctttgcccatgcctatgtcctgaatggtattgcctaggattttttctagggtttttatgatttaagggtttacatttaagtctttactccatcttgagttaattttttatataaggtgtaaggaaggggtccagtttcagttttctgcatatgactagccagttttcccagcaccatttattaaatagggcatcctttccccattgcttgtttttatcaggtttgttgaagatcagatggttgtagatgtgtggtgttatttctgaggcctctgttttgttgcattggtctatatatctgttttggtaccagtattacacactattggttactgtagccttatacgatagtttgaagtcaggtagcatgattcttccagctttgttctttttgcttgggattgtcttggctatacaggctctcttttggttccatatgaaatttaaagtagttttttctagttctgtgaagaaagtcaatggtagcttgatgggaatagcattgaatctataacttactttgggcagtatggccattttcacaatattgattcttcctatccatgagcatggaatgtttttccatttgtttgtgtcctctggtatttccttgagcagcagtttctagttctccttgaagagctccttcacgtcccttgtaagttgtattcctacgtattttattttcgttgtagcaattgtgaaagggagttcactcatgatttggctctctgtttgtctattattggtgtataggaatgcttgtgattttgcacatcaattttgtatcctgagactttggtgaagctgcatatcagcttagggagttttggggctgagacgatgaggtcttctaaatatacaatcatgtcaactgcaatcagagatgatttgacttcctctcttcctattcccttaatttctttctcttgcctgattgccctggccagaactgccaatactatgttgaataggaatggtgagagagggcatccttgtcttgtgctggttttcaaagggaatgattccagttttttcccattcagtatgatatttgctatgggtttgtcataaatagctctctttttttgagatatgttccatcaatacctagtttattgagtgtttttagcatgaaggggtgttgaattttgtcaaaggccttttctgcatctattgagataatcatgtgatttttgtcattggttctgtttatgcgatggattaagtttattgatttgcatatgttgaaccagccttgcatcccagggatgaaactgacttgatcatggtggataagcttttgatgtgctgctggattcagcttgccagtattttattgaggatttttgcattgatgttcatcaggaatattggccttaaattctctttttttgttgtgtctctgccaggtgttggtatcaggctgatgctggcctcataaaatgagttagggaggagtccctctctttctattgctttgaatagtttcagaaggaatggtactagctcctctttctacctctggtagaattctgctgtgatcccgtctggtcctgggcttttcttggttggtaggctattaattactgcctcaatttcagaacttgttattggtctattcagggatttgacttcttcctggtttagtcttgggagggtatatatgtccaggaatttatacatttcttctagattttctagtttagtttcatagagatgttgacggtattctctaatagtagtttgtatttctgtgggattggtggtgatatcccctttatcatttttttattgtgtctatttaattcttctctcttttcttctttgttagtcttgctagtggtctattttgttgatcttttcaaaaacccagctcctggattcattgatgttttgaagggctttttgtgtctctatctccttcagttctgctctgatcttagttatttcttgtctcctgctagcttttcaatttatttgctcttgcttctctagttcttttaattgtgatgtgagggtgtcaattttagatctttcctgctttctgatgtgggtacttagtgttataaatttccctcttaacactgatttagctgtgtcccagagattctggtacattgtgtctttgttcttagtggttttaaagaacttatttattgctgccttaattttgttatttactcagtagtgattcagaatcatgttgttcagtttccatgtagttgtgcagttttgagtgagtttcttgatactgagttctaatttgattgcactgtggtctgggagattgttacgatttccattcttttgcgtttgctgaggagtgttttacttccaattatgtggtcggttttagaataagtgctatgtggtgctgagaagaatgtatattctgttcatttggagtggagagttctgtaaatgtctattaggtctgcttggtccatagctgagttcaagtgctgagtatccttgttaattttctgtctcattgatctgtctaatattgatagtggggtcttaaagtctcccactattattgtgtgggagtctaagtctcttttaggtctctaagaacttgctttatgaatctgggtgctcctgtattgggtgcataagtatttagcatagttagctcctcttgttgcattgatccctttaccattatgtaatgtccttctttgtcttttttgatctttgttggtttaaagtctgttttatcagagactaggattgcaacccctgctttttttttctttctatttgtttggcaaatattcccccatccctttattttgagcctatcactaagatactccttgagaagagtaaccccaagacacatgatcatcagtttctccaaggttgaaatgaaggaaaaaatgttaagagcagccagagagaaaggtcaagttacctacaaaaggaagccactcagactaacagtggatctctctgcagaaccccagcaagccagaagacagtggggtgccaatattcaacattcttaaagaaaagaattttcaacctagaatttcatatccagccaaactaagcttcgtaagtgaaagaaataagatcctttacagacaagcaaatgctgagggattttgtcaccaccaggcctgcctttgtcaccaccaggtcttcctgaaggaagcactgaatatggaaaggaaaaactggtattggccacagcaaaaacataccaaaatataaagaccaatgatgctatgaagagactgcatcaactaatgtgcataaccagctagcatcatgatgataggatcaaattcatacataacaatattaaccttaaatgtaaatgggctaggctaggtgtggtggctcatgcctgtaatcccagcactttgggaggccgaggtgggcggatcacctgaggttgggagttcgagaccagcctgaccaacatggagaaaccctttctctactaaaaatacaaaattagctgagcatggtggcatatgcctgtaatcccagctactcaggaggctgaggcaggagagttgcttgaacccaggagccacaggttgtggtgagccaagatcataccattccactccagcctgggcaacaagagagaaactccgtctcaaaaaaaaaaattttttttaatgggctaaatgccccaattaaaagacacaaactggcaaattggataaagagtcaagacccactggtatgctgtattcaggagacccatctcatgtgcaatgcccacttttaattctgtgcttgagccaatggtatcatagtcagtgttcaactctacccacagattgtgctaactgctagtaggtgcagggctagctagctgaacattactgatggtaaaacgataattatggttgtgtgtgtgtgtgtgtgtgtgtgtgtgtgttttaagtacctgtagtttaaaccattgtggcctaatgaggtggctaaaagttaacatttttgtttgaaacaataaagaagggaagtaaaatcctgttctttaaaattacgattttgtatttgagaggtcctgggcatagaacaccatcaggcatgttccatctctgtgaattgacctctcacccagaagctgggaaattatctctatagaaattatataaatataatttccagattctcctaccttcaaacatgttggaactattctttcattcctcaaatattcattaagatactggagtagagatgctaaagaaattaagatgaaggaaacatggctctaccatcaagaagcccacagtttagccaagaagaaggatatttacaaatacatgtgtgttaagttcagacatggaaatatgtctaaatgttaggagagtctaactctactaaagagagtcaaaggaaagcttaagaaagaatttgatttgggtttcagtttgagttaagtcgtgaaggatgatttcatttgagtttcagtcatgagggatgattagaagtcttgcaggcagacaagagtgttccagaaaagtgaagtgtatgcaaggacataaaatgtttgagagcagcaagtacatagtttaatttggctagaacacagattgaaggattagaggttaaccaaataggagatgagaaagatagttggaggtcagatgaagtttgcattttatccaaatgaccagtgattcctagcctcagtaaatgcacacaaatcatattgcaaaaaaattcaacatgattcagactctttccctaccctctaccaaagttttcaggttaagaaccactgaactgctaaaggcagtggggatcactgaagtattatattttaagccagaggctgatacaataaaactaatgttttagaaagaccgctcttatagcagtgtggagattgttacttatcacctctgatgtgccaggtttgaagagagacagatgagaggccaagagacccattagtgtctcacccagctcagtttctttaaaatctggctctcattcccataggtgattaaaacatacataaagaaacatgtcagtgtatgagtggcatgtgtgttgtcactggtttccagcccagcctctctcacctgtcacaccaattgactttcttcctgacctatgaccttttgactcactgcctggatcttgattaaaatccctcatttgacaggaaatatcacatattaataatttgctacaaaatctcttttggtacagcctcaagacctctcacatcaatgtatgcttctcacaggctgctgatagcagattttctctag

SEQ ID NO: 964 - DNA, 1652 bp, Homo sapiens
ttctgtcctaagtccctaaaccgattcctgtggccatgggaatgtgttgctctgattggccaggcttgagtcacatctctacagggcagacatgtccaatagaaatataaggggagccataaatgtgaggcacagatataagccacatatgtaatcttacattttctggtagccacactttaaaaagtgaaaaaaaaggtgaaattaaatataatgatacattctatttaacctagtatatccaaaatgttattctttcagcatgtaatcaacataaatgatgattaaaatgttttatatcatttcttgtaccaagtcatcaaaactcatcattttaacaaggcttccaactgatgatgtgttggggggtggagggcctgtgagacatactttgagaaacactaacctacactttcattttttctgtgttcccaaaattacctttagagtgctcagagtactgagacatctgctgaaatatgctggagcaatccagagtgaagcagggttgttactggatagagcaagataggatcagagacgtttaatattgctgccatgttgccgccatctattggttgtgtcacatattacaggttcataaccgaaaaaatgaagctggtcatttgtgggcccctttatacttctggcaagacacctcctcaactgcatcctgaaatgacttttctttagaattcttatttattacagaatacagaaaaatcttaatagttgtgcattatggattatcaggcctacgtctaacagaatgttgttgttgttgtcagctacagaacagatagatttcctttaaatataaccctattatcctgtcagcaatccactgtaagtgaccttggtttctgtttctgcagattttcttcaccttctgaaggcattgaccagagaaaatttcttaacatctctgagccttagttccttcagctataaaatataggataataatgctaccttcttcatagcgttattgtgaagattaaattgcatagtgtttataaattatttggcacagtgcctgatgtatataaagaacgctgtcaatgttattgttaagaagaataacaagtcttaatggaaatttgaacagtgactggaaatttgataacattatggaattaaattttattttgttttttttaaatccttatattaaaaaaatccttatcctttacagatacacactgaactagttataggtgaaattatatgactactgggatttgtctcaaaataaaatggaagggaagtgagcagtaaagcaatattggctataatctgatcatggtttaaactcagtgaaggatttatgaaggtttattatgctactttgttttgtgtatgtttgaaattttccataaaatttaagcaaacaaacaaaattgccaggcgcaatggctcacgcctgtaatcccagtactttgggaggccgaggagggcggatcacctgaggtcaggagttcaagaccagcctggccatcatagtgaaatcccgtctctaccaaaaatacaaaaattagccgggtgctgtggtgcgtgcctgcctgtagtcccagctacttgggaggctgaggcaggaaattgcttaaacccaggaggcggaagttgcagtgagccgagattatatcactgca

SEQ ID NO: 965 - DNA, 1349 bp, Homo sapiens
gagacagtcaccttgtccccagcccaaatggaggtcccagctcaaggattctcatgcattagttcatccaaccattcattcaacaactatttattgaacacatattatgggtcagatactattggaggcactgaggatatggtgggtacatgatagaggaggactctgctctcagggaactgtcattcttatgggagacttaggtaatatgcaagttaacagtaaacagataaagaagagaatcttagatcaaaacagggcaatgtcgttgatttagtcattcggcaaatatttattcagtacctatgtcttattagatattactatagtttctgggcatgtggaagagaacaaaacaaaggtcctatcttcaaagatgctcttcgggtagaaaaagacttggcggatgaggtgtagtattagataggatggtcaaggcagacatttcaaaggcactgcatgggacctaagtaattaagaggatggcacttgaacaaacacttctataaataatgaagaggaaccagttatggaaatatcaggaagagaattgcttcaggaagatgagaaaataagtgcaaaggccccaaggcaggaatgagcttgtcatgaggaacacaagcaggccagtgtgtctgcagtggtaagagctgagggtaggagctcccatggggccctgcaggtggtgctcaggtgtttagattttgttttatttaattttaaatgcataaggagctattagttcaggatggataaatgtggatctatttcctggagctcacatctgaagatttgattcagtgagtgtggtgtaaagccttggaatctgcaaaacattcccacggtggtttcaaagcaagaagtctgtgaataattcttgatggtagattttagagagaccgcttggacttttactaaatgcctgctatttagatttgaaatcagcatgggaggaggctttgggtcaaatacatcacagagctgcaaggaaggataactggttccctgcagcatcccagaccccaattctttggcctagcactgagactcctttatgcgttgagaaacccttggagagcttgtggagcttcagcttcttacgtgggccccagtatctggagaaagcaatgcaaaggttgcattggcttaaggagtagagttctgaagttcatgccatttaacgtctctgagttctggccttctaaagtggttccaaaatctagcaaagaaactggatgagattcactcaaggattccctctctacaaataaaatgaagtaaaataaaatttggattatattattttatgaaaatcatgataatcttctgaagcaggtaggtcaggatca

SEQ ID NO: 966 - DNA, 1844 bp, Homo sapiens
gcctctctaagggctgtttctgagaatgaagaagaatgccctctctatagcgtaggtactatttatgtgaaggcagtgtccccatcactgtaagactgtgtcctccctcaggggcacctttcttgggtttacactaaagtgctatataagctagcagtggcccgacatatgctctgaagtcaggcatatcttgtgtctaatctcagccccactaactaattatgagaacttgaataggaaacctgtttccagattacaaatgaggcaactgagggttgtagggaaggattcaaccaatctcacagggtttttgtgaaaattacatgaaataagatatttaaggagaatgaggcagagtaggcactcaataaatagtattagagttctcctctcacctcccttttggaatggttctaccaccatgagaccccctgttaggaatattggtctatggttcagttcattaatgaatttgggccagttccagctccttaaaacattataaggtcctttccattcctgctgaaatgcacagttaatgttaactctgagcctgatatcctttaaatggcatgcattcaataaggcaaaacaaaagctcagaaccctatagaagaatgagcagagataataacactaaaaatctgagctccgttagtgactgcaatggaatacttgagtgttgaggtgtctggcacctaaggcaaaaaaggggaatcaaatggattgcataaatctcattatatgatttaagaaagatgcctctttgtgagggaatagtaactcttttttcctggggggctacaatgaagaagacatttatcaggtggcacttacaggtgaaggcatggcctttccccttctgtctatgtgattgactctgagaactgcctttggattttcaaaagcgtaatctggggcagaatgaagagagatacctgctccccaggattcaggagcaggccagtgcctcccatgggtaaataccttcctcttgggtggagatttgtgtctcgagaagggcatagatggattctaccagctacaggctggattctaagagctgggaattacctcacacagagtcagggtcacagggctatgaactcaatgaacaccaagcaacggtgcagcttccagagtcccttcctgcttctagtagccctgctggatggacgaggtgcagggtgcagccagcctgcctggggcctgcccagccctgtttgtcttatgtggcataaagtcctcctgaaataattttgcatttgctttaaaacaatttgcctgattgtaatgataaaacaacattatatgcagatgtcttgctattttaaaaaacctaatttactttgaattaatgtttgttgacatggtgtttggtggggcagggacagagatagagggaccaggagatggagctattgaaatgagagaaccactaagtaaaatggttcttctcattttttttttcttcaaatcaaactttcaggagagagaacagagttaaaatctgcaggaaatgcttgcatccaggaatgttttaaagctcttgccaagatcaacaatgagaagtatgtttggaaattgctttgcaaacctcccagtttgcagagcgcagcacctcaccaataatggtgatggtggctggtgtttataggacacccattgtgaaagggctgtgagcactgggcatttatttgtaagcaccacttgtttacacagtcaagctgggacgttgaggtgatagaaataactctccttttcaataaacaaggaaactgagtcacagcaaccagttcgagtgacttcattaaggcttagattcagcctcacagtattggagt

SEQ ID NO: 967 - DNA, 2298 bp, Homo sapiens
tacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaagg

SEQ ID NO: 968 - DNA, 5612 bp, Homo sapiens
cactgatcttcccattgcatgaggctctcacacagtgaaatacctgctggcttccatttgccaagtgtcctggaacctcaggaagagaggacaatggcagctgcagagaaggttatatgtgcacaggtcacaggacacatatcaggaagcttttgatctcttgtgctctcccaaatgaaaacttctctagaacttcatttctcaacctagggtaaaaggtgagatgggttggatgctgacttgaagtaactgtaaagagacttagagcctgttcacattctcacactttgaagtatgggcagaaaatatttgtagtgtatgtaaaataacccattttctcaatgagaaaagagggagaataattccttttatattactgatgaaaaaaagctttaataaggatctttggtgaaatatgcacctataatgtaaacaaccaatcacagaaagtgtaagactattgctgattccctactgtaaataaaatgtgctacgtatgcagaaaaattaaaaagaataaaataacaaataatgccaggtgcttgaaaaagttttgggagaaaggggagaaaggaagtaagactgcgcacacacatgcacacatggtgacacaacacacgcactctcatacagtgacatacccagtcacatgcatacatggtgacatgacacacatacttacactcacatgcatggtaacaaaacacacacacacactcccgtatgtagtgacgtacacatatgcatgcatacatggtaacatggagcacaccgaaacatgagacaacaaacacattcacaaacatggcgacatacacatgcatacatggtgacacggcacacatacataacacacacgtttccatagtggcatacacatatgcatgcatacatggtgacatggcacacacgcacacggtgacacaacacacacacaaacatgctgacatggcacacacacacaaggtgaaacaacacacaagcatggtgacatggcacacacacatctgtagcaaactgaggacattgaggggaaaaagggattctatggaaggaaaaagaaagaaagaaaagacatttatcaggtacaatgttaaaatttatgccaaatgtttatttaaaaaaactttttgtaagagtcccttatgaattctcatgaaaaagtcacaaaaactattaaaacgcataaaatgcaagacccaaagactccagggcaaagttagttttacagatcatcctttgaaagggtttagcatgctgtctataggtgacctgctgccatctgtaaggattatcctcctttccaacctagggcccagaggtgttgaggcacacttgatatcattggccacattatctaaaacctcaggaaatgattgctatgtgttttgttggaagagtttcctacaaaacagctctcagttagttcccctttaatatctagcacctactttctaccttgtgcttgggggaaactctgggggcaattcacagactacctctattctaggaatcatgctttgtggttctagtcctcatttacatcaactctgctaatgcttcctcaacattttcccccaagaaaacccacagctggtcaattaaatcttgacgacataatgctaagtgtaagaagccagtcacaaaaggtcacacattgtatgattaagtttgtatgaagtgttcagaatacatatatccacagagactaaaagcaattgagtgcttgccagggactgcccgtgatggaagtgaggggctggggaatggtaatgattgctgaaagatacagggtttgggaggatagataaaaagccctaaaattaataaaggaggtgattgcacacctctgtgaatatattaaaaaccatcgaattgtgcactatacagaggcaaatcttacggtatgagaagtatatctcaataaagctattattaaaattctaaatggagactttctcacttatatgcattattctctttatataaaccagattcaaacattggccatctcacagcagatgtccactggaaccatagatgaggtgggaaaatcgatctaatggtcagacctcaaaattttggccatacaattatttgttcactggaggggttggacctagtggtcctgagttgaaaaaagcgggaggttatgttgagtctggcatgtgcagggcacagggatggacctggattgaggctgaaaaaaatgctaaggaaggtaaacgcaagtggaaatagataggttgatgccaggataggttgaaaaaaagttctgaagaaggtaaaggcaagtggaaacaggtagggtgatgccaggatgggaaggtctcaaacacctggcagaggaggctgtgtgtataaatgctcaaagggaatgagggaacagtacgtactcagtaaaatcagcaggagaggagcaacttgaccataatagtattgaacaaagatgtaccactaaccgttctggtacttgaagctttggtgcaaatcaggaacaccaaggagacaaataatagtgtttggtaaaacaaacaaaacagaacaacaataacaacaacaaaaacaaaccctaatatatggaatgtagaagagagtagtgcaaatacatatagaagaaaatgcaaggtttcctggcctagagtatcagcatgctatagattgaatcgtgtccccctccaaaattcatgtgttaaagtgctaagcccccaatgtgatatctggaggtggggcatttaggaggtgattagctttacatgacgttagaaggtggagactctcatgatggcattagtccctttataagaagagatgctagagaggctgcttcctcattctcctccatgagaggacacggtgaggaggcagctgtctccaaaccaagaagagagccttccccagggaactaaactggctgcaccttagtgttggacgcacagggctccagaactgcgaggaataaattcttgttgtttaagccacccaatccatggtattttgttatggcagcctgagctgactaacacataacatttatatagtttcagttttttctttagttttaaaccttagaacctaacctgttctagtgaacaattctttttccaatacttatacaccatgcagtatttaaaacacttaaaactttcacttcttatctctgaaggggcattgttggagcctaaagagagttatcaacatcaaaagttatttgtaaaataaatgagtgtagagaaatgtttgacatttgaaaaatacagggcaaaaccttaagtttatcatttctgagctggctgactgtttttgtcatatttaactttgctgagcctcaggattgtaagaacattaaataaagaacaatacacggataacaagtcataaatcaaaccagaatcaagactgtaatggagggacaagttctgagaatggtttgatatttcaatgtagagacaataaaggcctaagttgaggtggtagtagcagcagtgattacaatgaggacagaataaacataaaaaaagtaagcaggatatctttctggcaatctcaaaattgagctgtttaagtaaaaatccaagagttatatttggtattttttttgcatattttccctattcatctgtactcccttacattgcattctacttgtcaacagtaagcctgtgtttacattcaggtactctgttttctttgaacgaaagccaaaggtactctaatcatcacatttatgcagtgtagtaaggtgcctaattgtttcctaaacaaaaagtatctaaactatcatactagtagaaaaagagaaaaataaacgttaagcctggattgaatgatttgttttatggatgtgtctgccttttatagataatagcaattcttcacatttgctttacatttggccttgcagtttttgaagcaaattattcacttttatcctttcaacagtcctagaaagtagaaagagaagcgatgatcccccatattgctgagtggtaattacacaattctgctatgcataagatgttttgtcatataaacagacatgttttctatattatcaaggtcatagaccctgacctaggcattgaatagttttgtggtacttgggattgaagattctttagagttgctcttctcctttgcttatgacaccctccctctatatattaagataaattagccatgtttctcattccctgccaaacactgaaacagaagctcctgtatccatctgccctgaactgcaccactgccctaatattagctatgtccttgactttgacttccccatccacccctcaaccacttctgggagcctctgcagctgctggagtatgtcttcattcctatcttcaactctccttcaacttatcacaggtcctgctaattttgccttccgaatatatctcataatttcctgttggtctacatcatcactagcaccagtttagcacaagctaccagctaccacggcaccctttaacggacttcttatctccattctcctttcgcacctgcagcaatctgttttccaagttacaaaggaaaaaagaacaattttattatagcctatgtagcgtatcaatgtcacgtcatagtttgtgtttctagatctctcccccagccctcctgcccttagtttgttcttagcccaccaaagcttttctttgttctcttcagcgagttgctcattttataaaatggctttgaatgttttgttcttctgtcctggaattttatatattgagagagagatatacatattttatatatagagagagattttagatatacaggaattttatatacatagagagagatgatatatatagagaaattatatatatctatcatatataatatatattatatattttatatatatataaaattttatatagaattttacatagaattttatatagagagaattatatatatagaattatatatagagatatgatatatatagggatatatattataatatctatcatatatacatatataatatatatgatacataaaataatatatacattatatctctatcggattttatcatttatatggtcaggtaactatacataatagttcttaagttactgtagaaataatgctcagggaattttagaaataattctactttgttgaaggaatccaacaatgtagttagaaattaaagtgaagaaagaaattacaatatacaattagtttatcattataaacatgtgctacctatttatttatcttggataatgggacagagtttcaacataaggcatttgaattagagacagattctctctctctctctcgttctctctccaaccttgtttcaacacactacaatttatatagttattctctaatcatttttatatgttcaagccagaagaaattttccagtgaaggatttccttataatctgcactacatcaagaatactcactttgatgctttcatagtgcctaagtaatttttctttatagcatttatcactgctgcatttttatatttctttatgtaatcattaattaatctctctgactaattgtgaatttcatgagttctactttgactcaccgttagatgcagaaaacccattagagttc

SEQ ID NO: 969 - DNA, 1511 bp, Homo sapiens
tattttaaaatgttttcaaggctcaaaagaatttatatagtaagttggttcattgtgtgtattggtaaatactggagactttaaaacttattaaatatataacagttttctgtaaggcaaaaactattaaatggtgcttaacatggaaaataacctcacttcgcttctcaaaattgaaactaagaacaattaggagaagtccttctatgtcactttctactgttctgggtatattgatgaggcagagagataagttatcattttcagtttaataaggttattttactttggaaatatatatctataaaatacacataaatatatgtaaaatatatatatatatataaagtatatttccaaagttatatatatatatttaactcagactgcaaatatatatatggatttatatatataaattatacataaatattatatatagataaatctatatagataaatctatagctatatatttttatatataaatctatatatgtaaatctaactaaatgcaagtaatttgtttgttttgaggttaagatcaatttcagttgatgccctttggttgtggcaaaattgggtcttttaaaaaaaaaacacagccgagtcattagctgtgatttttctttttcatacagttagcatgcatgcatgtctgaatgttctctctctgcaggttactatgctctttggccagcttactttccttcccttcctcccttccatttctttccatttatcttttttcctgttcaagtgggtgcaaagcactgcaacaagtcttttaccttaactcaggataagatgtctgccttcccttctctcttcttgatgtatatgcacccagtctctgtgagccacttttcctttttcacctgagaggagaggggaaagagattacttttctctctgatttctagagtagagcttggttaaatggcacatttcaagcctccctctcctgaccgcttatacttgcttggttttaaaatggcaggcagtttctttgtcttgtaggaatacagtgttgtagagttgttaacttctcaggcttgttcaagtaagatgaatgttctaaagataagagcctttttttttccttcctttctttctttttttttagagacagtgtcttactgtgttgcctaagcttatcttgaactccttgggctcaagtgatcctcccaccttggtctcccaaagtgctaggattacaggtgtgagccaccattcccagcctataagagccttctatacagaagctacagtgctgtctcctcccaaacctccctaggaacagaatattactaatagcccagttccacctgtgctgtctaccagtcactgtgcctcccagactagccaccataatgacttttagcacagtacatcagtttttcctatttttgactttaagtagaatcatacaacactcttttgtgtatagttgcagctttgtgtttgtgggggtggttgtgaggttgtagtttttgttgttgttttgtttt

SEQ ID NO: 970 - DNA, 1401 bp, Homo sapiens
gtgcagtgtaactgatagaagtttgcagagaaactggctttgctattgctcagctggctacatcttattgagcagtatcttcagacagcaaacaagcacaagttccagagtcagacagccctggacttacataaagtttcagtctcagcttcctcatacgtaaaaggcattaggttgaaccatatcaaactgccactcttttttggggcgggtgtggcaggggaagtgctttgccttgtgaagtttataatgagataatgaaggtaaggcatttagcatactgcttggcacatcatataggctctcagtaaatggaagctacagtgtttggttaatattattaacaaccgccaaggaatcatgataaaactagccatgttttgatatgataaaaactagccatgcctgccccagagctgctccacatagcatctcaaactctctttaatcacagctctaagtatgtgttccctgggaagacaggatgcaatctggagcactgtcacacaggacatgccctctttaatctgataagcagctgtgggtgagaactagcctccaactaaccggagtaaccagacagctaagacaagttcaactcacctctcctcaggcatttccaaagctttcagggaaggaaaaaaaataaaacacacagagaaaatagaaaaataggaaattccgggacttcctggaacaaaggagagaatctcagtgtctttttaccccaaggcttacgtagaaactcagcagccacatggcttctgcaattactcacatccaaaaagtttttactaatttctttcatcaaaggtaactggaattacaaaatgaaacctccagaacaacgtaacatcatgcacaaaagcactgtggatatgcagccaagcttgaaaaaggagactttaggtccattgtgtcaaagccttgaaaaccggggccactggaggaagggtgctcaggacggcacaaccacagtcgctccagtagggccagcatcttatctgcccatctaaagacaagctgcatgtgagtcaggagtaagtcaatgtgacatatactcactgacttcattcacttgcctacaagattatacgtcacttaaaagtgctagagattcgacagaaataacctgataaggaatgtaggaactctagtttgacaaatatccagaggcaccaacacaggaaccaaacacaggcgagacacacatgtgtaattttttttttcttttgagacagattctcgttctgtcgtcaggatggagtgcagtggcgcgatctcggctcactgcaacctcagcctcccgcgttcaagcgattctcctgcctcagcctcccgagtagctgggactacaggagcccgccaccacgcccggctaatttttgtatttttagtaga

SEQ ID NO: 971 - DNA, 2189 bp, Homo sapiens
tatatatatatatatatatcccagattatcttcccatacaatgttgtcttttcttggtgaggtggatctggcaaaggccagatccctgctaaaagccaggacagcacagtctttctacagagacctgaacagaaactgataaaagaagtccaaagacaggtagaaggagtcacagcctcttcccaggatcctggaattgctccatgtctacctcctatacctccccctatgcagacacacacattcacacacaccacatttgaccctctcatctaccagagacacacagagttctctccaacaatcactgcaaaagttagagctccaagagtttcctctatgctttgtctgtagacacagatactcataacaaaatgcacttctacaacaaggaaacccatcgttataaacttaagtgtcacaggagctgggcaattgcttacatcagatcattttaatgataattgaaggagatgattgagtatacagtttgagtgcttcttcctggttggacagattacagttctattcctagaacttttctgcaaaggaacaaaggtacagaattctcattcttgttcttggtacttaataatactctgccttaaacaaagctcatccttcaaggtctctcaaatattccatcttcaatgcagttttccttaaagccatcagaaagaattaattattctgtgctaatgttacatagcacattacttgttataccaaaacacaatttcatatatggttttggtgtatttctattcaaagttagtcaagattcctattttacttccaaagtgcctcctatgtatatgtatgtattatatataattcactatactatctgtaatttatctgcttacacatctgtctctttccctaccttccctatctcccttctcaacgtggtctttttgagaaaaggacagggattgcagccaatttgtcttggagtctgctatttggccagcaaggcttcctggagattaaatgttgtcactgccagtaggttgaaaaacctgtcaatagcacctgacttccgctaactagtcctagatcaagcttcagtatttattgccatttctctgctagggtctttgaagaaaaatgccttatggagcagaatctataaccactttgtaagtatcacccttcatatctccttaagaatcttgattgacatatgttctctgacttgagccacactctaccaatcaaagcaacctgtgtattttgttgcctctctgtcttgtttccttgttcccttgactgctccaccagggtcagtttccaagcttggttttaggatctgccccctataatatgctctgttttgtttactgtcttctcctattttattagtcaaccatgggactcaagggatcttcagtacaccctcatttctttcctttcaacttctatctctattaatcttacaagcttttacagctttaagagtcaataacattttcacaattttatcccattttatcctctcactggagcaccttccctcacctccaagcaaactttctatcttcattatagcctcactcatacatttataatgtaaatttgcatgttagagaaaaaatatctcactgctatttgaaaacgttttaaaacactttagatcctacattgacatttccaccattctacctaaggccttcttgtggtaggagcagggactttggagtcaaagaaatccagctggaacaccagttttatgatttgggttatttaacattgctacatcttaatttactcctcagtaaagtgggagcaaacacatccaactattgagttgttctataggctcaagattatatgattataagcactcaataaatggtagctatttttggtaaaaaaaaaaaaaaaagagagagagagcaaatctctacctcttggataggctcattcagtatgtagtagccatagcaaatccaactgaagagacaatgacagtcattttcatcattatggcttctaaatccaacaccttgtatattattagatgaaatgtgatctgctttattattcgcttttataaaaaccatccgcatataaagagatgagcaggaacattttataaaatattaggaagtctagaatgaactattttctggaactatctgcttttcccatccctgcacattgctgtgtctctgcagatagcggtc

SEQ ID NO: 972 - DNA, 1844 bp, Homo sapiens
ctctgctgtgtcctctttctaacatcttttcacttgtatccttttttagcctttgacctgatatgctgcttctaacttgtattctatttctgcctttttcttgtatcttccctgcttctcatatggcaaaagatggttactgtttagccttctaaaatgctcccaatttatcaatgccttcctgggtattttttagaataaagttgatctaaaaaatgtattggcaattaaggaatcttggcttttatttaaataattaaagactgaccgctttcagatgttccaattccaatcttttctcagcctgtgacagaggtctattgaagaaacagttcctgataaactactatttgtttaataataacttattcaggagaaatccaagacttctccagaatccctgaaggctttcctttctgtagttgattgagttgtccttccaaatcagggttaaggccactggcacaggaatttcagaaaaagaacatctgtttgcaatatacctggctggtggatgtattctggaatttaatgtctactgctgccaatctcttgacctttaaaagagaaacattgatcctagggaagctgagggggcttgtggtttagctttaagactcctcccaccccccaaaagacgaaccattgattatggaatcttatatacaatatatacattaaagattataaaatgcaatcagagcttctggagggacagagatgcccttaagaaattctataggcatctagtctctttatatgcaaaatgtatttcccatctctgtccaacatcaatttctattttttcattttttctttgttggctaatgtgagaaagtcatattctcctgtaacaagtaccaccccccttggtgcatgtatacaaccatttgaactccttggcctctgcaagcaactggctgattttttttcttaagtattcaaactagcagagtatggcataaagtacacctatccaaattagcccactgaaaatacaaacagagaggttctaaatattgcatttgataattttctccgtaatttgctgttcatacaaatgctttgcatatgttgattaaatatgcactttccactgccccagggagtcagagcccctcacagcagaccagtgtaatctggtcccaggagaccgtagcactccagaggggcaccgtcacacggactacctgcttcagcttgtcttagcaacaatgatcgccatatgtgaagctgcaggaaaacagatgctgtttttccatttgtgaaatcaagttgttggaaagtagtcaggtttccaatgtatgaaagctcatctaatcaacctacggagacagtgtgagctttctcagaaatatttgacaacattccctagtattggtgactagaaacatatatgaaatcatagttccaaagtgataatccttttcccatacttgtgttgataatatctgttttgatggctgcaaatggagtccctaattttcttaaacaaagggaatatgtaacctggttttcaattgcaaaaagagcttcacagcatggtctgtaggtaaagggtaggtttactgtagtatcttgttttattacatcagtcgtaagtatcacagattgtttccccttttatgtacaggaataggaatatgaggcaataactaatgaagacaatcccctttttatcaactcaaaagtaaaatttccataagagcccagccttagtgttctgtgatccatcctacttcactcttggactgtatcgcaagcagtcatattatgtgaaatttgtgtagcaaaatagtttagctgcttgtaaaactcctttttattaataaaatgtaaacagc

SEQ ID NO: 973 - DNA, 1287 bp, Homo sapiens
cctcctgagtagcagggaccacagtacaggcagcgccaccacgcctggctaatttttgtatttttagtagagacggggttttgccatgttggccaggctggtctcctgacctcaagctatctgcccaactcggcctcccaaagttctgagattacagcatgagccaccacgccggccacttttgacttttttgaccagcaagcttccatctggagcctaggctctcttctttaggtgcccacagccccaggggtgcacaggctgctgagcagctgcgggcccgcggggctgggagcccaccagggccgcgtgtcctgtgtggcgcacagtcccagtcatcctaggaggcagccctgagttcacaccttctcgttcctctttgtcagagctcggttagtgagtgggacactaaaatagcactgcaaacataatgagaaaatgaaaactgagtttaccagaactgctttcagagaaagagctggaagcattggagggaattctttgataagctgctttgagatgtggtggtgggggtgatactctcatgggggcaaacctaatctgtaacagcaaaagatcaccaagctgccttccaaaaatgtccctggattgcaaggctgtgttttcccaagagaatggaaatttgccttcaaaggagagtttggtcactgtccccagggaggcttcttcgcagtctttcaacattcggcaggaaacctatcagtgtccgggtgactacctattaacctgccctgattattaactgtgcccaggtcgagacagcatcagggttgtggttctaccaggccgtctctttgcagtcctcggcttctgtcaaagttgaacgccatccacctcccttttggttccagccacagaggcgtgccttccacagaggcgtgctccgcagcgccgccctccagcactccgcgcatcggcccagggtgctgcctggctcccaggcgccgccctgcggccccgcgcgtccgcctttcccttcagccagcccctgtgcttcccaggactctgctctgggctctgtcctccgctcaggattgagagtcagggaatacagagagtctctagccactgttgttggagagaccgacaaggagatgtctcaaatgccttcgggttctcttcccttttttcttctaccacggctgcaggctgagagagagtctcaatgacaagaatattgtgattcaagggaagcttcagtcaagggtagggaggaaatacagcagaacactggagagaaaaagaaataatctggcattaaaaatc

SEQ ID NO: 974 - DNA, 1743 bp, Homo sapiens
tccgggtagtttcgttgcacttttgcttttcatgtgaacttttaaactgtgaaatgtggcttccctttctcctgagaggtgactgtgatatcgttggtgtgaaatgatcctgtttatagtttgatgtcagcttgttaaatctgagaagtgattatggggttctttggtttgagaaacatgttaagatattgtgagcattgccattcatgaattcacattactccatgtagattgcacctttttttcttccccacacccttttttttgaaatagagatgagagcttttaaaattattctttaagatgctacatactctttaggagaatgtgaaatgtaactctaataaatattcatctaatctgcaggacttgtacacagagtttatcgccatttccatttcaagctttcattatctgcctccagcactgtcactctggactagctcatttcccccgctttggtagcaacaacaaaagacctaggtcctttttatatttcatagttatgtttaggcttagtaaaaaatcttataacattcattcacacatgcttgtgtcatgggataaggtaaccgtatcatttgcttcagttcttttccttttcttgtttaaattcggaggctcttctattttatttccaaattcattttctttagtacatccaattctctccggcactcccatgaacagctgtgggtggtgatggggcgatgtactgagatagtgcttcagcactctgagcatcccttctgagcagctttatagaacacgggaaagcatcgtatagctctgtggcagatggactttcaaatagcattcaccgagatctttctcttttatatcaggaaacacaagctatataccctacttagtatgctgacatttcacagttgatatcctcatatattttccttttcacttgatgggcagggatgggaattgaggtgcccttttcaaacaaaacatgcctttccttttagtattgctgaatattgactacaacaaatctatttggctgaattctacttgttttctatattcctacattgtacacttaatgcagtgactaccaagcattgggaaaaatgctaaatagttctgcaagagttcattgcctgtttggctcaagaattgctatacttgaatatatatttagtttagaaatttaaaaagtaatcttcctgccatctttcatttctttttccctccactagtgtgaatacttgtgttttattgatttataaacgtcacagaaatgggtgctgaaagaactcctggacagtttgatgatgtcaaatgtggtgtttacaaaatgttgacagtgaagggcattattatctggtttaatttaggtcctgtgttttgaacttattttactttgtactatggaacaattagacggccaagcattttcccaaatgaaaaaaaatatgaattttgctgaagagaggaattgcacttacgttttaagcttctttttaaaaggcagtttgaaatatcaaaaactttcagcagaaatatctcatgcttgttctcagccctgcagtaaatttggttatggaaaatttaatacagtctgtgtggagagtctggagataagtaagtgtgttgtttcctcttgggtaattccaaattgttttctttaaacttgtgatttagcaggtaatcctccaggtgaaccttgacaatctggttatactgtgatgccaggacctctgaaagtagcaggtgattggctggctt

SEQ ID NO: 975 - DNA, 3142 bp, Homo sapiens
catggcaatggatttttaaaacatacagaaactatttttagttttatattttagagctagagctgtagtgttctaaaacctaataccaaattttggctaatcttttcatatgtcctttttttattcagtgcttagaaataaataactttagtgatcataatgtccttaaatgtaaaatagttaagtttaaaaaatttcaaaataccttttcctattgtaaatgaattaacaatagttattagattccccagtgttttttgtcaacacgcttttttctatgggatttagaaaatacaattagtgatatttttcctaatccagaataaattttctttttgctttgtatgcattctagccagatgagtgggcaattattttgaaggttgacaatctgctccaagtcttagaaagcaggcaagtccccaaagaaagaaggaaaagacttgagatctcagcttagagttacggaaattacatggactttaatgataaagaaacacttacagaaaaaaaaaaataaacctggctctgctatttattgattttgtaatcttgggcaaattgtttttggctttgcttccgtttctcaattttttaaatgatgacagtggaggggagggggagatcaccttccagagatgtcctggcaattaaatgacttatttttatattaaacatctgattttgtgcctgacttttcttcttcacatgcttgctttcaaacttactgaccttctttttccccctgaaacaagtaaaggaataaaaaaggtttccctgacttctaaaagttatgaaatctgtggtgccacagacacatcctgtttctgtgcagcatgagttattcagcattattagtagacacattgctgcttccaggcacaggagcatttctgaatgtggttcaatagaagtgcttttagtaaaacacttcattaattccagatactccaccacagcatagtgttatcactgaattctgttgacctagttaagccatctctaattttattcctgaaagtctataattaggatggtctgaaatagcctgaaaatattcagcgccagcacttgtctcaaaaggcaagtagcaaaaccttcaataaggccttttctgagatttgttcttttatgtcactggatttgacaatctttcagcatggagagagagtgggggaaaggggagggtagattaggaggaaaccagagagaagagggaaagggaggggaggagaagaggcagaaataataatctgtcagttttgtgagtttcatcaaattgttgaccaggtcattactcaaattcattactagatatctgaaatccgtgagtaaaggttgagagaatcatccctaataaacattctcgtttaaaaaattatttatttttatttttaattttgtgggtacacagtaggtgtatatatttcaacgaacgaacagatctttacatcaacacggcttctgcttttgtgattggggcttttaagaacacaataataccacttttcagaaaaagctagacatgaatgtaacagtattttccaactcaagtgtccctcttatcccccttcctccagcaaaagagcttcagaaacgcaacacctatcaagtagttcctcagaaatgccagattgctgggattttagagccctacttttttttcctttttgacatttagacagattgagtttgagagaggaagtgactctgagtccagactgccccgcaccactgtcagaggaaataactgaagtaaaatgaagtgataatatactgtagaatatttaacagagagaaaggcagaggaaaatggcaatctgggaatatacagcgaatccccaaaatagacacaggctccagtgccagaacaaatgccaagtacagtagatcataaaatggtaaaacgaccttgccctgtgggctctgtgttgacacaggaaaaatggctccccaatagccggcatagccgggtctttattcgcagtttctgctatcgtttgtcagggactctgccaactttcctctctactcttttctgtatattcatcagtgagagagctggtaagtaaccaccttaatgactgcagcatgttgcagtaggattaatgacagataaagtacaactctgggctcttatgtcacgttgtgaatgaaatcagagggttctggggaggatattagcaaagctccttccattttgtagaagactcaaggtgactagggacatttagatttccctcccaaggaaagctatgataaatagagcggtgaaggaaaaatacacccccttctgtgcgcttaatgagtgacctgccaccttctgggaaatgggataagaatgctgacgtggtgtcttagcttgatgcaaaggttgaaaaattgacaaaacaaaccttcgtcatttgctgaaagccacagagaggaatgatgcttggagcagggaaaacatcttttaaaagaatactgctacctcatattcatggtagcattggagagatttacattcgaagaaggcctgtttgccttttttactgtgtggatagaagagagtagtcgtttttcctcacattccggcaaaatttcgtttaatctttatactaaggctttcgggtacgcaggtgactgctggccagccattgaggctgagatcatcatcaacattaagaattaagaagacttcatcctagcttgcttgctttctttttcttttttcttatcttttttcctttccttcttttcttccttccattctttctatcttttttttttcttggtttctttcaacttaaagacaatctttaacatcttgacaaaaggaaaaacaaaaagtaaatcagcttacagagaaaaggtttaggtggagaaataaataggaaaaaatatacaaagaaaagccaacagaaatctggtcaggacaattccctgggatgagtgttaggagacggtatgcatttagaaatacatgtataaactatggaaagtttcccactaaaaaaatgattacttctggttactaaatgcagaaaaacgaagtgatttttaaacgctggctgaagtttctacccacgtgtgaatctatacagcttcaataaaaagcggttgtcatttgtcaaagataaagttcctgtgatttggggta

SEQ ID NO: 976 - DNA, 2704 bp, Homo sapiens
ctctcagagaagcataagtctattaagccttatgttagttattaacatatgttagttattactaactaacatactaacttattaacatactaacatattaactaacatactaacatattaacataactaacatatggtacacttattttaaaataattatctttttatattttttagggctcaataacctggaataaaatgaaaaaataaataaaaataaattcatttcctttggtcaaatccagtgatgtactgaatggtaagaagtagaactaaggctcctgaatggaaagatactagtcatgccagacagtctagccttttgtagaaatattttaaagtatggataacctctgtctgcccaaactgtagtttggaacataaaagggaagacaggccaagccattccagtccttggctgctaaagcctgtgactgctgctgccaggcatcttccaggcttggtgtcagctccagctggagctgagatgtttccctctatacaaccgcaggtggttatataattagcagtatacacttgtagggctgtaaagagaagtctggtaacaaatccatccttggtgcacatctgttgggtgttacaattgactggaaaatggtctgttcttgaaataaatagatcaaaacactttttttttatttctgaaaattaaaaaaaattttcttaacttttaagttcaggggtacatatgcaggtttgttacataggtaaacttgtatcacgggggtttgttgtacagattatttcattactcaggtattaagcctagtacccattagttattttttcctgattccctccatcctcctgccattcagcctctgataggccccagtgtgtgtcgttcccctctgtgtgtccatgtgttatcatcatttcactcccacttataaatgagaacatgtggtatttggttttctgtccctgtgttagtttgctaaggataagggcctccagctccatccatgtgcctgaaaaggacacagtcttattcttttttatggctgcatagtattccaaggtgtatatgtaccacattttctttatccagtctaccattgatgagaatttaggttgattcctggaagacagtgtggcgattcctcaaagacctaaagacagaaattcgaccaagaaatcccattaccaataaccaaaggaatataaatcattctgttataaagacgcatgcatgggtatgttcattgcaacattattcacttttgtattttaaatattctgaggttgattatttaggcaaagtcaccactgaagcctaaatgactgaaatggcagtgacaagcaagcttgaagtgtatctatatcctctgctatccactcagtttgagcattttctgcatctttcagaagccttctggagccacagatgccctctggacgggtcactttgcaagagaacctgttgcacttcctatcttctgccttgtactaaggaatctgatcttgtcatagtatttgacttatttctcacccctctcgaccatgtggatacacatttccatttacatacctgccaaaagtgtggacatacttggacatacttccaattggatgccactcaaataaaagacaatttattacttttaaccaaaaattcatttattcaaaagctgtaccaaagatatcagtgaaaataaagtcccagcttagcagagaatcaaagttctattaagcacctctcttttctctgcacagttattgatttccatagcgcatgcaagaaagagaacttggaatccagactttgatcccaaattaatatatgtgttaggatgggagaggtatatttcggtcctccacatgctcttcagtatctgactgtttaacttgttcagaactaggtgaagaagagaggtgttgggtgctccctgaaaactcccaacaaggttgttttaatttctctgctactagtgacttctccagtctcggtttaggtcctctttatagttttagctaaactgaaaatgactaaaactggaagtgaccataaactaaaaataacccttaatctttatttcatggtcacttttctcacacagtaaatggctcttccaatcaccagctagcaaaaagctagctggacatcaggagtgaagggtcatgttggctatgggctgtggttctattaattgtcatccaaatgggcacggaatttaaaattaaaattttcttaaaagcctggaaaggcccagagtaacaacacagcccctgttttttaacatgtgctgaggtgtcctcctaatggttttcaggactgagaacaaaaccccttatcaggataaagggcaggattgacatgtcatccagggcatggacagaggcagaaaccagatcttcgtgtgtgcatgtgtctgtgcattaatcatccacagcatgctttgtggaccaccatacctaagaaggttttgcaaactatctggcaagatgagataatgtgtttccacatttagcattttggctctccaggcatcagaactttgtagctttaactcaaaagcttatcactatagaaataaaaataatttaagtttccaatagtaaggggaagaagacttcttaaaagtctcttatgaagcagaataataagtgaaaagtaagagaaatgagactggttggatttttacactttacaaagtcagaagagggaattttctgaatgcct

SEQ ID NO: 977 - DNA, 2099 bp, Homo sapiens
ctactctgttctgcggctgcacctgcattgttttgaaatatcataacaatcctccatggtcagcaccatccaccccaagactgaatgccatgaagagtatgtgcctcaggaagaaccaggcagaagcaactgagtctccaccccaacaaccagagctaggcgactatggaaaatcattcgaccccttagaggtcatgtcctagtctgtacaatgggataatgccagtaataataacacctatttcagagcaatgctgtgaggccaagatgtcataataaatatggaatgctgaaacacattaataaatgctccttcaactttctcatcttcttggcacagaatgagcccaccacatcaaagtgacaaaaattatgattgaagaaacatgcaatgaaactggattaaagatggcaaaaacataataaacaataatttttaaaaaaaaaaaggaaaaagaaacttgattaaaacttattatgtgctagactatatacttaccacttttgtgttttctattctaagttgaaaatctacaaggtagatgccatcagcatcatttcacaaattaaaacaaaacaaaacaaaaactgggattcagagatgtcgaacaacctgcttaaagtcacacagcttttaagtagcacattcaaactcaggactcttgacccaaatccagtcctctttccactcccagtcttctctttcctccaacatctggccaagcccaggttattatcagtgtttgctcagccctggaataggcacagatcatgctgagcatcacagatagtgtggaggagctacacattcaagtttgcagagtaaatcctaaaaagccttagagaaggaactgcaaggatgccaaatcaatctgaaggaggcctcagtagacaaggaggcatggggaagaccggctggggagacagatttttgagcgtcttttcacaaaatctaaaaattactaaccttctacatgtcaaaagatatttttttgtcaacacatgcaagaacaccctgctaagaagcccaaatgagcagatggatgagttcgcagactcgcagatgctggagttggaaaagtccctgctggcagtccccaaaggacggcccagaaaccccaccctgccctagcccctcaccaggctgagttcaatacctttcagagagccttcaagcttctggccttagactgaatcttgctctctagaaaccaggttgttggaaggttttttcttctttttataatgatccccctgtctctgcttcctgctcctacctccctctccttagcttctcactgctttccatttggcattccacaagcatctcaccttcacccccacaggacagaagggatcatccttctgtgataggcaggaattcaaggctacagagctcagattcaaacaagtcaggaggacacaattacaccaaaatctgtccatcctcaaagaccatgagatttccacagtaccacattgcctctaactaactagagaatccccattttgtactctggaaatttacaacccagagatgtcatgtaaattggtttcacataggatggtaagaccaaagacaaaattagcatacaaaagtagaggcataaatctcaatatcatttctaatttgggttgcaatttagactgtgcttcctatggccaaaggaaaaaaaaagaagaaaaatgaaaagaaagaaacaagattaatcccacaatcagcattgtcctcaaggaaacatctaccagtgctgcgtcgacacatgcttcctggtattcctgtctgaaagagcagcttcctatgggctagtgatccttgggcagtaagaccaactctcaactttcccacgacagtttattttgatgtaagtggaaagggacccttgagtcagaccttctgaacacagttcgatgggactgaaagtccataagtaggactctggggtgttcccgcctaagttagtgataagaacaagatccaccttcttactactccaagtgtggcctgaagaccagcagcatcagcatccctggaggtgtggctagacatgcagaattgcagacctcctgggctaggaatgagaatctccattttaatg

SEQ ID NO: 978 - DNA, 5537 bp, Homo sapiens
gacacttaagaggttgatcccaatctctttgttttttgacacctgcaaattgtaactcacatttgcatatcttttgccacttggccagttgttttgatatctattagcatatttgatcttcccagccatcctatctgaaaatcagagcaggaattgttctcttcatttcattaagaaattagaggcctagagagataagtgacactgacttaaatcagaagaggaactggatccccaaagagcagagcactagtcctgtgctaatcccctccaccatgcaactgccatccactccaaataattggaaggagtgggtgaagggaaagaatgaggaagagactgagctatgaaaataaggacacaacgaaggagagagagaggaaaagggaattgcgatggttaatttcatgcgacagcttgattgggctaagggatgcccagacagctggtaaaacataatttctgggtgtgtctgtgaggatgtttccagaagagattaccacttgaatcagtagacttccctcaccaacatgggtaagcaccatccaatccactgagggcccaagtagaacaaaaaggcagaggaagggcaaatttgctctctctgctttggttagggcatccctcttctgcttttggctctggacactcctggttctcaggccttcatagctggactggagctaaaccactggcttccctgggtctccagcttgcagacagcagatcaagagacttctcagcctctaggatcacatgagccaatccctcataataaatgcctttctagatatctctgtatatcctcttggtcctgtctctccctgactactacagggactgatggttaaagagcaggaacaaaggaacacgagaggtaaggaaggggcaggaggatgaggctgggtcagggagtccgcaggcctcccaacccatcacagaacttgtcacactctactgaaattgctggcttgcttgtttctagctctggctgagactataaaacctacagggatggtttgtctgtcctgtttatgactctcatccatgtccaaggctaagcacagtgataggtaaatagtgggtgcttgataaatattagtggaattatcttcaaatatggtagtccttggagccagagtaatatcgggtcaataactttactctctctgattccgttttctcatccataaaataggtataacaaggtctttcttagaagattatgtcaataattaaatgaattcactccgtcaagagcatttggaactcaagaaacactggcattgttagactgcagcccataggataccaatgccattgccacaaatagggcccatccttggaaacacagtaatcaacatattctatggacttggaagaaggttctacaaggacagattattttatttgaaaaaatgacactttttttcaaaaaaaagtggaagatactgattatgaaagtcatacaaacacattttttaaaagtcagacaatatggccgggcatggtggctcacacctgaaatcccagcactttgggaggccacggtgggtggatcgttggaggtttggagtttgagatgagcctggccaacatggtgaaacctcgtccctactaaaaatacaaaaattagccaagcaaggtgggtttgcctgtagtccaagctactgggaggctgatgcacgagaaacacttgaacttgggaggcagaggttgcagtgagccaagatcatgccactgcactccagcctgggtgacagagcaagactctctctttaaaaaaaaaagaaagacaatactaaaaacattaaaaaggaggtaaatataatttatactccaatccgatggcaacaatcatattgctatagcaattatcatcttggtgttactttttccaggacacttttccatacattgccttaaataatggaactatattatatactaagacagatactcttgccttgccacttccaaaccattctcttacagtttgttcactaatagaatatttttgtttgttttccgaatggagggaccatgtgctttaaatgaggtcccttctgttcccaaaacatcgatcttgactaggccagaggaagtctcactcgttccattcttattgctgatgattgatttgtgagtggaagaataggcatgtggtcaattctgggcaataagacacaagggagtctggtggaagcagcaaaacacttctaggcttgcaaaagagacttccaataagaaatactttttcctgtttccaaacataattgcagaaggatgtgatattcagaagagtagcagccatcttttaaatatgagaggaactcacagttgacttcagaagaagcactgagaagccaatgggaaccataaagttattgaacgttgagttaaccaagccaggacttcttgttctataggatgataaacacccctcatacagaagtcccctgcattttggttggctgttacttgcagcccaaagcattctaaccatacagttactatttataaccgggtttatgtgttcactttttaccttctctacacatcaatgaacagaatcataataattaatgtctatgaaagacttcctatttgcaagtactttatcaggcacattacatggattgtctcatttttaatccttgtgacaaatttctgtagtcgaaatgattagctctatttttttttcagatgaggaagaaatcaaagatttggaaagagcaaatgatgtaacaacaaaatggaggggcaggaatgtgactcatgttgttcagttgagggtctaagtttcttctccacaatcacagcccttaggactcccctcatcatttacaatagctccaagcaccctattttctgtacataacatgcacagctaccctcccactgatgcccacatcccacaaggtgaggtctttttccctcttcccttcccaaacccttaccagttggccctacgtgtttggcatcttctaattatcctgattcctaaatatgcaaaataataatattccccaattgccttctgctgtaatttcatgtaacaggtcccctcaaatagaacgtccttaattttaattgcatattatgttccctttctcagggcagacagctatttattcatctagctaattgttcaggagacaaagacatggaatatatctcaccaaattaagtatttgctagttgctattactactggggctataatatatacccctgatttactttctagaagctcctgaggaaatcttggcatctttttttttttttttttacatttattttttggcttagcctacctatgattgtatgaaggccaacaaatcctggggtattattattagttgtgatgataatagtaattaccacaatgtatagatatacaaccatacgctttattcaatgaaagaagaaacacagtaaaaatggcttttattgaatacctattgtgtgctaagcattggcctgggtatgagaaaatattagcccattgcctcatttttgttcaagaacttcttaagagactaaaagcctcatgtttactgatgagaattgaagggtacagaagtgaaaccacttgtctgcacccggcacacagctgggcatcagaagagatgggttttgagcccaggccagtgaagaccaaagtgtaggttcttgtggggctaccacagagcacatagccccttccaacctcactaattacacgtgagaaagaggcaagcatctcaatggctactttatagatatggtcacctgcatagataggaagtgattttcccgaccttattggatcaaattattcatcagaagccggatgaagaagtgctaattatcatgcaaaacagcccccgagactaagaagcctgccttgcctgcttcccaagctgcccacttccagaaagggtggggctgttttgccacctgcacatgtctggatttccctctccatctcccatctcccacccttcacacccacacacccgtggctgcaggaatttcagccacattcaccagacttaccttctgttttttcccaccctccctccctccctcccagggagtcagtcccacagctgagtgagagaaaatgcccagagaaaaaccatcagttcatttaattaatattcacggaatagcctgcctgtattaggtgggtactgtgcatgcagagatgtgataaacacagctctgcagacctcccagccccagagaaagtcccagctcatcacgaccctatggccaagggagattgggcaggaactaataccttctttctacagaaaaagaaatgaaagcagaaaaaaaaaaaaaaaaaaaacaaccttggaagaggagaagggcatggtgcatctgaatagaggctccaggaacaaagaagggaggatagagcaaagggaaaatgggcagtcagcgctgccaagaaacctattaacctgaaagtaattactgagtgccactatgtgctaaggacattgcacacatatgctcgatccaccacaaggttggtccgttatccataattttagacagggaaattgaatctcagagaggttaggccactggctttagactgcacagctgaatagcggcagtgttaacattcaagcccagatcggtctgataccaaaactcattccctgtgtgagacagtccaacactagcccgaattggcattcatgaaagctccacagctgagatggcacactcagacaaatgtgccagacacttccatacactcaccaagtttcatggttttggattcattaatagcagagatttccactaagaaacgacagcccttcccaaacaagagctgtagagaattctaggtcttctaggattctagggaattctagggcttctgtagggaattctagaactgttatgctggaaacacaaggagaacactttccccaagagaaaaattccccattaaggtaactctcctaccagcctacaactagagctcgtttattcaacaaataacttattgagcacctactattgccaggcactgttctaggtgcttaagataatcagtgaacaaaagaagtgttgaccttgtggtgctgacattctagtgatggatgcagaaggagcaaaacacccccaaaccccagctacaaagcccagcagctcaaatgcacccagagagaccttccctttactttagcttagtcctctcccacaaccttgtacaccaggggatcagtaaggcctgggcagactttgtctcaggtcaaactgagcctcctggcagaaatgaacaggaaacatcttgaacatgtgggtagaccccttctgggctggtcagccaaatcccatctcaccaggagcctggaggcctgcctcgtcatggcatctgtccactgaactaaccaggcagagagcttgtccaaatcagattaaatggcaagcaatgcaggactgcctcccagggcaggctggccagaaggcatactgtaatacagttttaagtctttacagttcttttttctttaataacacctttattg

SEQ ID NO: 979 - DNA, 1976 bp, Homo sapiens
ataatgcttaacatgcgttctgttctcttctctccaaaaccagctttcacttagtttcccctcttttataactttagcttgcaaatgggttaggtttgctactatctctcaggctttcctgatgtaccttgtctttttccacccccatttccaatttactaagtttttaaaatgttttaaattccttaaatagtagtatgattgcctggctcattctttctcgggataattcataggtggtagatcactggcaggactatgcatagagagacattggattatctgcgcatctaatcctatcaattgaaactggaggaggagagcacaagttttgtaggaataaagatttcccttaaaaggaagtattgtcaggaacaggcagtataacagctctcaggagagtagatcgttatggatgatctctgacctataaaaggggtatgttttacaaattgaaagccagagaataccgtcttgctaagattctcagagtgtaccaataacaacggctatctaatacacgcaggtaacatttacagaatagaagtctcttcttgtttcctgcctcccacctctttcacacttactgtcaatcactgaatcaaatcatctcaaataaataggtgcagtgacatagcagaagaagggcatgcacaattggggctgttttggggcttgggagatcatccatcatgttagacatgcatactaattagttcatgttgatatgcccaacatagcaaattctggggaaactggaggggaagtttggggaaaattaatgtgacctagagttgttgcttgaagaacatccccccacctctttttctctatcaatgggaggaataaaaggctatgctaattacatatttgttccctctctgcggagtctgcatggacagctagtctgttcacatgtagaggtgaggaggatcactaaagacaatgacagagagcaatacacagaaaatgatttcatgctaaaaataccaaattgtaagaatgtggatatctcaaatatatatttgaatcagtcatttatgtgcttgctttcctctgagatggtgaaagccaatttagcaggtggagagagagagagtcagaaaataatcatttccagaaacagcaggtgaatcatgcatatttttatattcacatatatacactcacaatgcagatagcttgaaaaaatatttatccctcagataactagatgatctacatacctcatagtatattccattttgtctagttgctatcaataactaaaaaaataaccacacaatatatttaaattaggatgcaaaacagatacctattatcacactgtaccaaatatagaaagtaaatgcgatagtcgaggaaagataatctgtttcatttatgttggagatgaaaacaaaattaagaaaatagaagtaagaaaaaaaaaaaaaaacctctatactgagcttgggagtctctccccaggattacgttgttcaacattttctagtgatgctaaggatagaaacaaccagctcttgaactttgaagtaattggttcacagctgtgcttatactgagatggaaatatgaaaatacatttgtacagaggagggttttttttttggtagttgtaatgaaagagttgtcaaattaaacgcaaactgctgtaagtaaaataaattacatgtggaaattcaattcctgatactttcatcaagtggatacatgtgctatatttccagaaagaatgctaacattaatcataaaaagaactcttacgctgtgttattctcttatgttagttagtgttaaggaagcaaaagtgatctaaagtgattgttagatatttttgtatccaaaaagcatggataagacactgaatcggtggaacacagagcacttcaagcatttattaaatgtttgagctgttcgggagggacataaagagtacaaagaccacatttctggctgcagagatacttcaaata

SEQ ID NO: 980 - DNA, 1794 bp, Homo sapiens
ctagcacatatgacacacaataaatacatctattcagaggagttgccactggaattcttacacactaaaattataagccatggtccattgaaacaggtaccatagataagtgttaattgagaactaattgaatgtattatataataaaataggaaattacaaatgggaaatattttttctatacttgtgatgcacataatttagctttaaaatttacaggtataaaagttttttgaaggtgaaacaatatatcatcttggcactgtttttcaaaagttcctgctgagtagtactttgataaaggttttcagggggaataaaaaaggaaactcttcaaacttaagtcatagatgtttccatgattttttttaagagaaatcaagacgtgaacttagggtaacttattaacttcagcagtatctaacaatcccactacatttctaaacatttaaattgcacttttgccttcctctttggttatttgatccaaagtacacattataagtcctcttataagaatatctcacctcaaaaggtacaggaagaatttcctcatttttctctgtctattctctttcctgagaaaaccaaagcacttctgctattatgctttggttatagctgaaaataacatgagtcttgactgtaactgctattgtattctatgaatttggaaatataagggactggtgcatagactgtaaactgctgcagtggtctggcgatttatttgtgtttttatattgtgtcaatattaggatagtacggcgtatttttatcatgctttactgcctttctagaactttggagagttgaacacacataaggaattagcactggagtgagaagatgatgaagggtgccaagaaattccagtggaaaacagcatagactgcaactgcctaataagcaacacagcttccacctaggttctaaaagcaatagctgtgactcaggatgacagcaaaggagaaggacaataaggtaagtgtagatacgtatctggaaatttttctgtgatataaagggagaaatgccttagggaagagattcctttttctctatggaatcaaaaattttatgataacgtggatacattttataagaccataagatggtcacaattgggtagtttcaaattgctagcacatggctgttttactcagcactccttgacacataggagactcaatacatatttgggactagataatattatatgatttatgctgccgtattatgcatattgcataatcctgactagtgattctgacttgacaacatttacaagcttgaaaatagaagagggtgcaacctctgcaagtagtttgaaaatagaagagggtgcaacttctaagagtagtgcataatgtgaatatggtacctgaattattgtcctatccttgatttctgtagcaaaatcaaacaggaattactatggttcatgaataaactgtccttctcaatggttccagatggttatattgttatcaacagcaaaaaaacggaaaagtgacaagataaaagtgtgagccagacttccctagaaatctgatgaccacctaaccccaaggtgaaagatttatctttcatcctgataaccatttgggtgaagaataagaaatgaaataattctgtctctagcgtgagattaatgagtcactccttctaccattctctaccccctccatccttttccactgagtagaatttctaactttgattataaagatttgaggccaattattgggaaaaaatcccaaggatgctagcttatgtgagtatttttcctaa

SEQ ID NO: 981 - DNA, 2163 bp, Homo sapiens
ggtgacagagtgagactctgtttcaaaaaaactatgggtgtgtgtgtgtgtgtgtgtgtgtgtatgtatgtatatatgtgtgtatacacacatatatatacacacacacacacatatatatactgagcctaccttgcagattggctatgaagtccacaaatgttaatagtattataataatgattattaccatcatcatcaattcaatgaatatttatcaagggcctattatgttgaactgctggtgtgcaatacagacaaggcccaccttaaagagtttataagctagtggggaataaaaatgccagcaagcaagtaaagaaatgattatgacattgagataagtgtcatgaagaaaataaacaagatgctgagatagggagtaaaacaaagcaagagattacattacatcatgcatccaggaatagcctttttgtagtagcttctactctgggtcataacaatgaaaagaagccaggcttatgaagagccaggtgaagcccattccaagtagaggggatgacatgtgcaaaggcacggaggtaggaaagcactggacatgccagaccatggctagcacataatttgccatggggcaagtggcacaagatgaagttggagaaatgatagcagtaataaaataataggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctattacaaatttcttgaaagcagggactgtggattatttattttgtatctctccctcttattgtgatttgcacataccaagaatgtgttcattgaatatttattacattgaaccctgtttaaactttttcttaaatcctttcatgtgaggccaaataatagatatagctctgagaactccttccctcttggactttgccttctggtagtttatccaggcaaaaactacagacgaccctattttatagcaaccagagcaaggaacaagaccacaccagccttttaaactgacaatctattagatactttgaggggtaggagttgatgttttttatgacaaaaaaacctgggtactattttttcctcttcccaatttttatttctatatgtaaaaagaatggctgagaagtattggaaattttttgccaagaacagagcttaagttcttgctagaacttcaaaagattttgcatatccacctatgtgacaccctttgttaacattaggtggccccctttaactggttacctgcttcttcaccaaaagttccgtatgtggttttattaacaactatttttacatacctaggattagacggaatcttgaagtcaggaaaagagataattccaatatgatcaatttcttctaccatgtcaacttctgatccttcaggatcctgtaaataaaaacaaacaccctcaaaggccagaaactacattttaaaaaatttaactgattatacaatctttgatgtacaaaatatttatagatcaaatatttgaagacaaatacccatgtcttcaaattaaatatgaaggatgaagatctgttaaatgttatagaagggaaatatggttcatttcagccatttcccttcttctttttccaatcttccccatctctcctcattatcttgaagag

SEQ ID NO: 982 - DNA, 2168 bp, Homo sapiens
gcaaagggattctaaagtgacttgtctagaaacatggccaggaccagaactcatgcctcctgtttatcaaatcctatttcactcgattctagaatgaactgtttccccccacgttttcatatctcttacaaccgacagcattttacaattctaagagccggcattttttcctagtaataccttaaataaaggcttatattataaataatggcattttacactcactaaaaaatggtaatactccctctacttccttaggaggggaaagaaaaataagtgttttgtgaatcaggaatctacttatttcgggggtgtaaaatcgtcatttctcccccagagagaaacatgggcttttgctttcaagcgtctgtagcaaagacctggctgctctaaaattcaaggtatttaaatataccttgtcaaactgagttatttttaaaatcagacattaagtcacagtatcttacttaaaaaaattaagtaaactgaagtttcaagaggaccttaaaaaattgttgtgctcttttttccctgcaagagggtacaaaatgatcttggcatctttggcatatgggaccaaatatttgtggaaaataccatatgcaaacacccctttcattcaaaagatcttaaggtagaacatttgatgaaagaaagggaagttcaaaggttctttcatgagtaataggtagtataatctgaagagcatcaggaagattctctctgaaacctcaaaatgtctttcttaagcctagtttgcaaatggctgaatttcatctcagaatttcattcctttggattaatataacagccttcaaagtgtgttcttcaggaccctaggacttcatggaggttctttagagcttcccacatttttactcaagtttccatttttaatttatttttatgcattttaaaaattgaaataaaatgagcatgcaaaggtgttatatccaaactttaaaacacggggacaccaacacattatcctgtaccacagggtgttttgtacagccctgctatctaagtgaaaaatggcctaatgtatatactcattgtttctgctgcttcttcctttctctaacatactccaaccaggcttctgaacccacgacaccactgaaacaacttggtcaaggtaaccacagacctctgcattgctaaaatgtatttaaatgctcaattctcagtgctcatcttactcggcctgtcaatagcatttgatagttcatccatctgccctcctccttgaatgtctttcttttcttggcttccaggacgttgctctctgttgatcctcttcctacctcactggctactcctttgcgaattccttctcaggttagctctcctactgtccctgtctccactcattgcttagatgatctcattcagtctctgggctttcattaccatgcatacaagccccagtcacatctccaacctgactacttcttccctgactccagactcccttacccagctgcctactcaacatccccactgggccaggcatggtgggggatgcccagctactggagaggccaacgcaggaggattgtttgaggccaggagtttgagaccagcctgagcaacatagcaaaaccttgtttcaaaaaaaaaaaaaaaaaatcccatttgggcatctaagaagcatttctaatttaacatatcatatttttctccctcaaacctgcatctcctgaactctactagttgctgagactaacaaaacttaatgtcatcctcgactcccgtttcatatgccacagtcaaccaatcagaaaattctactgattctaccatcaaaatacatccagaatctcaacgtttctcagcacccccaaatacaaccatccttgatagatcactatcatatcacctcgattactgcagcaccctcctgatgggtctccctgctttcttccttgcccctctatagagtcagatcacaacattaacagacagtaatccttttattctgaagttcaggttatgtcacttctttgctcaaatctcctaaaagctccccacaccactcaaagtcaagtcaaagttgtagtcctggagctgcacattgacaattgttgccccacaatatgaatacacataatacctttgaactgtacacttgaacgtggttaagatgggaagtcttatgtgaaatt

SEQ ID NO: 983 - DNA, 1561 bp, Homo sapiens
tgtttagacttgagtcccatccttgagatattatgtatatgtaaatattccaaaatctgaaaaaatctgaaatccgaaacacttcttgtcccaagcattttggataagaaatattcaacctgtagtagatttggagcatatttaggggctcccagggatgaggcagcagagagggtgatttgataaaagagagaggagactggagggatgaggtaatgggaagaggtatagggtttggtcttaactgtcaagtcctagagaactctttggcaacacatatggctttaatggaagactgtgtctcctggggaggtccctgcattcattcatccattattaaattcattcaaacactctttattgagcgcctgctctctgccaggcgctactctaggccttcgggatccaacagtgaatgaaaccaaagcccagcctttacagagctgatattttaggggccaaatgagctgagctttggcaaatttttggagtgtaaggggcctctgagacatccaggttggcaacacctagtaagtagatgttagcggtgaagagcagtctgggctacaaatataaattggggatcattggcacaaagacagaaattggaaacttaggcattggttgaataatctatttctttcacctcagttctcaatgatttgccattggatctggtccttatgtgtgaggagggatgtatctagcttatgccataatctcagggtgctcatttacccatacttctttttttatggcattttggtaaaaggctctctaatctttcttgaggagattgtctgaagattaacaaatatctctgatatgcaaagcattatactaagctctaggggggatggaaaataaatagtagatctagtccctgttctgaaaacacttcaaatctacaaggagagatcacccctatacactttgtaaatggtccatggtgcttgaggacagccataagcaaattctaggctgctaaggagattgaaattctagctgaaattctaggctgctaaggagattgaatcttccagtacgtatgcacaggcagagctgtaaagtaattgtcaaggacacttccaaagggcatatggtttgaaactggtttctgatgccctgaatccacactgggttggaatgacataggccaagttattgggtctgacttgagataattcagatgggcacatgcgttttgaaacaattttgacccagctgtgttggagctcttgtgacttaggtacctattgatgccactatgttgatgtggtcccagaacaaatcattgaaattccagctgttctgataaccaggaaataaacaaatggatgtcctttcttcatcttagggcctcatctcccctgtggtggagttgggacaaggtgggattcagaggtgggatgaggtagggtacaggctccatctggcaggcaaagaacccatgacagggattcatgtgctaaccttgtcctctgctcataaaggaccttttgtcattctaagctgagtgattgctcattcttagagatgtcatggacaccttgaataaatg

SEQ ID NO: 984 - DNA, 1560 bp, Homo sapiens
tttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcagggccgtctcgcatagatgggtaatagaaggttgactgattgcgaatcagatgtattcggttgcaaatatgctgcttggggttaaggcagtttcagttaacgggaaccagattttacgtggtgtttctactttgaaggtacagtattgttacattacaaactgaaagacagaggtggagaaattcctttaagtatcacccctagccttgtttcaccactgtgtccaggaatctatgagagactgttaacaatagctgcattgttggaaatgacagtggcttctcttgcagaaagttaacctttcattatgattttcatttcagtttactttgtaaaagaaaatttagctttatctgagaaattggctgtaagaaatttgcaaagagagcaaggaaaataggttttcttcaacgtgtctgttaaaattcacattctctccccttccgttttgataactggtggtgatctttatttcctctagatattaggtatgctaacacagtacctgatttttggcagttactgtgggaatatgacttttttatgtaataaattgatgtcaaataataatatgaggcttttaggaataattaattcacatgcatagatctaaaacatgagggaaatcttttagatgacccttcactttggtacaagaatagcacaatttgaagtattaagttgctttctaagtagaaaaagctatttactcagaattgggtaattttagattttaaagttttttttttttttttgcaacatcaaataatttggcaacatcaaatttcttgttaaaggaggcgacagaatctcacagattctttatcatctgatcatggcatcagttggactacatttcaacttaggacaataatgcaattaaaagactacatttaaactttctgtttggaggtttttctaatttgctttcaatctcaagcccaatgttagaaatcttttgttggtgacgcacaattttagtgttcagattttaggttttgatcgtttttagaatttttttttatgtgtgtagagcagcgcatggatgactgaattaatcaaagatctggcctcatttctcattcaagtttgtacatttcttcacactgagatacgagcttgggtgcaattctgttggtgggcgtgaaagctgagggtaaggaccttctacctagagactgataacatttaaatatttcagatttgggaattaatagaaagttatttattaggttaaaaggaactagcccattcaggtatttgaaaatgattgtcaatactttgaattaagctcttagaaacattggggtttgagacaatcctaatcagggtcaggttttgggtgtggtctctcttttgggcagtcttctctgt

SEQ ID NO: 985 - DNA, 1433 bp, Homo sapiens
actggggattacagttcaacatgagatttgggtggggacagaaatccaaaccataccaagcagttttgctgaaatcgaatataactcaaagaccttttctgattgtttttaatcaaggaagtcaatgcttttcttcttgtcattaaatgtggtaccttattttcatcttataatgagtccgtgtagtgcatttagtagatgagtttgggttatgaggggttgtaatttaagacctcctctgttcacatctccaagaaattacattaagtttcaaaactttatacttgcccttaattcttgtgcctttctgattaagatcttccttgttttttagtttaatggtgtgaaaattctaaaaagctcagtctttggtaatcagtagataaagaaactgacagaaaacttaatgcattaacctgatacttcttttctttccacaaaaaattgaaatgttataattgtcacaatttcaacttacttgattctttgttattaatacctctctgtaaaaatgtgaagttctgttgacattgttgaggtgaatgtcttaaaagtgttgccctgatttgctgccaaatgtctttttctgatttatgctctgtgagtaccagcctagctatgcattaatgtgctctctgtgaaatgcttctgctttttgtacaaactattcttaagctatgctcacgggaatgaaggacaggttgttttatttcaataaggtaagaatgctttacatttaaagaaagcttcaaaaaacaacctgtgtcaattatacattaaatatcaggggtttgaaaccagttttgaatatgtgaccagaaaggatggtttgacttttcaaaagaatttccaatatcttaaaactttagaatttatctcgggttaggtgggcaatgtttagactaagttgtttcaatgctttccaataatacttttcataaaatttcacagatttagggtggctagctattgcagtaatacagtcttataataattaacgacagaatgttagaagcaaattgtgtgatttgcatgacttatgaaatgcagatggtgagaagtagacttggaagctttttcagggtgcagatggacacaagttcttcagtgaagttaattaaaagtaatcattgtatagtaaccactgtcttgtaggctgctaagaaattagtattctactttcccaaatgaaaatgccagatgatgcctttccaggctgtgggaaatatctttatcacctgtagtcatgtcaaaagacgcattcctcttcccctttcttcctccatctctagatttcatacagatgaataaaattaaagggacaaatactagtaggaagcactgtatatagaagacaatacaaattatctgtagtactaagttgggattggaggttgtggtccattccacatcctgtcctgtatttgtatgtg

SEQ ID NO: 986 - DNA, 2049 bp, Homo sapiens
ccagaagaccctatgatctatttttactaaataaaaattgtgcagccgggcacagtggctcacacctgtaatctcagcactttgaaaggctgaggggccgctcacttgaggccaggagtttgagaccagcctggccaacatggtgaagccctgtctctaccaaaaatacaaaaaatagctgggcgtggtggcgggctcttataatcccatctacttgggaggctgaggcaggagaatcgcttgaaccggggaggaggaggttgcattgagctgagatcgcactactgcactccaggctgggtgacagagtgagataaataaaattttaaaaaattaggcatagtattgtacatgccttgaatttatataatgctctctattatggcattttacaagagagaagatttaaagtgtgccatctgacttgcaagtaaaaagagcatctccaaaatgatactagttactgtgaaaatatagcagcagacaacttgttcctgggaaacaaaaggatgattacaaaaatccatcaccaaaagctcgtttgaaagccttatcctgcaagaaagggctcagctgttagagttctgctccttatatcagtccttccccttaccacttccttctggtactgcctgatccaggttacaggtgtttaggccattttagagaagaatgagaatgtaccaacatgcaatgggcattttcttggagcatctgaatccattctaagagtcagtctaagactgatccaaagaaagtaagaggaaagcgtccaggcatggtggctcaggcctgtaatcccagcattttgggaggctgaggcaggtggatcacctgaggtcaggagttcgagaccagccttggccaatgtggagaaacctcgtctctgctaaaaatacaacaattggccaggtgtggtgtcacgtgcctatagtcccagctactcgggaggctgaggcaggagaatcgcttgaactcaggaggtggaggttgcagtgagccgagatcgcgccactgcactccagcctgggcgacaagagtgagattccatctcaaaaaaaaaaaaacaaacgaacaaaacaaaaaaaatgaaaaagcttcatcctaaaagaaacaaaatacacataattaggccaaatggaatgggcctaataacttcatctaaaatgaaaatctgatctcaaaagtgtacagatgggagtaaatgtgtttttaatattttatcttactttcttgcactgcatgatttcagtgtcggttctgtttctatttaattccaaaagggcttcatatttaaggatttcttcaactctgcgacaagaaaaattaagggtagttttgaagagataagctcttcggagactaaagaacattttttcaaagtttatcttctgacagcacattaatatttttattctgaagtctttgtggttttagggtagaccgaacagcattgacaacaacttagtaatgatcctagtaaccacggcacctccctcacctcttagctggtgtgtaattaacagtttaaaaattatcctgagtaggaaatagttgtccagtattattgcctctgcgcaatttgaccagctgccagctgagaaacctttgtggcaaaactttataagcttatctcttggttcatttgggttaatggcggggagaaagaaaggacagtcttcaagttgctgctaattaaaatgattgctatgactcctctctgaggactactctttcagttataaagtgcatgtgtaaatggagcaccccaggcatctgcaaattcagaaaagcaagtcacaaccactgaggctttttttttttttttttaaactaacatacaataggctcagctggaaaataaaatggtgagggaatctgtttacaagagctctttagattttcttgtatgataacctgttttgaggaacattgggaaaatattggttttttttttctttttttttaagggcaattaatggaagttggatttcacatttatgggacaaagttctcacccgccatttaaatttttcacaaagggggctt

SEQ ID NO: 987 - DNA, 1726 bp, Homo sapiens
gaccgtgtgggttgactgtggaatacagagtggttccttgaagagtgagtaggactgagtattagtagcttccacagaggcttgtatcaaggttgaaattaagatgttttgctcatgattagtcacaatcttgaatgttttgggggttacgggaagggttttcgtttcgtttcattttttagcttttcattttcttgctgcttttgtgggaggaagagaaataggaataagaaaagagtggggaactgaagggagatcgtaaggttctcaaggtgaggcaaaaggacgccggagctagaaaaaggacaatcagtgctgattttatgacattccaggttgttaccagtgagctcaaagcatgttagaatatttaaaacttgtgaaaagttaatttactaagtaaaataaaattataatatttaaagtttcttcaaattaattttaagtaaactaaaatagcagtattcaaaacttcgtttcactaaaaaatgaaattgtaatattcaaaacttcttaaagttagttttataaagtaaactgcaatattttaaatttcttaaaacttacttttttgtactttttaaagaggttttaaatattgtaaggcaaagtcaacacaaaacagaccatggcagatagtattggtgcagggaaggatgtaagagatggtaggatggaaagatgctgttagcagggaaatgtctttaaaaaacaaatccagaaatagtaatgccacagatccacaaagactgagtatcactgaactttacatcacagttcaattcagaaaaaatctagcatttgcagcgaaagagaccacgcaccacaggtgcccaataagcccttgtttgcaatttctgaggaatgttacgtgcattgatttgatggcagttttccctgctgacaatcagtgtgcaacctttctgtacattctcagcccaaagagttctcaaattacttagtcataacatgaaaggaagctacatgttttaatagctaaggcccatttacaataaacactttgcacgatgtaatgggtgcttaatatgctcataaagctaacagtgcctggatttaggatggtcgccctcctgtatttctcagataaactcttcatttttaagagtttataaaatgaaatataagcaagaacagcttcataaatgttgcattcaaggccatcgtttaattctggggtttttggatgaccagtcctaaaatgccagtaaatatttcaaatgaccaagaagaaatgcagtgctaagagttttggcactacagtaaactgtccagtgtttaaattttcctgtgtataacttaaaatggctatgcttaacctaagcagatttaagcaaaacttgatttagtatgttatataaatacaatatcaaatcaaaaagtatatagcctcatttaaaaggtaaagtatcttagaaaaagtctcaaacatggacatttccttggctatcaataggtctatactgtgataaacattatagatttaaaattcaacaaactgaacattgtcagtgtgattctggtcacataggccaaatccagccaaatgccaaaatgacactagatttagaatggaaaattttaagatcacatgtgtcaagcagtattaacctgacaaaattccagaagaggaaagaatttggataaactcttaagagttcaccataatgggatgtgactgtgtgtttctagccaagatgatatgtga

SEQ ID NO: 988 - DNA, 1204 bp, Homo sapiens
catgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgc

SEQ ID NO: 989 - DNA, 1533 bp, Homo sapiens
ttagtgttcatgtagcaagcgtatcatcagatgcattcataactttctaaaaaaagaataaaattttatcatacaacataaagtagcaaattacattccagattcataatcagtttgagccttggttgtttgagactaaaccaaagattttggaaggttttacatgtatctctctgtttgtggaaaagttaggttctcgagttcattccatctcatatccaaagtacaagtaaccagtcattaaagccatatgctggctgagggaaggttttgtcccagtcagacattatttatataatcaattcaaagttcttaagtacagaagctacaaagcaaagacaaactggttggccgtttgttgttgttgttgttgttcttcaaaggcaataaagaatgcagatttgcagttagactcagtgtcagactgtgtgctccaaacacggcccaacagcaactcctatcccacattctcttctacaatgtgaacttgccactgctccatcaaaaggtggtattcaattctccttcccttaaatccaagctggccatatggctcctttgtaaccaactgaatgtggtagaagacatgtgtgatttctcagcctagttcagagagattctggctcttatgactcttgtcctgcgggacccactcaatttgtaagaattccaatatcctaagaccacaatgctagaaaggccacctgtaggcattccagggagagtcacagctttgcccagtatctcacagccttccccaccaaggtgccaaacctgtgagcgaaatcatttggaaaatgaccctacagttccagacgttctggttcctagccattcaagttatcttccacaagggctccagacatccatcctcattatgtcctatctgaattcctgacccacagaattcatgagtataataaaatggttattttacacgactaacttttgttgtggttagtttcccagcattagcaactggaatactcttggtaagaatccatctttaccactagttaattgagaccttggtaatcttaacaaaaatccaaagtttcctcaataatatatagggataactttagctaccttgcaagtttattgtgacattgggaataactgaggtgtctggcttgtaataggactgaataaaaggataatagttttgtgatcatgatctaccaagagcattgttaaatgttaggtaatgcatatcaaaatttaaatttgaaattgacaaagtacttcattatgcaattcattatgcaatgcagagattttactacttaaaggggaaaaatcttcaattattgaaaaaagtatcactgggattttctgaatacgtaaccaggaagaaacataacactaacaaacaggcactttcatatatttaatctttatgataaaccatttgaggacattaagttgtatgaggtcacatgattggtaagtggccaagttcaggtcagttagaatccaatgtctcatttattctccaacatactactctactctgatacagaattacattac

SEQ ID NO: 990 - DNA, 1303 bp, Homo sapiens
gggtaaatttaaattagttaaagtggacatagcttgtacccacagaatgaactattttggatacaaagcactgagacagccacctaaattatctttaacctaaagaaaattcctatctcaaagtctcataacacaaaaccaaactcaatgaatgaggcttttttcatttgcatatgagaacactcaattacttgacccaaacgtatgtacacagcagaatctttgcggcgtgtgtggagacagtggaactgtttttcttcccaagttataacagaactgaactatctttctccaccctcccagtcatgatcctgcgaggcaatgcatgtcaaagtgtgcaagcagaataaaacaagaactaaaatctgcccacatgttctaggaagttgctgactaaacttttaatcaaaaaacttcacttcatgaagcatcatagagacctgtgctttcagagaaactcagcaatatatttgtttatctttatctttcctaaggatcagcaagataataactccatggaaggaaaaagctggccagcaatgcatttactgcctttggaaggaggcatttcaggggtgcagcatggtagaagagaggtgattcagtctgctattcttgtcaatgcaggtgaaaagcctaatgctatttgctaggcagaagagaccttatctctgaaatgcccttaataggatatctctggctaaggattactatggtaagtagaacacgggatctctgaggcacagatggcttcctggagaatgtcaatggagctatccaaatctctggggtgtaaaatgaagatatttgcaatgctcccctttgtgtgtggaaacccacaaaccccagtataaacctcatctattctgggccagaggtgcatttctgaggcagtaagaagtgacgtggggggctgcccttcccttctctgcttcacttgagccttctgactgcctgtatccttgagattatttagtaaagcttggtactagttaagaagatctctgagagtttgatttgataatctgatcttgtgtgttagctcactccacaactcatcacccctgaaaggatggaggtaataactaattgggttgcactaaggactgaacacagttttattttatgccatgctttgctgctcctcttgaagctcagccagttggagaaaaacaacattatcaatttgattacttggtgtctcagagtcttcttgcagtcggtctcactagaatactgatacaagctgaatttcctaacaataaatcacagaatcagagaggacgaagaaagattagaagtc

SEQ ID NO: 991 - DNA, 2016 bp, Homo sapiens
gccaaactaattcctttccttagaggccaccaatgtcatttgatttttgtatgattttgcagataaatcttacatacatatacacatgtatgtaaacacacatttcttccatctctttttcaacaaatggcggcaaagtaaacgtgctgttctgtaccttacattttttgcatttactagtttaccgtagtgaccattccacatggaacgtacagtacatgaaatgtttcattgaactttccactgcgcattaaagatcattgtatttgtgtctgtctccctgacaagccttttaatttttgaagggtatacattttgtcttcttttccgtatcctcgcaaagctctgcatcctggactctggtgctatacacaatactcaataaatatttattaaattgctcaatcagaatgatcttcttaaaatgctcttttgcatttgacactctcacccccaggaaaataacattaacttctaattgcccacagcatactttctttctttcttactttcttttttttttttttttttttttgagacagagtctcactctgtcacccaggctggagtgcagtggcgccagcccagctcactgcaacctccgcctcctcggttcaagcaattctccttgcctcagcctcccgagtagctagaattacaggtatgcgccaccacgcccggctaatttttttgtatttttagtagagacagggttttgctatgttgaccaggctggtctcaaactcctgacaccttcacagtcaggcccaactttcctttctagactaatctttactccccagaaacacactctttgttttaaacaagtctcctcactggaactttcccacagttggtatgtatggacctatctacttctctctctgtgtgtatattttattctaatgtcttcccaactagactataatcccctgaaagagaggcaatgtctaatgcctttattcatcccaggacagtacctacaactccgtgattctcattgcatgcttgatgggctcgtaaatatctttctctaggatttcttccctcctttcctttcccttgggcctggcctgccccaggctggatgataattaccccgattgtacatttccttttggcagagacagaatacagtttgtttctctagttcatttttatttttaaatcattctttcctcattcaaatgattctccagccagagaagttataggcagaggcagtgacaaaggtcaaagcacataataagtgtactttctgagagggagttttttttccccattttaacatttttgtcttgaatttcaattacttaaatccaaaatcactgccttttcctatgtctcaaataatggaagctgctttgagattcacatcaaaagccaacatggcactataatggctctccagcgcttgaataaagcccagtagtacttataacagtatcagctcaaaaatgggaagcgttacaatagctaccacttaatgagcactatgtggatgatactattcgaaagctttacacccttcattttatttaatccccacaatcatcctgagataaactctattattcatattttacagatgactcaactaaggctcagggaggtaaggtagcatgatcaaagtgtctatcagaaagtgatagagatggaacttgaacccaggcaatatggctccagaacacatactccaacccctaggcatattttctcccttagcttgtgagagccaatgcctttccggtgtatattgcttgaaatctattatatttgaacccctcaggagcacaggtgtcatcagcctcgtctctgcgtccctattgtttcctcttcccttcacttggttcaaaaagaactgttctgcttttccactaagcctcttcaccatttgactgctactatctggggaagcctctctatctgcactctgtatctagagtgttccttgctgctcgaaatatactccacggtccagcagcatcagcatcaccagggaacttgttagaaatg

SEQ ID NO: 992 - DNA, 1451 bp, Homo sapiens
tattcacagttgtctcttttttctttgtttgccactagtgctctcctcacccctgctgaaaggttatattggcaaccagttgccagaggaaaaatgttggtctcatccaggaggtcaatgagaaatagatcctttcagagcagaaaggagtagaatttatgtctaggattaaaaaagaaaaggctcaaacccacagatcaagttttccttatcctttccacatactttttcttttttcagaaatcatctccaatacagccttagccagtcctgtccaacacaggttggagtttagatggtgtgtttattttctggaagtttatggcttaacttgctacctcatttctttcctatagtgaaaggaagatgaaggatgtgtttctttatgtgctgttaatggtttcttatgcaaaagtgcatgtctctggttttatatttatgatctggaattgcctgctgattacacacatggaaagggcaggcctgcttccaccaggcacctctaatctagccaggtatacttaataccctgttaaccctggaacatggcactcaaggaaaggaaagagaaggttaatgaactagctggatgataaggtaaatttgtactgtaagtgttcatgtgcgatagtagaccccactgaaatttcaacagctgttactaacaagttacaagaggagatttttcagtaggcgtggataaagacaagctgaaggaagtttcttgcacttcagaaagactgtagatttccctgcaagtggataaaaagaagcacaaacccaggagtgaactaatggatcaggagcctggtgcaagagtcatgtgccaacagagatttgaaaacacaagagcatcttgcaagggtgtctctagtacatggcttctcctgctggagtcaccctggagcaaaaaatgagttcagaatatacccaagctgccatttggtatgggttctagcatgccttagggaagagcttattctctggaatataacccaactccctgccattagattgagaacttctttgatagcaagaactatattatcttactcattttggtttcttgatgcctagtgcaatgctaggtccagaaaagctacttgtgagactcagttaagaaactaaaggggatacctgagcaggaacatcttatcaatacagacccagtgtctctcttcttctcttcctcaatcccagatttgcagtggcattaccagctcagattgaggattgtctgtaggccccacatagagctaggcccagagattcaaatgggtgaaagacacacctattgcactctaaggtactttcatttgtgtgggaaagatcaagttgccatgaaacagtagtatgaggcaacagtctggaagcttgggcatggagggatctttatcatgaaatccagtggtctgtaggctccaaaggtcttgacggttcataagtagttg

SEQ ID NO: 993 - DNA, 1756 bp, Homo sapiens
ccagcctgggtgacagagcgagactccccctcaaaaaaaaaaaaaaaaaaaaagaaagaaagaaatatcaactactaaaagacaaagccttcaaattgaaagcaaacaaataattgaatgaagatatcagatacttatttaaccatacagaatgaggagttatggatgattcggataaagaaagctgaccatacattcttagtgggatgcagctaggaacaaaaagaactgtatagaaaatcttgaactttactttgtaggtttattgtttaatattatattgttatttttaaacaattctttttttaaccagattaatcaaataagtaactatatttactgtgttcaaaatcaaaaatttaggaattctgcaccataagagataaatgtaaaataacaatatgaaaaaagaaaaatcacaaaccttttctagctctgttcattgaaatgagccaagagcagtgatacccatacagtgcccccttagcattcagattctggtctctgatactattctttcactgaaaggaaccatgactccttcaaacatgagtgattccatgtctggggcagaaaggtacaaggggagcggggaaaatatgattgtaccagaaagcaacaaaactttcaatgagtagtgggtcatgttataaggaatggagcaaaagtttttaaagtcttccacattaaaaagaaaataattactataggtgactgaaatatagtaagtctatgaaaaaccatgctcccataatgatacacaaaaagaaaccataagaaatgatttcaaaagtaggtgaatagaacagaatggccgggcacggtggctcatgcctacataatcccagcactttgggaggccgaggcaggcagatcacccaaggtcaggagttcaagaccagcctggccaacatggtgaaaccccatctctactaaaaacataaaaactagctgggcgtggtggtaaacgcctgtaatcccagctactcgggaggctgaggcaggagaattgcttgaacccaggagacggaggttgcagagagtcgacacagtgccactgcactccagcctcggtgacagagtgagactctgtctcaaaacaaaaacaaacaaacaaaaacagaacagaatgcatttctatggagttttatttctcattcatgaggcattattgattaatttattgtatcaatagagaatatagaaactagtaaatacatcagttgaagggcaatttctgatgccaggggaatatcagaatggccaataaactgcgatctcaagtcagacaaagcaaaatgaaatatctggaattcaattgtatataaatgtaagtattcttaagatatgtatggccctaagaatatgaatcaatgggaaaagtattaacatatctcaagaacccatcaacttccaagttctttagagtgtggagaaatacaatacaatatcgtaagattttatcaactcggatggaaactacagacttattatgtaatgtaataacattatcccagggaaatgggctaagtcactgatcacttacctcttgaggttatggaatcactcttaaaacaacataaatggggttcaggatgtcctatcagggtcatggatgagaatccagttggcctccatgcctaagcctttggcagcaaatatcctcattgatttggtatgataattcttccctaggtggaataatataaaattaggtatagagatgtttaaaagaagtaaattattgtatttatat

SEQ ID NO: 994 - DNA, 2262 bp, Homo sapiens
ttatgtatcatttattatgatgctgcagcctgcttaaaatcaggatagcaaaaggttgttgccacagggtaaaaaggggaagaagtgggggagggtagtgtgttctatttcagagatagagacaatgactccattgttggttattttgagtttaaagagccattagtgataggttaatgtgcagcagccatttgtatatataagcctggctctcaagatgaaaggtgtctgcatatggatggtaactgaaaccacaagaatacatttaataatctagagaacacaagcagaatacaagacaactactgaggctggaaactgggggtggggaggacatcaaacatttcagaaaagacgagggaagtgtaaaaattaaaagaaaaatagtgatggtgtagaacagagaaaaagcagtgttgtgaaagcccacagaagagatggtttcaatgaaaaagttgaccaacctggtcaagtgctgtagaaaggagaaataaggtaaggactgaagggagaaatggattttagttggcagtcactagcgacattagcaggaggagttcatggatggcaatgtgggcagaagatagaatgcggagggctgaataattaagaattagatgagaaaataaaagcaaaggtgaagctgaataatttaaaaataggcgagaaaatgaagaaagctcttgcctatcaaaggaaagagacagtctgaaagagaaacttaggagggactttttaggatgagaagtcttgaaatgatctgtatgccagtggaaaaaaggtagtagtccaggaggtagtgaaggtacaggacaaaggataattgatgtatctaggtccccatggctttgggaagagataaaataaatggaaaaagaagaggaacttttcttttgggagatggttgttgaactgaatggcttttaaggcccttcacaatactgatgcaatttcataaaggatggaaaaatcctacagttattgtagtgagttctggaaaactagacagaggatgtactccagtggtatcaggctggcaatacatggcacaaaacaatgttacaaggctccagtgtacttcagacaactaccaataacccctgtgcctgatgctaaacccagacttttttcaacaaataactgtctcttttcctttcttgtctggcttcttttaaatgctaagtttgaaatgtgatacctttgcatgaaagcggcatgcagtctacatgtcagttgataagagtatactggaaatatttcactttaataatgtggataggatccttctgcctctccccttctcccctggcccccacaccttgttcttaatatctctggattccatctcttccctaaaatacctttaggatttctcctatgtgcataacaaataacagcattatttacattttagcacttcttctaagacgtttccaggtgctagatacaagctgtagaagagcttgcattttttcctttagatctaaatagtctgaatctcagtattgctcatgggaaactgtttcaaaggctgaagtgtcagaagcagaaaggaaagaaatgagtgggtgggaagttctacatgcaaacctgtcacactcttctttcattttcagacctgaatatgcatggatgcagaaattatagcttattccaaagtttttattgtcagcatcaaatttaacaaaaaaacgtcaagaatatcagattggtatatttaggtgaaaatgttcaacagacttcatctttaacacaaatagtcctatccgttaataagccctttaattccctttgaatacacttcaagagagggctccaggcaaagtacacagtaaaatctcatttattccaatttcgctactttgaaatttacaataatttaaaaacagaatagggaagaaacttgattttgtttagagatccctttatacgtatagaacaaaataatgacactgagaaagaaactttaaaaatacttgcaagtcaaattataaagatgatgcatgcataagaatgtttaccataacattattttgtaacagcaacaaagaaaaaaatgcatcagcagaggactggatgagcagattatggtacatacatacaacagaatgttattcatcttttaaaacaataatgtggatgtacatttattgacatagaaatacatgcacaagatgtgcgtaaaaaagcaagttacagaacaggtcatataaagttatctcatttacatacaatcaagtagatatatgtgtatatatacac

SEQ ID NO: 995 - DNA, 1991 bp, Homo sapiens
aacaaatggattaaagctaacaatcaaatgagggctaagtacccagagaagccctcatggaggagaagccttagttgtccttgaaggatgccacttattccctccagcacacatttatcacttttttttttttgagactgagtcttgctctgttgccaggctagagtgcagtggcatgatctcggctcactgcaacctctgagtccctggttcaagcgattctcctgcctcagcctccccagtagctgggattacaggcatgtgccaccacacccagctaatttttgtatttttagtagagacagggtttcaccatgttggccaggctggtcttgatctcctgacctcatgatccacgcacctaagcctgccaaagcactgggattatcacatgtttatcacatagtactgggcactatgccaggtgcatacctcaggtacaacacctcgcctgcagtctcatgtcctatgtgagggcgtggttggtattcacacttgcagatatggttcttgcccaaattcacacagaaacaaagtggcagtccagaaatttgaatccagacagtctcactccacaactcaacacctttatcacatagttttgccaaattcaggggtaactgatgcaatatccaacatgtatcttctattagagccgttcttgagccctgcatgttagctctgagacacatccatgtggagcagccatacaattccatactgaatattttattctcgcctcattctttttctttttctttttcttttttttttttttttttttttttgagacagggtctcactctgtcacccaggctggagtgctgtggcacaattcacagctcactgcagcctcaacctccccaggctcaggcaatcctctcaccctcagcctcctgagtagctgggactacaggtgcacaccaccatgcccggctaattttttttgttgtgttgttgagatggggtttcaccatgttgctcaggctggtctcaaactcctaggctcaagcagtctgcccatctcagcctcccaaagtgctgagattacatgtgtgagctgctgcacctggcctcatttcattttttttttttttaaccgaagagagtaaatgactgaagggaccattttccacatttattgtaccaatcttgggtggaggtaacttggtgtctaatgatgatggaggccagtggagaaagaaccttgccaaccctccactaatgtttgtcatccagtggggtcagacaggaaggaagtagattgtaacaggaacacaagaggtaaggccaaacattccagtgcctgcctgttaccaggtagatgaaaccatgaaaagggaataacaccaagatcttgcctttataaatctcgcaataaccaacaccatcttttcacatgtcttatgtttaatctgggaatgtcagtagatctggttctagttaaatttatgctttgtggtaattacaatttcacttgtttgtacctataaatagagaggaattacttacttacaagattctgggcagggattattatgatgttgataagactatgttagcatgtgcttagaaattctcaaaaatggaagacacatatagaccctagattgaacagtagttaatatttattgcacagttactgagcaccagacactgtgctaattgctttccatgcactatctcagtcgatactctcaacaaggctgtgaagaaagggctattagttttttccattttaaggatgaggaaattgagacttatcaggaataactaatttatctgaggtcacacagttggtaagtgaaagagacagaatttaatcctggcaacttagcattggagcccttgctttgagccactttgccattctgtctcaatttaaacccatgatatcaagctcaaaggaaatgacttttcagggattcaaaatatatgtaacaaacagaaagaacaagatattaactcgaaaacattgtgcagaccaaaaa

SEQ ID NO: 996 - DNA, 2360 bp, Homo sapiens
cactcccagctacttgggaggctgagatgggaggatcacttgagctcaggagtttgagactagcctgggcaacacagcaagaccccattcctataaaatatatacatatatatattttgagacagagtttcattctgttacccaggctagagtgctgtggtgcaatctccgctcactgcagccttgacctccaaagctcaagggatcctcccacctcaccctccttagtagctggaacttcaggcttgtactatcacacttggctaatttattttttatttttatcttttgtagaggcagaagtctcactatgttgctcagactggtcttgaactcctgggctcaagtgatcttcccacctcaatctctcaaagtgttaagattacaagaaaaaagataatggttgaaagccttccattattggaaactaagcttttcctcctcagcattgtcagttcctgatctcccacccttctttcacttaagcttaactttacgtgtctctgagcaagaattccatgtctaaagctattacagaaatatacccattgtttctaaatatcatttaaaaaattctaaatgtataatctagacaaaatgtttgactaagagcacgcagttgccatggtattcaagacagcatctacagcacacaaacacatgcctaatatagttgtttcgaattacaatagaaagctgcaggcagtgaattcaggtagggtgaggcgatgaaaaaaatagaacatacttcatgattttttcactgttttcaaaaccatcatttccaactgctgccaatatcataactgccatcatctatagtcacaggactggcatttgcttctgtttattgggagcatctggggcctgtgtcactgttagctataaatagatgatcctcaaaactacttattgactacttatgtagagcaaatgctcggtcactaaacatgcaagtattatcttgtcggggtacagaagggaatgtcacagcttggctgagagagaaggactttatttcatttattttatttgtgggtttttttgttgttgttgttacttttcgttttatttatttatttgtttatttattttttgtgacagggtcttgctctattgcccacactggaatgcagtggtgcaatcatagctcactgcagcctccatctcccaggctcaagcaacccccccacctcagcctcctgagtagctgggaccacaggtacatgccaccagcctgggctaattattattattttttgtcttgaactcctgggcatcatgcctggccacaactgattctgaatcacggaaaaaataacataaaatagggcttggagcagtggctcatgtctgtaatcccagcactttgggaggccgaggcaggaggctctcttgagcccaggagttcgaaaccagcatggacaacatagtgagattctgcctctatcaaaaacacaaaaattagctgggtgtggtggtgcacgcctgcagtcccagctacttgtgcggctgagatgagaggatcccttcagttttggaggttgaggctgctgtgagctgtaatagcaccactgcactccagcctgggtgacaggatgagatcctgtctcaaaaaaaaaaaaaaaaaaaaattagcatcagctgtaagagaggaactttacacaaagaggagcccctggctttcagaaggtgtcctggcagcaacagctgggctctgtttccctgctcttagacatagatgatctcacagaagcaaactctgacaaggttatcctgagaccataacagaatgagagataacaagcctatttcgtaagtttgtttaagcacttacaaaagcaaggccactgtacgacccacaaaataccagactttttctcctctcttgttaaatgactgactgcagccggaaaggtgcctgtggtcccagctactcaggaggctgagatgggaggattgcttgagcctaggactttgaggccacagtgagttatgatcacaccactgcacagcagcctgggtgacagagcaagaccctgactctaaaaataataacaataaaataaaataaataaaaatgagtgactgccgcttctatacccaatcatagaattgtcccctctttctgacagttacctaatttagggcaagtcaccatgaccttaggccttcctccaaaatcattcagctagcttcttccaaccagattctttctaacaccctcttactgacacaacccacaattctatatggtgtgtgttcttgatgcaatgagcaataatccaacatctttaactacaggtgtgttcctggtggtctttggctggagggaactacctcctcatagcatgtaatag

SEQ ID NO: 997 - DNA, 1620 bp, Homo sapiens
tttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaa

SEQ ID NO: 998 - DNA, 1745 bp, Homo sapiens
ggagcacctgggtggtagggatatagaaatagagacagttaaaaaggtaatacaacctccatattcatttgacatgcagtaaccaaagacaagtgtgtcccaaagtacttttccaggcttgaggtagccccttaaaaatgactgaatttcaagctacgtgtgatggctcacgcctgtaatcactttgggaggctgaagtaggagaatcacttgagctcaggagtttgagaccagcctgggcaacacggcaaaaacccatctctataaaaaatacaaaacttagctgggtgtggtggcatctacctatggccccagctactcaggaggctgaggtggaaggatggcttgaacccaggaggtcaagactacagtgagccaaaatggcaccactgcactccagcctaggtgacagagtgagaccctatctcaaaaaaaaaaaaaaaaaaaaagattggtgctaaattcacattgattaactactaatcgcaatattaataataacatttatgcagtacttactatgtactatgctttacttatatttattcattaaatcctcacaacaatcctagggctataggtactactaacatctccattttactgacaaggaaactgaaggaaagacagttaagcaattcgccaaggatatacagctggaatttgaaccttttcctttactatgttgtactgactctcgaagatcacaggaaaaaaacatgaaaataattctttcaagctgggcctacatggcactgaaaagctgtttaaagagtcatagaatgccactgattcctccactcaacagtcaaggaatgtttactgagcatatccactctgccaggtgctagttgtttaccatcatttctgtttaatcttgcattaaaccctgtccctgatcatggagtagacagagtgctgtgtaggcctatacaatggaacatctgtgtcagtacatccttccatgagttcccttggcagttggtttcacgtaatatcactttttctaaaatgcactaacacaatatcctatccccacctccagcccccaccaacctacccagcattcttgagagtatatgagctctgggtcgggcatgcttgtctaattccttgacttgttacaagatgattggaagagtatcgggacaaaacttaatgaacagaaaatcacatataatatagaatcaatcagcaaataacagtagtaatagcaagctacacctccttatgtcatcaaaagctaaatactccttcaattatagccattctgttaacctacacttgggaacattatgataaggcctagagaatcattccttcctgaccaaagattattcctttcatatgaatggaaaattggatccatacacttcagtctgtctttccctgaatattggattaaacactgccagcttctgcatcattggaaatctccattctttgaaggcctttactgggtttacaatggctgaaggtaaggaggtcttcttggttgggttgcatcctttctaatgcagccatataactccatgtggttcttccagccattcattcacccaataattactgagaacctggcagaatctgtgctggtgctagtgatctctacccttgaggagcttacagactattgggaaatatagaaattaaacaatataaataagtatagaatgtagtcattcattgttttcagtagttccaggagccacagaaaatcctatcattgtaactgtcacatctct

SEQ ID NO: 999 - DNA, 1457 bp, Homo sapiens
cagaattcttcctacttttacagttggaaattaccatttaaagcactacaccacaaaaaaatataatgcttctctttggctaatgttggaaattgtgaacaagtagtaaatttgaataatgttgattaaaagtgggggcaagagcaaaatataagcctgtttctggttacacagaaagtctaagaccctgcttcttgattctcgtcatttctaataatttcacagagacttggcagctacagcacagattctgaaatgtaatatcaattacctgaagaatgaaatactagtggtgtttgcctctagcacttacttgagattgattagcaattgggaatataatggagatgggcagacttccaagcctgaggatcaccttaagcctcttccaaatatttagatgctcagggtgattatccactctcaattacaggcaatgtgacatgagcagaattttcaggggctgtttctgccattagtttctttcagttaaacaactaacaaaagtagtaaaattatatttataaatctatccattcatttttaaaagaaaataatgtctctattttcaagagaataatgtctctttaaaagcaacgagaatggaaggaacaacagatttccaaaactgtactattattgcaaaataattcttcaaaaatatgtggcatttgtacatgtccaagtattaaaagacaatgggctctggaactgtgttttctagaatagccctagaatggtagggacagggaatccttctggagaaaatatatttacattcctagttaacttcagataaatatggtagctttttctagtgacatttagagatatcactcatagagacatttgcttgtatttcagcaattgctctttctctggaagggaggtttgacaggtttggataaatttgtcagtagtccctgtagaagatcagagtctagtaaacatggcgttccatttgtgtgacctacccccacagtgtgtgtgtttaccactagtttttcattatccattcacactgcaggaattgggactcagggaactagcattacaatgctactctggttgctgcatttgctctaagtgataaactgtctttgtctctgactcagaggcctccagttttacacatatatacatagcttgtgaaaagctgacttacttgcttacccaaagtataaaattttggaccattacactacgtgactgtatttttgaaaatttcattttctgattaaaagcataatacatatccatatgttcactgaagaaaatttgaaaaactaaaaatatataaacataaataacacatgactcaaaattttaccatcagaggcaatctagcattttggctgtttttgtccttgcttgttttgctttattttgtctatgcatgtgtatatacacttaaagatattgagaactttgaaacagctgaaattttatggtctggg

SEQ ID NO: 1000 - DNA, 1883 bp, Homo sapiens
gaactacgggtgcaccccaacacatcaggctaatttttttttttttttgaagaaatgggatgtcactatgttgaccaggctggttttgaactcctgggctcacgccatcctcccactttggcctacccaagtgctggtattaacaggtgtgagccaccatgcctggcccatcattcttattaaaaagaaaattacttaagccaggtggcatgcctgtaatcccagcctctcagaaggctgaggcaggaggctgaggtgggagcactgcatgagcccaggagtttgaggccagccagggcaagacagccagatcccacctctttacaaaaatcacatctttaaaattaaaaaaagcagaaaattacttgaacagagacaagagggaatccataatttgccccttgcaaaataactttatttccaacatcaagataaaactgctcttacagtgacagtctcttctaaatatacagctttgaagatgacaaaatttatctcattcacatcagaatacaacagcactgtatgaaaagaacactttggatgtttcccagatcttccacttaacagttcaagttattcaacctctgaactgtgccttaccctcaatataatggaaataaagcctcccttatacagttgtgattaaggatcaattgatatgtaaaagtaggaatttaagaaataacagggccgggcacagtggctcatgcctgtaatcccaacacttcgggaggtggaggcaggaggactactcaagcccaggagttcaggaccaggctgggcatactgagacacggtctctacaaaaaatatagaaattagcccagtgtggtggtgaaccattgtactcccaactactggggaggccgaggagggaagatggcttcagcccaggaggtagaacctgtgataagccatgcactccagcctggatgagagagtaagaccctgtctccaaaaaataaaaataaaaataaaaaaagaaataataggtcttatccacttctcttaaaaagaagctgattttcggtatgatttaaatatattctacacaacaaatacattcaataaataaaggcaggtaactcttgctgatactatcctttcaggacttaaaaaataataataatcctcatatcatctgtactttatccaatgacaatctcatctcagatcacaagttcctgtcctactttaaactttcagtaataaaacatttccctttctaaaaaatcaccttcagttctaaatccaagttcaaaatctcctgacaataccatccctctaacttacacaaatactcattacagctttaagcaaattaaaaaaatttattggctacaaaaccagtcaggcaaattaagagcctatgctgtagttatctcaatatttggcaggatatgtagactgaatcccagctggctggcaagaaaagtgtgccaagccgaaatataagtctttgcacactttattctagagtccagattaaaaacctgtagcagaacaaagatgagaaatggaagtagccttgcataaaaggcaagagaagccttctttttgcctctactaccgacggcattgattcaaaccattaaggaatacctggagatctcttagaagggtggacctttagctcctgctaacagtcatttttaattggcacacctggctgagaactgactggctttaatagcaactgcaatcagaaatttctgttttcaaaattaaagattagatacagaagtatttgcagatagaaacagaaatcttaaactagctttaaaatccagggagtaaaggatgggaagtggagagagtagcgtgcaaaacagatgcaacaagatctgccagatacaactattggaggtggacaatcaagt

SEQ ID NO: 1001 - DNA, 1677 bp, Homo sapiens
catggttttaaatgagagaacaatggtgctgatgacacagaagagtttattaaatctacttcagtgttacaattttatatcctttattaaatatggcaacatccaatgtctagtaatttctactgcaaacactaattggacagaggttcaatttacaaataagtaaaattaggtatctccacaaatggcttcttatagattatatttggtaatctttatgaaagggaaagaaaagggcatctcagcagcagaaaataaataaatgatagtcatctcctctcttcaacaccagtcttattactattattttttgtggctcctatagagtttttcttcctctttaccaggcttacttaccctttcttatcccttcccacacactttttcccaacctggctataaacacctacaattaaatacaaacagattcattcaaatataaattaacttattcacacacagagcatatatacacagttttatatccactcattttattaataccatgttgaggtggaagagtgaaatttgaattagtaaaagaactggattttggcagagcctgagagtggagagattcttacataagagaaatagtaatgccaaggccaagaggattatagggtaagtttagaaaccagaagcccagatgggatttatttttagttgaaaaggtaacttaaactgaagagtcatgcagaatgttaacacactatgttaatggaacttgaattagaaagaaaggcagaatcctttgctcagattagtgaatgaaaaccaaactacaggatgcgacattcagctattaagaaaagaaaaataacagactgcagctgttctcaagtccctgaatatcaaggcattgtttccagagacaggctttctgcctgttctcacagatgattcttaaaatataattcaaaaagagaaaatcaataaccatggtgatgagggattaattagacctcaaactgacattataaatagaggcaaatctttgttctatcatatgcaactttttctgcaatacagaatatcataatacagtgaaaaaagccaaaatatatttatcagtgaaaatctatcatttagggttcattcagcgaacttatgaacactgtgctgaactgataagcagtaatcgttttccctttcttttaatatactgttgccaattttagctggttgcttagaaacattaagtaaaacactagaagccaatgtaagaagaataagggctgtggtaggggttggcagtatattcaaaaatgtaaagatcagaatataactatgtgtaagggtgtgagattatcagccaaattttgctagctcactgttttcacagacgtcacaactctcgttggaaacttggaaaatgcagctttctacaactacacccgacaaaacaaagactgacattttgaattggccacatgattaggggattgataactgttcctggctagccagcacagatggcaacagcagtattggaggtaaagaagagtctatgaagattggaggttcagtaggaagaacctgggcttcccttccttatccctctgccactagagaggaaatagtgatataaaaaagtttgctgctggttacacgctcttgcaaaatgctgtgccttgagtttcaatataaataatttttaattaaataagtaataag

SEQ ID NO: 1002 - DNA, 2337 bp, Homo sapiens
aaggcagtggtttgggagacttcggttttcactctgaatttttcagtgtgtgaactcaattaccacttgggatcaggctagagatttagtgataataggaagcattttccccccagctaccccattgctccagtctgaggctggttttcctacatcctccttataatgactattcaagactggaaccagagcaaacagacaaaacggtaccgacttgcagactaattaattaaaggcctagataaattacaatgttatttattgctcaattatagtaattattttatccatgtttttggtgtaattatctcctctttctttgtattgtttctgattcctcctttaactatccactctactcatgtgttgatgtttttctttgtcactgagtatcctttgggggaagtaagcaagatagtaaattaccaataaatgctgacccacagaacaccaacgctgaaagtgcctcagtggctcattttgtgttgcagatgagtaaaatgagttctgagaagcaaaagaacttgccggaggagaatgagacctggaatggggactttcaggatacagcttatattgagatgctatgacaacttaatattgatgaagtatgcgttttatttttacccatagtaagtgtctcataaacaacatctgtgaaaggataccaagaaatcaatccctttaatccatgtaaaatgacttatccttaaggtctgaatctctgatggttatttttctgttacaggtttggctgcctcccttcaagacctatgaacatttgtggaagtgaatcacagataagtagagctttccttctcttctcctattcagaatcaattttcacgtctaaatttagagaaatgacaggaagcacatggcagttccctctggatttctttctctgaagaggcagaatggaacagaggaaagacactgggctctggggaagggggcctgagggttcaccctggctctacctgcatctgaccttggacaagttatccaacccaacttggtgcctcggtttattcatctgaaaacaaggcccgtgctagtggccaccttgtatggctgttgttagggctgaatgagagcactcatggaacagcacaggctgtagcacacacagagtgagaggccgacgcacagcactcataaaagccattcagaggacctttcaggaatgtgacatactgcggttctttatttctagaagtcaagggtaaatttgatttgcaaccactccagctgagaaaacaggttgaagactatgttcgttcaaagaatttgaggtgaatgttgaaaagctccatgaaattgggacctccagtgttaatttgaaggaaatgatggccatgttataattatttctgctgttggtgtgctgctcatccttacaataactcatttagtcctctcaacaatcctatcaagttgctactgatatcctcattttataaatgaagaaactaaagttcagagagttgaggtgcatagcttagagacagccagcaaggtcaggggaagccacagttagagctcagctcttctgatcattctctctgcagtgtggtgccgagaagatgctctggttcttcaaattcagtgtcctgcctcccgtccaccctacaaactggctccataaaaatggaaactccagaaataagggatacattttttactcctcaacaagaaataggattcctcttctgctgtccagagagagggaacccaggagctcacatttgcactgtggagtaatcaatcaggagtgggctttgaaggaggagcacagtcactccctgtactctaccccataaggcggtaacactcagtactgcctctttgcgaataggttacggtttgaatggaaatgagaaagagagggattcagtaccccaaagccaaattatcacttactttcccacatttccttttattattagttgaggccactttggtagctacacttatattttgtatgaatgagtgaatgaatgaatgtatatatgtggatgtatatgcatatatatgtaccttttttagtattgtctcatataatcagtattaaaatttataaattgtaaaaatgcaagaagcagcagaaaaaaaattacctgtcagctcaatactctttcaaacttaggtcaggttaatattataatttaaaaaggaaaggaactagtatttattgtctttagtcgctattaaaccacaaagagatattaggtctgtgaacctcagtcaatccctcaagcagtgtggaagctagatgacatcctgtttttacaggtaaggctgggagttgaactctgactttaacatccacagtct

SEQ ID NO: 1003 - DNA, 1675 bp, Homo sapiens
cctcacatggacggtaatcattatgggaacaattggaaatggccagtctcgccaacggtgctttccagcgcacgccacagttgagggactagctacaattactgcatatttacacaactgtatttgcacaacaataaaactcatcttatccgatccaaacaaaaccttgctcaaaataaaccaaaccataggagaaggtctcctcagtagaagcaataatcgtgctgtagcttctctggcctctgcctttgctttcaccaactgcaacaagccttcattctctcttcctcagtaaagctaaggcaaaaattcggtacatccaggtgagaatactgtgcgtacggccagataataatactgtgataaggagtggaaaaagaggggctgtatcttagaaatcattctaaaagtaattatggaagaaatgataggatgttcaggatttatttaaagtaatctgaggaaaggaagaagcacagaggggatagagcgaccaggggtggataattattgaaactgggtgatttgcatgcatggttaaatatggtattcttcccactttgtatacatatttgaaattttccataataaaatgggaaaaaagaaaaatctgatcaatgtaaaaaaaaaagtcatccttcgaaaataaaacttttttttctttaaaaaacaacaaaaaaaattctcagctttttcttggtttcatgaaaagaggcaagttcctggtaagaaaatcaagctctgttcttgttcttaagaacatttccttttttccttagttatacagaaccagttctactgctaatattaatccttgaaaagacaaataaaaaactgtagaaatctaaatctgagccttcagaagcctggtttttgcatatcagacttattccaatgacacaaatccagatttctcccctatgaaggtgctttggatgacatttctgttgcggctgccaaataaattccagaggtttcaggatcatttgtcaacaccaaagacaatattaccaagaactggtcctttcttcccagaggtcactcctctgatccatgggtttattacctagagcaacaattaatcttgctgccttcaaaatacaaaatatttttagccaagatagtgtctattcatgatccatatctctgaccaggcatccttgccaggaggcggaacagaaggtccactggctggacatcaagggacctgtccctatccaggatctgtcgttaacctagccttagttcaactgcagagtaagattcttccctccctggccttcggctactttacttcaaaatgggatttcaccagatgatttctaatatctttcccctctcaaaaattccatgattataagaatctctaattcctcaaaaggtaatatttttaaaaacagctttagtcccaaaatgttacattttctattacataatttttaatgtgaatatgaatattgtatgtgggcaagtttttgtatcctgtgcatatatatgtatatataagtatgtatatgtatgtatttgtatcactacttatacatacacacaaacacacacacactgataccattaggtgcttatatgggactaattgcttccaactcaaagcagcaaattttcaattctgcaacagatgtcgctgtgtgatttctcctttctgtgctggattttc

SEQ ID NO: 1004 - DNA, 1077 bp, Homo sapiens
ttaatgggcccctaggttgattccacgtctttgctattgtgaacagcgctgccatgaatgtctgtagagctgaactattttgtgtagaagatatgcatactgggaattaaaagaatgcaaggaactgtgctgcagctgggaaagtctcactgcacttggataagggattatggtgaacattcctgaattaactgttaagaggtccatgtcctttatcatcaccaaactcacctttatttttgtgggatttacatggaaaaattagattagtcaagaggttgaattagccctcaccattagagattagacatgatcccccattacctataaactcacctgtatccattcctgtcttcattaactttctcccagccttggagagcaacgagtgctttcttaacctttttgtgctttccacacaccgttaggttaaaagactcgaatgtgtctataacaccagcaaataagtataggggaatgactttattagaaaagcaatgcctcggtgtgtataaaaaaaatctccaatgatcatctctccattgccttccattagcatgatgttactgtttgagtattcactgccctaactacattcttttacatactcttgcaaagctctagcacctttaaggaaatacatgatccttcttttgcgctaggttgacactatgcttggtctgtcacttcttatttacaggatgttggacagagttgctgatgtaaaaaccacagccttccaaaccttttcattcagcattgtgcctggcagatgttggcaactgtaatatgcataattgtatctcatacacagatcacagtctggtggcacactggtttgcaaggcggagacgaaccctccctccttcagtgcaggctaatgcatagattgtgtccttgcccagttccctcctgatttcttcgggacttcattttatcttgcttttctctccctttattttcaacccatacacctctcgctttggcttgagactcttaccttcaccctgtcctcactcagtcccagatacctgtgaatctcttttccttttactaatttgaagaaaggtcacggac

SEQ ID NO: 1005 - DNA, 1397 bp, Homo sapiens
atgcgtggtccatacccactggtggagtgaaggagctgttaaaagaaaaacttcagccaaattaaatttaaaggagtttagctgagcaatgaatgattcgcaaatgcggcagcacccagaatcacagcagattcagagactccagcgcagccatgtggtggaagaagatttatagaccaaaaaaaagggaagtgacgtacagacatcggaagtgaggtacagaaacagctggattggttacagctccgtgtttgccttatttgaacacttgaacactggacaatggatgaatggttgaagtatggctgctgggattggccaagacccagctattgttacaggtgcatagtcctaagttagggtttcaatcttgtctatccattaagttgggttgcagtccgtccacaaggactcacatgcagaaatatggagtccttctcaggccatatttagttcgctttaacagagctttcatgaatcaaagcacagaaacacttggcgttttatttacagaactctggaatagattttggagacgtttcttccagaatggcactccgggaaaaactgaaatgtaaaacttttgactggtacctgaaaaatgtttatccactcttgaagccactccacaccatcgtgggctatggaagagtatgtattatgaaattgcactttggattttaaatgtttgactgtgaaagacaatgcggcctgaatctcgtgattgcctgtcctgcccaagacgcccttcctacctcagctttctactcagctcttcgccctcaaccctctcagtttccttttgtcccttgctccccgatccccatctcttttccttctctctgcttctactccccttgaaaactatagctcttgcctggactcccccccgccccgcccccgtttctccagcagctgcagcgattggccttgtccgcctgaactccgcagaggcgcccctccctgtgtgtgtggtgatgggctgaggtgatgggtgtttcccggatgtgggcagcgcagcagcgcctcccttcggcgctggtctgtttcccagtgcttagaaaatgcctgccgggatcccagccctctgctccttgtggctggtcgttcctggtgtcctcggtgtgttggggaaaatgtaggccctgggagggatggcgcctcattctctgtcctttctaacagtgttgccgtgtgttttgtccccttcagatgaaaaacctattggatgaaaatgtctgcttggatcagggacccgttccaggcaacacccccatcatgtattactgccatgaattcagctcacaggtatcttccacaatcttcctggccctgcctgggcaagtctgtcgtggctcagcccctggtaaccattgctgggtctggactccgtgata

SEQ ID NO: 1006 - DNA, 1671 bp, Homo sapiens
tatttaattcttgcagctagccagtaaattttcagatgatcaaacatttcttctagggttaattattattacttacttcaagaaaaagtgctgtgtaggagaataatgtcaacctatataagaatctattatcagcatggcacatgtatacatatgtaactaacctgcacattgtgcacatgtaccctaaaacttaaagtataataataataaattttaaaaaaatctattatctacagtttagtttgaaattttatttaatattttatcttacctcgttgaagaaacaacctaactactaatgttttcttttaaggtaagtagcagggtttggggcattgtgtcacctattgtataagttaaattttccaaagaaaagggatgcaaaaagtgttatcacagatattcatccttgtatttaactaaggatattacgttacaaaggcatcagtattttattgtactgaatttctttgacataagcacctaagattcatgaagcatattctatttggtcacttttgttaaagtactttctgcaaagcaaatttaatatccaacaccatttatctcattagtataaatagtataaatatttgttttcaaattctttaagaaggtactctaaacacaatcatttgaaaaaatatatagattgaatatctctaaaagcaagggtattcatatgtcaccatttttctaggacaatcctggatataaacctgttgcctagtctatatactcatgttatctttatcaaaaatgtcctgggttgggtagaaaattatatggcaaccctagtaatagccaaagagcaatgagaactcaaaggtttcacaatttctgttctttggttccttcactgactcaaatatgcagattgaattaaataccctttcaagatatttatgtaattataaaattctgtgattcttcattctaatcaaagtgtaactggatcattcagctaacactaatttagaaaatctgacttagttttcagactgaacttgtaacattgtcttaaaactcattgaaaagggaaggcatataacttttatttaatataagctagtatttaaaatacatacacattttttaaatttgtgaatccttaaaaggatttttgcattgcctcaaagtgggatttaagagaaaaatcccacattatcaaaataaagccatgaaagcaattatttgtaggattagatgaactcctttttggaataagaaattaacaaaaggaaagagattcaaaaagacaaaatggtatcctgcaagaaaaaggtacatttcattagtattaatttgttaaaacttgatgctttccataataaattaccacaactctcaatccagtattaagaaggagaaatactaaagttgtacttttacgtagtaaagctctacagaaggaattacaataaaacctgtagattacatatttatatgttcacatacaatattgttcataaacattctctatgttttctgcatagtggtccaaactcttttttttttttttttttttttgtaaagagctgtttctacagtgctgactttaattaacgattttagaatgtgtatctatcttctttattaaaaaaaaaacagagctactaagctatttcctttattgggtcacctttaggacttattatttgaagtact

SEQ ID NO: 1007 - DNA, 1692 bp, Homo sapiens
tgacacctaatatcaaaacattcttttaatttttaccataagtctcttttccagtcaaaacactacaaaagttattaaaatatttaaattgcctgattttggcattggcttttcccccattttttgggtgtgtttccacttagtgccttcactattagttacataaaatgagaataatatctgccaaatttcattatggtataggggaggaaaagacttctttttctcacccttcactaggttcatacctgatgcccctataacaagagacagattaacaagagaaaagcagacacatttatttaatatgtcttatgtgacacaagagccttcagaaatgaagacccaaagaaacaggtaaacttggatccgtttatactgagtttgatgaagtggataggcattgagaagtatgaatggattttttaaaagtataatttaacagtaattaactctgggtaacttagaaaaccttatttgttcagattctttcctgtgtccttgtgtcttctgagataaggatgttcttttcctccataggaagggcacctctgagttagggtcttacgaccttgccttagggaagaggtgtgaagggaaagtaagagtgatcttattacttctgctactttcccaaatgccaagggtgccatatactggggtactatgtcctgaacctcatcactagcgttgtagtgggaaccaaacaaatatgcaaatgagataaatatgcatatgagagaaattttcaaaacacaggaaaattacactcatttatactgtaatttattattcaaacatactaatgaccccaaaaaggagcaatagaatgaagcaagagatataagtaattgagaaattattcaattatgtctcactttgtttggaaataaccttataaagaaactgaaatataacattgtccagcgaacttatggattagaaaaatgagcttcatcctggctcaaaattatgaatcaggctatttaaatattcattcaattatttggagggcaggtgtgaagcctttattctgtggcttcccataaaatatagaagctgatatggtagggcttcttatttcatatgggagttaatatgaaatttagattacttccagaaaaatcataccctatgcatctttgaaggaaataatagaggcttaaaatcatgaacttttttgtttgccaatggaaactaaccttgggctgaggaaaacattcgttgtgtttatacatcaccataaaaggctaccaattttttaaaaatcaggtaaaaaaattacttagcattgtttaaaacaaaaacaaacacaattagtttgactaatcctctgtttcatttaacttcattttcatttcgctttgtttcttaattcagtcaactcgtcctggttacataagttgagtgaacttgtcctaaaaggaaagaactttagtgtggtagaaggatgcggcaggaggcttcacttccacacagtctgtgattcaaccctgcaggaagcaggaactacctggctctgtgagtcttgaaaaagcaagactattgcactgtaacaagaaatgaaaagaaagacagggaattgcctgagaatggttttcaataaattaatgaggaaaaatacaaggaaaggagggcatattgtaaaatttggagagaagtcatgctctttctcctcacataacaattgtt

SEQ ID NO: 1008 - DNA, 1584 bp, Homo sapiens
tacctgttttctctggtgattttaattttggtgaagaaataaaagtttccattatctgaatatccccttattttaccttttatcctagtagaacaaaagtacttttaaaataaatgtattgtttgtgaaactgcccaataataataatgaggatgataacaacttacctatcagaacctgcctgactttaattattttgctaaattctcgcaactgctgaatttgatgtcattggccttattttaaagatgaagaaattggtacttagagaccattaataacttgtaccaagcagtggatctaaactggaacccaggtctttctgattgcagattgcaagctctgaactgctaagctagacacttgtctttttaaagtaagaattcttccactgagggaggtcatagctacaggaaattcagcagcatcctctcttctgcagaagaattatgatttctgaattatgaaactcactgactagactcttattggaaaaaaatcattagagatgacaaccctcctgtccaggaggcaagtaaatgtattgtttcaatagagaatatgttgcgtttgtgtctaagacagtgataattacgtcactccctaatgcatggaaaagaagcctttgctgtttctagtaagctgtttacagcaagaactttatagaatataaatatagtgtctattatatagcattttctaccaatagcatcattgttcccctccatatgttcttccgctaggtgtctaatgagttcctacgtatgaaaaatgacaagagaatctgaggaataattcaagcaactgtggcatatggaaactgttttctagtccctttgccatgatttctaggcaaaacagcaggaatacttggcagcagaggctagaaaaatcatcatccctgactgcaacttcgactgagttatctggcgtaaatgtcaggctttgagttgacagtgataatgataaacaaggcaaaatttctgtcagaatttgatacatacattctattgttcattccatagtgaatatttctctgcccctaagcttaattccacgagtctatgaaaggagtcattaggacttttgcatccagtgcatttagctttccttcatttataaagctctcttgtgtttctgagtgttgtgtgctcctctgaattcttgtgaggttttgccagataagcttttttcaataagacagttaccaatctatagttctgcttcttctccattcaaggaaggacaccataacacttttgagacaaggtagtagagagatgtaatatagtgagatgtgattcttcatcccctttatccttcctgatccttagacgtaatgattgtgcaactgtaatttattctgcattccacctacagacatgtatctactcatcaatttacccattcacaaatatattgaggacactcctagacagaacaagtcaataattccttccaccatacattgttcagtgctgcctactagtatatacatttacttatttaactacatgccggtacccagtttggacttaggcatttatgacagtaacagaattgatacagtcttcatttggtatt

SEQ ID NO: 1009 - DNA, 1929 bp, Homo sapiens
gaatttgggcagagaactgacaagatctgacttatttttctaaaggttcactctggttgctgggctgagcatagactttgggggaactcttattacactatagttattagttgttgatttatctctagcatctctccctcttcgagcacaaatcctgcattttgtttatcttaaagtgtttgttacttgcaggtgtttgggagacttactaagtaatctgcgtttgttgaattaattccatttcttcatcaggcataagagaaatatatgtattaaatgaaatcagaaaagattacattaagtttaattccacagacaagcaaaactaaattgataaagacggtagactgtagaaggggaaaaagagaagaaagttaaataaactcaaatatagttaggtaaagaatatagttttaaaataaaaaatgaaatacaatattgttcctagggttcaaaaatgaattaagacctaatagagtacagaattctagcataataacagtataaactaaacaaataaaatgatgccaactatatcgtaatgcagtatgtccctactaaaattaaatatgctgtaactctgaaaaattggccatttttcatatggctgtgtcaaacagcagcatagacaaatcaccaaataagtattccacagttaaataaatgtgtatcccgaatctaactcaaattatgtgcttgggtcttgtatgttacttccaaatacaacctgcgacttcattgatttttcagacaattcacaggtttcactgaacttattcttttgcaccaattttctggcatttgaaaggctgtattcataagtttagctagaaaatatttataagccctatggtgccaggcactggcaaatgtcctcccctggacatgtactgaagggaacaagccacacaactcctttccctcccacataatccctatgattcactggaattggatgaccttcctgggaactctttactgtggcctctgtgggtgccaaaagcccaagaaagcttgctgagttgttctcattcaaatactgcgcttgctgggttcttattcaggcctctttagacacacttccttcttgctcagcaaaactgctaattggcacagaaaatatcctagctttgtccattttctatagaagttgaaaatgcttctacctgactgtgctgacagaattatattttcaatggtatgaatactccagacatttcaatgacaactttgggaacaaaataatacatataatagagttggttggtcttaaacagcctcatgcctcagtataagtgaccagaagcaaaaatcctccaaaattaggggctaagacatgagcgtttgggatataatcatttacatttgacaaaggctgcacatagtgcctttctgtttctgtgatttttaccttaattggttcattttcactattatacatttaatctgtttgtcactagtaataaataagcagggctgttgtgattggttgccaataattatttttccatcagctcaagaaagcatgttgcaatgccaggagtaaagaaaattctccttgtatttgtcattggccaggtgcccaagtctcatatatgtcttggtgagggtgctgtggggagaccctttaattcatatttttcggtcctgcctccttctcacggacttgtgtagagggaaaaaagagctataattacttgtaagagcacttggatcaggtgacaaaattattgaaaaccttttaagccatgattagccatttgaatgtttacttatgtccacttccaagaactaccttaaattatttgcatatgtttgtatgtatgcaacttgtttgaatttatggagatgtataaaggttttgttgagtcttcagaagacagaggataatgatgctctttagctgtgatattttatgctcgtcagata

SEQ ID NO: 1010 - DNA, 2712 bp, Homo sapiens
acaacagcttagagtgttttgacatcagtcaacaactagtgggattgcccagaaagaacatttaaacaaccaatggaagtgatccagagaataataaactcttatttttaagttgcctaattagaaagtgacatgacagcatataaacaggcaatatgtcagcatttcatcaccaaacatccgaagatgacaaaccaaacaactgaacaaaatgttacagagtgggacaggacattgtgaagggaaactgcttgcaagccaaaattaatactattttatgtgacatttcagaatgatgaggcttcaaaaaaacagcagatgaagaaacccttactgataatgaatgagaagaaagaaatacctgagactatggagaaagacaaatataagagaaggcagaatttagatcagttgtagtttaggagtgtggactgcattttgaaaaacctgttacctaatcagtctttgtacctgaaggtacaaaccacagtagactgtggaaaatatttccttggccttaaacggcagggggaccctatgtaacagtttgcccctttccaaaaggattgagttgaaatgatgattaggctcacttctatatgtgaagttctgtgatatttgatgttcaggcaggtattttcatgcaagaattcagacactattggatatcagaaagaacattaggaatagaggaatcagaaaccataactgtgtgacttatgacaaggcatttgacttctcaggttgttttagaactaccatttgacccagcaatcccattactgggtatatacccgaaagaataggaatcattctatcataaagacacatgcacgcatatgttaatcacagcactattcacaatcgcaaagacatggaatcaacctaaatgcttatcaatggtagactgaataaagaaaatgtggcacatatacaatgtggaatactacacagccataaaaaagaatgagattatgtcctttgtagcaacagggagggagctggagtccattttcctaagcaaactaacacaggaacagaaaaccaaataccacatgttctcacttataagtgggagctaaacattgagtacaaatggacacatagaagggaacaataggcacaaggacctacttgaggatggagggtgagaggagggtgaggatccaaaaactacctattgggcactatgcttacaaaataatctgttcgccaaatccctgctgcaggcaatttacctatataacaaacctgaacctaaaaaaaaaagattttaaaaatcaggtttttttttttttgccaaatatcggctatagaaacaactatgttgtgggtgacagaacctgtatcaccctttagaaaagaaatacttcctatcgggaggggatctggtgcctagcgccaaagcatggcatctggtgatggcagtgggaggccttgctgctcatgaaaggggttggttggtggctttgctgagctggctgccaagctgtttcctcaattaggtcacaggccatggtgctgaaggtctgggaagactccaaggcctccggagactccaacagtgtggtcatgtactgaagagtggatttttacttaggccctgcgactggtccggggttaccatgtatactggggaggcatcatggtgccatgtcataccgctcagaaaaggtgacatacacctgccaggattttgctgtgatatgctgagggttgctttaagctatgaaacaaatatatcatgtcttcctggaatatcaatgattcctcggagatcttgaagaagagtaagaaatttagattgctaaggcaaaggtagcagctgtaataaactccacaatatgcaatgactccggcatgtagaagtgctttctcactaatgtaactgtgagcttggcatatagctttcccttcaaggggtccttcggggacctaggttttttctgtgttgtagctctgccatcttcaacatgtggcttccaaggtcagaatgctcctttttttttttttttttttgagagatgggatctcactatgttgcccaggttggtctggaactcctgggctcaagtgatccacccacctcagactccaaaatgctggagattacaggtgtgagccacaactcctggccatcatgctcttttgcttaaagccactcaaaggagaaagggcccagaggattgagctttaaaaagtttctcagtaaggtttagaacaggatcacatgtcagcgactgacactcaagaaaatggttacatataattgcaaagaagactaggaaagcaacttaactccatacatagatagatgaaatagctttggagagaagctatgtagcattctaacaataattgataattcaaatattatccagactttttctattaaaacaaacacacatatgatgtaggacacaaattcacatagattctgaggccaatgtaactaaaattcaaagatgctttcggctagcttgaggctactctgtgtttactatacccaagatccttggagctccacattcaatcttctctacctaattattaaaaaggggcataaacttcattctacctagtttataataggcatttaatatatatgttttgattaaataaaacagtggatgcatgaaatgctatcagtcagtacttgtctgactcataggaagtggacaagtgtcagaaaggcctcttgaaagtacttcc

SEQ ID NO: 1011 - DNA, 1763 bp, Homo sapiens
agacagggaggaaatgtaaatgcatattactaagtgaaagaagccagtctgaaaaggctgtatactatgtgatttaaactgtatgacattctggaaaaacaaaactaaggagacagtaaaacgatcagtggttgccaggtgttagtgtggagggagggatgaataggtggagcacagaggatttttaggacagtgaaagtactctgtatgatactgtaatggtggattccttatacttttgtcaaaacccatggaaacagcgccaagagtgactctaatgtaaactatagactttgggtaacaatgatgtgttattgtaggttcatcagttataataaatgtatcaccgatgggggatgttgttaatgggggaggctttgcctgtgttggggaagggggtgtatgggaaagctctgtaccttatgcggacttttcctgtggatctaaatctctaagaagtgaagtctgttaaaaacgtgatttggtgaatcagtatagggggatacatgattgctaactttgagagagggaaacagaaagagtgagtgatagtgtgtatatatgtgttcgtcttcgatattctgaagttattcaaattatgtgtttagatttagcggccaactttagagtttttgctttggcatataacactttgatggatcaaccccttgactatcatctgtagtggtgtcttggcatttgctatgcttcctggatgaatcactaacaacagtatgtctaagtaattgatgttactgtatttagttttgcttgagtattctgttgttagcttctctgagtttgttgagggaagaatgaaactttccatgaaggaagttggtgtttcaggcctggtcgttactggtttcagctctttggtttgcctatgatagactgtgttgacttttcctttattcctcttgctgaagtcatacttactatggccttgcctcagaatttctagttgttagaagctagaagttttagtgattaatgagatgggatttgcacctatttcccgcacccagtattgtacctggaacatattaggcttttagtaaatgttagctgaatgatggatgactaattgactgaatgaaaatgcatgaatcgcaaaaagaaaaagaggcgtaaagagattaataacaccaaggttatccagctcataggtggtggatctatatcttaaatttagatttcctgacatcaaatcatgttctttttttagtttattcatttagcatctagcttttcttctaaaaatatgtgaaattaaataagacagtacatcatgctaatttttaaaaaggacaaaagaattcttctaacagtaactctaacaatattacatggggttaattgctttaatgcccttgcaaatgaaacttaaaccaaaccagttacacaccgtccagcttcagtccagtccctgggtcagagacagtatccgtagctctggatttagttttagataagactctttaaagttggctgaggagaataaagccccttacaaaagaaacagaatgaatggttgaagatagagggaaaatcaggagggaatagttatcaggaagctaaagaaaaactaattagaagtacagttaagtgtgttggatatattaaatatttaaatagtatgaggactgaaaataggcttttggatttaataattagaaggtcattgttttcagcgagacgtttgggtgaaagccacatggtaatgaattggtgaggaaataaaagtacagaaaatgggagta

SEQ ID NO: 1012 - DNA, 1699 bp, Homo sapiens
ttgctttcccagttgtttatatcttagccaatgaaatgaattagaagatatgtgatcaagacaaatgaaaaagtcttgcacaagtgtgagcagaaggaaggaaaaggtacctgggccaaagtggatatggaagaattagcaaaactgtcgatagtgatgctagtgacaaccactctgagttggcatctgtcttaaactaaaaaacaggttcagttgtctcaataggagttcacagttttaatgtttacctttagacatgaaaactgcaataatgaatttaatacaacaaaaaagcagaactacaaggtcaggcaccatctcatggacttttcctcatgaagataagcccaaatcttgcaggtagcaattcaaaattaaaaatcagcaggttaaaatgttgataggcttttggaatctgaattacacatttctttccttttattcttcatccatgtttggatttgttttcaattactgctgcaaaacacttcccctgcagcacaggaaaaatgtgaaattctaaaggctgctactatttttctggcctatctgtttaatcacttgaccatctaaatactatattttgattgtaaaagtggtctcaagagaggctggattgaaggcagttaattttctttaaaggaaacaagtggcataaacagaatactgacggggcagaaaccagagctgtcagagtccatatgccttatatttttagaacaggaagcagcaaaacagaaggaaagggatctaggtaaataaatgagacaccgtttgtgacaagcaaaagcttttttttacctactgaacaaacatgaagactccagtagtctttggcagcaactccataggacaaagccaagactgagagctgttatttatgtagtgatccaatctttttcctgaatgtctttatatataaaaggcagaccattaacaatggaatattaaccaatttaaatgtaatagcttgcccatgtggagacgctgctgctgaaatgtatcccaacaattatttacgggtctccacggctctttatctgaaagagggaggcaggagccgcgaccacaaagatattttttttcctctcttatgatccatgatagatataaacaagatgatggtgctctgaatctatttaattgacctgactgtaataaattgcagctggatcttttccctttattgtgctctaaagccactcacacttcaggcattaggaagtcatcatattctgaaaggtttatctcagagtcatagaatcacagacggccagagctgcaaggggcctttttcatccttcttttgctttcccagaaagccaggtttaggtttggctgtcagcccatgaaaaccttccaaacagttatcaagaacaaaatgggtttccaaagcctgcattatagaatatataaaagcttttattatttattttaaagtgtagacataacatctgcatacattttgtggatgagattttaaaagaaaagaaaaaaaaaactcattggcaactaataaggtgtttgtgaacaaacaggtaacttggatcactgatatttgtctttttcaacataaatcaagacccatattttgatattgccttggactttgtcttccatttaaaagcacgaacataaatatgtctgtagaaaagcacgtcttacggtcgtgtctacctgaggcaatgaaagtcagctg

SEQ ID NO: 1013 - DNA, 1797 bp, Homo sapiens
atatatcgtgggtcaaaatatttgatcaaatattccaaatttcagtaaaaacacagtaagcaaggaatattttataaaccttgtgtatatagatatcatatatgacataagaaaactggacagagtttccaaggcttcacctttacccattcaagttttacagtgtctttggacacataaaagtgactctatacaaacttagtattttcctagtctaatagaaaattaatcagaaccaccaaattgactattttatcatttgtaaacatgtaacccataagttttaatccaatctatttcagaattcttatgtaatgaattcacttaagtaataaagctataacacacagaagcatcttgcattatttgcacctacagagcaaaatgttggtatacaacatatactccaactctttctacactaaccttcacctatgcattgtattttagcacccagttaatgtaagtctctgtagctatcttgaaagaaattgaaatcagtagcaatcatcaaccccatcatctcctccatgccaaatgatgactttactagttttcttcagaaaagtctagcactgaactctgtgtacaataatctacctgaaatgagtcagaataaccactgcagtcttgaagaacccactcaaactaaatatagaaagagtgtccctatctaaacttggacagcattcttttcacaaaaatcatgatctgacagttaatgtgtttataaccaatacttttggacattcagaaaattttgttttcatttgttcattaaaacgccaacattaaaacgttttgttcatcttgtatagaaatatacattctgctgtcatccgtactagagaaatgaaacagagaatccacctgcattacagctgtccaaatgcaggatggggggcggggggcacagcactttgcctcacccagtgttttcctcattctacttggcaatgcagatgaaagaataaagttacattttcccttaagtttataaggtgaaatgggaacacttgattctgtgctactccccctagaaaaaaaccaaaacaaacaaacaaaaaccctttctacttgccaaatctgataccaaaattagctcttagaactacgtttctaaagaaaatgcattagtgggaattttaacagaaaacccattatactcatgctgttactaaaacttttccaagttcttctcttcagaaaaaagagcctcattttaaatactcatacttctaaagaaaataaaatatcaattctctactaagattcctttttgggtggtagaaaaacaaaagaatcacgcattttcctactatgtttgataagcacagtgctaccatcaaaactgcaggaatgaccaccctcattaaatcgaccccaaagaatgaacccccagactaaacaatgagtagtcaaacaacctcagggttctgtttttctttcaatgcattcggcattaagaggcgatttttaaaatgtatattctaattatacattttcatcttgtcaacatctcttaatataaaaaccagtaataaaaggtaatcagaagttcagtcttaacatagtttcaggattaccatactgttttccctaattgttactttactatgtaatttagaacaccactttgttacaatctgttcataaatatctatgaacagatcttaagttacataaagggggaaaacaatggctcttgggagcctggagcggaactagcaataagcagtaaaggtaagcaatttttaaggtgctggctccattttcagactatgctgttactgtttg

SEQ ID NO: 1014 - DNA, 2421 bp, Homo sapiens
gactacccctaaacatctatttttgtcctcctttctctgggaaactatgaaaactgctgcctcatctatctcttcctgaataaccaaaggccccctaagggaaaagttgtcccatacttacttgcctatctgggtttccatcttctgccagatcttagtctcataattaattcttctcaatccttgttagatttttaagtatacatataaaactgggtagcagggctgatactttactattccccaatgggagggctgttccagagaaccaggtctaccataactggaactagaagtcaacagaaaaatttcttaaaatttcatgtccctagccctcatgctctcctggctacaaatagcagtttccctcaaagtctctttcccatccaccctgcaaacttttcagcaaaacattttcaaattcttctggaaacaagctagttttcccttctttcacgtctcttatttttcctcaccaacaactctctgtttaaataagctagcctctctatttccttgagctcgccctttcaaccatcactttgatcatcacaaaaaacaaggacaagaagcagattctctgcctggtgggaatatgggtagtttttatatctttattgttatctgtattttctaaagtttctgcaacaaatgtgaattttttaaataatcatttttaatgttgtaatgcttaacagatctcagagcatatgctattatttcctacctatgcataatttggtatttacttgtgctaaatcaagtcagcatgatctatttgtacaagtgaattccctgtttccttaggactttaaaactctgcagctgctgtcatgtagaaaacgaattcccatacaggtatccttgctttaataacagactcacaattctgtttccaggcttccctcttagctttcacttttatttattcggcactccttttcccttttctcagtagtgtaatggagatatcattttttaaaatattttcagatgcattttgatatcatgtaaataacattgtcctgtgactcactgcccactccttgacctagaaaggactgacaccaactggaacagtatacttactgctcagcactgactgagaaattagatttttaaaaaatccctaagaagataatggtctagaaagcaagccttgacagaaaaagaaactctttttttttttttttttgaaacagtgtcttgctctgtggcccaggctgaattgcatcatggcccaccacagcctagaactcctcaactcaagccatcttcctgcctcagcctccccagtagctggactatgggcaggtgccaccacacctggctaattttttactttttcttctgtagatacagggtcatgatatgttgcccaggatggtctcgaactcttggcctcatgcaatccttccacctaggcctcccaagtgctgggattacaagcatgagccactgcacctagcttttgtaatttatttagttttttagagataggatctcactctgtcactcggaagtgcagtggtgcaattatgaatcactacagcctcaaacttctgggctcaagtggtcctcctacttcatcctcctgagtagctgggactaaaggtgtgtaccacatagccatgctaatttttaaaagtcttttagagatgaggtcttgctatgttacccaggctggtcacaaattcccagcctcaagtgatcctcctgcctaggcctcccaaggtgctgggatcataggcatgagccaccccacctggcctgttttataaattcttaaagctccaattaacatatcaagagctaagcctcagtctctggatatgaggagagatagcttgggctgtgatattaagctgttcctgccacaccaaaagcaggagaccctgcccattgaggccccatagactgcagaagggagagggagacagaaataaatgaaaacataaagacatacacctggcataaaatttcagggaggaggtatataagagaaattgagaaatcttgtgtgacataccccatttggaactctggaaactagaacacaggatagccccacacaaatgcaagatgctacatcaaagcgatgtcagtgacatgacataaacaggtagagagaggactagaataagcactccttagcctcccttcactgttaggtgatatagaagggaccttaaagtcactgcaagtccagggaaaggagctgagatgaaggcctgtggaactctcatggaaccatactggtgatgagcaatgactgttccagcagctgtaaacttgatagtcacaggctgggtggagagcatggtttagactcaaagagcactacagttcagtgacaaccattgtaaggtacatggctgtgctttggtcaaagaataggcccaggtaaacatcctgcatgac

SEQ ID NO: 1015 - DNA, 1539 bp, Homo sapiens
tctctgcagcttggcatatgcttaaaatacaattcttttcaagtgaactcagcaaattgggggacatctttcacccatcttcgatgaggtcatatttgggtctactgccattgccatgtttctcagacttggctctattgacattttggctggataattccctattgtgagcagctgtcccatgcacccttgtagtgtgtttagaagcattcctgacctccacccactagatgccaggaacatttcaccctgcagttgtgacaaccaaaaaatttaaagaacactgggattctctccataaagcctgggacaagacccagtttcactgctctggacaggcaaacctggtcctccctcttctccttacccaggctgcctttccttgttggtagaattggggtactacagcagcctcagaggattgtggaggggattgaccgtgctggttttgtgaacccacaaatggctaccactttaaccgttaaccactattcccatgtaaagaataaagtgattttcctcacgtcacaggatgagtggcaaaactggaatctggatctgcatttgtcttacttgaaaaccttttgctgccacaccttgcaaatggatgtgtatttgggaatgacactaggatagtggaaagttgtatgcactacccaactatctatcccagggatgtatatgtcagaggaagaaattctgctgtcttgtctgaatctgttatttgagggaataccaggtaaatgctatcacagtgacccatagtccctctgttgtagagagatctaggctgagtcagcaggatctggacatagggtacaaaggaggaggattcctgaccaaaagaagcagcagaaatagatgtttcagtctgtggctacttgaagcctagctttccccatcaccctacagggcacagagaatagagaatctcttgcaagtcagtctcccaggagtcagccagggagagaaacacctaacagaccagcagacccaacaagagaccatgaagcagaagacgtgtctcccacaaggccagatccacaggactttcactcatggtcatccttgacaagtaacagcagtgttatgatgttgcaaccctgtaatttccattatgatcaatgtatatgttgggggccagagaaaggcagattgataacttcatttagagcaaactaattgaattccactaagagatgcatgactcatctaagaaatgtgcaaagggtgtcaaagagcactgagtctcctcctctggtgatttttacaagcctcatcaatttttgtcccacagaatactttaattaacataaaagttctagaattcttggagttaaatcctttctaaaattctggcatcttggccagcaaaactttgccatgacacctttgacttaattaacatgagtaaaggaaaagtgagcctacgcaaatgtcggctgatcagccgtgacactcagaagaaaagcaataaagacagccaccggcagtgcctacgacagcagtgtcctggaaagagagacacttacgtggtcc

SEQ ID NO: 1016 - DNA, 1606 bp, Homo sapiens
tttctgcaaggcacaaagtcttcttctgataggagatctctgcttcctgcctgcagaactgcccgccactctcccagcctgggctgagtccctttgcccttctcttcccctctcctcctccagccctgcccagcaggacccctgaggttgctctgctgccccctcagctctcggccccgagggatgcccaccctgttccagctggacactcagtgttggagaccgatgtcagctaaagggaagtccaagcctcaaatgaaagccggaggccacatccccctcgactctcaccagggctcactgagtggcagggtctcaagcgcaggcagcccctttcttcccacccggggctgtgggaagatggcttctctgaacagccttagccagcaccgaggtccatatgatcagaggggcttcccacaccctcccatcacagtggaccacagcttagtgacgctgggtgggtggcccttcccccctgcaggcgccacaggcaggacctaacccccccagaatcacccagtgctcccccaacctgctgagcgtggctcaagagggttttcctaaatagcgtgtgaaatccattaggagaaaatgggttcagaaggaggaaacaggactgcttctcaaacaccctggcctaggaagctacatttctaacaggctctaaggggattctcacagaaaggggcccaaggatggtgtcactgaaaaacagcacataaataataacataaacgatgacgcactacaggctgcacatccacatacaagggaatgtcccagaagtcacttctgggacagtggcagcaggtaagacttccagctaaagtctgctcatactctgcgtgaacaatgtgttgcacgcttggaccgacactcctatgcacagcagctagagcagcaacacttggaggaagcgccacacaaaacagacctagacagttcacagtcgtgcgtctggtcttctctgcagtcaaccaaacgcactgcacagaccttggcctgacacagaagtcatttccttggctgctctgtgctgtctgggtgccaggtcctgagagccagggcttcatgtcgatgcttcaccccagtgtaccctagaacctgttctcaacctctgtgccatgaccctgtccaccccccgcccccgatctctcactgcagcacccactctctgccccaccttgcttggcaccattttcctgatcctcacaccaccgtcccagactcttgtcctgcactgggacgcctcgccagacatggagcctgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatatctggagtcaagggcagagtggaaggggaggggaac

SEQ ID NO: 1017 - DNA, 1432 bp, Homo sapiens
aagctctctggaccgagctacttttaagcgcaagatcgttgtgcaaatggcaatttatctttgcctggcagaggcatttgaatgtaattttggtggtattaagagatcacttagggaatttcatctaactctggctccagacactgagaatggatgtttacatttaaacaacttttttagactccaaagatcacaatttcttcttttttgaacctgaaaatgaaattaaggcccaattatcttcctcaaccccctccctgtggcactcctgggaggatgaactggtcatcaccagtacattctgggtagcccaagatgctggtgtgcaattgtgttccgtcacccaccgccacaatcggaagcagaaaataagttgagtacaagtttttgatcatcttctatgaggcaggccctgaatgagtcactgagaaggcagttgaatacatggttcctgctctcgaagagctggcagcctggtgagaggacagacatcccagtcagaagctgtcatacagggtgatgggggctaggacagattagtcaagaggagtggagggcgtgagacctgctggagaaatgaagaagaccagtaattcagccagaggagatccaaggaagcttcactgagggcatatgaggagagtcagaagctcagaaaggcctaaaccccttacttcctgcaacctttcagatgcatgaagtttcttacctgcctcagatgcataagctccctcacctgtccaggtccataagctcccttacttgcatcatgtgcataagctcccttacctgcccaggctttgggctacactgggcgcaagagagtgcttctgagcagctgttaggcctctttcctttaggagacctttagtcttctagactagtaatttaaaaattacttgaaccacaaaatgctttttttgcgataaaatcttagtaaatccaatttaaaaactagataagaagtggctgtggttggggatgggagctgatttttgtcttgagttctctcaaaaagttccacagagctctgtgggttccaaggagcacactctgaaaacttcggtcctgggtcatttcgttttgcttttggcagtcatatcaatagtgttagcttagttttattgtggtttgtgttgctatgtctttttgttttgtttttgtgacaaagtctcacttttgtcacccgggctagagagcagtggcatgaacacagttccctgcagccccaacctcctaggctcaggtgatcctcaagccccccaagtagctgggactaattttagctaattttttggactaattttaacatttttgtaaagatgagtttcatcgtgttgctcaggctggtctcaaactcctgagcccaagatatctgcccaccactgcctcccaaagtgctgggattacaggcttgagccattgcacccag

SEQ ID NO: 1018 - DNA, 1392 bp, Homo sapiens
gccattgcactccagactgggcgacaagagtgaaactccatctcaataataataataataatacgtaacataaagtaaaataaaaatagtaaattttaaaaaggaacaaggtactgtgtcaggtgcttcacatcacatttagtgatgcagatatttttgactccagttctaggtgagtgtactgagattcacacaggccaaatagtttcctgaaagtcaacagcaaggaactctgaccataagcccctggcatgtaacaatctcatcatactgtctgacagagggagctaaggaaaacatacacacaattccaataaaatatcccattcactgactgtgagtgaacaaggtggagaggatggcagggtggaccagagcttccagcaatagctcattatcaggtggaacgccgacaagaggcaatgggtaattggccactggaatgtctcagaaggctgtgaactgctccggtgagctcatgggcctagctgtgatttaaagttctcatcttctgggccctattctgcctgatgtctgatggcatcgcaaccccagagagcacttcttagctttctgattcttggaaatgaccattctaaaggcgcccacgcttttggaaagtgtggaagacattaaaaggttgtatttaattctacttttatgaacactccttgtttctgctggctcttattaaaatgaatgagacgtctctatgtcaaccatgggtgtctctgatctgttccaaataatctttaagagaggatcaaccaaccttaaaggaattctctaccccatcccagaggaaagcatagacaagtaactggagaacctcaaatccaggcctcgctgaaaagttgttcgcccaactggtaattgccccaatgacaagcacttaagaacaaaattgaaggcacagggaaggttggttgtaaggaatatttcttctaacttgatggcaagagaccacatgtagaggaaaacatgttttaaaaatagtcacctgtttccacagtttatttcatttctgaaataaagggtatctgcttggaattttaaatggaggggacagggaacaaaaccctggttgccatagaaatgaagaattcttttccagtcagaggagtatgaattcaagtgaaaaatcggaatcaggtgaggtattccacaggcagaatcatctattatcctgtaaaaatctacagccagaaggaaaaataaatgctaaagggtatgtagagtacagaattatgaatttctccatacattagtcacttgctttttagataagcactgggactctttggctgatctagttcaaacattagcttccatattaatgtaaaaccaatattaaaattaattttcatccatttcattcatgttgcagaaatg

SEQ ID NO: 1019 - DNA, 1546 bp, Homo sapiens
cagaagattgcaataacttacaaccttctagcagtaaatcacccaatcttcagcagctttcatattttcttcagtatttactaatttcataggtaaagtggttcatttcttaaattgtcccttcttataactaatgaagctgaatatttatttagttcgtctttgactgatttataacaacattatatcaacacccatttccacaggcttacaaagagtttggctgtattaaaacccaagacatcaagtaatatggctgtgaattttctgccatgggaaaaaaagtagtaaaccacctatgggattacagcataagtacaacttgcttttctcttactttgggaaagatgaacctcctttatagtacaattttcaggaaatgcattgcacttcccttgttttccacataggatgtaatttccagcaccactgcaacatcttccaagggaggcatttttaaatcactgacagatattgtgaaggttccatcatggaggttccatatagcgacttttgttttgcattttcctggccatacttctgtttagaacctaccattaactttgataatttaattttacccctttcctaagaataaaatccatgcacatgtcagtatcagcaaaataacatcacttctctcttctatagcttcagctaacctttaagtgaatcttaaaattttctataaccatcttccaaaactaggcattttatccaataatataaaattagcatgttatagagggtgctgcacaaatagcctacactgattcacagatgactttaaaaattcagtgagccaagaatcccacattattgattcatgctaacaaaacgatgaagtacagctaatctttaaaacacatgctgggcagaatgacatttataaatgcagacagaccgaaaccaattggacataattctttacggattaaactgatggctgcaattagacctaagaaggtgagcagtctctctgctgggaactgagactcagcctcctgggtccaactccaattttctctcatccttggctaaacatggtattccactgttccactgaccggctagttgagtagagttccccatgactactcaggttaactaaattggtttgtaaaatatgacatgttaccactttggcttgcctctttgacttttaataacaactgccccgaagggggctatgattaggatcatcatagcatgatgctatcagtgtagaataccagatgagcccagcaaagagcctgtagggacagaatatggatatatccctttgtatctgccctgtccctctccctctccctctctctctccctccccctccctcccgccctcccttcttccttccttccttccttgtctccctccctgtctctctctctctctctcttttgacatagtcttgctctgttgcccaggctggagtgcagtggtgcaatctcagctcactacaacctccacctcccaggttcaagcaattctcctgcctcagcctcctgagtagtgggattacaagcgcctgccaccacaacttgct

SEQ ID NO: 1020 - DNA, 1624 bp, Homo sapiens
catcagagggtctaggaccatgcagactcagctctatagtattttttaaatgaatccccttagatggaaagagccagcttatatttaccgagataaacttttagagttttgcattatatccaacagtgttaagcaagaaaaaaaaaaaaaccttccaataatcagttccacgagagaggctgttgacttttattcgtttctatagctcatgaacccaaccttgaattccagagagagaaagctaccctcagcttgtgatttaacaagttctgcagttcacgaggaactgaagaggtttttagctctggataccatccctctggctccattcttttagctgatagaaaacaggatattactctagggaaggaggttcttttatctcccagctgtagctttctttagagaaaggggattgtggaagtcaaaacatcgtccttccctgaatagacgagattgatttattagttggcatctttataatcctttcctaagtaaaggcaagaaacagtgcttaccagcgtggatttaaagctcctcatatatggaccaaaaatttgccactcccactcactagaatgtgtccatggaaaaggtcctgaaccagtctgagccttagactccttttctgtaaaatgcagttgataataaagcctacctcatgggaccgatttgagaactgcatgtgataatgatgtaaaatgcacttagctcatgatgtctaataagtgttccttaaatatgttatttttgtgactgtttaatcctcaataagaagagtaaatatcagatatccctgcctccctctaagaaggcacattcccagttcattttcaagactcaagtggccaagacaagcaaactttctagatgtgactgaggctgaacaaagctggcattatctactcctggtctttccagatctgtctgtttttatcccaccaggtccactcgaagcctctcttctgaaatttgaccagaaatgacaaagaatcatgagttggttccactgagcatccacccagaatgatgcctcccaagctaatggcatttttcaaccatcacaatggagtgaatgatgtggatattagcacccctacttacagtcattgatgaatctgctcttggcagtcagagcaccgaagtgtgactgcaacaatggtgagggggagagttagaagggaagataaatgagctcattgtgcctatgtattttggaggccaaggctactatcaggtgttccaagaaatgggatacaaaagaaatgagttttgtcacctaaaaagagaaaaggattcaaccaaggcaaattctgaaaagaaagaacagccagtgtcacccaatttctacctcttccaatcatggcatttatctattttatgtctctagccaaggaaaaatgcaatgcctcctttacaggtttgttctgctggagatagtgattattaaagcaatttgttagaggcagattttgcgtacatattaaagcaagataatcgtattggagacgcttgcctgaagcagggattcagctggaatggccattgcacacaagtctgtttttcagaactgggtaatgatgagcacatttagtgactaagatgcatggcctgatttaatggg

SEQ ID NO: 1021 - DNA, 1335 bp, Homo sapiens
cacatgatcccacccaagtttctttttctgttgttggtttttattttgttttgtttttttgagacagggtctcaccctatcacctagactggagtacagtggcacaatctcggctcactttagtatccacctttcggactcaggcaattttcccatttcagcctcccgagtagctgggactacaggcatgcaccaccatccctggctaattttttgtagagatggggtctcatcaggttgcccaggctggtctcagactcctggactcaagcgatctggcctgccttgacctacccaaagtgctgggattacaggtgtgagccaccacacttagccaagtttctttaagccataattctcctctgtgcaagacctgcatactgggcttctgaacactgccccctgcaccatttggggaacataaggaagggctatgagtaaggagaccttgccaagggaaagattaaaaaacaaacaacttccccagccaccatcaatagcatttccaggaagaaataaacagaacggactcttggccataaaggatttatcactttcctttccattggtgtggaaatgaagcagggttgcttcaaaactgcattttccagctttccaaggagctgtgtggattccatatcctagagaagtcgacaccgttctagtaagttggcatggaccccaggtcctacccttaagggcttaatactctgatgcaatatataaaatataatttaataaaagactgaggcagtatttgtgtaccaagtgtctatagcaagtaccaaggtatttgcatggattgggggtggtagcaagtgtgtgatattctccttctaaatcccctgcgtgtggggatggaatttttaacagtgggcgatgtgataggacgatcagagatatgcaaaaccacctttttagtggtgggacacagtcacagttgtattccttctgggactatttggaaatcacacatttctcatcaagtaagaaaatgaaaacagagaaaaaccagttgacagtgatggctcaatagcgccatctcgtggtgatctctgtccccactccaagagcagtccatgggccccaccccttccgggatgttttgccccctctgtatctgagtcccagaaggcagtgcaaaagggatctgggcaaaacagagtatcctacagattggaacagtgaccaacggcatctttaaggaggagaaatttgaaatgggttctaaaggaatagatacccaggcatcaaagagaagcaaagacatttttgatgaagggcatagtgcaaaccaaggttggtggctggaaaatgtcagatcctttgaggata

SEQ ID NO: 1022 - DNA, 1552 bp, Homo sapiens
caaaaataaactcaagtattagtattcagattacatgtgaatgaattaaactcctctataaaaaggcagaaactatagctaccatttagtgagtgttattatgatttaggcactgtgctgagcactttaaatagacaattttatttaaagctaacaataaactctacaaggtaggttctatttttattctcatgttaaagatgagaccctgagacttaagagagattaagccatttgtttcaagtgagaggccagatttgaacccatgctctttgatggttaagacccatgctgttaatcattctattaaactaccactcatcttggtttaaacaattacttaaatgttatttgtaagagataaaccaaggcaaaacaatatataaattctgaaagtaaagagttggaaaaagatctataaggcaaatgataaccaagatgaaaggaggcagggacagtgatattaatacccatgacatatgatgagaacaaaacaattttgagaacagtgtgtatagtatatactgtttgtatatactattctgtttatgttaaaaatatatgtgtgtgtatgctgtagaatcagtagtggcatgaaggggtgtgtatttagattgtttgagttgtataatgctgttttacttgtgtaattaaaaaagattaaaaaaataagaaataagcttatttttttaaactggagaataggcaggtgtccagctgtgtaatgcaaaccaagagagaaactagggagagaggctgtggattatgttgggtgaatacaaaaataagccttaaaagtggtgataaaagggggggatgcttttcaatagaggtgtcacgaagcaccttcactcatcaaactttgacaatttcccctttctatgtgtgtgtcgggggggtggtgagggtggaggatcaggaggcaatgtgtgagagtgacagtatcagccacatgtcttctgttcaaagcaatgcaacgttttcaatcagaaaggaaaaatatgaaaaagaaaaaccctcaacttttcttatttcctctgaattgggttgtccgtccctttgcagttgctatgacaacagcagccctcctccttcttcatctggatctatttccaaactgaaaacaatgaatgtgaaagatcagaaaataggaaaagcaagtaggcattaaaagcattaggatgatttaccctggagaagagaatgctaagaggtggcaattatattgttctgagctattaaaggtgactactatgtaagtagttccctgcttgggcccaagataaaatcagatttattttaactggagggaaatagctttagagagaagaagtccctgatagaaagttctgtgggactgctttggctctgtcagggtagagtggtgaggaggctctgaaatttttgtatcctgcggtggttattattttcctctaaaaagttcttcatcggtcaaagaacaacaaccatgacaaccaacacatggtgcttactctgtgtcgagtgccactctaagtgttttatatttatgatctcacttagtctttacaac

SEQ ID NO: 1023 - DNA, 3371 bp, Homo sapiens
tcattggaattcaaaacacatttcagacactctagagaagattgatgggaattaatcaaaactatttcttagaaaagaaatgacacaaagagaatttaagatcgtttgaaatgtcgcctttgctcattacaaaggtctgtcattttacttttgttatgggaaagacaaagctcttacagccctttgaccttctgaagttatctcagaatctatctaatttatttccatttctctgaatttggccatattagaacaataacagctcaactaatgagaagcctcgcttttatgtttgagcagttcacaagttttggtaaaagttccattcaaatatgtccatggctttctaatacgagatttgattcttagctattaatttaacaaacaaaagcaaactgtattcttttatattacaaagctcttatataacaagctaaatcatgggaaagttgatattttaactgcagctgggaggtggagggaaggaagtcctggctgagtgagaggcataagaacatgtataattcaaataaaattgtggagaacaagaacaggtttcatagaaaaatgcacggttttcttaggctccactgtcagattgggcttgtgttacatgctgcatcaagaggatgccttttgctaccaggaaaaataccatccaacctgcttttaccaaaacaactctggaaacaacagtgagaagggactggttatttaagaggcacgtattaaagatctctaggaagggaaggccatgaagcaggaacatagctgcccaagttcccccccaaatcctatatgcttacccaaatcccacaggccttgcttccttcattctcatcacccaaggagagctgtccctgtattctaaattaaatcactccaggttatcctaaatcttttgtagtggctcaggtttcctgttgcttcaatttacatttttcaaatttcccttgtactaatgactcttgactctgagcaccaccacccagaatgttttcaaacgaccaccctggactttgccctatccctctccaacatctgattgcgctcccaatgcctactatttatgggttacccacatcaccaagtcctgccaattctacctcactaaactttctccgatgctttcatgtcttcattcaatacatatttatagggagtttcctatgtgccaacacctattctagcatgcaaacatcaggaaggcagagacttacttctgttttgctcactttcgtggcgtttgcctgctagtagaacattatatttattcaagcgtgagaactcctaactctgattaatacaacaaccccaagattactctttttctctctgctaaaatttgatcaaggagatatgtctgcactgccaatcagcaatgtactccttagaatcctccagtggtgctaattttcccttctccactgtttagtatatcctttatagcccttaagattggctcctgctcaccatttcagtcccatctttcaacagtcagtccaatttctgacactttatattttttgctccaactatttcggacaaattgaagctccttaatgtgctacagcctctcacacttctggagtttgcctctgctctttttatgggaaagccattattcgttcttcacctcctaggtcattcctgttagtccttcagtataagtgtagatgccagctctccctgacatcttcctcaactttttcattgagagtctttacctcttttctgtgcctcttaacttaggatcttaaacctgtccttccacctagcacaaatgcatttttctcagacaaatacaatatattttatgtctagatggtgttccattgaaatgtacaaattctgccccccacccagtgacaagctgataaacagtgaaattattttttaattgagttgttgaactaataaggactcaaactaaggtagggacaaagccaaggaaagggctgtaatggaaatgactttgaaggttaaactgaccagatttggcaacttctatacagtattactgaaagggagtaattagaaatgatttttaacattttcagtccgaatgaatggaaggctagaattatgtggccatctggttttgacaggaggtaaaacatccatttttgaaatgttaagtttaacaaatctatagggcatccatgaatagatatatgggaggcattcaggatttgggatatggctttcaaaggaaagatcagagctagaaaaatagatttagtcttcagcatccaaaaaaaaaatcattgtagccacaagcatgagatgtgtagttcagtgaggatgtaaagcaagagaaaatgagagttgtgttagctttttagcgaaagtaaagaaaaatggctccatgaaagatgctgaaaaaggctggtcagggaagtttagaaaaaaacccaagaagttgccatgtcctatcgagtcacagaaggaggagcttgcccgaagtgacagaattttggtcatgacttctgatctagatgtttttgctgatgagttttctctcagttcatttattgacgtagaaggatattctacagatgcagtatgtcagcatagcagaagcaaaaagctgctgttcctttgttttgaaagcatcatccctcaagaatcatgcaaatcagaaattcattatggaaactgtgtatgaagatcatctgggaattcccctaaatataatgcccctggctgtcatattgtccctcccatttttatataaaggagcataaaatgctagaaatattacatccaggcttgcatttaattttgcaaaagtgatggattttaaaaatttcacaaagggcaattatataacacaatattcttcttctcagttatgcatctgttgaaggaaaaactggcatcattaaatgaaaacaaagtttttgacatttatggttgtctattgagtttggctgactctacaaatattatatttcctaaaattataaattgctaatttctttttttttttttttttttttttttgagatggagtcttgctctgtcgcccaggttggagtgcagtggtgcaatctcggctcactgcaagctccacctccgaggttcacaccattctcctgtgtcagcctcccaagcagctgggactacaggcacccgccaccacgcttggctaatttgttgtatttttagtactggcggggtttcaccgtattagccaggatggtctagatctcctgacctcgtgatctgcccacctcggcataaattgctaatttcttaagtaaaattctgaactctgaacatatatttcaaacaatgacaaactgacctgttttatattcctaagtatctgtgggttacaaattttcagaaaacagatataataaaag

SEQ ID NO: 1024 - DNA, 3177 bp, Homo sapiens
agaaagtcttgagtgacaggctagggtgtgggcttttctgataggcactgggtagccatttcagatttttgagttggaaatagcatgcttagaacacaccataactttggaagcaatttcagaataaccagagaggggagagacaggaacagtgataagtcagaatgcaattgtaaaattgcaggcaaaggtatagttcaggaacacagtggtgctggggatcgtggagaacgaagaatgaaaggcaataaaatttttctcacagttagcataaaaccttatttatatacagagacaaacacgcacacacactacagcttcgtaacacaggaccatatatgttcatccaagacagcaaatatattctcccctcaggaaaggggaccaatgcacaccacttatttttcatttcccattaattttaattacagaaatggaatgtattatgcaacctttaaaatttcacatcatggatgcatgctgagagccctttcaaactgaatttcaaacaattcaatttctaaggtctgtgttaaaggagataggaaggaactgacactatcgtttacatatctgcattttaatatgagtttccttaatgccctcccgcttgacaaatgacagcttttgaaatttttaaataaatacttttggggtttgtgtcctcagggaggaccctgtttagctggaaagacaatagactaaaagcagcaggccttacggtcagctttctaaccttccccagtgtttgcaaagtgttaggcttatttctgaaccagtattttggtaggttccagctttcatgatccgggaagtgtgttgttcaccttcctttccctgttactcaacaccttgtcctgcagcacagatttctccagcatagacagaaaatacaaaatgcataagtcctggtaatgatacagaggaaggcctctatttgcatacccttcataattcaatttaatttttttttgtcaagagttctgaatgctttgtgtttgctttaatcagaatgttgacatttacactgaagccaatttctctttttcttctccatgttttgtttaactacgacaagtgacagcaaactggaaagaacagactttttaaattggctccttgcccagaatgcatcatttctcttgtagctttccccccttcctatgcatcgcaagaggaaatgtgaaaacatactttgcgaacacaagagtgaggtgttactgcttttagataaagatttgtgttgtattttaaaaccagattgctgtacagtttcgagctattagcaggagcttattacgccatggctccaggtccttggagaaatatgcttagtatatttcagtaattcaaggcaaatagaaaactatatgtgaaaatacttaaaggcaaaaagcatcaactcctgaaggctgcagaaagcaataaacaagcatggcacctgccattaactcttttcaaaaacaatttatctaattgctccctgtcatgccccaaattgtggagagaagaaccaatgtgaaaatgaacctgtgatattagccattcagaaaagcaacaagcaatagtgcagcaagcacgttgccctctttagcagagcatgctgttgttgggtttcacgcttgatctctaacagttctatgagaatgtagcttataattgaattagaatttgcccatctatcagattcaatggtttaaatcagaaataagtttgtgaatggctttatcaaacacaaaggaaaaatacagcaccaaagacctacctggttaggtaggttaggtacctggttaggtaggtctttgtgtcccttcatggaatttaattctgactcaacaaagagacaggaaacaaaacgattgggtttcaaataaagcagatgttgaagtcatagtttactctgctagaatatcatctttagagtgactgaggtaccaccctgccttcaggcagaaatctcttctaaaacccttgcaaatatacctttttcccgtgtattcagaaatcagaaggaaatagatactataaatatcaaagatttacctgaagagaatcagaaaatcaaatgagagagtgacgtactcttcctgtttttttgtattttgtttttgagatagggtctccctctgtcacccaggctagagtgcagtggtgtgatcactgcgcactgaagccttgacttcctggggtcagctgatgctcctaccctaattttttgtattttttttttttatagagacgaggtttcgccatgttgtccagactgatcttgaattcatgggctcaagcaatctgcccccaaagtgctgagattacaggcatgagctatcacacccgtactctgatctttctattgcttagctaccatagtgtttcactaaccgggggcttcactaacatggaggattcactaacatgggatctcacataatggtcatcacaaagtacatagagaaaacaacaagtgattttcaaattcttaattctaatttatttctgtgaactcaatgtaattgctctcaaattgcattttgttaactgaaaaattatagaaagtagatttgtaccttataatgtaagcattattgcatcaaaatatattttcagttatatttgcacatatatgtattcatatgtgaattcagttatgacataaaatgcatttcctactgtgggtcagcaatcaaattttcaaaacactaaaaatgtaaacatacccaaatacaccttatctatccactgtgcttcaaattctacctttcaccacttttggggcatgcaaatacatcagagaggaaatctattcctgacagataaatgtaagtttatcagatgcttcttttgccctgagaagtctctctaggggaacacaagggaacttagtaccatagcaaaaagataaacaatccctggtatatacaaaataaaaaatgtacatttatttttaaaaaatgagtgaagagtgttcacatggaagatagacaagaaaagcaaggtaacagaaaaaatcaccacaaatcttaccagctgctgacagggaatctattcatgtctatgaaagggatatgaggatagaatgggtggaaagagagaagccatattcaattgatcaacctaggattttgagagattatttggggcaagaactggagtgtactaatttcttaagtcttaagt

SEQ ID NO: 1025 - DNA, 1535 bp, Homo sapiens
aagatccttctggccagatgttcagcatgacccacaccctgccttttgtgtcagtgtcccccttcccagatgcaagcatctgggttcagccagagcaattggtgcgggtatgtgaggccccactctatccaaatggagtatgcatttttgataaagggccagcagaggggacatgacgtttgttcctggggcaggaggacagaggggaaaaaaatggagtcacctcctcccctcctgtgtgaaggtttagaagctatagaagtttgcagggagaagggcagctgtttggagggacagccttaggctcacagaggtcacaagggaatgctagtggcagctgtaccatggatagttttgggtgggagacgcaaagagagaatcccattcagagaacagagtttgaaaaagacaagggagcagaatgccgctgcttaggaagctgaagggatttctactctcacctccttaggaccccacagcatccttcatctcccttcaattctccttgttctccaaccctgccctcaagctcagagagagagagagaaaataagaaagcaacctgaatttatgccaagagagaaactgcagctcctcaacaaatggaaggcagggtcatcctcctaatattttgaatgtggactgttccagagagcagcaagacatgtcaggaatgagattggtttgagcagggccccaggaacactgccgggctccaccagggagatgaaagaattttctccttcctttgccttttaaatgtaattctgtctgccctctgcaccccgcaccctctcgaccctctagctgggagcggtgcggacatttagccatcctgggaaaagacaggatccttttcattaactccagcctgattggagtccctagggccatggcgaatttcattttactccctctctgcctccctgtcttggatccccctcaaccctagacacaacaaggctaccatgagcagtgaactgtttcccaatgggatggagtggagatagggttcaagcaggagaggcagtagagaagggtctaggatgtgcgcttttcaaggcagtggctttgaggagggacatgtgtacttcctccccatgcctcaatttcccctggatttctgagcaaatctatcccagctttagggtagaaatcagcagccagttatgtctggttgtcagcgctggattggacagatataatctcgagtggagatttctgcagaggtgctcagggttagcagacttaaccaatcctatttttaactagcaatgtgatcttgaaaatgtcacttatcagcttcttctgcaaaataaggacttagtctggagttttaaggtatgttttagtaccaaacattggttttcaactgaagtcgcatacaagaaccagggaaaagcagagccactctgagtgaaggtagagagacaggcacagtgcacgccctttgtctacacattttctcaccccagtttcccagcagaggtggctcctgagcccactggggacacaatgattttctcctcttctcc

SEQ ID NO: 1026 - DNA, 7670 bp, Homo sapiens
agcactttggtaggctaaggcaggcagatcacctgaggtcaggagttcaagaccagcatgaccaacatggcaaaaccctgtcactactactaatacaaaaattattagctgagcatggtggcatgcacctgtaatcctacctactcaggaggttgaaacacgcaaattgcttgaacctgggcagtagaggttgcagtgagcagagatggcaccactgcactccagccttggcaatgaagtgagactccacatcaaaaagaaaagaaaaaagaaaacagtttcaattggaacagaaatcccaactgcagattgctttgaagtgagtgaagaagagccatcttttgggcagctagaatgcaggcctgaggaggacactagacaattagttttgaataatgcacaaaaataagcattttccttcatggaagccaaaaatgcatagtctattactacccctcttcaactagcacatgaaccttagcagctgataaaatttatctatgcttaaaataggtaatcccttttctgtccctaccatgtatgtccaaagctgaccccggtaatcaatccactccctcctggtcagcctctatgtggtcaaggtctcccgcttggtacattgctccttctccattcctgttccacattccatcatagacacaagcatatacgtgagatgccactaggaattctgaaaggaatgagaaagtatacctggcctgactaacccctcctttctcccgtccatctttttacaaacatttggtatctactatgtgctgaacacattaccatgcattttttcaaaggtgaaagtaaatattatatagtttttatcttcacagtacttactctgtatgttatggttgaactctctccctcactcccctctctctctctctctctgtttctctcatgcattcatacatgaatgcatacaagactataatattgggattaaatacgaattgcatattgtctccatttctattgtgccttgtattatagggtcaagtaagtgttagaatgatttgaatctactgggcctcattggccttagccttctgcaagtagagccttcctcccagggaattcagacagcttgggaaccccaagcaagatagaagtggagagagactagaacaacaaatagaagtgccagaggaggcaaacagaaaatctggtccccttttgcatacattttctatatcgaaccaatgttttaacagcagaatgctccaaagggcatagattggtggtgtggcctccatttctcctgaaggctttgttcttccagactactcagtctgttgttaatcctcctgcagacagtaaatggtccaggtaagggcttcattcgtggctgcttttaagagatactgaatgagagagtccttgggaggtcaacaattaaatctagatacatgaagatgacagaataggacaataaatatttgggagcttgctaatttgtgaaagtgtcctgctcagttccatttgggcttcctgagaaatgtctagaccacagctggacaccacatgggcccagagtttgatttccttgaacagaatttcaactgtaatacaggcaaataagcaactatgaggactcctcggaggatacttcccatcctccatctctgaatgctaggaacacaaaagccagaggttggaggaaagtagaaagtagagattttattttattttattttatttatttatttttgccatccaagggatggaatggtataacagtgttgctagtttttaatgaccatacaatttttgattctcctcccatcaagaagtgagatctttgaaccctccccttgaatctgggtgggcttctgtgaccactttgaccaattaagcatgatggaagcaatgcttgtgactgccgatgttaggtcataacaggccatgcaacttccaccttgtgctcttggaatactcattttggggaaaaccaggacccctgcaagaaattcaaataatctgcagctactgtgctgcagatgctaaatgagagggctttgtcaacagtcccagctgagccccactttccagccgtccccaccaaggcaccagacatgtaagtcaggctgtcttggctccttcagaccagcccttctgccagctgagaaccacttatttattattggtaaatgctgggtatgaaaaaaaaaaacaaccaaatgagccctgcctgaattcctgaactatgcaatccataggatataataaaatggatattgtcttaagcttctaagtttagggagggtttgctatgcagcaatgctgcccggaacagaagggcgcatggcctgagggtaaactgtcaaaggtcctgctgagggtgatctgggatggagaggaatgattgttcacaagttgatgctgccaagtgggtctgaattggagggcagggaagataaggatgctcctccattggctttttttttcttttactttttatttttcttttttaagatagggtctcattctgtcacccaggctggagtgcagtggcaagaacgtggctcactgcaggcttgacctcctgggcacaagggatcctgctgcctcaacctcccatgtagctgggaccacagacacatgccgtcatgtccagctaattttttttatttatctattttttgtagtgattggggtcttactttgttgtccaggttggtcttgaactcctggtctcaagagatcctcccacctcagcctcccaaagggattacaggtgtgagccactacacccagcccccactggcttttgaaataggaatactatcaaaaccctcacactcttaactccctattgaataacaagcctctactgaagtcacaataggcaagggtcctgacaacctattttgtggccccactgtgttacttaaggattgtattagttgactagggttgccatgacaaaataccacaaactaggtaacttaagcaacataaagctatgatcttacagttctggaggctagatgtctgaaatcaaggtgtctgtagcgttggctccctcctaggcctgtgaagtagaatctgttccatgcttctctgccagtttctgatggttttctggcaatcttgggcattcctgggcttatggaagctcaccccagtctctgccttcatcttcacatggtgtttctgtgtgaatatctatgttcaaatgtttcctttttataaggacaccagtcttactgaattagagcccatccaatgacttcttcataactcagcaaattacatctgcaataaccttatttccaaatctggtcacattctgaggtactagtattagggttccaacctatgaattttgggggcaattcaacccataatacgagctgcgtaatcttgtactattatggaaaataataataaacctccgctattagctcaaagagatgctgagggagttaaataatctaggtaaactggaaaaggctgtgcattggtttcaatgccgaaatctccctgctcccaccctgagcgacgcagcatgcgaggtgtgaggtgtgatgtcccacaagccaggtgctcagatgctgtgcctacatgagggtgtgggctgaatgggagtctcggtggcattttgcaaggggatttttttgtctggtgtttctgtgctgcgtgggatggagctcatttatgttattttcacttcctacattagcaatggcaggtgcacagttatggagaacttcatccctccctgtctgcttcaggggtttgtgtgtggtcaagtgggactgaagaaaagtagcacactcaacacaaggggtacaagacagcaaagaattccatccaggctacttctctcatgctgtccagctgggacaggtcacaagaagggggtaatattttagagatcttaaggcagggatctcagagtccaggagacaaagatgactgctgaaattcatcacctgcagccacttctctccttcctcagctcactctcaatggacacttgacccattacccccggagcccttgaagcagatgaacacagcagcagtgtgtccatgactgccaggggagagatgccttgggaagccctgtcagaggggcctgagtttacaggaaaagtctagtttcccagcaagggagacaggcattttttactcattttatcaaggccaagttgatttggaaccagtgcccactgattgcctgaatggaggtcaggactgtgtcgaaaatctgggcacatttccctttaagcatttgcacgttccatatttgaaagccaaatctgagtccagggacaaaatctgctttagtgagggcatctgggtgtcctgggatgagattgtgcaaagcagcccatcagaattccaggccctgggatcttccatgaaacctccctccggttttactgggataaaatgaagatgagatgactgaaaccaaagctcctagggaaggagaaatctcaaggaatagtgtatcagctgacattctctggggctgctatctcaaagcctaaagcagagaaacggaaaaagtctgctccccggtaagaagaaaatcaccagtttgaattgcagaatatgcactcaattcaccctctatccatcatacagatgggcatctccctgcagctttgtcctgtctcttttgcatccttcccctccccatgcctgttctcttctcctctacaattatgttcttgactctatgtgtgtcatagaaagaaataaaatttcaggtttaggagctggggttctcaaagtatgctctgaggtcaacctacatcagaattacctcttaggatagagaaaggcatcaaaaatcagagttcccagctctgtcttaagcctgtagaaaaagcaatttctggaggtggcatctgtttaggttcttggtatcaaagtgcggtccgaggatcagcaacaccaacagcacctggaagcttgttagaaatgcaggctctcaggcgacatcctggacccactgagtcagtgactgcattttagcaagcaagcccttccctccccaccgcaggtgaatcccagaggcatttatgcatattaatgctaaagggtctattaattatctgaccctccagacccagagctgggtttcccacccaaccctgtggtcttagtagcaagacaatgattcaagagacactttggccagctgccctcgatttccattctatttcatctggattaaaatagcaaagaaactacaaagcagcttcttgggacctgacttgtcagcatcgtatcttccctgcccccaccctgacactgtctttagacttcacatttcctgatttgcaaagcacaaacaatatttattatagcaccagtggaatctttgcgtggaataagagacccagctttatccattcacatttggtctagcacttcttttcgaatatggccaatattatttctaggtgcctcacactgacctttcagtgaagcactcgtatgtgtataaaatacctatgaagtgataaaaagaaattgatggttacttccagggaaagaaagaaggtggctttgaaaaatgggtgggtgagatgtcttcctgtattcccatttgtaaccactgaggtatgaacctttaccaagaaaaaataaatttaaagtagaaatcgaattgaaaatgatcccatctcttaattatcctactcagagacatttgccagctctcattcctcctgcatggttgtgaatgtttttgttggtaaatcaaccgtgcttgtatgtcccccagctctggatgcagagccaaacatttgcgtatcgattaaaagatgcattcttggaggtgaaaagagaagaaatttgagggtggagaaaaaggaaagaaaaaagaaatagcatatacgacaacacaaagatttaacctagaaaaaactagaagcttaggggaaattggaaattgtatgataggcttctctacttgtccccttctagctttatttattttgttccaaaaatcatgacatgctgctaacagaaactgaagtgtctagggtcacctgaagctcatcttccttgaatggcttcccaaatgttgccccaaatcactgttatacattctgggatccatggaaatgacaataagacctccagttaccattttgcacaaatattgaatgatgtgggatataggacaggaaaagggtaaaaataaagttactttctggaccttcttggaagaagtcccaatctcatgacttcattttgaaatggcaggaaaaacaaaacacattgaaatagggtttcagtagcagccccaacttagacgaatgcacagagaactgctgaagtgttcaaaatactgccaactggcacttacatatgcaaatgagttacaaatgtgagggtccaaattttgggttatgtgtgccaggaccgaggggacagagagagcatgtgtctatttccagactgcaccttttttagaagcttatttctacattgtcagcttccctgaaacctttatctcacattttgaatgataaacatatttttaattctataacctgatagacatttcaaagagactattctgtgtatctggaggtggtatcttggtttaaagaaccacagtgttgaacaacatgtctctcatcaatagcatcattttttttttttttaagatcatcaaggtctgatctgctggcaaaatgcttttgctgaaaaataaaaatgtcactaggacccagggtttaatgaagatgcactaaaaaagatgcactacatttttattctcctccaagaaaatctattatagtgtttcaaaagtgagatgtcatcctcaaaatgtctttttcttcttggcttcatgtacaggagttaagccagagctaactcacaaagcgcttccttggtttcctcactcccaaattgctgctgctcgcatccctgatctagtcacacactgggcctggctttgccctgggaaagacagcgcatcgaccctcctgctgggtggatactcaccccagtgaccaaggtccttcccaactgctgggtctccttgtggttctctgttcatcttgctctgtacctgtcttgcccttccgggtctcctggctctcgcctatttacaaagtactgggttttgcatctagccttatcgcctgacatttatatcctggtttttatctgtacacctggcctctgacctgccccttgctctaaatatcatgcttcacaggtgccttgtctggcctgctgactccttggtgactcaacgccctctcaaagctctatcatgccaagttcttgcattagaacaattgtttctgattcccctggctgcatccaattggtgggcatgcataacctctgattcagtttaatccagtccagagttattaaaaaagcagatttaaccaaagcagtacctttttgctagttactgtactgaagtcacaaacacaacagagacaaataaagagcaacaaaatcctcaaataaacatacatctaataaaaaattacaaataattaatatgtgccatcatacttgagccatgaataaaaaagtatttcatttggggaaaagggaagagagaagctgcaatgtccactttctgcaagtctccacaacagagtgtacatgagagggaaatgaattccaggctcttcttgccagaaatgcaacctgtcttcc

SEQ ID NO: 1027 - DNA, 1801 bp, Homo sapiens
tgccttggccaaattagaacacgtgatgacaagtgggctggattacaacgtccatctttcacaatctcaatttttaataattttttcagaaatggtagattatacacatttttcccttcttaagaaatatacagttggtaccatcgaattgagtccaagccttaattaaaagcagcatgaggtctttgaccagagggtcaggacatgtgtatttgtgtcctattacagccaataaccaactgcatgatttgggcaaaagacttttaaccctcccgaaccttggctccttacctaaaaaatagagcatctctaaagtctcttataaatgtaaatttccataaattatttacttgaaaaacaatattgtgtcattactttgggattccctgaggatttgaatgcaaactttttatagcagaaaagttgacggattttgtatttcagctaaaattacttggatcaaagagacattctggcacatgagaatttataaactaacatttttagaggcaatgtcagcatcagcaagtgaaacaggttctttaaaaagtaacgtacaaatacggctgcacaaatactgccgcacatgtgaaggggtgtttgcaaaacaaatcaataaaggcacatccaacaatggattgcagttaataaactacatatagtaattaccaccaatgccagtccagaaagtcattcattaaatgttaattgtcacacaaaagtacaaaagcacccatttgaacaatcaatcgtgtggctgcacctttaaataaaatactttcttacagccctgaaattcacccacataaactgattttaaacacacctgggtatttgatatgctgattaactgggcctttatctttgaaatgaaagtaaacatgacaaccttttcaacattttcactattcctgcaagtctaatataaatatatatatatatatttacctatatataacttataacaaagtgttaatcttctccaaagattaaattattatttctcttatatctctctcctaagtattaagagagatatgggtcaaaagtatccacataaaacccatgtgcataccttattcctagtcaattggctcacgaatgtacaaaatgggtagctcacatataagctaataaacctggtggtcagttgtgaaaattttacccagagtaataagaaaccagtaacaaaaataaccttttaaaaaatctgtaatgtattttacattttctaatacttagcactatctaattaacttggaagaacaaacacctggccataaaaaatagctcataaaatacaaaaaaaaaaataataaagaaagggcagatttttctgttcctacttagcttcattttcatgctatgtctgtataaaatctgacttattcaacttacatatagattctaaaggtttggccaagaacattttggtttaagacttgtaaactgaagaacatttcaaaacacaccatgttccttattaggcaacttaagatctgttatcttggcttatgggaacagatctaaatagcatcataatactaaacgttgaaaatcacaggcctggggccaccaggactcaactctatgacttggacgaggttgcaaacttccaatataaaatgtagtttaccattaggagtaaatgtttgatctttaaagcttacaaaattactttgtttatcatagcagatgaaagcaaaaaggaataattttaagctcaaaacaaaactgtttatatgacagtctttactgctccatgattctaagcatttaagacagattcgagcaattaaca

SEQ ID NO: 1028 - DNA, 3015 bp, Homo sapiens
ttcatgaagtggggagttgggtacctgcttcctgttgcggtgtttcatcttattgttaaagtcttccttgtattttcaggaacgctgtcatagtagccggcatctggcttgtccacggagttcagggtacttagcttcctattaggagaaaacgttttctgtctatctttctttctgtctatctttcaaagtagcctcattgttcttcagtgatgtcccaatttgtcccgggtgtggctggcgagggcgcgtggccccggaggtgctggtggtcctgtgggtccatgcctcctccctgtgtgtgagggaagagctgccccgctctgctttttattgtattcagcaaacatttgcaggtgctgtaggggccttgcaactacattttgcgtaagttgggtcaaatcaaattcacagactcaccaaactcatactggccactgccctcctcgtgcttgtcctctggacccagttacacacctgtcccccctttcctgtggcagggccggatcgtggcacccagaggctgccaggactttggctgggacccctgctttcagcctgatggatatgagcagacgtaaggagccctgcttttcttccctggggtgtggggttggtacagccatggtttgggttgggccagtgccccgcccaagtgcaggcatgcggatatgggcaggggaggctcccagggtgctgttccagccacaggcagctctgctggggtggacactaggaatctgggtggcccagtccatggttggggaggcagccagatggcactgagagtcctgggctctaaggctccaggtcaccccacatcagctgtgtagccagtggtttcgcctttctggccttggcttgtaagctgtacatctgacttttttttttttttttttgagatggagtttcactcttgttgcccaggctggagtgcaacggcgtgatctcaactcactgcaccctctgcctcccaggttcaagcaattctcctgtctcagctgagattacaggcacgcaccaccgtgctcagctaatttttgttatttttgttagagacggggtttcaccatgttggccaggctggtctcaaactgacctcaggtgatccgcccacctcggcctcccaaagtgctgggattacaggcgtgagccaccgcgcctggccacatctgacagttttatggcatcattttctgacccccatctaggttgggaaaatgtccaggcttttgcagcctctggtgggcactattttatgccctccaagtaccagttgttctctgtagttcgcacaaatcgccccttgttcacacaaggcacgggccattgttggaatcaggctttccaagctggaggggcccttagggagcgcagtgtgaggccccacaatagccccagcaggggtgaggacattgtggaaccagccactagccatatggggctgtggagcacttgcgtgtggtgagacccagaaacggaatatttctgttcagcgttaattcatttaaatagccacacctggctagtggctactggccgccgtcttgcacagagcagtctgcaggccacgggcggggtatgggattctcacctcactgcggtgctggcatggaggtcgggcccctggccagctgttcaagtgctcccccgccctcagcgcatgagaggagactgctgtgtttgctctgtcaggccccactgcttcctgtcaacagatgacaaagctgatcaaacatgcagctcatccccccctgtccccagcttcccttaatgacttttgggcacactagagcaagtttaatacccctccatgctcattcatgggggtttctgcctacaggggaattgaaaactttatccgatttttaaaaattcactggctgccaggagctgctgggccccactcccctttccttggggtctgtgagctttggtctccagggatgagatgaggtagggttgggagggggtgcacttccttcctgaatctgggctccctgagctgctactgtcacccctcaggtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaccctgccccaggcaggtgtctgtctcagtctcctttggcaggtgcaggaagttttttgggtgggggtggggatggggacacgggcagcaccgtgtggaaggcattcggatgccactgtgagctggagtgttacgtctccactcgagttcttgcctcattcaatggcatggattgcgggctgacctccaccctggatccatgctgccccccacccgcaggtagtgccagggcctccatgaagccttgctgggttgggggctgggtagtgtggcacgcccagtgcttttgccttatgctgttacacatcagagccgcgaaaatgttggtttacaattacaatggccagttcatttttatggtggggaggggctggagtcctcgaccccactcggcgtgatcgccacagttcagcctgcgggctgcaggcccctcgggaggccctgcttatgccacacgcccttactctgtgccctggcgaagccattccctggaagg

SEQ ID NO: 1029 - DNA, 2103 bp, Homo sapiens
gtccacggtacacatggacaagaaaatgcctacagtgtggttggaaaataatttgatgagcactgggacaatgcaactgggccacagaaagagaggcagggaaggctttgtgagaagcggaggaggtaccgcacccggaagacaaagtttttacagtgccccaggaaaagtgggagcaacaggctttactaagacagatgaaagcacgtgaaacagaagcttgaagccactcatcactgcagggggaagctgggtagcatccagactgccatccttcggtgcaattcctgagagaccaatccctcaagttgcatgggtattttgtcatgagaaggtcactgggatggcagactggtattctgatggctgcagcagcccatgttccttttgctcagacatgttaagggagccaggctttttaggatgtgttgatcttcattttggcctgctccatttgatcaatatgtgatgagtatgtctaaagatggcatgaatgttcctgctgcattttttttcaagcaaaggagaaaagactctacctctgtgaacctccgtttagactcatcaaactcgggtctcatgaaagcagccaggagggagaagcaaggaagctgattgctgttgccttggtaaggggaatccactccactcaggtccctgtggtttccatgggaacagcaccgcttgcttctgcaggcccccagggctggcgggatgcactgaaaggaaaattgggggatgaaagagaggagcagaaagagactttgaggaccttgaaggtatttggggaatgactctcagctggatgaggctgctccgttctccctgcataggtagctgctgttaacaggccatgtgggccatgtggccccaacaggctgagtaccagaagcacctgcctagaggcacatgcatttatgcagctctcatggactaatcaccatccaggtaaacagatgccaatgcaagacaggaaggaactggcaatatgtggatttcaacatcaagaccagagatgaatgtgtcctctgcccacaccaggccagcatgtcattgttgttataatttagaataatgatatgtgaccccaggaagcatggcggtaggtatttcacattcactatctacactcttcataacaaccctgcagggatgacatcaacacacccatctacagatgaaggaaatgaggcccggtgtggcacagaaggagatctggacccgagcctgattctccactgtgggatcttattcaaaatctaactgatcacccaaggaaaatgttagttcccaaatacagcaagcatcctagctcaagccttaaaaaatgcgctgagtacttttggatttggcgctaggatgcacacctggagagggtgacatcagcaccagccatcagctctgggaggcgctagaggccccacattgtcttacctcttgttctagaagtgaaccaactgaggccaagaagcacttggcagagccttccagtccagtgcaccacactgtccgcatacactcttttcttggacagctgcagctattcagaaaatcgcatgccccacacacacctgcaaggcaccagagtgtgtcgccagttgaagagctgttgcagtctccaggaggaaagcacagctgctgttgcagctcttttcttgaaccactgggtcaactgggcagagtggatttaccccatccatgcctaaggtctgttctcagagttcttcatcccactgagacttatcaggcatctgctgtgtgcactgcagtgtactgtgtttggaccagaggcaatgggaaggaggatcctcagaggccacttttcaaatggccaaaaggcaaattgagtcccagagagatgaaatgacaggtggccaaagccacactttggaaatgttggcattgagccccacatttccagattcccaattgaggacacttttcttgactccaggctgaccccttccttaggaagattaaacactgtgataccaaattgctttagaaccacagcaaggcaacgagtgaaataacaatgttattagtaggctgtgtatatagcacgcacgtaggagctgacaaagatcaatgacaatccttatg

SEQ ID NO: 1030 - DNA, 1470 bp, Homo sapiens
tcctgtgaccttgagtaagttacttcctgaatccattgtccattggagatgatcttcattgaacaaatgtatattcagcaagtggatgttagaaagtgatgagcaagtagaatgagtttacaaccatcacgtagactaacctcttatacaggtggaaaaatctaagaccttgagagcctgggtgacttccagtagcagagtcaggattaaaatcctggtctccttgtttgttccttcagctaagatgaatgaacaatattatgcagtttgcacactgcctcccaataaccaggctgtctcaaataaccaactaacacggtttctctgagaagcttgtatatttaccccttttgtgcttagatacatttgagaagtgatggttactaccttaatagtcatgtatgcaaaaccctatgcctgtagtcaattcattcctacctcattcaccatatatttactgagcgcccaatgcttgttctggataccgtggtaagcaaagacagtccctgttctcgtggagcttccactgtattctaatgtacctgactgcagagggccttggagatctttctcagccaaatatagtatttttctttccttggctggaccaaaggtgaaggtagataatagaatgatgggtgttactcccagcactaagagtacctaacatttatcttactgtgtatgactaatttcacatgactctgtgagatgaggcaggcctattagcctgatttatagatgaagaaacaggattagagagcaaacatagtgttatggttgagagcatggactctggcatcaggcagcctagatttgaataccgtaatgactctaacactcatgtagctgtgttttgggtaagttactcaacctctctgcacctgtttccttgcctttagatacaataataatagtatgtctgtttcaatcatgtaatagttgtaaagtatttagaaccctgcctggtacttaataagggctatataattgctaaataaatttgtggcagggtgcagtgtctcacgcctgtaatcccagcactttgggaggccaaggcaggtggatcacaaggtcaggagttcgagaccagcctggccaatatggtgaaaccccatctctactaaaaacacaaaaattagctgggtgtggtggcaggcgcctgtagtcccagctactcgggaggctgaggcagaagaatcccttgaacccaggaggcggaagttgcagtaagccgagatcgcgccactgcactacagcctgggtgacagagtgagactccgtctcaaaaaaaaaaaaaaaaaattgcctggggctttatcagtagttgttagtaggtatggtttgaatctggacatgtctgattccgaagcctgagggcttagcaactggcactatgctgcttccctttggcatcgagctcagcctgtggatcagggcaccataacctcagaacagtgccaagttgaa

SEQ ID NO: 1031 - DNA, 2198 bp, Homo sapiens
agccgggcctgatggcgggcacctgtagtcccagctactcgggaggctgaggcaggagaatcgcttcaacacgggaggcggaggttgtagtaagccgagatcgggccactgcactccagcctggcgacagagcgaggcgctgtctcaagaaaaaaaaaaaaagagactcactttctggccttccctcattgtcttttggcccccagggtccctttgacatggacagctgcttatcaagacactccatcaacccctacagtaacagggagagcaggatcctcttcagcacctggaacctggatcacatgtaagctcacagagcgaggttcagacccacgagtgcctgcagggccctgtccctgccgtggccctgtccctgccatggccctgtccctgccacggccctgtccctgccacggtgttgcctccttgggtttcaagggctgcacccgtgttacagcccagggaaggggtacctgatggcagcatagggggctgctgagtgggcacacaccattccctccactgtcagcatgtgtacctgacccggagccagccctcctgtcccctccagtcctccctgtggatggagctggtgggcagcgtccttccccagaacacaggtcccagcccttggctgtcagaggttctgaacctctgtgagtttgaaccagggtgagctcagacagcgggagctcctggtgttatgataggtaagggtgtttttccctttttctttttcttttagagatggagtcttgctctgtggcccaggctaaagtgcagtggcaggatcatggctcactgaagccctgaactcctggcctcaagcaatcctcctgcctcagcctcctgagtcgctgggactacaggtgctcgccaccatgcctggctggcttattttgtggaaccagcatgagcagaagtctcagcaggcaggagtgtttcacagccgtacgagctctatggctctaacaaatgggcaggatggaaaacttcattcttttaaactgagatgcattccttgaatataattgtagccttgcccttgctttttgaagacagaagccttcaaatgcccttaaaatggctgtacaggatgagcatccctaatctgaaaacctgaaatccgaagtgctccaaaattcaaaacgttttgcgaccaacatgacgctcagaggagatgctcatccgggcatttaggatttgggatttttttttttttttttctgagatggagttttgctcttgttgcccaggctggagtgcaatgatgtgatctcggctcaccgcaacctccgcctcccgggttcaagcgattctcctactttagcttccccagtagctgggattacaggcacgtggcaccacgtccagctaattttgtatttttagtagagacgggatttctccatgttggtcaggctggtcttgaactcctgacctcaggtgatccgcccgcctcagtctcccaaagttctggggttacaggtgtgagccactgcatccggccagatgtgggatttttttaaggatgctcagctagtcagtataatgtaaatattccaaaatcctaaaaaaatcccaaatccaaaacacttctggtccccagcatttcagatggggacattcaacctgtattgctttcggagtgagatttttttttaaagtatgtaaaacactatggtcatagttgagcttttaccctgtccatactcagcctctacaccttgccccgagggaaaacacttgtgaaaggtgtgtgtgcccttcagagccctctcactgcacctttaccacaagcgtgtgagtttatcatgtacatacatggtggcccacgctgtcatctgcagagccgtgtagctgcacctttaccacacgcgtgtgagtttaacatgcacgtacgtggcctcccacgctgtggtctgcagagccgtgtagctacacctttaccacacgcatgtgagtttaacatgtacatatgtggcctcccatgctgtggtctgcagagccgtgtagctgcacctttaccacacgcgtgtgggtttaacatgcacatacgtggtggcccacgctgtggtctgcagagccgtgtagctgcacctttaccacacgcgtgtgggtttaacatgcacatacgtggcctcccacgctgtggtctgcagagccgtgtagctgcacctttaccacacgcgtgt

SEQ ID NO: 1032 - DNA, 2131 bp, Homo sapiens
gaggaggatgcttgcccttcacttgctgaaaaggggaaccctctgtttacactcttgtgtgtattccaagctcggtgtgcccttcccatgtgccaggggctgagaacgttacaacctcattatagaaaagaatgttcccagattccattcatcttacgaaaagcgtccctgttcttgacatgccgtgtaaggacgcgcttttaaatgaaaacgaggctttcagcaaaaaaccaatctgtttaaaacaacctgtggagttatgagagatgtgcttttgactaatgagcgcaaactttatgcaagcagagtgctcaattatggatgagctaattacatgggcacgtcgtgtttggattgcggagatgtctctacctctcttcctcagacgaggctccggtccgctagtggtgatgattagtgaaaccttggtctcatgttatgttgctaggcataaataatcacttaattttgtgactcaatctccatcaatcacatgggtgtgccttaggggttttctatcagtgcaggatgcaggaacccaggaaggatccctcggcctctgcaacacctggttgtgatggggctcagcctggaagtgtggtctctgggtgtagtgagagctcctcttgggagcaggctgtgctggcagaagctccctccttcctgtctgcagggtggctctccgtgagctctgcagggtggctctccgtgagctctgcagaggcaccctgtggacaccagctgagaagagcaggccagcagatgcatttttaggatcgagaaggttgagttcttagagtccttgagcttttgtgcagaggcaggccttcctcagaccctgtctcttgaaggtgataaaagcccagagtgttgttttttaaaaaattttatttcagggcttggtcattgagttgcacttccaggagtatcttttctttcctttattccccagaaaaagcaaaactaattgtcttcctttctttgcttacaaggtaacaatagcaactaattatgcagtgtgttgatgatgtctgggcattgtgctgttttacatatatagtctactttaatccttagtacattcatgttggttgatgagcaaatgagcaaattcaggcagagaggagctaaattatttgttcggtcttccaaagctaccgagtatccgagcccacagtgggatctgactgttgaacttcaaagctcacacttataaccacttcattgtgccacctgtagagcagctgagcacctactggctgaccacgtgcaaaaataaggtcctccttttcccctcaagcaacctgtacgctggggaagaggcttcatgaatcccagccactgtaacacaacctgggttgaaacggtaattaaatcttcaaggtgttacctgtagcttgattctacaagttaaaaaatattagcagattgtgtttgcacttttgtaatttgtaaatattattcactgcatagccacatagtgaactatgatttcttttttcttgtatgtatttttccctcagaaaattctagtttcctttttttttcttgcatggtctatcattagcttacccttaaattcctgtagcctctctgtaacagtaacaagtctctgaaatttcattaaaaaaaaaaaacaaaaaaacaggcaactccctctgggaattcttttgcaagctccaaatgaagcaactgcatcccaggatggctcgtccattaacatcttgggatagccttcatctctcccctgaattggatcctccaatttcttacttctttttttatggtgggtggggaggaactacatccttaagtaatttttcttttttattaatacatgtctaatttttaatagtttagatttacagaaaagttatgaagacagtatggtgtcaacttgaaacgatcaaaaggatcagaatccagttttaaagagtctatttaagcaaaaagctgggaatagccatcctggagacacagactctggagaaatggggtcagtgttctgaaattaaaagtgaaggtattgctttataggtagaaggcaaagaaatttaacaggactacaatatttcctatgcaaatctggtttatgagctacaataatttaattagttacagtttgttctct

SEQ ID NO: 1033 - DNA, 1555 bp, Homo sapiens
cagtagggtgttgcgtgtttggtcatccctgtgaccctcgggtgggagtccctccctcccaaacagggtgaggaggaggttctcagaacaatttcgtaggtgaaatccacaaagggaaatagaagtttgctgacagcaagactgttctcctgaccagctgtctccaaggagggccagcagccctggagtgaggagacagagctccctccttccctccaaccccactgtcagcccggacttgccccaccccacagtgtcaggctctgcacaccctggtctcagctgctcttgcccacttgacagtgaggctttggggtcagggactgggttctgttcacatctctgtcctgaatcctagcgcggggcctgaccctgggctgtttgttgaatgaattagcgaaagaatgatgagtggggaaggaactgtctgaggccaatccaaacgtccatccaattatacctaccactctggtctccagggtcagatcgaagcccctgaaaaaaatccttcacaacaggaaaggccaggaggggtttgcatagcttttcttccaatttgctatagggttttaaaaacatacatgcaaataaaaataactgaacacactgtgtgtccacagtctgggctaaggaaggcagacggtggaggtttggttgattgttgatgcctctgatggtccttaagcaccatcagctgctacagtgaggaactgtgaaggtgaggtgaggagggaaggactctgggcctccacctccagcttcaggccggaagagacaacagctgaggccggtgtgagaagcagatttcaggagaacaggtcaggctttctgctaacccagcagtttgcattttccctgataacaacaaacagcacatgaaagtggaagaaaaataccagagcattcatttttctcctgcttgggccaaagacaaagatgcagggtagttcatgaccaaaaatggcctgggaattaccagtgcatttcttgcctagtggtcgatgaggcgccatcagcaacattcactattttggatgatagaagctaaacgctgcatgttcttgagtacatgcaaaagaaaactgaccagtaaatccaatcccaggttgatatggtctggctgtgtccccacccaaatctcattttgaattgtagctcccataattcccctgtgttgtgggagggacctggtgggagataattgaatcatgggggtggtttcccccatactgttctcatggtagtgaataagtctcatgagatctgatggttttataaagggtttcccccttttgcttggttctcatttctctcttgcctgccaccatgtaagctgtgccttttgccttccaccatgattgtgaggcctcctcagtcacgtggaaccatgagtccattaaacctcttttctttataaattacccagtctcgggtatgtctttatcagcagcgtgaaaatggactaatacacaggcgtatacccaagagaagtgaagacacatgtccccatggaaacctgtctgagaatgttcatagcagcctgactcataggcac

SEQ ID NO: 1034 - DNA, 2873 bp, Homo sapiens
gccatattttagcgtcaggaaaagccatgcttagagggattggtcttcaaaattttgtgtgtgatgcccaatgtgtaggccatattgaaaggtgaacgcaccaaaggatcgaccctgtcaccttggatggtctctattttgaccctgttgcccatggagaggtattttacccttttgcttctttgctcaggtggtccagggttgtctgtagcccaggaagcggactgaccctgtatcttgaaagataagaccaggaaccgggagtgaggctgggactctcactcagccttttcacggtcagtcttggtcttctcatacttatttcaagatggcaccaggacacaccttcttttgtccacctgttgacaccatcaccctctttcatcaaggtgatctctttcatcagggcatatatgagacttggtgctccaccagactgtcttctcccctacccctgccccttccacaaagccatttctcaagtcgcagtgggaaaagataccaagacacctgatttcttgaaccattcttgcttcagcatgtgaattctttaagacactactcacatatgccattggagagaaacaacccgttctgcatcaccataatgaaccgatcagtcattcatcctcttattcaacaaatacttgttccacttctaccacactggccatacagttggaggcaagatgggcacagttatggccttgtgggctttatattctacagtgggaggaggtggatggttaatgtgaaagcaaaccaaaataatttccagagagagaagaggcaggaagagagcagagcagagtgatggggctgggggcagagaaggagagaggggaagagggagagagtggggggcattgaaggggaagaaagagaggcaggggttgtctacgtctcctcctcctgcgacccatcacctactggaaaattaccacttgctgcttgagggttggtctggtgttggatggaggaagaaggccttagtcttagctcttggataaaatgcagtgcagcactgaagataagacatcgcagttgttacgacgcctggttctccaccaaattcctctgtcattccagcaagagtggaagcagaggggcaggggcaggggcaggatgagggctgctgccctggtgatgagcttgccccatccctgggcactggctctgcccagcccctcccatgttggtcccatctgtcaggttgccaggccaagcaggtctcaggtcagccaggtctcaaggaggataagggggttcaacgtcagcgacttggcccacggggcacgggcaccttggggatgccattcttcttggtgccagaaggcagctgcatctccagaagctcccccagcactgagctcacttagtggcatccttcttaaacagcatctgcttttaagtaagcagctattccaaaacatgccgtgattcatgtaatttttgagtggttactttggtgcagtttgtcaatttgctctaccatactgttttttgattatttgtttgttttctagtgtaaatagcacagcccacataaatgagcgaaactcatcatctgaggatctttgattattcttccccacttattgtacattgatgtgccgcctgctaggaagataaactccctctttgctcactctgagccaggatctctgtgttagttacactcagccttatctgagcattccagggaggtcttaaatgaatgtttggggttttgaaacatgctaccagcccttccttccaaagagcatgaagcatggctctgtgtggttttgtgtgtctaggtttagagcttgtatttggatgtaaggagtgactaaaaacaggtctaggcagagaactgctatcttttaaaccaccccagccctcagtcgaacagaaagaatgagcgtcttctgatgtcaaatcattctagaaaggtcttagctagtgagcacaaagtagccaatcccgggagtttatatgggcctccatgtgaccaagccatccctagctaggaaacttaactctttgcacaacctccctttatgctgaagggcccttgggaacatgggaacatttgcactttgtcagaggagtggccccaccctactctctgcctgaaacacaaagcagctcccctcagaacagccagcccggtgcagaagcacttgaacttctcatcttccatcttatttcactttggttgcagggagttaaatacataggccacagcagactaagggagcggtgtgcacaatggcccccagaatatccagtgacccaagtgatgttagtcttagggtccctaaggcagtagggcatggggaggaaagttctctccatcgattcccaaacacaccagccacaagtccacactccacacctgtaaacgcacagcccatgccccattgtaaaggtgactgaagagaatggtcaactcggtggtgatgggcctgttttggagctaaaagcataaaatgaatcctccctgtagctccattgccttttcctcgtgaaggattccctgctaaatgttctaagagttactgtacatagaatcaagagagcagttttgaatgagccgtaaatctgagtcatatataagaggcataatataaattgggccaagcttgcccatgtgggacacacaggtttatagagattaaacactagtgagtagcgggggaagggaacagtgactgtataaatggccatataaatgacctacttgtcttctcatgtaggctggaatcagaacctacgtatgctgtagataacagtcaattaaatgggttaatgttctaagccaagagagttctaagccaagacatgtgcttgggactggattaactcttgtcaatatcttggattccata

SEQ ID NO: 1035 - DNA, 2438 bp, Homo sapiens
cagctcccctatgcggcagccagacctggggccaagcgcagcctccctcgggtcactgcttggcctctgacatgtgctgtcctcttctgtcaaatggggatctaatcctattgaacaggattgtgcaggttaaaggaaaggcttcttatagtgcaaacaaagcaagcatggcctctgccctcacagagacttcttggagctcaaacagaacaaatgtggcctctgccctcatggagaccccagcagcagggatggctcagcctgccaactttcatgttgggggtgcatgcgatgccggggaggacttggctgggagacaccacccatcggaggctggttttgttctccctgagtgggtggtccccgcagagagagcggggcctgttagaggactccagggcagaggtgccttcctgatccaggaccctccagccctttgtctctggcctgtgtggctgggggacaccacgtggttggccagcagatggagggacagttgcctggaatcccagtctcagtggctgagcaaggcaccctggactccccaggtgtggctgtgctgcacacggctgccccggcttctcagcactcatggccggctctcgcttccccggaggcaccgacatctgcctgttcatcccagttgtcctgtttgctttggaaccaggagcatgatttacgtccgagtgcgtttttatgttttgcaccaaaggttttaaacagttcctagacaaaacaattctattttaatgcacagaattcctatcttgggttatcttctttacagccatatatgttttattagtttatttttattggcctatctccttgctagaacataagctccctgaggaccagggcacacctgtgtagcactctgttcccggtgcctaccacggggccaggcacgtagggagcctccagaaacaggttgagagggtgcacagaccggtgtttgcaggggccggctgtttatgtagctctccctttgtggcagctactctccgcccatctttctcttaatagttatggattatggaaaagaagaacaaagcgcattaagaggttcccctacatttgatttgaggaagttttcatccgaatggctccattgattggcctttcgcgtgcagccttattcccttctcacaaaatgaatattgccttgtctccttgagaaaaattgatttcagccagaaaggagaagagcaaactccctcctcctgctcttcttttttttttttccctcccaccgagacggaatttatctcttaggtaggtggggggtagaaataggaataattggaccagaagctaattcccagagattcattgtctcgaaagctcccaccagaatgtgagaagcttgccttgaattgcatgctaatgataaatgacaactctaacagaccgtcacattgagatgtttagtccttcctgctaggagatgacacattaattttctctcagatttacattggattcttaataaaatatcggtgttggaatatgacaagtgaggggccacggaagcaccaggcaccatttgggaggcatggactttggccggaggagactgcggtggggctgaacatgagccaggcgctgggtggcattggagcagggctcccatcactgtgctgggatggggcttacgtgacctggctgcaccaagcagcaggaatggctgatcctctttcttgactatagtgttgaatgcaaagacaggtgatgccattaattctctctcatcttaaacccccttttctttggcttgtcactgaccaaatgctttcagcgtaataagtgaagttttctatttttaagaaaagttgctgtttcttgattaatttgctcatttgatgaggacttatggagtgtttgctgtttacaagttatgaaggtagagaggcagaagcagcagccagacatgccaagtctaagtgatcatcccacttccctgcttcaaaacctccagttgcttccatggcctcgagagcaatgttcggaattctcggaggatccacaaagccccgggatctaacccctctggacgtgcagttccctttgtctggaaggcgcctctccccgttctttttggctgacttttactctctttaatccctcggcctactatcactttttcaaggggccggggaggtgggggtcataacccctctgccctggtctggacccagcctctctgtaggatgctgtcaggtgccctctgctttttcttccttgcgcttaccggagttgcactctccaggttaatttatgccgtcttacattttatgctacatttgtattaagattggagtcctcgcttttccttcatcgctgttaatacacgtgtacccttggttaattcgtgtctctcatcactcttacagtaaaatccaccctggttcaggagcccagattacttggggtgagcc

SEQ ID NO: 1036 - DNA, 1326 bp, Homo sapiens
ttgcagtgagccaagatcgcgcaactgcactcaagcctgggtgataaagctagactcagtgtcaaataataataataataataataataataatatagataaatataaaaaattctttttttgacatggagataggatttatatcacataaactttgcatacagtttttagtatcaccatcaatatgtgacagggtgatacatttgaactttaaagaggacatactctacagagtcaaaatggcagtattttaaaaagaaagaaaatgacagctgctagattttacttgagttgagttcttttggatttatatagacttatttatattttattttagagtttaaagataacttttgtctcttaagcatgatattaaaacaattcttagaatacttgtcatttcctgaattaggtaatattcatttcatccttaagcaatttgaagaggaaaagaaaaacagccagaaaaaaagtgatagttgttggttatgtgggaaagaatcaaagataatttgtttatgttctgtaaaattcagtttatacatatttgcaaaaaatcctcttcaggagtcagacatagttttttctctaatatttatgaatgtcatatttatcacttaaaattagccattatgattttaaaaactaaaaatgaaaagaaaaattaatgtagagtctgtgtaaatttagcaaacttttgttggtaagttatcaaataggtgggagttataaatgggcttagtactcatttgtaggtcaatagaaataatacaaatcagtggcaagatttttaaattcagaggccaaattattattattattgtggaaagttacttttttgttccttagaaagtgactatacaggcaaatctttggttttgtcaggtgtgatgatgtgtgcctgtagtcccggctaaggcaggaagatcacttgagcgcaagtgtttgagaccagtttgggtccctgtctcaaaaaacaaagcaaacaaagaaacaaacaaaaacaacaaactttggtctaggaggcaaggtactatttatcagtttcaagcaaacaaactcttctagagatatttttggtaaccacagtgaataaaagattgactgttagtaactattttcatttactagactgccctgaactactcatctgtgagttgagtattttttttttaagtgaaagcatgtttattaagaaaataaaggaataggctgggtgcggtggctcacccctgtaatcccagcactttgggaggccaaggtgggtggatcacctgaagtcaggagttcaagaccagccgggccaacatggtgaaaccccatctc

SEQ ID NO: 1037 - DNA, 2603 bp, Homo sapiens
accttcattccatccgcaacctggatcccccccttcccacgcaaggcgccatattcacaggttctggaggtttgaacatggacgtctttggggggccgttattctgctggccccgggagcattcccatggatcatgcacgggagcaggcatctcacttcccactcacaacaactcaaggaaatcagtactagcttactccattatatagagggggaaactgaggcccagggaggtctaggcttgctgaagccagtggtggagcttggagtcagactcaggcccagttcagctcagagaccaagctcctctgctcggctgcaccgggcggtggtggggcaggggtgtccccatgtgcagccatcggggaggggcagcccgaatcacctgctgtggatccagggaagacggatgacagcttgcaagaggtctgtcccctgcctcgccccaaggagcaaggtgaaggagccatgcttttataaaggggggaaattggacagcccgcagaggtggggagatactatctgctctaaatagttgtgcaccccaccccgccaccctctccctagcccatttgccctcatacgatttatttgctcatagaattgaaggccttcttttctggcaccattttctgttctgcttagacaaatatttagcagccaggcctgaccttaatttccttaaatatcaggggccctggaagctgaagagcctgcccagtgggtgaggacacggtgcacctggggtgccgaggatggctgggacgctgctacccttcccttggtgaggcctacctctccccaggacctaccaagtagccctgcaaactgtcaggtctccccactgttgagggtgtaacaagaggtagggtgcagatggcaggattccagtgactcagtgcccaacggagctgcatgctggccagggcctctctgctgggggtgatgggctgagcagtgatggagcctccccccgtctcccagggctccctcccttgtagggtgtggactggcctgcatatggagggaaggcagaggcaggagtggcggggatgccggtcatgtgggggctgccggggctgctgactctgtcattggctctgtctcccacgtggtcattcgtgaactcatttcattcattgcttcattgagaaacattcagtctcgtgctagcctagggatcggaaataaagtccacagctgccttgcaggagctgtgtcctggaaattggccagcgagaggaggggcatagagtcttgggcaaaggctggggtagaggagatagagatcgggactgtcctcataaaagagtgaccaagatgagttttggagcatgagtgaaacaagctccctgcaaaagactggctatctggaggaagcaggacaggccatcctaggggtgctgctgggaagaggaatggttggtgtcttcaggaggcagggacccttgggttctattctcagatcctgcctctgaagtcagctccaaagttcttggctctcctatctgtcccttgcccctgcctgtccctgcattttgtcctccctgtttgtgtaagtggggccactgccattttcccagccactcaattggaaaccaccattttctcagactaataccagctactgccctcaaggctttaagaacataacctcatctcattcgcaccgcagcctaggaagtaggcacgtgagttatctccattttgtggaaacggaggtctagagacatcatcactcctccagggtcacccagccagcatgttgtaaagctgagagtttgcaaagaagacaggaacagggagaagacattcctggcagggcacagcctgtgcgaagtcccagaggggagggagagcatggcacaggacagtgggtggtgggtgcagctgggtgtgccagcgagagtcgggggagaggtgtggttgtgattggatctcaagtgttttagaagtggcaacatttcctgggtgttaggttccaaaccaccttcacatctgtcatcttatttgatcctgttcagttgctgttgcagtaagcagctcagagaggtgaagaggtacccgaggatgcatagctaggaagtggcagagctgggccccagccctgctgtcatgtccccagcacctttgggggatggccaagaccaccagggcactctctagggaacagggttggaccaggacccctttgatggggaagggatggaagaagggagagtgggggccagggctcctgtcttgttttgccccaagatgcagagactggagccgccacactcagccctcaacactgtgaccttggacttgtcctcccgtcctctgggcctctgtctccctgtctgtaaaatgacaatctcctactcacactccaaatctctgttacggcagcatctcctccaggaagaccccctagcctctgcctccgcatcacctcctccaggaagccaccatggcctctccaaccgcattgcatgcctttactaaatgctcttagtgctccggactgccatactctatatccctcacctcacagcgtgactctgtgtaatatcttcctaggtctggatctcgatttgggacctgcccacattttagctact

SEQ ID NO: 1038 - DNA, 2232 bp, Homo sapiens
ttagacaagatcaatctgggaaatagtgccaggatcaaattgtgattctttagtataagaatcaagatgaacctgtttagatatgatattacatcttatcctgtcaggatatgtaccaagaagagatcccagtttatgagtatgtgggggagagaattttttgaaaacattcctttgttcctaaggttcacttgtacattggttgcttggaattaatggcataccacattttctaaaaaaggattcttatattgatccagaagaatacctacctcaatttcaagaaattcaggcacatgtggaggagatacttcctgatagatgacccagctctttcatttatttctatccctcctttttaaaaaaagctttaagttagcttacaaagagccatgtactcattcaagtatttaagtgacaacaaacatttgaaatctactgctaagctgggggaacacaacactgaataagatagacaccatctgtcttcactgcagtctcacagaggaggcacacagtaaacacacagctatacaaataagcatttaaaattgtggtaagagctgtgaaggagaaccaaggaagaaaagagggtggttctatttcagaagtccagcccatgaatctaccttctacttctcaaatcattgattttctagaaatgttctaggcagtttgcagccatagccacggccatggagagtccagcggggctgtggggaagaagggagggagggccctggggctgcccagcgtctgggttgtgctgctgtgaactgaggtgctctgttgtagtttggtctttttgtaatgtgaaggatacgacaataacagaaaaagctttcctctgctgggtgtatgagtccaaaaggaaaaaccaatgggtctagtgggacaagatgtggaataaaggagtaatttaaaagaaaaaaaagacaaaaaataatgggttgacttaaaacagataaacaaatacataggattttttggtatttctttttcccatggcttctctgctgaggtccttcatgttctcgggcgcttcagaaattttaatacatgtgatctctaacttgtactcaagttacacatttcttgtgggagtgaccattcctgccttaagcaccatctcctgctgacatttccatggaaatctggaagttttaggtcagaggttcttagatgatattccagcagaatcttaagtgaaaactccttgatgattaggactgactataggcactcgaatcagacagatattcagatccaggctttgagccctttaagcaatgtctctaagctctaattccctgctctgtgtggagagggggagacactgataatacctgtctcttggactatttggagtacattctacccagcatgtaagacagcacagtgccttgagcgaggaagttctcagtaaatacgaagttgtcattagaattactgtgaaagtgcctggaagtatccgtttaggttagcagacatggtgacttttcaaagcggctgtgctcctggggaggataaatggtgctgagtgtttgcctagggtcccagctgagacggaagaagaaaatccccttttactttactaaatggccagtgctgataggacatcactctggctaatatttgttaatgtcacttactttatcagtgttatgaaataatcattatgtagcttaggatgccaatgccaactaccagtgtaataccttttccctctttggaaataaattgttcacatttccaaaaatccagcttatagattaagaatttaaaaatggggacactatatttagaagtgaaaaatgtctatggttaatttattcacactttagctaattaaaaataccataagaccattttctggggctaattggctatcttatgttttggaaaatgtttcagggatattgttgggacaaaggtgtaaatcaagcaggaacaaagcatttgtgtgtctgaaatggaggctcagttggctcggctctgcacgagagacaaacctgtctctagatgccctctcttgggctctcgagcttgaagcaggccagagagtagatgaccatgtttataatgactgtgagatttatttctcttgaagtagactgttgataattaataagccaaaaattgaaatgctgagagtatgccagtttggatgatattcttttcttggtacatatattcttgaagacgacaagagcttcctggttgtgggaaaaa

SEQ ID NO: 1039 - DNA, 1829 bp, Homo sapiens
gctatctccgtaggcagcactttatgttgtgttttttataatcagaggaaaccgatggcaccataaacttctagaaagtcaactaccaccttggttctgtgtgggaaagtaaaattttatgttttccataaatacaagatgaagacagcatttaaagcctatccctgaattggatagatcattttaaagtgagtttgttgcatttagaaaccatgatccctattggccctacaacaaggcaattttcatatcaggcaggtcctggcatctggggagactggctgtttcctttgttgccagggaaatcatttcaaaatggaaaaaaccctgaatgccagcccccagcaatcttcaaaacaatacacattctttaaaaaaaaaaaaagaaagccaaacaacaaaacaataggtaacacaaaacccagtacattactgtacactagaaaggtttttttctttcccaactgaagggatgaaagggcatcataattttgttttcaaatgtgtttaagaacctgttattaaaacggaattaaacccaagtcccagggcagccgctctgcaactaccgggagataatcttgataatgcgattagggcctgcttcagtggggctgggaggggaagggaagtcgagatgcccaagcgggagctctactgagtcacctgcaactgcccgtgcccgaacacagatgcctcgatctccccataaccgggcaatggacccctgctcttgggagctactaggggcctgaaacaataagacgaataataacatttattgatggctccctataagctgtgctaaactttcacatgtattttctcatttctatcctgcaaggcagatactgtcatagacacacctgcacacacacccatgttcagaccagtgcagaaatcatcaatgctgatgctgtcttgatggacaattttgaaatttccttcatcacagatcttttgcacccatcggagttcttaaaatattgcttgaaaatattctttatctctccaagtttctctctctctctcttttttttttttttttttttttttggcttcactgaagccacacggctgatcagcaccagagctgggattcaaacccaggtctgccgatggctgagccttgcctttcactgctatgatctatctacaggattgtgtggtttggtacctaactgcaaacgactcagatctcttggaaaacttttatgtactagcaatctccactcccactccacagcgaaataaccaggcggctgtgattgctgctgaaatcgtggccaatgacgaacagaaagtggctgtgcaaataagatcctcctcatttatgttacattttagcctttgcttttttatccatctggaaagcaatgcccactctgcacctctatctaatgggcccgttcaccagcaggctgtgacagccgcatcctccacagcactgtactttcaccggagacatctgaagtcgcagaataacgtcactgattaagaggccagaggaaagaaggaagtaagtgttcgttgagctttgactctgtgccgagccctgtattaggccttttacttactagatctcattgaaatgtcacaaaaattctgtgagggagatggtgctcttctccccatttgtagataggagaactgaggctggagaagctgagcaattcttgggccaacaggaaagggtgatgttacttgctagaggtcagaggcagtgaataaaggctatgaggacagacctactctctgataattccatctgagcggtctgtagccctttctgcctggttgagccatctttattttctcatggatggtct

SEQ ID NO: 1040 - DNA, 1788 bp, Homo sapiens
gagaaggcttgcatttaaagtcagaccaagaacctgcagacatggttaaaattccagctctccgacatattggctgtgtgacagagggcacatcacttcctctctctcagtcttaactttctaccctctaaaattgaatgataattgctggtggattctgactccagctgcttaatgcctgaaggccacttatcaccccacaacctatcactgatgcataggaccagaacagggcttctcaacttcaaccttgttggcatttggagttaaacattaacagttctttgggggggtggctgtcctgtgcattgtaggatgttgagcaacttccctgccctctacacactagatactcccagtgtgacaaccaaaaatgtctccagacattgccatatgtctcaactgggtaccaaaatcccccctacccatccccacttgagaaccaccaaaggaattcctctgattaactgtgctgggcatcccctcttctgggcctcagtttccccatctgtcaaatgaatggcttagcccagaagatggatagctattggcctccccaaagcagagttttccccaactctaaattttgtggtgaaaacccaccaagttctaagaacaggcttgggacaaggaggagaaaggacattcggccctcagctggagggaggcagagccctgcagatgcccatctcaggtccaccttttgcggcctcttgtctggctctaggccctctcccttgccagtttcctgttggccaccatgttttcccagttgctctgggaacacgtttccttcccacatcccactgggaataggaaagtccattgaatattcatgaacgtataaaatgaatttgtggttgatatcgatctagttcctgaggcctaagctggcctcatcttccccaagtggcctctcagccctggcttcatgtttctaagggaacttgtcctggttttcttgaaaggtaatcttcttgcggatcaactttgctaagaaaatgaaaagctttttcctctccctttaaatccctgctcgtatctgccaagagcaggaagagtccctgccagagccttgggattgcattgggcatttgagctctggagtcaggaaggtctctgttcaaataccagctgcgtcggtccctgagtgctgaccttgtgctggtcacctggttcctggagcctcggttcctcatctgtgtaacaactaatggagtaaatagagtaatgggaattcaccatctcgtgaggtggtttctagcattaaataaattaatataagtgaagcacacagcatattcctaacaaatactcaatatgtaatagatattctagttttgttattaatgattacatatatgatgattgagaagtcaaatgagattattatagccagtgctttgtaaactgctcagtgctacgtacaggagtaaatagttctaagatgttatcaacattattagcatcactttgccagccagccaaagcaaaacggccctgggtgatctgtcaatatcacaatccagcagtatcagatgctgtttggctctgatttcaggatcagaaatggcctacgaatagactcgttggctcagattgacttaaagcttcattctgaaaaatctacaccacagatttgggcccagggaattacccctagtggagaccaactgggctccagaatgaaggcttcgaatacaatttgaattgtgtgactatgcgagaatgtagaccgtcccccacagcatggacatgcctaagacacagtcgggttcaatcttgtca

SEQ ID NO: 1041 - DNA, 1862 bp, Homo sapiens
aagatgatgacttcactcgtctaaataagtgggctgttgacccaaaggctgggctcagctgggactgccaactggactgcctgcttgtggcttctccctgtgacctggacttcttagagcatagatttgtgcattccaggagagagctttccaagggaaccaaccagaaactgcaggcctttgatgacctgaccttggaagtcacatggcatcacatctgctgtcctatactggtcagagtagacacatgcctgtcccagtggaatatgatttataccagttgctaggctcgtgctgagggttgagcagcagcaagataactctttgccggtgaatagcctccagttaacatggggaaaacaatgaggtaagaaaacgaatgacagtccagcatgccttgtgctcctgaggcctctgtgaagtgctgtgggcacaggatccattcttggagcatgcggtaactgagctcacagccaaattgctctttcccaatatccagcaaagctgtgttcctggagttactcatggccagtgctccacagattgtgctcagtcaggttaggctgaacacccctgaaagtaaattctcgcatgataagcagggtgtttccagttggaccagaaaatccagcagggtgacaggtcagataatgtcccagcaaaccacttcccaacccttgtcaaaactggtaggtgcagaaacaggcagtaacaaatgccattggcatgtgaaatgccagcctggtggggtgaggaagagaagtggaaatcatttgaggctactaaggcacaagaaggactagagggcaggaaataaactttctgtgacccgtaccattggaactgtctgccatcttgccgaatcttccatttgttcatgtatctcttcatccgcaagtgtttatagaatactgattatgtgctaggcactgtcctcagccctgggaatacagtggtgagccaagcagagctggtccctgcctctaggaacttacagtctcatgtctgagattatttcagggcaccacatggtgggttcaggtacaggttctggtgtcaaatcacctggaatcaagtttctgctcgaccacttcccagccagaagacctcatatgaaccattttgaatcgatttgctccctctgaacttgtttctgcatccttatactggggataagattactattttctgtgtatggttgtttaaatgagatttggattcacaaatgtaggtgctgctggctatggtggtggcagctttctcttctcttctgaactcactgtaagctcctccggggaaaggcctgttctctactcctcctgtgtgtctctcaggtccactctaagctgcctctgaagctggtactctgtaaatacctgttgagtccttagggctactgaattctgattcagtagctctggcgtgggacctgggattctgccttgctagcgagtcccaggtaagacccatgctgctggtctggggatcacactgtgagtagccagagactggctcatcctctcgccttgccctacagtttttcataactgaacaggaagtgttgttatctcatgcaaattcagggttgttagagcgtgagctcagcatgcactcagctaaacttcagagattccaaacaaacttttttccctcctagaagaagctgaagttttgctagatatgctttagccaggactattttaaatgactcagcggcagtaacattgaagcttcagccctaaagactcttccatgtgttagcttctcacctggggcaagttgtttaatctctcttggcctcggtttccttgtctgtagtagggggactggtccatttgggggctgtgaaatgatgcgtggaa

SEQ ID NO: 1042 - DNA, 1819 bp, Homo sapiens
cattttaactttctgcagaaactttcctacttgaactcttcaaaaagggacttagaaaaggtgagatgtggcccctggataaggaaggactttattattttgttacaattaagaatctaacttggggcccactgtggtggctcatacctgtaattctagtgctttgggaggctaaggtaggaggaccacttaacgccaggagtttgcggcagcttgggcaacacagtgagaccctatatctacaaaaaaaattaaaaattagctgggcatggtggtggcacacctgtggtcctaggtacttgggagactgaggcagaaggattgcttgagcccaggagtttgaggctgcattgagccatcatcataccactgcattctaggctgggtgacaagcaagaccttgtctcaaaaaaaaaaaaaatttaacttggggctcgtgacagtccaacaagcagggcatgaaggcagctccacctgacaccttgaactccatgaaatggcttgaatggcctgttctgcccgaggactgggctaagctctgcctctaggagaagccctttgcaaggccctggaggagatcaggatttctgccaggtcatttggggacctgggaaaaccatcaaagggtatcagtgagcccatgaaaggcccacagaagtctctagcctcgccaggacagatggcagggtggaccccgagtaaaatcctcaccccaccaagggcaaaggtctaaataggtttggggaaaatccagctctaatccttcccgatgcacctggggtcccagagtcctgctgggatggccgagggaagaagaggagatcagcaccatccctgctggtggcctcagcaacaaaggcggcccaggggctgccaaagggcttccaagtcactttggagcccccaggagtggacggagatgacagtctccatagagatagcagggagtgtgtcccgctcagaagccgtgggcaggtcactctggcctcctctgggaatgtttcactagcccagtttttgaggatttaccctatgccaggccccatgcagagctttttatgtgtgcctcatctcctgaaggcccttgccacagcccgacaagtagtgaccatgatcatttccatttttacggatggagaacctgaggattccagggatgaaatcatctgtctcaatcacacgctagtgatttgcatcctggcctctctgcttctagagactgtgtccccaactcactgggtgggcagcttccaagatgaccccaatgatcctgcctcctggtatccacctcagtttgtcttctctcctagattgggggtgagatctaaatgtacttctttctttcttccttccttccttccttcctttctttctttctttctttcttttttgagatggagtcttgctctgtcgcccaggctggagtgcagtggcgcgatctcagctcaccgcaacctctgcctcctgggttcaagcaattctactgcctcagcctcccgagtagctgggattacaagcatgagccaccacgcccggctaatttttgtatttttagtagagatggggtttcaccatgttggccaggatggtctcaatctcttaaccttgtgatccgcctgcctcagcctcccaaagtgctgggattaaaggcatgagccactgcgtctggccaagatctagatgcacttctaatgaacagaatagggagaacaagatgggctgtcctgtctgagattaggctgcaaagagactgtggcttccatctcttcttgcacaccttctcttctctttcttggaggcctctgtgggaagcaagctg

SEQ ID NO: 1043 - DNA, 3123 bp, Homo sapiens
tgatcctgggaagggaatgagttccgttggtggagcagtagttaagcagttgccttccatccttcattcattcgttctttccttccttcgtccattccttcacttgcaagtagtaacatggcaggctctgtttgaggcaatggaaagatggaggagaacaagacagagaggcctggcctgtgaaacttacatagaaacagacacacacaaaaggaactgtcagattgcaaccagtgctatgcacagagcaaaagagggaagctggggagagtgactggcctggggaagctactacttcagtttgtgggggtcagagaaggctcctggaaaagagggtatttggtgtgaagaaggcagccgtgccaaggtcttggggaaaagcattaagaagcaggaactgcatttaggggctgaatttggagtggcacagagtggttgcagaacaggccagtgtggctggggcgtccgtctgggcacagtggcaggaggtaaggttttctgttccctccaccctcccaagtccatttacacatagtcatgcagttttttgcttatgatgttatctcctctgccagcctggagggcagggcctaaatcatagggacctcttagtgcctgctgcctagcatggggcatggttcccaccaggggtctagtctgtgttcgaattgatgccttcacaaggatccccaccattgggccaggcacggtggctcatgactgtaatcctagcactttgggaatatgaggtgggaggatcacctgaggtcaagagttcaagaccagcctggccaacatggcgaaaccccgtctctactgaaaacacaaaaattaaccggatgtggtggtgggcgcctgtaatcccagcttctggggaggctgaggccagagaatctcttgaaccagggaggcggaagttgcagtgagccaagatcgcgccactgcactccagcctgggtgacagagtgagactccatctcaacaacaacaacaacaacaacaacaacaacaacaatccccattgttggttttcatgacagtgggttgacatcaatgaaggtcagtggaaggcagctgcagatcccagagaggtgtcaggtgaggagtcctggggaaaaggagttgaactgggctgccaaagacactctgcccggcgctcttgcctgcttcctgttcctcggttctttcccgtgcccttgtcccttctgtcgtttctccttgagaatcaagttgtttggaaaagagaaaaccagttgcataactgtgtccgttggcaggcatgttctaattttaaaaaatgtgtcactctccaagctgcgcgtcccttaatcaggcaattactttatgatgtagtagagttaaggagggggggggggagccaccaacccttgaaatctcaaacaatttcttagtagaattaatttggtaaatgtttgacttgagctcaagaatatcttttgtttccatttctaaatgacaaaagggacacaaaagaaaagtaataatttggtattaatcaatccttttcattaaaattagctccccaaaccagggatgtcatggaaacagcaagtgtcaggagaagggcttggagcctggaagggggtggggaacagggttattaagtggtcatggctcagggacacaggacaagacagaataggtatcaacggcactgaaaatagtaaccatcaaggactgaatgcttcccgtgttcgagcccttgtgctgagccttttcaaatgcccgatggttttgtatctagagcaaccccacgatgtaagtactgctgtgcccatttcacggttgaagaaaccgagcccaggggaggctagagaatctgcccaacactcacagctggaagtggcagaatcaggacttgaacccaagtctcttgactccaagtgttctgctctatcattgtcccatcttaccatccctaagtgtcctttgcctctgctaaggagcagggctggggagattccacacgtcaggaggggctgttgagaggccctcaaaggcatatgaggaactttattcagccaggcacagtgactcatgcctgtaatcccagcactttgggaggccaaggcgggcagatctcttgaggtcaggagttcgagaccagcctgggaaacacagtgaaaccctgtttctattaaaatacaaaaattagtcaagcgtggcggtacatgcctgtagtcccagcacgcctgtagtccctgtagtcgggaggctgaggcaggagaatcgcttgaacccagtaggcagagtttgcagtgagccaagattccaccactgcactccagtctgggtggcagagtgagactccatctcaaaaaaaaaaaaaaaaaagactttctcctttctgccaaggatgtagggaggagtggggctcactgctagcagatccaaggctcctaagaagcttatctccagtggtgccaggcttcccgggctgggggcccccatacttcacccagaactgtctgttctcctgtgagggctgcattccaaatcttccctgagcttctcccttcatcaaaatacctactcaggcctttctgtccttcccctcagcctcctgtgtcatgatgacttaatacacccttgtttactgtgacctttgtgttgttaaacccaagaaatcacagaagctctcggtccagcatctgcctcggttggtggaggaaacattctgagctggaaaggttggggcggggggcagggcagttgccagttttccatcatctctgactctattccccatggctaacgctctctctctaaacctaagcatcagaactctttctccttcctccgatccgccccagctctttcttacgcagaacataagccatcctggccctgtctttccccatttgctccttgtctctttatccggtcttctatgtgggctgagcacaccgggctggctgttatggaggtggaggggtgggagagtctcctagctggcaaacacacttccattaggggaagttgagggtggtagggaatcctcacttgagaacataacttgtccctgttgcaagatcacatattacaatgactctgccacctggatttttaacagctcttgttatctgctaagttataggtgtg

SEQ ID NO: 1044 - DNA, 2035 bp, Homo sapiens
agccagattaaccttcagtagtaacattccagttgtgggtctggagtgtggctttgtcactgatattgtttttctggttttgttttggggcagcaaatggttgagtgtcagaagtgtcctggggccccctggcttgtgcccaaatcatgtccactcctgtgaactttccttacaggaaaacctgattggcgccctcttggcgatcttcgggcacctcgtggtcagcattgcacttaacctccaggtaagtttcagttaccagcactgtctggggacagagacacagcagacaagtcagggtgtcttatccaggtccagctgcctcctctctgcagggccttgcctactgcatccctgggctgcacctgggacaataccttgtgggccgttccaggatttctcttgattcagtggccccactccatcccgccctcgccctcctagccaggtcctcactgtctctccttgggctttgcagtgacctcctgctagcttctctggctctggtctcatccctctttgccttgctgcaaagctgctggaattaccatagttttgtcaaattcaactctaattacagcactgttcattacttaaaagcctcagggatgccctctacagctgctgtggatccccccactgacctccaaatcccctcggcctgtctgagttcacaagcagctgtggtgtgtagcaagttgatagctaatgagcttctcatgggggcaccaaggagctggtgttactggcatgcaggcacagttggggtgtgcactgggggagcaggacgttaatgcccctggaggctgccttctgccagcaggggtgggaggcagggaataaatgccccaggctcttatcctctgctaggatgattctaaggtgagattcacagggtttttcagagggtcccctgtgggactgagtcccagttgcccacgggactaatccgctcatgaatgcacctttcatctctgttccctgcctcactttccccttcccttactcgtgctccctggaattatctcatacagactacctgctcccacattcttgtctcagggactgcttctgggaaacccagataagacttggtacctgctaacaggatgaatcccacagcacactggccggcttcactccaccagcactgcccagcttctgcctgcagtgaactgctctccctccctggagcaggcaggagactgtgatccctgtgggcacacacttgtgccttgttcacctgtactctatgcatctcagctctgggatgtgtatgtttctgtgtgtcgctgagaccacgtggtctcttagctacttgtctggttcattctcttctttctccagggcagcatctctggttgtttatctgcttctgggcagcccacatcatgatcctccccaaatggcagacttggccctctaagtcaacatgactttctagcctgctttagttactgcttcagtttcgatgtcccaggttcacatttccccccaaaaaagaatattgaccatgcttgagccacgtatccaccccagggagagcaaggcccactgatacccacacaactgcccagcgagagctgctggcatgtagacaggaaggagtgtgccgaacacacagtcatccaaacgtggggaatcctggaaactgcagagagagggaggaggtcgacccaagggccaggccaagtgggatctttagactatggctcccaccctgagactgcattgcctgtgacgtgcattagaaatgcctgttttcaggctcatccacacctctccgagactgactcaggatgaggcccaggtgggtattttgacagagcttctcaggggattataaggattcccagcctgttggagagctactgtcctagaatttagatctagtatttagatccccactgtcttactcttctctgagtcaggactccacaagaacctgacaagtcttcccaatttatttgcaagttgggggtggatttagggtacctacatcatagcatttttttccccaaacatctgagcaaat

SEQ ID NO: 1045 - DNA, 5933 bp, Homo sapiens
ctgtgacatgttggggaacagatggaagtcctgatgacccagtctttccatgtcccaagcaaaggctactcaaaagtgcttctctcctgtgagatcccacagctgcctgcacccagcccccaggatcctatgagtgatactcgtagcgtcctattcttcctacatgggcagatcccagatggtctctatgcccagctaaggttagcttcagctgctcttattaatctggtcagccagacacaggtattagctaggaaaaaagtatcttggcatgatgtaatccaagagctcaagccttcccattagcccagaggaattcaaggaagggtgtggatcacatcttcaacaactcaggggatgttctcaggactgtaggcccaggtccctgggtctttgaggcactcagggcctgtcctcttcacttgagcccctgagctctgttagagagctccatcatgcattctaagcctgttcgtcagagcatcctcactcaaggagtctagaactgccatggtccattcatgcctcagaccaccacccactgaagactggaaaacaatacatgctgattgttctccatgacacaaggaagtacatttggattttcttccaggggaaacacgataatccaagggagtttacaggtagcctgggggagctccctgcaagaccatgggggagtctgatctaagtcccagagcaagatgagagttgatcaggtagcctagggccaggagccttttctctgaacccacctcccctgagtcacccaaaagattgctcttgtacataaggcctagaggaagggccaatcaacacaagagggggtaacccaaggccctcttagaaagccaagccctagaaaaggtatgtagtgccttccccgaggaccacagagtctgaggacacccacatcactgagggctgatagtaatgcacatatgttcaagtaagatgacaaattcaccaagaggctcaaagaacagggttggggtattgatagaacttcaagctccagcttttgagccagcagctgtgaaaacagaccctggctggggaaactctgttggcctccacagctctctgagtcaggcatggcagagcacagtggagaatgcatacacacaactttggatattttacagagaaaacagagcctgttggcttgatcccaaaggtgaaagctgaaatgagaatgacagagatacctcattcccctataagtagaggtcacagcccaggattagactcctaaagcttgaccagttttcccagttcctcttccacgcaggtagctgtggtcctaatataccttggaccaggactcttagctggaataaggcctttgaactgggccttggattaaactgtgttcacagtttggttttggacagattcctgggttggattggactgaaatttttgcctgtgctacaatcttccaagaagacttctgaaaatctgccagttggaatgaatttttcttcctctacattctggtagcactttgtgaccacatctatgtgcaataattcagagactgctttaaaataaaagcacatgcttatcttactcactagactatgagctcttggagggcaagaaccatgtttgaatcatcttcatcacttgcccggtgctgagtgtaatggccagtacatagtacccactcccttccacattttgctgcatttaaattaaatgaaaaacatcaagttgtaatgtgggagtactggaccatgcatctcactccttgatgggataccaacatggaggtcaacatcccacggaccctgggagactacaatcatcctaataactgagttatggcagctcagcctggccaacttaatagcaacagcatatgaacacaacgtatcaccacatgtatcacaaccccatgtatcttggcatgacacaagtattagctaggaaaaaagtctcttggcatgatgtaatccaagagctcaagccttcccattagcccagaggaattcaagaaaggaattcaagagacaaattcaagggaccaaacctcacagaactgacacaaaactttccccaagcaactggcatacagtatgtgttccatactagttgttcagaaatatgacctaatgtctagatcatctaggagttttttagaactacaattcctaggccccattttggacctactgaattggaattttgggggacaaggccaagaattttgtattttaaaaggcctatgagtgattctaatggttagctgggtttgggtctactttagaccacgcagggccaccaaagacacttccttctcctataaagtacctgactgtttaggcataaaggaaacaagtgatgtatgtgactcacactggcctggcagggaaagtgttgactaattccttggacatcctgataggaaatgctgggagcctccttcgtgagccatcccttcagtctgcctgatttcaccctggccaggtacactgaagagctggatcccacgggcttggttcttacagccagattctaagccaagcccagctaagcatgatggtactttgggaagttctagtcctacaaactgttggggtgagatgtgtgtggctgcacagagccagtaactggtgggcttgtgagaagcccagcatacatataggcccactcagttttaggatctccctctcctgctaacccttcttcaatatgtatgccccagtccaaggactgggcttctattctggttcatggtttcctctctagtctctgctgtgagactgaagtctctttttggagactgaagcctttggatgggtcaaggatatactttgccgggatacaccctattcccttgggtgaggacatgagtcaatccagaatcttccttcccccataaagtatctgcctatttgaaaacaaaggtaacaggcaatgatatgacccatactggcctggtaggacaagaattgactccacctccttgtacattctgagaggcaacaccagcagcctcctttgtgacccattccttcatccagggtcagctctttcagccctggactccctcaactctggcatacacttcccaggctgccccatggccctgggacgcttcatagctatgactagtgcccattctccagtacagtagcagatacagaccctcccccatcctgctaccacccctgactttccactcaaggcgacgtccccttcagatcactgggagaattctgcagagcgggcaccccctgctctgcctgccactagcaaagggaaaccacaggtcttcagtgttcaggttcttgaggactggataacagagggagggagacctgggacttcctaagttccctgtttattttctggggctatctgtaggtcaatgaaaccttgaaagaagtctagagaaatgaggggaatgttacattaagcagaggaagctcacaccgatcacggtccctggcctaatcacaaacagttcccaggaatattatccctcatgctgaggctgatgcatttaaatctttgctgatcccaactctggctctgatcatttgaaaaaggcaatttccaaggactctagctattgtgatcatattttctgggccaagggaaatgatgtttgaaattgcatttgtcctggaaaatctgggattgtatgtttacagggaacactaggtttcagccatagaggggagggaaaatagagcatgcttcacctgtgcatgtggcattgaggtcagggtgggaggagaaatgaaaaaagtacctgcctatttaagaataaaggtgacaagcaatgtatgcgaagcaatgcatgtgacctatatgaagaaaaccatggagctgttatatttagaaagacggaagtaggcgaacaaaaacatgtgtctggatatgagggctgtgtattataaaaatgcctattttcttcaagttaatttatattttaacaggagtgcacatacaaaaatcccaataggatgttttttttactctgacaaaatgattctaaaattaatcttgaacaacaaacagatgagaataacaatgaatattctgaaagagaaaataattcagggaggaaggagttgtttctagctctgccagatattagaacacattataaaacaacaattaaaattattcaataccagtgctaagatagaaatagagcagcagaacaaagtggtgactcaagaaatagacttaactacatttgaggattcagtatgtaataaaacaattcatttccctcaaatcaaaagggaaatgaattacttaataaattgtgttggaaaactgcataatagtttggacaatattatacattcatctaagtaaactccagatggagtaacaaattatattttaaaaaatcaaattactgacaaataaccaaaaatagaacgaactgtttctcagatccatggcagaataactttgtcagctttgaaaataaatcacaaatactgagagacttgtttatatagaaatgtaagacaactatacaatgaaaaatagaaaataaatagggaaaatgaggttgggaaaatacatatatcaaataccacaaagaatttctatacacaatgtagaaagaatgccttcaaattgggaaagaataccaacacctcagtagccacatgtcagtaccagtagtcactatacagggattggaaacagcaaatgccccatgtccctcctagacagggctggaaccaggtcggctgaagaaaggccaagactgaagtctctatccagtgccctgtgatggcaatcttggcagtcctccagacacctcttttatacctcttaccccaacagggacatgtctctggcccatggctacccagcagtctgtctccagactgtgctcccataaacccacctcccttcttcattcatatccattaggcaacagccaacccctataggaaccattacaaacccaagtacccagtcctgcagtgtgggcgcgcgtgtgtgtgtgggtgtttatgtgtgcgtcaatgtatctacggaacatgtcccttttgcataggcccaaacccagtggcttctcccagaacccactgctgcctcttggatgtctccttttccagcagggcctctcatctttcgggcccaaccattctaacagagaagatgtcaagtctatgccccatgagaagaggggctgttgctcttctgttcagcacccactatgatgcccaccacattgcaggcactcaataaatatgtgttaaataaaagaatgaacctaatattcatagcatcaatgttttctcattgaaaaactaaattataagccacaagggcccacttcatttatataatggtgtctatctccacatgagaagagctccttgaggacacggaccgtgcccaattcatctctgaattcgtggcacttaaccttgggcacttcacagtagtccacaaaggtgtgctacagaaatagattcaacttacagctattaaattagcaacttttaaatggccacacaaatatttgaagtttagtgaagctaacaaagtttacaagcaatatatatgtgacctaaacgagaaaaccacaaagttgttatctttagaaaagtgaaagtagataaacatgaaatagaggcatgccatgtttctggatggaaagaccatacgttttgagtcttgttcttaatcttacagcttttgctactggcattatgaaccgacaccatattttggggaaaccatgcaacagtatgcatcaagagtcataaaaatactcatgtcctgatcggataatgtcaattctagaaatttattctaaggaaataattcaagagaagaaaaagccataggctgaagatgctcattatagccttatataaaataattaaatataattggttgaataagtcatggtttattcacttgacagaagaacccacagattt

SEQ ID NO: 1046 - DNA, 2153 bp, Homo sapiens
gcgattctccagcctcagcctcccaaacagctgggattacaagcgtgcgccactgcacccagctaatttttgtatttttagtagagacggggtttcgccatgttggccaggatggtctcgataccctgacctcgtgattcccccacctcagcctcccaaagtgctaggattacaggcgtgagccactgcacccagcccagatctggaatttgaacccagacagggagactccagggactactaccctgcactgctccattgctggcacttggaggaccagcagccttcccttgatgcaggcctctttggagagagggaaacagacagaggccgcgcctgtctgtttgcaggcaaacagaggttgcaggcagcgtgatgccatgggaagagagccagcttgaaagcgagggggacacgaggtgacggcctggctctatccctctaccccttactgagggacagaccataaggaagaacttcagattcgctaagcctccgcttccttttgaacagagatcttcattcattcattcattcaacaaatatttactgagagcttttcatgtgccacacactgtcttcacgaatgtgatgttctagctaggaagacagacaagaaaacaagtgaccagacaaataaaataaccgcaagccgtaatgagcaccacgcagggaggtagccaggggctttggggagaaagctgggtgagggcctattgtggataataacagcggtcacctggagggtcagaaggagccagccgcatagagaagagcaagcattctgggcagacagaagagcgtgtgcaagaatcccaagaagtttgggaactgagggagcccagtgtggctgcaagcagtgaagagaccataggcgatcctagtccctcttcctggcttatcgtgagtatgaaagagggctgcacacatgtagtagacacttaataaatgtgagatctcctcctctctcccccaggctgggtgccaccgggccagaaagaggctccttcccaggggtggggcaacactcctagccatcttcagccacgaaaccctaacagctcctcggggtccccaagctccaagcctctcttgccaccatcaaagcacacactttctccctttgtctaattattcctaattggaagaaaaattgtttggcaaatcaactggcatctcctcggctccggtgtcctagcaacccagctctcaaggggtgacaccagagaggaggcgcctgccgcctccacactgcacagagtgccagggaagggcaggcatgacagctacacccccagactggcgtctcctctctccttggcccctcggtgctgcaccccgcatgcacatgcagtcgtgcacacacacacacacccacccccccaacagaggccaccagcacttgacctgcctgaaacataacctcagcctttctggaaagcagaaggtgtctcagaaatagatttctaattttccagccacctgctcggctgaaagatattctggagtttataattacttttcaagcacttaactagagcctagtttctagggcagcttgatgcatctcctaatgttctcctaatgtttatggggaaatctcacccttctgctcagccagggtagcaggagagtggcccaggcacgtcccagggaagggcgctgcctcctgagctcgggctttgtaaagatagcaatactgcccttgcggggtctgaggaaggagtcaatgagataatgcgggtacagctcctgaacaggacaccggaagtcgaagaagttctcagagactatttaacagtggttctaacgaaaacaggctgcatgggccaagcgcggtgactcacacctgtaattccagcactttgggaggccaaggcgggtggatcacttgaggtcaggaatttgagaccagtctggccaacatggtgaaaccctgtctctactaaaaatacaaaaattacccgggtgtggtggtgggcattggtaatcccagttgcttgggaggctgaggcaggagaattgcttgaaccccagaggcagaggttgcagtgagctgaaatcacaccactgcactccagcctgggtgacagagtgacactcagtctcaaaaaaagaaaagaaaagaaaagaaaaaaaaagaagaagaaaaa

SEQ ID NO: 1047 - DNA, 2362 bp, Homo sapiens
ttgcatagctccagtcattctttggcttatggcagcatcacttgaaactcttcctccatctttccatggccaacttccctttgtatctttataacatcccccttctgtgagccatgtctcctcttacaaggacaccagtcatatcggattagggcccaccctcctccaatttgacctcatcttaacaggattacatctgcaaggaccttttttccaaataaggtcacattcacgggtaccaggggttgggatttaaacatatcttttgggagaacataattcaacccatatcaggggtcaaaagcagactctagttcagcaaacttttgaccactgctatgtgccaggccttgtgcaggtctagatgaagaaaaaaaatgaatcagatataaatattaatacaaagtacagaaaggagacatcacatcctcaaaggggcatttgatgctatgagcatcggatgagaagaaggcaagatcatgttcagtcatggaaaaaattcagaggtggttgggcttcagacacttgttggagaatagatcagagttcaacagacgaatatggggacagcaaaatgtggtccaggaaagggaagagcataagcaggtcatgcagcacagaactgatgctgtaccctctgatggtgtgtacagtttttaagcagagaatcataaagtgattcgattctggttttcacaaaaatcccagccacctcagtaggacatcggaggccctgactgatccagtccctatctagttactggtccagagtgaagtttgttctgtgtgtggtcttagaggtgccagacatgccaggtcagtactcactgggtatgcgcttgtcctgctgcctaaaatcctccttccctcccttgtcaggcaaaaccctacttgcctcttataggtcaactctgatgtcaccagcttggtttgttgtgacttgcaaagcagtgtcagctcacctttgctacagcactaaagacaccatattgtcattatctggcacaattttcctcctctactagatcaggggcttctagggctcaggtgctgggtctagttaattcctatgccactggtaaccaacacaaaccctgacatgcagctgacattcagtaaacatcactgaccacagtactaagaaaggacaggaggagatgaaactggacgcaggaaggtccatttaggtgacatctacaatagtactggcaagagataataaggctcctagtactgcataaggcagagacaagcgaatgaagaagaaaggcagattccccagaagcctagaaagacacagtttataattctgcccaccacaccctggacatcccttcctccccctcctcctctatccatgtgcacactggtggacatcccttcctaaagccccaaggacctgtcatgacccagagcttgtctgccctaattctgggcaggaagcacaaatgctgcaacccttagcctgaggctcagtcgggtaagtgttgggagtttggccagccctctccaaagctctctgctgctagccctaggcgtcccttaaagtcatttcttagagcccaagaagagccctgctatggccctttggtgggataagagcgacccccagtgctcaggaacttgcccaggcaagctctttacccacaggttctatttaaaggggcagtttgaacctgtgagcaagacccttgataattagccctgtgtagactgggaaaagcccagtgagttcctggaaagcaagcccttccgccttcaatgaaacacaagctgaaccagaatcatgtaggagctggtgccttctgcctcctcccttgtaggctggtgcagccatgtgccccttttggtgaatgagagcctcccactaagtaccactgttttaccttccaaataaataaggtggctccattgcacgcaggatgtgatggacttgggcgtagaaggccagctttgcagaggctgctgtggaagtcgtattgtcacaattcctacagaactccagggagtagcctacaccaacctgaccagccaggagtaaggggcagcccatgctccttcttccttccctctcaatcttccatcccctccagtgctggccacacacaacagccagggctgttgcagctacccagaggaaacaggaaggaggaaggaggtggttattgggtgtctcatcatttcaatctgcattcacttcataggaacacagccactcctcccactggaagaccccaattagggaagacagtcaaaatcaaatcgttagccctataactgtatcgtacattctctctcccccacctcttctctctctgtccctccctccttcctttgctagtatccttccttccctggactc

SEQ ID NO: 1048 - DNA, 5301 bp, Homo sapiens
gcccaggcatccagtctagggtgacctcagtgattttcttggtggcttcttggtggcagttagctacaagactagccttgaggcctttaccctaattccgtggcagatggccatgaaggcatatattcacccacaggccaggagtgtgggagtcagtgaccccagtcttcacagctttggtttgccttacagaggctttcactttgcaaagatgagtaactgaaaagttcccagccacatttcacttttataaatggaattccaaaggcctctaggggatggcccatcagggagatacttcccaattaaggtcaatggtaagtcacttctgggccacattagaacactcaagcagaggcaggaatctttgcctaggttgggcagggctggtagtggggagggaaggcaactttcgtagccatggccatgagatgaccagggcatctgtatacagttggcaggttgtgcaggtgtctaataggtactacccatgtcacaataccaatggcgccctctagatttttgcagtgcacaatctgcccaactggacacgttggccttggcactgttagggggagggaagaaacaaatggagatgatgaggcaggtatagtcaaaaggattgcccttacacagattctaccacttccttcccaaggctcaggagtaggggtaggaggcagagggttaggagccaagactttcttggccagaggttgggggctggtctcggtggcccccaagctgcacatacgcaaatgcccatgttatgatggaaatgggtacaactatcctagggctggccatcagtatgtgggtcccaggacactcagttaacagagataaccatctgtacacatagtgagtacacacacacacacagagtcattggctgagatatctggcccattacacacacccacataaatacacgtacgtgtacgatttttatcctgttgcacaaacttaatatgtgtgcatccatacacacaatcacagtaattgccggcaagagcaatcggctcgtcactcgggcatatttagcaaacatttccagagcacctgaagtcctttttggctggctagagctaaccgtggggagagtccagcgcagcactaagtcagtgggagagaaaagtaaatcagtgggtagaatcacttgactactgccagcagctgcgtgccggcctgcagtgccacctactggcagaaaggaggtggttttgtgttttgctttaagactagataaaacccgtgatctgggaagccgccagccacacgatgctattcatccacctccttgtgttctacccaagtcaggtgaggctctgacatcctcagagttgcatcatatcctcagaggatgaacattctgggccttgcatgcctcttggatagcaaaacccaacaccaatagggatggcaaaataggtttcatctttcacaccagctccagcccgctggtagtggctgcctggaatgctggatagagaaagattctgagacccagtctgggcttagtggagaagagtatcatgatggcatagcgacagcaatgatggctgtagatggggcgtcttccatactgtctgttcttgcagtggatcctggaagcctggtaaatctctaaatttgcagagtcctagaattctcctgatccacaattccattatgaggggtatttgtgtttattgctcacgtgccttcatgccacaagaaactgccattccagctgttacaggagttttctctctcacttgatcagtaacttctgaaccggctaaagtcctcacgggaccctcttcacgacggacttgttcttgctttcacagaaagtacatggatgaccttgttggctcggagctgctgaaatcaacactgggcacttcaatctatccaaaactcatgtttagctaatgcgcatccacctactaggctgatcattgcctaagaggccccatgaggaaatgagtcgggaatacaaagccatgctggacagccagctgggctcatccccagccaagggccctgctcctgccctctcactcatcagcttgggagagcacattcaagtcaaatcagtgcatcaacaaaactgcaaattaccatgagccatgggtcgcttgaaaatagtcaaaacttggaatcttcagatgggcatggagccccatgtcccttccctttggcagtggagccagcctccgcccacagatgcataggtggatgtgacctggctcatcccactgaggcatcagccaggctgtctgccttggcccaggggtccgcacatttttctgtaaagggccagataataaatatttttggcttgcagcctctgttgcaacaattcaactctgctgttgcagtgtgaaatcagccataaacatatgtaaacaaatgggcatggctatgttctaatcaaagtttcttttatctttttttttttctttgagacggagtctcaccctgatgccaggctggagtgcagtggcgtgatctcggttcactgcaacctccgccttccgggttcaagtgatcctcctgcctcagcctcccgagtagctgggactacaggcgtgcaccaccacgcccagctaatttttgtatttttagtagagacggggtttcatcatgttgggcaggatggtctcgatctcctgaccttgtgatccacccgccttggcctcccaaagtgctgggattacaggcatgagccactgtgcctggccccagtcaaagtttctttacaaaaacaggtgatgggtcagatttggcccgtgggcccagagtttgccaaactctgcattagcccaaaacaggggccttcacactgggtttctcaaaacttgggattgtttggaagtgcttctgggggttcacaaacgtttggctctaatttaaattatttgtaggtgtttaggaagctataataaaagcatgcactcaaatgtattccagcatttcaccatgcaggaaatcaacatattaactgtcaggtaagtaaactcctttagtgaagacctcagaatggagcttctctggctatctccatgcatatgtatgagcagtatgacaaaatggttgaaaacctgggtcctagaatcagatggacatgagtttgagtcccagcactgccacttactagctctatggctttggacaagttactttgcctccctaaaccagcatggccaggacaccacaaaacagagtagacactggccatagtgccgctgcagcctcctagaggctgcattgtgggaaaatggagcgctcacagtggaaaggtcagctgaggccacgaggagacattcaggggactcagcgcagcattatctaccaactgctatggaggtatttcaagttttagtcatcagtttggctgtactggtgcacaccaattgagtgtcattataatgccaaatccatcttggctttgaacttcttgctagtttctatttttttctggcacattctgatatatccccactactctgattgggctctcagataggagagggggatgttttgcaactggctgagcagtctcagtgcttagtaacagggcttccatttttctgctaagcagcagtcccattggctctgggattttgctggcaggcatctcctggaaccagtgttctgcagggcttgttggggaagtggtgctctcagctaaaggggtccagtgtttcagaagccgtggctgctccacctcagtgctgcattccctggttaggcctgggactttggtgttcacctggctttttaatttactggtgaacaacactcaatgttcctcatccctgggcacctcctcacctctaagacaatcagaaggcccgtgtaactgctgcctaagactgcccctcagatttctggctttttattccagtgactgaaagcttttttccaggcctgagatgctcatttgtgatttcaataatagaatttagactcttagtgtttctccattgcccagggctgtctgtgtctattaatgatggctccagtgaaatccatggcttttactgcaccttatctttctgcttccagcatcatattttcctgcttcctgagagacatggaatcatcagtggtgttcatcaccaggccctgggggcaagaccacacaggtcccagaatccctgcagtttttcttaattaggtgacatctggtgccgtccccagtgcacaggtccaccctggtcagtcagcctgttgccatgctgtgagcctgggctgtgcccggccttgtaggcttcttgcagtcactggttctgtgagccttggaggctcttccacgggggtgattctgacccctgggagtgagaaggagagggcctttctgcagttcagccaagaataaaggagactcagggctgagctccctccttcacttcttttttgtttccttgaggttgttcttggccctcacagtacctctgtctaggcttggagctctggaagtagacacaacccgggtcttctgccccaaggcctcctctgttagccagaaggatcctggctgtgcagtggaaatgacctcgtgcaaagacattatcatatgcccttccaggggcaataatgccagtgtcccctgataaagcagtcactgtgggtatctgtcccagtcactccacacagccatacccttcctccctgggaccagcctcatggagacctctgacaatgacagtaaaaactcagcccagcctttctcttctggcccaaatcgttgctcatttgagaaccgtctctgccttctcactttgttctccttcctggaatatctttctgcatctcttaccctgccccacactgcacagaacctgtgccctttcagaccctgagctgagtccccagaaggacaaagatcaaaaaccccagggtgttctcttcccctatttcctaccaccacatctccaggcttctgcccctctcatgatacttttggttttctttacaaagtgcttgctcatgactaggattcctcctagaagcctggcaatcagtccacacacagatgtctgctcaccccttctgtctccctggggaccagccattggtgcttccaccctccctctggagagagccagggatgctcagcaaaggaggaggctgactcatcaagcggtgagagttctcctctgaaagtggtgaagaaggggccgcaggggctcttgcaaatgtggaggatccgctgatgcatttcatggggaggttatctcatcctggaagcccttgctcagcatccactgatggagagctcattacctccaaaggcagctctgactggct

SEQ ID NO: 1049 - DNA, 4042 bp, Homo sapiens
taaaaaaaaaaaaaaaaaaaattagttaatcagattcagttaaacagatttagttaatctgttttgttattgttggttctgtaacactatctcatgttaaactaaatctgtttagtttaaagcactaggtttaaacgaagcttagctcaaaactcaaagctctaggtttctagtattggcattttccccatggtagttttttttttttttcttttgagacagagtctcatgtcacccaggctggagtccagtggcacaatcttggctcactgcaacctccacctcccgggttcaagcaattctcttgcctcaacctcccaagcagctggaactacaggtgcccacccccgcacctgtctaatttttgtattttttttcccatagagatggggttttgccatgttggccaggctggtcttgaactcgtgacctcaagtgatccacctgcctcagactcccaaggtgctggaattacaggcatgagccactgcacttggcctccccatggtagtcttgtttccatatgggcacatcaccgatttcagctttttgtgtttgtttcaggctcctagagattttccttagttccttgtactcctaagtgtataaatatctatttgttgaaatgtatccactatcaatatattttaaagaagagcttttcaaaatatgtagtgagccataccgctagtggcagaagtcttttttgttgttacatcatctagaatgttattatatgtgacattaccaacttgttctaaaatgttaaataatttttcttaatggacctggcaacaccatatattgggaaagttaatgtccagagcctttccatttcagttatttctccgagattccataattttgcttaggggagagactagaagtggtgcataaccagaataatatccccataatcacataagccagaccaattccttaggaaccaaaagtaagctcatgtaccacagatgaaataagtcccagtaaatgatcaccaacagtctaattgggtaattgagcaactgaatagcggaagattaagatacagtgatgtattgaactcagggaaatatcataaggattaatacaacattcattataattacattggctattggccacaggaactaatccattttgaatgaaacattaaaaccctttaatggtggtggctatttgtggaaagagtgtggaagtattggaaattacaccggggactgtgtgcattcggagggttttattggtcctagaccagcagcagtcagaaacaattttgtgtatgtccccaggcttcaaaagcctccctagatgagggacattggtatcatgggggttccctgagaacagattcaacactcagagataggaagtttctttatgaacagaagggatagtttaagaaaagtgtcatatttttatccctggatttttgacacacaaaagccatacaccaatattcagacaaaggtccatcagtcattttgaaacttttcttgatctttttgataattctgttctttctggaggggaagatccttattaccttggtaaggcaagttgtctctaccttagaaacgcgaccccaaaccaaactgatacattcagaagggaaaatgtgaccagcactgtgataactgcttggtaaagctgacctcgtcatttggtctcttgttcatagagcagagggggccagcacactcactgtgtctttaaacttttttttttttttttttttgagacagggtctcactctattgcccaggttggagtgcagtggtgccatcataggccactataccttcaaactcgtgagctcaaacaatcctctcacctcatcctcctgagtagctaggactacggggcatgccaccacacccagctaattaaaaaaaaattttttttttgtagagatgaggccttgctatgttacccaggctgggctcaaactcctgggctcaagcaagccttctgcctctgcctcccaaagtgctaggattataggcatgaggcaccacacccagctacctttaaacttttgaggtgagaattgagtagggttttttttttttggttaaatgaaagaaaattgttaattgcttaagttttttccttgcagaagagaggttggtgacagaattattctcttgaaagttgtaacctcttaccttgctcacaaactagcccactcccagcctcctgctcagttggcatccaaggagcaaataataagccaatagaaaatatccagcaagttgttcttaaggctaaaagctcatgaaataggcacaagagccaggcgcggtggctcacgcctgtaatcccagtgctttgggaggctgaggagggtggatcacaaagtcaggagttccagaccagcctggctaacatagtgaaacccatctctactaaaaatacaaaaattagttgggcatggtggcgggtgcctgtagttccagccacttgggaggctgaggcaggagaatcctttgaagacgggagttggaggttgcagtgagccaagatggcaccactgtattccagcttgggagacacagcgagactctgtctcaaaaaaaaaaaaaaaaaaaatggcacaagaagctgccatgcccctgaggcagacatcttctcaagctgagaagcctggtccagggtgcatgggtggtgagtacaagccgggatcgtcctctctaggaaagttcaagtgacgcttctttcctctgattagtcttcatgtatattcaacctccagctcagtttcaccagggtgattgtttagactcttgtttctgtgcatggaaagtttggacacacttcagtaatgctttgtgaatatctagcaaaatcccattttatacataaatgttttccaagtggatggtcactggaactgtagaaggaagttgcatgtgcctgtacacaattcttgagaattataggcaagacatctggccattttggtcgatacattttaaccaatttatgtttcaaaatcccattttggctttctactatcctcagctaattgtgggtggtgtgagcagtgatgggattagtgtgtcagtaagacattacacatttccctataatcggatctgaaaactaagggttatgatcactgttgaaggttaaagttgcctaatcctggaagcgaagctcttaaaaagtttttgccaggtacagttgctcacgcctataatcccagcactttgggaagccaaggtgggaggattgcttgagctcaggagtttgaggccagcctggcctcaaaatttttaaatttaaaaattcaaaaaattttgaaagttagctagatacggtggcttgtacctgtggtcttagctacttgtgaggctgaggtgggaggatgatttaggcctatgaggtcaagactgcagcttgctatgatcctgccactgcactccagcctgggcaacagagcaagatcttgtctcaaaaaaaaaaaaaaaagtttttgattggtggtgactgcataagcctttgctcattgctgagcaatgagcacatttagaacacattttctctgtgttctaaaaacatacatgaaggcaggcacggtggctcatgcctgtaatctcagcactttaggaggccaaggcaggcagaatgcttgagcccaggagttcaagaccatcctgggcaacatagtgagaccctgtccctagaaaaaaaataaaaattagaaaaaaaaaaaaagaattaccaagccataatctgggtagaaacaacctaaatatttacaaataccctttgtggtaaaagatgaggtacttgtatttatgggcaagtgagcattactgttcattcattcagtgaatgtttattgagtgcctactatatatatatatgtatatatatatgtgtgtgtatatatatgtgtgtgtatatatatgtgtgtgtatatatacatatagttgtagttgctggagataaagtgactaaagcaggcaaaaacgccttccctcatggagcttatgttctaaaggggaagacagaaagcaaacaaggtacagaagta

SEQ ID NO: 1050 - DNA, 3696 bp, Homo sapiens
aacagcaagtgcaagaagatcactctgaccttcattctgtttctgaaaagcaggggataaaatccccacatgaaagatgtcttccctataccaaaaggaaagtaacatttttattatcaaagacaggaagttgaagccaaaggaaatctatataaacaaactttgttaaactaacccttatctccctcatcacttctctacctaattatcctggcccaagcccctttcccttaccacatttcacaacttactattctttgcccattcaccacataagtaattgactctaactgcttctataggtcttcatttccttaggagggctcccatgtcacataaaacttacattaaatacatttctatgcttttctcctgttaatctgtctgatgtcaatttaattttcaggcccagctgaaaaaattctaaaagggaagaggttttacctcctcaacactttctgtggtctccccgtctctttcaaggtcatggtaattagacaggtcttggtgaccacctctgtcactccctcctgagggaggggcctcagagcttctttgtgccttaacttgctgtggcttgaatgaagtggatcctgcttctctgaccatcatcgacccagtgaaggataagggtagatgccaaggcaaaaagatgtgttatgtattaggccctcatggggctccctaaaaacttcaccttattcatgctcatggacaatgctgtgagataggttttttgttggttgtttttgctttctgtttttagggtttttttgggtttttttgtttgtttgttttgggacagggtcttgctctgtcgcccaggttgcagtgcagtggcatgatcatggctcactgcagcctcaatctcctgggctcaagcaatcctcccaactcagcctcctaagcagctgggaccacaagcatgccactacacctggctaattttttgattctttgttgaaattaggatctcactatgttagccaggctggtctcaaactcctgggctcaagcgatcctacttccttggcctcccaaagtattgggattacaggcataagccaccaggcctggttagataggcatttttaaattccattttgcatcttgtaagtggtagacctgagatttgaacccaaatctgatttcaaaactgtctgatatagtttgaatgtatgtccccaccaaacctcatgttgaattgtaatttccaatgttggaggtggggcatggtgggaggtgtttggatcgtggggagaatccttcatgaatagcttggggtatcctcttggtgatcagtgagctcttgctctgagtttgctctgagatctggtggtttaaaagtgtgtggcacctccccttcctactctctctgtctccttcctgttttcaccatgtgacgtacctgctccctcttcactttccgccatgattataagcttcctgaggcctccctagaagctgagcagatggcagaaccatgcttcctgtaaatcctgcagaatcgtgagccaattaagcctcgtttctttataaattaccccgtctcaggcatttctctttttcttttcttttttttttttttttttttgacgaagtcttgctctggcccaggctggaatgcagtggcatgatctcggctcactgcaaccaacgcctctggttcaagcgtgccaccacgcccggctaattctttgtatttttagtagagacagggtttcatcgtgttagccaggatggtctccgtctcctgacctcgtgatccacccacctaggcctcccaaagtgctgggattacaggcgtgagccaccactcccggccctagtctcaggcatttctttatagcaatgcaagaatggcgtaatacattgtcttttctctgaaagaagaaagaaaaagtgctatgtagaaaaaatgtgtgtaataaccatagctactgtttagaactgtatgtcaggcattgtgctgagtactttcatgcatcatctcattgcattctcttaacagccctgtgatgaatgtcctgttttttcctcattcaaaagatagagaaacagaagctcagaatcttgcccaaaagcccagttgtaagtaagtgggtaagccaggctcagacccggttctaggtaacaccaaaatctgtacttttaacttctttatatgacttcccatgaaatcacgtgtgagaaaagccctttataacccgaaaagtgtgccacaaatttaagagtcaatcatagcacttcacggtctgtaattaatagtttgtgtataatttgagtaatgtctgtcttccctaccagactagtaaaatctataactattctgctgaccgttgtgtgccagtatttagcacagagtaataacgaaaaatatttgtgaataactgaatggatgcatgatcatgtcttttgcctaagccataagattcttagccttactaatggattgactcttttattctccatttgacaaatgttaattgattctaaaaagcttgtagaaatagttgtataactttggccttgaactttatggtagaagaggttagaatagaactcaaaacttctcagtgctaattatttttctgggtgaacagtatcaatacaaatgaaacctgacacaatttagggtgtctcaaaacaaggaggctctctttttgttaggagaataatatcatatgattaatgaagtccctttaacttttcacattttttctcttaacatcataacatcatgaaaggctcaagccagaatgaccctttagtggtcatttaatctgacttcctcatattagaggtagggaaactgaaacccagagaaggaagtgacttgcccatgcacacagacttgtcagttacagatctgagactagaacccagttcttctgcacccttgttttgggctcattaattcctttcttcaagaaacgcttattgagcatcactctgtgccaggtatcaggtgcacagaaatgagaatctgacaaagtcctttcagggacctgtgagctttagggagttcataatctggtgaaagagacggataagtaaacaaacagtaaacaagtaaacagacaagtcaaacaacagtgtggtaagggtagtgatagaaagcacagggcaataaaattcagaaaaacactgactgctcctcagggtcaaggcagacttcagagaaggcatgcctgaatgtcacatgaacttatctctgtatctgtacttcccagagtgtctggcttgtgatgtagctcaaatcaaaagacctggctagggactcgtttctgccaccaccttcagcagaatttttttttttttttttttagatggattctcactctgttgcccaggctggagtgcagtggtccaatttcagctcactgcagcctcttcagcagaatcttgaccctctctgagattcagttttttcatctgtagaaatggggacctaaggtacagagtttcttctgggagaattaagtgaaactgcatgcaacaccatgttaggcacactagaagtgatcaataaatactacttgagtatttgtgtgcatatgtaatctgtgcgtatgtgtatatgtatacaaagatatacataggtaaagagatgtaaatatttttagatttgaaggtaaaagttgtgctttctgggcacctagtccttagcctcagacagattagatccattagaaa

SEQ ID NO: 1051 - DNA, 1428 bp, Homo sapiens
tatcaatggtaaaataaatagctgtctattgaaaagactcagatcccccattttttgtcaacagccatatctttagctttaaggcataaaatcaattggatagacttgttccctaacaccttcatggcttacaattcagatgatgttagtggtttgaagtatacatgctggaagaaggatttttgctcattaataataatattcattgtcatcaaacaacaaatcttataagccgattaatactctggaaaataggacatataatattcatgtttcttccttatcccaggatatcccagagcaactctgctaaagtatccttaaagaacaatttaatattaataaaataagcaattcagaagtctgatttaaatgctagctctgttactacagtctctaaaaaaaattttagcctttctatctcaattttttatctacaaaagaaggacttgtgatatagtacttactttttttaaaataaagttttggacctgaagtgaatttgcaccaaagcagcagctgcattgccacagttctgtcttcaccttcaccatgttcctcttggtcaaaaacgcaccaagtcgtctccaagtttgaagcattcagcaaacaatggcaaggcagagccaccggaaacgtacacctgattttcatgataaatatggtagtgctgtattagctagtggaaccactttctgtattgctatatggacataggtagcaacacaaatcagaatagaatggaacctgtcccctgttggcagggtcaccccaaaggaatggagagatcagtaatcattccagctggtgtaataatgaattgtttaaaaaacagctcgtagttgatgccaagttaaagcactgtgtacccattaagatatggcattattgaagaaataaagtacatttgaaaccttaaaaaactaaataaagttttgggtttttaaatacaaacttctaatagaaaatgagaaaaatgtataaaagggaaaaaaatgtaacccagacataatcttgttaacacattggcacatttccttttttggtaaattattatgggtttttaaatgaatgttgggcaagttatgattatctgagatttatatagagtgaattatatgccaaatgttccataagatatttttattgattatttaagtaacattgcagaatattgatgtaattatttacatttgtgttctcttgaatcttgatcaattttagttagtgtcattttttatatccttttctatatatctttattttttcatgtttataatttttaatgactatttgatagttcagtgaattgctatgctggaggttcacttaacttttcctaaaggaagctttaatatgagtattaaacccttggaagagagaacaaagtatgaaagttgtaagtctgattttccagagtatcgatta

SEQ ID NO: 1052 - DNA, 2131 bp, Homo sapiens
gtcagggttcatagagcatcatgattgattaatgatgccagccatgggaatgggatccaggaatgacaccaggtcctacagaagacttcccatccctttaagatttcaaagtatacccaaagccaagcatgcttgataaaaagggagatctaagggcactaaataaagctgttaaagaccattaacaccttattaagaccctttcccagatgcagccagaaacagtcaaagaacatagaatgtgggaacattttggagagaaagcatggagctgtctgaagcattttttcaaggagcaaaaactcagttctattttcaaggctttaattctaagctccatctacatgaacatcaggtaatggagggaggtcattgtggaatttggaaacctacttctcactagaagctgatatgtgaccttgggcaattaatttaagctctcaaaacctcaggtgtttcatctgtaaaatgtggataataatctctatctcatagtccttggcaggtattaaatagaataaataacgtaaagaagctacaaagaaccccacccaaaggagatgtttgaaagcattcattccccactcctttttctccctcagaaagaacatggtgacacactgtttgtaagtcaggcataatttacatatagtagtaagattcatacattttaggtgaactgttctacacgttttgacaaacatatgcagccatgtaaccactaccacagtagatacagaatgctgccatcaccccagaaagtcacttcacacctctttccagtcaatcccttgcacctacctccaacccttggcaaacactgatcttaactctgttcctatagttttgcttttttattacaacccattttaaaagcataaatccaaacagcaaataattctccagagtttttccttcacatcctactcaaaaatagctcagctctgacggcaagctctctgttccaggaaaattcttcattaaataaatgaattccatgtgcatattaaaaagacattctgcttcatattccttctatttataaccagagttcaaccactgggggccccaggagcctgtcagggtctctgtgtgctctttagctcacactctctactccctgctccagcccaactgcatatctggctccaggcccaggtggcaggaaaaccaaggtgccaaaaggggcttgtggaagtgtgccctgaggaggtatgctccccaaacttttggtgcaaacttcaggatgtcctgcaattccttggggaatacgtgccatgtattaattactaacagcatggagaagaaaggaatcagtctagaaacaagaacaaagggaggggtggaaagggttaggtggtttctaaagtctttccctgcagagaagtcccatgacccaagtagatcatacaataattcctgcggccaccgccccctcctcaccttcatgtgccaaataccatgatcggcacaagaattaaaagtgaacaaatagaaaaaaataataataattatacttaatttttgcccatagataacttactgcctaatcgagaaacaaaacatgcacagaaggatgtggttgagtagaggagaaatagcatggagtattgaactagaggaaacagggttttaacctgaatagtcatttgcttgttgtgtgaccttggatatggtgcgtctctcctctgagcctcaaagtttccatctataagctagaaattacatccaccctcagaggagtgttatgtggactaaataaggttatggctataaatcacttagcccagtacctgtcatgttttagctcaagaaagggtaggttgctgggtgcggtggctcacgcctgtaatcccagcactttgggaggccgaggcaggtggatcacgaggtcaggagatcgagaccatcctggctaacacagtgaaatcctgtctgtactaaaaatacaaaaaattagccgggcgtggtggcgggtgcctgtagtcccagctacctgggaggctgaggcaggagaatggcatgaacccgggaggcggagtttgcagtgagccgagatcatgccactgccctccagcctgggtgacagagctagactctgtctcaaaaaaaaaaaaaaaaaaagggtaag

SEQ ID NO: 1053 - DNA, 4053 bp, Homo sapiens
taccaaatgcccctttctctttagttcatattgaacagtttcttaagaaatagagagaaatcagctgggtgcagtgattcacacctgtaatctcagcactttgggaagccaaggcaagaggatcatttgagggcaggagtttgagaccagcctgggcaaaatagcgcaactctctctctacaaaaaatttaaaaaattagcaaggcatggtggcatgtgccatagtcccagctacttaggaggctgaggcaggaggatcacttaggtacagaagtttgaggctgcagtgagctataatcatgccactgcactccagcctgggcaacagagtgggaccctgcctcaaataaataaataagtaaataaacatttaaaaataatagaataaagacaaataattaaactgaaatagaaacacaaatgttacaccatagaaactgatatacaaaacaactttttctaaacacaactaaaatcttgtcaccgactgagttgtctgacaaccttaacaggtagatgtatcccttaggaagttatagagaaacccactcttcaacaatctcttattattatctttactcatatttacagaacacttgcaagggccaggatttgtgctaaatattttgcaagcatcacctcatttatttctctcagtgatcccataatgtagtcactgttattatctctactttaaagatgaggaaaccaaggcttgaagaggtaaagagacttgaccaaggttacatagccaacgggaatttatctgaccccaagaaatgtcctttttaaccattaacaagatactgttgacaaagattctttgcttagccatgctttcatcaggcctctgaaacttctcttagacccttctgtgtacttcctcataacatccaattgtagcaaaagaaccctgcaaaagtcagtttagccagaacccccaatcctcaatatctgatcatcctcaataactaatcaggctccttatcctccaccatccccaggtggtatctggcttccctggcctgtcttcagcaagaatccttttaggtggttaagtcagagtctccttttcccctgatgtttcctcttagtaattttctattaactgactcctaccctgctcctcagccataaattccttcttgcccatgctatatttaaaggcgagcccaatctctctccccaactgcaagacgccactgcagttgtccttatatctgtgatgattctgagtaaagtctgccttaccatcttaccatgcctttttctttttctttctttctttcttttttttttttttaagacagagtctcactctgtcacccaggctggagtgcagtggtgtgaactcggctccctgcaacctctgcatcccaggttcaagcgattctcctgcttcagcctcctgagtagctgggcttacaggtgcatgccaccacacctggctaattttttcacatttttggtagagacaagatttcaccatgtttgccaggctgatctcgaactcttgaccccaagtgatccaactgcctcggccttccaaagtgctgggattacaggtgtgagccaccatgcccagcccttaccatgctttacaagtatcattaaataattttttcctttaacactgcctgcttgcaatatgtgattaatgaacattacatactttgcaaagtgtttggcacataataagtgtttaataaatgtgacacataagagatggagggagagaaaagagggtgacaggtaggcacacaagggcaaggcatattcacaaacacattgcaaataatcctggtagcagacctgtcaggtacttactattaacctgctttataaataaagaaactgagattcagggaggtgcaggggctttgagaaggtttcccagctagaagcttggcaggtgcaggattggaatgcaggtctctgagtccaacgtccgtgctctctgatatggctccattgtcccttttctctctcaaccctatgcacaccttatgttctttttattcctgaaatgtctaggaaaacaaaagggatcattctcttccctgaaaggctgatacagatgtgagttttggaggggtcaggggttggctactcttgctcgcggtatctgcgtggagatcacccacaggtgtgaggcttttgatacttcaaaaatccaatctctgctggaattttgcaacctgcaggtggcttgctctgcagggtcctggctccctcactgctgcctagaacacttgaaggagtggagatcccaggtccttagatcaaggcaaagagttcgatacggcttggtagaaaagagaaagctgtattttgtgctgtggctggaagaatctccccagagtcaatggatgcagtgctgccagttcccagagttggaatttctttacaataaagctgctgacagtagcaatactggtgctattgtctagccaggtggaggtttttccatgtaacatcaacagaaagcaaagctgtatcaaatagggccaaattcaagaagatgccagtgaagcactagggcacagccttgatcacaaaccccaaaggaatactactttaaattttaaaactgctcaattaatatgaataagtgaggtggtttgtgtttgcttagtacaatgcaaatcactgaggatgtttgcaggaaacctgttctccttgataactcctgctgtctctgcaacacctgcaaagatctttccctgctagaggagaaacaagtggcctagaagaaaagagttcctcttttcccaactatctgggacactttaaataatgttgtttcaaaatgacaagaatggcgacatgtttatatctgctgttcctttttgggttggcctcatgaggcagttcttactgtcaaatcttccacagcaggatgtgtgcacagaagattactgcaggcactacccagaggattaaaaaaatacatattacatatcataggaaaacaggacagctcttctatgttctccgtagagggtcagaaataggatgtgttatacacctaggtttatgtctgcacagtttatgtcctgcagcatgctgatttgaatatatttaaaggaaacaagaaggagttatgtggtgggagaaaggtaaagaaataaaattaagtgacaggtgtatattagtttgctagggctgcagtaataaggaaccatgaattgagtggcttaaaacatcagaaatgtattgtctcatggttctggaggctagaagttcaagatcaagttgccggcagggttgggcccttctaaagactgggagcgacactgtttcatgcctctcccctagcttctgatgggtagctggcaatcttggcatcttctggcttgtagacacattatcctgatctctgctattatcttcacatgaagttctcatgatgttctccctgtgtgtctatctgtgtgtccaaatttcacctatttatgaggacaccagtcatagtgaagtcactatgacctcgtcttaactcattaaatttgcaatgttctatttccaaataaggtcacattctgaggtacagggagttaggacttcaacatatgaatgaggactggggggtagcacaatgcaacccatgccacaggtgctttattcatgttagctcatttaatctacaaaacaattccataagaaagaagaccatgtttctcttcttagtgataaagaagtggaagctcagtaaggtgaaatgatttggccaaatggcattgtcttagtctatttgcattgctatgaagaaatgtctgaggctgggtaatttataaggaaaagaggtttatttggctcatggttctgcaggctgtagatagactgaagcatagacagcatctgttttctggtgagagccttgagcttcttctacacatggtgtaaggtgagggagggccagcgtgttcagagatcacatgatgagaaagaaaggaagcgatcaggattgggaggtgccaggctctttttaacaaccagctctcttgggaactaatggaatgagaactcattaccacaaggacagtatgaagc

SEQ ID NO: 1054 - DNA, 3639 bp, Homo sapiens
gttgtccaaacgtcattctgggccaccagaaatgctaccagattttaccaatgtgaatgaccgtccttgaatatggtagtttaaatggttaactgtctgtgtaaatgtgaaatttctttttaagtgaaaggtcttgctgcaagaagaatggctttgggactgccaacttacagggccatttctgaaaacccagtcattatgttgccttgatattactgttaatcatgagtgtccttagaacttattgaaatgctaagaatttttggtgaggatgtacaccgtttcatcttataggcagataagtctcctttagagaccaaccttatgaaattgtctagcctgctagagctgaataattttgtaaaataagtattgaaaggtttagtgtattatatagccaatcacctcgagtacactgaaacagccagtaagaagcttaaacatactcttgaagaggcaaaaagagacatcattagacagggcttataactgctgcccccttgattttctcatttcaggacttttatcagctcagtttcaacagaaagcaaagaaaaaaaaatcttcccttttaacttgcttattgaaatagaaggaattttttccttgccagtctctgaaaccctttttcaccaaacaaaacctgctgggagaagttttcattctttgtttggagacaataattttggaaatagaaaactgtgaactttctatgagatcagatgatttggaatgggcacatggtgtgctgaggcaccaatagggaatgacctctgtcgtgacagccccccagcacacacaccccataaagacctcctaggccacaggcctgtgaattgatgcatacatcatggggcaagatgaaagtgaaacacacctcaagctgtcgtgcttttcctttaagtccttaaggataagtcacagctattgttaccccaatattagtgaatcgaagacttcaaagaagagttttctataacttaaaagagtagatttaagaatggggaaattccatttatgtccaatgtaaagatacattcatttgcccttcccttgcgcttaaaaatttttcatccatcactgactaattatcagcgcaaatctggcccacagcctatattctcccatttgattctgtagcaggtggatgaaatttcagctacagtaaacccagtccctataatctaagtcctgcattagcaactcgtagcttaccctgaagaagtctagatgaggtcagggccctgagtctatttgattccattgataataacaataaacctcaggactatttcaaggagactgtaaatgcactgagtttatttccatgaaaattaaacaaaataatcagtttggtgatctcctttaacacagattaaatgtaaggtttattgtcctcttaaaaaaaggtttgtttatgtacccaacaaacagttaatttgtacctactatgtgccaaatatgaagtctcttgttctagttggacaaacagagaaatagaccaacaatgaaaatatgctgtgatcagtaatacaacagatgtaaaataaatatagatgatttggtcactgagaagggcacccaacccaggaaaacgggggcatgtattacaggcaaagattcagagctgagagagaacaggctccctgtaagtccctgtcgacagctgggatggctggagtacagttatgaaacaagggaggcagatggtaggcagatcaaggggcttaaaaatcatgctaacctgaaagattacaaagcaggaaagtggcaggaccagttttgcatttcagacagccaaggcccagatagatgaatgggctaaatcaagtctgatgggagaaagaggccagcagtccatacaacggagacacccttgccctcttttaattaataggaagttggcatcgctctttcattccaccctactgcagtgtcccatatgaggagtgagtcatctgatccttgaggctgggaacagctgggaggagtggagctcttctgcttcgggatctgcataagggcagggggcacattcgggtcaggccaaccagggcaagctctgcctatggatgtgcattaacagaagcggccacgggaggacggaagggtagcactgtcctcatccccattaccggctgagtgactgttagttctacacacctcattttaactcaagtaggactccaggtatagacctgggagggatctaagtcacgtgctccagcccagctttgccagacacaaaagatatatttttatctctgtttggctcctgtgtctgatttgcagttggctcaaaatgcagagggagaggagtatgatgaaccaaccctcctaaagattccccagcaagggcccaaatcacacagtggcagacagggtaggaaggaggaaagagagtccagagataacgaagtttgaatttagtgatccccaggatgtagtatcatcagtaaaggacaagcaatctttcaaaaccaccacaaaataaaacaactaaaacacccttgaaatgaaaaatagaaagtccgataagttagcactcttatttctatatttcttggtatggttagtgtatctatttttcatagaaaactttcttgtgtcaaaaatcttattacaaccatcctctactcctgatatattttagtctctgtgatgaaaaataattgcattgaagggggaaggatgccatccatgtttggacctccttaatcagtgcattacctgataggacatttattaaggataaaacatttcttttatcccaatagctgcctcagcagttgttaagatgagtagggggaggggaaagaaagcctttatcatttcctgatctctccagcaaattgccaatttatgcacagaatattacaaatactgctgaattatttcagcctggaattaatttagagaatcttccccttcttttgagtgcccagggatttggcttatctttatttgctgaaggaaccatgccactgaaagcagtcccaggattatttcaagtgaatgaataatgaaattgcccagcttcctaacggtttccaaattctatgactacctcagtacaatctcctgggctgattcatcagctgggcttctctcactgtgggtgaagccaccaggctcggaagcaggagcttctgcattgagtaattaaggccagtgaggacaacccagtgtcaccagggttactgaaggctgctttggaaaatgtagaaaagatatttcatccttcagacagcatcattagggtaacacacacaaaataatcaattaccaaaagcagctatttttaaataatccttcactggtgtgaaatgcctttatcacatcagaaatcattgctcttgctagaggtaagtatacacgaaacaacagggcttcttgtttggtgtatatttcttggctttaaaacaagggcaaattcaggatgatacactaagaattcaaataaatcactgttttacacaaagatgcgtatgtaccatggctaacctcctaaaaacactccactcatcatgttggttggctccagtaactgtctaggttatttcttttgttgctaagcaatgaatattaattgtggaaaatttgaaaaatttaaatacaaggatgaaaacaaaatgcatg

SEQ ID NO: 1055 - DNA, 2255 bp, Homo sapiens
ttgtagagatggggtctttcagtgttgcccaggttggtcttgaattcctagcctcaagcaattctgctgcctcagcctccagactcagtttatctgtcaaatgggaataataatttttactttatagaattaaatggaataacaaaagtaaagggtctggcacccaataagggctcaaatcattatagttaagaactactaggcactaggtacttttaatacatctcatttaaccatgacaactgctttatgatgctggcatcaccatttccactagataccagaagagactgaggctcagtgaggataaagagtttgtacaaagtcacactattattaagatttaaaactcagttttctgcaaaggccatgatgtttatttccactccaaagggcctaacttggggaaaagaagtagtgaagatagacttaaaaaaatctctcctgcaggggcaacagcagagaagtgatgattgtttttattttaccatgtagggacatgtgctggatacggattctactttagaagtgcccagaatcacagatgaggtgttcagaaagctcagggattggaggagggagggagcaaaggacaggtggtatatgaagtccagtggattcatcatgttcaccggcttctatcatattttttcatatttcaaggctgcattggcatttttttaacaggccatagaaattcacaatcaaaatttcaaagctaaaaatacagccatgccatcctggaaaatagttttgttttttttttattttgtgaaaaacaaaacacctgactgtcttctacccaataaagaaagaaatgtacaggctgcaatgagtaattgaacctacttttgtctgtttgcaataaacattcacaaaacacattatccttttgacatttctgttaggattgctcatattccattttctgtgaaatgctttccatcctcaccgggttcttgtaattacctctttggaagaagatcacctcagctctttagctacattatcaattttaaacagttgattcctaatcattgttgttgctgctattatgttcagacatctccggaggtggaagaaactatgctgtcttaagctgttaaaagatacagatagcctgatacccagccaggaaaatgatagttatagacaagcaggtggcagtttcatcatatttcttccattttgtcaattccaggggtcactgcatggcccaatagtggtaaagggagccacactgtctgggatctaaccctggttttgtcatttttcaagctgtgtggccttagggaaattgcttaaatatactgtgcctcagtttccttacatgtaaaactgggataataatagtacctaattcatagaactgttgtgaccattaaataagtcagtatgtgtaaagagcttaattatgtgcatattatcatatacagtcaataaatggtaactatgatggtggttataattattttggcatgatgataggcttgaaattgttgtcacttctgtagtatggaatattcttagttttatctacaaaatagacctatgcagtgcccacatcatgcagagtattatatctaggccacagtaataaatctgcattgtttcattttgttttttctaattgcagggggatgccactgaggtggttttcagcagaggaattaaatgaccagattaacattctacaggattattccacctactctttggggaatagactaggcagaggtgatgttaagaaaccagttaggagctagaataggtgagacatgatagggacattgaccatggtggcggtgaaggaggtgcaacaaaatgggctcaatgtgtaacttacacgcaattgtgcaggcaggtaacaattatagaggggaaatgtgaatgatgattcctgggtttctgaatgactgcatacaagagcaacgcattggaacgtatacagggacctttgtatgctctgaaacaacagcaaagagaacaacaaaaaaagaacatgaatagaaatgtctgtagggaatagaagaggaacggaaggaagcgattctccacaaatgaagtttgtggagaactgaagctctccatggagtgttgaatgattgcactgtccactgagagaatagcacagtctaagcttggcagaaggggtgccatgatatttgaggaaggctgcacttgtcacttatgcacaggaacaacatggctttgaattgctaataagccacattatgcaggtatggccttgccac

SEQ ID NO: 1056 - DNA, 4514 bp, Homo sapiens
atgacttggatcccgtgctccttctcatacgttgtagatgtcttccaggagagaggccagccttgaactaagccatcttactgagaccatgactccacctaagtcttatgaattcttttctctatagagctgaatctatattctgtgccttccatcactgtttagggcccagctgaaataaattgccttccctccctccctccttcatccctccctccctccctccctccttcctccttccctttctccttcccttcctctctccctccttccttcctcctcctttccttccttccttccttgtttcctttattttttctttctttccctccttctaaagcatttattgagcatctacatctactatgtgctgggcattatgctgggccctgaagattaaagggtgttaataacatagtcccagcctcctggagcttaatagctagtaaaaaaaaacccagaaaaatagccagataatttcaatatagtgtgataagtgctaggacatagagatatgggatgcagtaaaagtctataaaaagggccgggtgcagtggctcacgtctgttatcccagcactttgggaggctgaggtaggtggatcacaagttcaggagtttgagatcagcttggctaacatgatgaaacccccctctactaaaaatacaaaaaaaaaaaaaaaaaagtagctgggcgtggtggtgggcacctgtaatccccgctactcgggaggctgaagcaggagaatcgcttgaatccaggaggcggagtttgcagtgagcagagatcgtgccactgcactccaacctgggtgacagcaagactccatctccaaaaaaaaaaaaaaaatctaaaaaaagtaatctaacctagcagtcagggtgccagggagggtttcacagaacagccagaaagaaacctgaagagcctttggccaggccaaagggaagctagcatgttttttttctgtttttgtttttgtttttgttttgtttttgagatggagttttgctcttgtcacccatgctgaagtgcagtggtgcaatctcagctcactgcaacctctgcctcccgggttcaagtgattctccagcctcagcctccaaagtacctgggattacaggtgcctgccaccacgcccagctgatttttatatttttagtacagccggggtttctccatgttggtcaggctgatcttgaactcctgacctcagatgatccacccaccttggcctctcaaagtgctgggattacaggtgtgagccactgcacccagccaagctagcatgttttaaacacagggaaaaaaatgggcaaaacctgggaggaaaatgaatggggaaatctgaaggacccacagtttgttcagggggactggacaatggacagcaagagaagtagagagaaagttgctgtgagagaggaactcatgagtctggctgcacacagcactggtgagaaattgagacttcattctgagagcaagggggagccctggcgggattttcagcagaaggtaaaactctcagatttgagctttagtaaaataattctcactactcttttgagaatgagcccaaacagaggagactgaagctgtagggagggccctggtaatgtcacaggtgtgagatgagggtgaagttgaactaatgtagtagaggtggggatagacagaattgagagataccacccttagggctggttgttactttcagtgagtgcttggatccatactgaatgagcctactggaaaccatatcatgaacaaaactaacaatagtggatttacttaccaagtgcttctgatgaagccaggtactcgactaagaacttaaatatactaccatatttagaaatgaaaacaacttgatgatggtggcaaagttattttctttatttcacaaatgcagattcctaagacccattggaaccttactaaacccacatcttcagagatggtgcccgggaatatgcatttgagaaccagtgctctcaatgtgcactaagtttttattgccactgctatgagctccaaagcaaatgacatttttattctggggaatggcttcaattaattaaaaaaatttcaattccaaaaataacaatttcaattaacctgtgctgccttatgcttaatgacatacagatgccccaaatagtatggaatactccagtgacaagtacacgtaaaacactgagctgagaatgagactgacagcactcttaagtagagatactagtttagagagaggtgtcttttggggcctcaaatggaatagtcttgagatgcagagaacagtctggttgaaagaagatgacacactcaagattcaaaggcaactcaggcattggaaagtacctgaaataccttcaagtctgaagattttcaaactgtgttccagacaccaccgagcttccttaaatgttattaaaaaacaaggtggaacctaaacttttagtgttggggctttcctcacccaagtaattcagccttttaactgcttcacatatggggtttgatctagaattctctttgaagaaaggggacaggagatttggagagaaataaatgaaaggaatttatgcagtcaccaggtctaacacatgttttgtgagcatatgcataccaggtgggctcagtgtgaggcatgaaagaactaacgtgaatagggtcaggcctctgcctgcatctgttaagaatctttgggtgcaagcaacagaaaccagcaccaacagacttaaacaagtagcaggatttgctagatcactcagggtagctctagaatggatcagagaattgaataatcggacttcaggcaagaaagagccaggaggctctagggatcttggtgaggagaactaatggatcaactccgtaagcctgtcagcagaatgactttgctctagcccaggtgtcattcctctcaaaaaccaaacactctttgtatttttagtagcctaaaaaaagctagagtctgatttgtccagcttgcatcatactcacgtgggccaagggcgtaaggctatggatgggctgatggcaaggaaggatgagttacactcccagccaaagcacacggcaagaagtggggtacttctccaatggcaaagggggtatagtaaacaaagtgaggtggaatggaagctgaataagcaaaaagagcagctgcctactagatctcctgcagagaaggggaggttttggagataaatattttttgatctgcccaccactgcccccactccatgtctgaagccttctccctagtaatccttctctcctacactgtgatatgtgatatgaatagatgctcatatgttcttacaggtttacccaacctggtcatggttgattggtcctggtccagggatggcccattctgggccaatcagggactctccctagaactttaaaacttacagttgtgtccttaaggattgttggtagccattcttctccacattcaggaagctgaccacagaatattaagacacagagtcagggagaattgtggctttatttgagcccttaattctaattgtccctgaagccaaactacacacagtggcccttgtcacaatggcataaagcaatctaatattttcaaaaaacaaataagcaaaacacaatactttttttttaccttagttcaaagtgggattctgtcattttcaactaaaagtgtcttcaccaataataagtgaacaaaaagctgaacatcaaggtcatgtgtagcaaatgctatcagaatgatatgattgatgttaaggaaaaactaactgataattctaacagctcttatttactgagcacctagcttgagtcaaccaggctaggtatctgacatacattatttgatttactttttgtgtcagccctgcaaggacatctttacctccatctcacaagaagaaattgaggccagagaagttaaaacactcacacattattgtccagctaggtgatagcaaaacctggattcaaatctgatcctagaacacactctctttgtcctgcagccagaaagcagagaggcactctttatcctttgcaacaatgggcaggtcccccatgagcttatcaagaactacaatcaagttgcatctctgctaacttagaatataaaatctttctggtttgtttttgctgagtctagacttcatgttagttatcacttcattatagcccattattatttaggaagttgctggggagttaagtttgcaaacatatttcaatagtacctcaactcctcaggccaccagactgttgcatttctcacagtgtgcagtttttacaactctcttttcttcattagggtaagaatttataagcctgacaccttggccagggaattgtgcatcactatttctgagttagggcccttctgggagggtggtgtgtgcagcagaatgctttctttgtgcagtgggtggaggtgtatgttatttgtagtcaagaccatatcaatacaaatagcacaagtctctgcaaattcagatggcacc

SEQ ID NO: 1057 - DNA, 2541 bp, Homo sapiens
cctattacaagttccaggaatagccaagtgaagagatagacaaatcctctctctccacaacatctataaagctggacaaaattagcaaaatcaaccatcccagagttggaagttgaacaacagcatataacgacctgagaaacatttatgtttgaaaatctgctgaactttgggtcagaacagggggaatctggtgcctgcttgcctgggactgaactccttcccaatccatatggaagctcgaagagggcaggatgagcctaaagaccacaacttttctgccaggtaaatgtggactcaccaggctcaaaaaggtgggagatgcccatgctcaagtgtattttcagcagaagtgatgacccaaggcagccagcagtgagggtcaataactccactggtctgacagagacgtattcctgcctgaggctgctcatctggcataagctgttcacacactcctggctgatcttgaggctgagaacatgcacatagctcacaagaaaaagcacagtgtaaattcaaagccagaacagctttgaaaaatacccaaacttttaatatgcttttctacccacacatagttccaagaaagtcttactagcttgaagtatttgaacacaacctctgtccactctgactgctgagctatgcaaacacgtggcaacccttaggcttaaaaataaaaacatgagtgaaaaaagcaaaactaagtggagacatcatcagccatgcactgtgtggggagggtaatgaatttcacagatttagcccatgaaagctactaaacaactcaagagagctcagcttaaaaaaaaaaaaaaaaaaaaagatgagtgatcaaaggtcagaagagctccttttctaaattccaaatctcatattcacttttaaggctttacatcacatctccaagcaatagtggatacagataactttatttccacttaagttctctattttgcaaagttggcttgggagatactgaaatcagtggtgagtatgtgtcagcaaagaacatatcaaaatagctgatggtatttcttcaaaaacatctctctgatctgaagtatagatgagcacatccactcagaacaggcatttaatgcaaaggcttttccagtcggctctgatttttcaaagcccttctgagttttatagcttataatagcatccttttttaaaaaatgaaatctgaacaattattaaaatgtagcatgccaatgaaggaaaaattgatgtgattctcatgcacacatgataacacattacgaaatgctaccagtgagatgagtgttgggacaaccaggatgtggctgcagccttaggcctggacactacctccagttctctaacacaatagaataaaacaaaaaggaagagtcctcaataataagctatcccaccctttattaaatgcaagaatcccctccactatatcctcatgagctcctttcagcatctgcttaacatatataatgaatacagaagattactttagaataggggttaggtctggggttatatctatttggtagatgtatttcatttggctaacatttaaaaaaatgttagcaatattttaaaattaggaaatgtcacacaaaaacttgattttctaacttttaaaggaagcatagttctggccactctaggccccatttccacatggaaacaaaatgagactgattaacaaatgctccttttgaaaggggcccggaccccctagctcaccaaggtcctgaccactgcctaatgcccataggaccacattaatcgccacattcacactgttgctttttcttgaagtaaagacagacagatgtgtcccagaactctctccactgaggggaagtgaaaggcagactgaacctgctctggttttctacatcaagattactcaccaagtgcctggcccggagggatgtgagagtgtgaccccactgtgtgaggaaccctcaaggacctccttcccattagtcacctctctccatctgtttgccatataattcctgcaaacctccccgattctctgtacatccttttatcagtctgcaaaaggaggctctcttctcggtcctcgctccctctacctgacaggaatgccttagaagccacttgataacatctgcaaaagggcggcgagcttcccatatgtaagtagatacaacagagcatgcatgttaccatgttgagtgttattaaagttgcttatctacctccaagtgacactctcatataagtggctagcaactcatgttcagataatgctaagcagtattccaagcctagaccacaggatagacctataaaccaactaaaattttgtagagaaaatcccagagtgggcagaggttttggggatcagtgaagaataagaggaaagagaactctgttttaaccactgttgtaaagataagaaatgggcagacaggaggtcctggatctggaagactatgttgctgtcattgattgtgggcttactgtatgctacacatcttatgtgtgtggcctcatttaattctttgtaaaactccatgagat

SEQ ID NO: 1058 - DNA, 4815 bp, Homo sapiens
gaataggggcagcctagcatggggatcatcagaatgcactttggcaataaatagacctgctttccaattctggttcagccacccgagaccttgggcattttattccacttctcttgagcttgagtttctttgtgtgtaaaatggggatcgtagcaatgctacctcataggattgtcataaagacaaacatgtaaaatgctgagcttgatacctgacatacttggtaattacccaatttctggtagaatcttttacagcctgcaaataaaaaatgagagattcagaatttctaaatcctacctggcactttccagctacatcatgttgggcaagtcatttagattatctcagtctcagcttttctatctgtaataaagaaggaggaggaggaggaggccacctgcccttggatcttgcagaattgaggagggtttcaaatgaagtaacattcaagaaagccatgggggcagggagtgggggtggcacccaaggagtgcaccatctagttacagaagcaagaccaagaaagatatctgacaatctttaaggtgatcttactttagagaccgtaagagcaaaagaggctaagagaagagtgatctataagggctctaagaggagttgggatgggccatgtctttgtacatggatggaggttggcagagaggagaggagcattccattaatggtgaaatgggcacagcttgtgtgtttggggagaaagacaggttggggaagatgagcaagaaggaaactcctttgcctaaatcattatcaagcacgaaggacagtaatgatacaagtaggatgggacatcatgacggaagggaattggagagagagcaaaggatagacattttatttctgacttttgatgtggccattgttatctttgcctactcagcatctattaccttgattttcctgtggggagcccccacccccaccaaactccaggaatttgaattgagggctgacaattcacacaagtgacgaagcctgaaacctgggattcttccttgactaccttcagccttcccatccagacagccctcagttttgtagattctacctccttaatacctccgatccacctatatctctccatctccactagcaccccccaatccaactcatcttcacctctcatctgaatacatatgtcagcctcttacctagtatccttgcctccactccccctccctccaatccactctacctcctgcagcaagagtgtttttttttctatagtgcagatgttcctctcctacttaatatcttttgatggcttcacattatccagagaataaaatccaaactctttatgaatggcaagtcctcatttacctagaccctagacccaagctacttatacacttcctttatgatcttaggcaaggtatttcacttctctgtttctcagtttcttcatttgtgtaataaaatgaatcttataatagtacatactttacaagactgttgtgaggaataaatgaatgcatgtatgtaaagcacttagaacaatgactgggacattgtagatgcttttaagttgtttctatcaccactatcaccaccactaccactaccaccgccatcatcaccaccccgtcatcatcattgttatcatcattaccatcatcacatcttcctcctcctcatcatcctcatctttgtatctcatgctttttccctcttactctctgctacagctatacagagacttaattcctcctaatgtcccaaccatatctcccctcagaatcttcatatgtgctgaactcttttccagggaatagatcctaggattcccacatcatgcctcttcacttttatcttaagtgtttcttccccagagaagccttccctgagtatctcagatggggatatgatgctgctacactgcctcacagtatctcatcccactttttaactggtacttccttattcagtatgtctctcactcacttgactggaaactgcttaagggcaaggaccaagtatgtctcagtcaccactagccacctgtcccactcactaccctatccactctatcatataatgtgttaccatgtttcacatcatttcctttccctatgccctctcattttcatagtgggaaacattcttcctagtggaaataagttttctgcttatttatagcactcttttatttgaaattattttaaaaactaaccagaagattgcattttaatccaactagctaaatcatttgaaatatttataagggccattttcagcctttgttctaaaaaaaaaaaggagtgtggggtggggagcaggcaatagaaggcacatatgatatggaatgagcagagctgaggctctgaaggaccatcaaaagttgccactctgcccactggaaagatatttcccaaaataaaagacatgccattcactgacacttgcatggtgttgaaaccatgcttgttctgccttgtgccaaaagagtttgggagaagagggagcgactgctcccagctctgtcggcagccgcttctgaagctaccatagcaacaagtatagactaaaagcgatccttccatattaggtgtgaactgactccagacaaggaaaatagcttgcagagaagaagccaactttgctgggaaacccacagggagtaatacgccagtgacccatccccccaccccaattgcctttcacttccccaaccaccatgtaagtaatagtagacagaattttttttaaaagaactttccttcaaacattcagacatacagccttgcttggtaaaattgcactggagtccttccccaccccccaagccccagcgctctcctctcttgttctcattctcagctgcctcagtagcccatccatctgtcagtgcgcatatgggtaaaagaggcaagccaggaagcagagagaagaagaatttgtatttcataagtatcttctcagcagaggagtagaaaataccttctgccaaaacagaatggggtggcaggcctggagtagtatctgctcagctagaaatgacccttaaaatgtagatgctactctgtcatttgggtttctggggcaggacctgtctctgtccccatagctttctaccctgaccaccctacccctttcatccaatcatccattcccacccagagacaagactttcggtggcacattgaggcccagttcctgcctttgtccttgtccaggctctactctttagccctgaatcagttcagatcagaactctgacacataagtgactgtgcaaacttgcgcgagtcactttgtctctgagcatcagtttcctcggctgtaaaacatgactaataacattgccaaacttgtaggtaaattgtgaggattaaatgagataattcctgtaaaactcttagaacagtgtctggctcataacaaatgatcagtaagtgttattttttcctcccacaagcttcatcttccagctcattttggagctgcccacattgtctagtcttgacagactttgtcctcgaaggcaaagaccatgttgttttatttgtctttgtcatattgatttgtctacagtcctagttacctaatacacagtgcctggctcagtgtacgtgtttaatacatgtttgctgtgaaaggcacaaattgatggatgggaggatgaatgggtgggtagatgcataaataatagaagggaaaacccaccttttcttgccacatagaatcagggagaatctgggtctctggcaagccatccaacagagatgagttttccaggtgggttgacagacttgcctagtcttgaggtcttttctgaccagaggctgttacatggagttggctggatgtttccttctccatccatatgggaacttgggaatttggctaaaattctggtattttgttttgtttctctttcttagcttgacactggggcttctttcctttctctccttgagtgccagcacagatgccagctggcccatgggctctgttaaccctttccagcctgcccttgaatggctctgccaatactctgtatcacttggctttgacatgaacccacatggcttcttgcctcatgatgtttacactgctaccctgcctctctctctcagttcccccaacctggcttctccagtcacacagagccacatgagaagagagctggtattaagcacagatctggaaggaaggcaatgcataaagctgtcagccttaccttgtgcccatggcacagttacctggcccaggcctctgaccacagggcttatgttcattttgctacagtaaaagtcttctcaaagtcgtttcagtgagatggagcgttattcctatccctctttctgtctcatctccacagcctatcttagattctttgcctctttattatctctaattttacaaagggataaactgaggctcagaaataatatgagatctatataatcatgaagtctcatcactggaaaggaaacagccctccagttgatggaatcctggcgatgcacacatgaataaaagcagcagagcttgttctagagggtacaccttctgactgcttgaggtctagcctaactccagagcatcttctgcttacactgcagtggcatttactacatatgttgaaatcatctgttcatatatctgcttcccattctctgactgagactttctttatgacggtgttccagatatttttgctgcataacaaaccatgtgaaacatacaggtttacatgattatctcaatagatgcagaaaaagccttcgataaaattcaacatccttcatgttaaaaaatctcaataagctagatattgaaggaaca

SEQ ID NO: 1059 - DNA, 6108 bp, Homo sapiens
atcttttgagtcctcataacagctctgaggggtagatgttattgtccccactgcattgctgaagaaactgaggctcagatgtgttgagtcatttgctaatacatgcaggagccaggattcaaaagcaaggctttctgtccaattccactttcttctcattccctcattttctgagcgcagctgaggctctggggtgagtgaagatcaaatccgagtttccgtcctattttcccctcaggatcgctctcacagagtcattctgaagatggaagcagaatcagaacagagcttgtgtgttttgttatgtctcacctctttttcccaagatttcaaaggcatgggcccatttatctagacactcaagttctcaacaggggcgttagcagctggggagtggaatgttgtttggaaaggatgaaacaacactggcagtgtttatattcaattccggagacctggttagaaaaatatttttaaaaaacggaaggaagagtaaccatgcacttacaaaatgtggcctccttatcgtgagggacttttgcccttggattctattcccaggagtagacatgtccagcctcagactgccgttaggagatgaaagggaatctttcaacatttcctcctattgtttgtgctttctctctgctttgtcaccatcatattcattattggaattttgttaatgtgccatttctcccctggaaacaaaagagaagagctgtcaaagcaaagcaggaaagacgtgtggcttactcctaagtgagtaattatcatgtgtcttggaatggttggctgcttccagttgaagatgtttgagctaaaaaggaagacacataagcatccagtgaagtgaaagatgggggaatccacctggctgcgggaggtggcttagagcccacagtaaggcatggggagggctgaatatgacttgggaactagaacacctgagctcaaatcctgattgcactctgtacaagctgtatgaccttgagcaaggtacttaccatctctgaacttcaccaagttcatcacatagacaggaattctgtctatgtgttgtgtgttcttgtgaaaatgaaatatgagagaatatgaaagtgcccggtacgtggtagctttcaaatatgtctttttccttctttctttctcctgttaacatcccttctacctgcacaatctccaacatgaaccttttttttttttttttttttttttttgagatagagtcttgctctgtggcccaggctggagtctggagtgcagtggtatgatcttggctcactgcaacctccatgatatggtttggctgtgtccccattcaaatcttaacttgaattgcatctcccagaattcccacatgttgtgggaaggacccagggggaggtaactgaatcatgggagctggtctttcccatgctattctcatgatagtgaataagtctcatggatatgatgggtttatcagggatttctgcttttgcttcttcctcattttctcttgccactgccatataagaagtgccctttacctcccaccatgattctgaggcctccccagccatgtggaactgtaagtccaattaaatgtctttttcttcccagtctcgggtatgtctttattagcagggtgaaaacagactaatacactctacctcccaggttcaagtgattcttctgcctcagcttcccgagtagctgggattacaggtggctgccaccacacccagctaatttttgtatttttagtggaggccaggtttcaccatgttgaccaggatggtctcaaactcctgatctcaagtgatccacccgctttggcctcccaaagtgctggattataagcatgatccaccgtgcctggcccaacgtgaagcttttgagatggccaagtgaaagaaacaggaacagtatgaacaagaaacctcaagcactggcaacttaatttatctaatgaggaattgtatgtatgtttgtatgtatttgtgttttggagcaataattcagagcagagaagaaaagaatatttcattgaggttatctgtccatgtgggttttcaacactgctgtgactattaattagagtgtgtataattaagcctaccatttacaaagcgcctgttctatcctgggtattgttggaatattatcttgtttaatccttacaaccaccttatgtagtaggaattgtcatgcaaatttccacacaaggaattaaggctgagagaaatggtcagtagtggagttacaattttaattcagctttttctgattccaaagctactcctactaccactgaatttcaaaagctcttgtgatctctaacactcatgttagtatttagtatgtacaatattgtgtccactcatacattcagtcaaggagctgtcatgtgctaggaactactctaaaatggggggattccaacttgtagaagatggtctttaccaattatctaaaaattttgaacttcaggtattttttttaacctgtaagtgggaaaactaatatttacctgatactttgagaggattacattaataaatgtatgaaaagcactttagagtgtacttagtatatgcaaggtgctcgcataagtcttagaacactcaaaccaggcagtttgaggtgaagagttattgaaagagttacaggcatagagaaagcaatgaaggatcttgctagatctgaaggctagcaacagaagggcactgttatcttccccgggcctgaaagggtgaggggaaggcatggtcatggaaccaggaggaggtagcctcatagagagggctgtagcctttcaagagctgtggtctttggtagagaaatgcagctaacccacagcaacctgacagaaaaggagccaggagaggaaataccctaacctcactctcctttcagttctgatctcctgctggtggcacccattggccaaaaccaactggagactggggacaagggagccccttgatatcatctacatggtcagcctccaggggcacagagctggatagggtagtgcagagagtggatctagttgggcagaaaaagtatccagctgcatattccataaatattgaattcaaatccccaatctgaaattgcttgtagtcaaataagaaagatcagactcttacctaatgttcacaatacaggacagggtgggtgagtctatcacagtaggcttgagttggactagatgctacctcatgtttgtcacagcctgcagtgtgtcctcaatgtctcacaaagctcagactcttcaaagcaggccttgaagaccctctacactggggctcagctcacatgtcctcctctcacctgatgtagtggccaaattggattgctcacggttcatggtgttttcctaagcacagttacacctctgtgctttgacggaagtgcttcctccagcacagcaggccctgctctgctgccttcccccagcccttttaagctctcagggcacataccacctgctcaatgaatcctcctctgctcactcccactcagatttttagcatgattttcctgtgcttctgcagtatagggcttgcttatctgggtaaggcatacttcattcaacaaacatttcattcagcaaacatttactgaatgtctatagagttcctggcactgtgcaaaaagggactacaaagggaatgaagcctggttctttctcttaagaagctcttattcttcctggaattagcattctccttctacttaaccatctccccactagactatgggtgtgctgaggacagggaatcagcttaattatctttgtgctctcagtgcttagcaaccatgtggcacagaagtctttcaggaaatgtgaagctatagaagaaaaaagagagaaagaggaagaaaggatagaagaagttagttaatttattccacagctgtttgcgaagtgcctaaaatatgccaggtcctaatgagcaatgaatagtacacaggctacccacatacgggtgtgtgtgtgtgggggggtggcggtgcacatgaagactcagaacttagtggtgagtgtctatgaagctctgagaacaaatcagaggatgcccctcttgactagctttctgaactgaagctttccgaatccacaggaaagaagagagggacctaactggatgcccaactgagctactgagtggtggttaaagggactcttcaaataatttcagaaagcaggtgatttttgcaattgcaggcttataggcatatggtatttggatgatataatttctttaattgaaagtgttatcttaaccagggagttttgcaaaaccccaaaacaaagacatctgttgctgtttttgttcttttccccagcaaacaatctggtggtgaaaaataggaatgactaaatggaacaccagggaaaatcatggatttgaaaaacaaacccctacatctttaagaggggggcaactaatcatggcacaaaacaggcacttctgaatagagttttctgtgaaatcttgggtcattataactctacttattttcatatcaataattattaatacagaaccaatgagatgagcttatggcaagtttagtgcacttctctgttgtccatggaccttagctattagctctgtatgctggtggtttggctaaatctttacaccagatcctttaatccatctgcctcctggacatcttctcttgatggcccaaaggtacctcaaactcagctgctcaaaattaatctcatcagtctaccggaacctgcttcttctgaattctccattttggggaatgtcctgccaagtcagaaacctctcaggaccttctctctcctgcaaaccttgcagaagctgaaatcaaaatctgttgtctctctgttggaaagattctgcactctgctgcctcttcttcacccccactacttctgtctcccactctctggttactgcaatgattctgcctctctctatgcctttattcaaccttgaccatgacctatagggaaatggcaggaagcagaattcacctcacatgattcaaatgaagaaacattaatgaaggaactgcttagaggggtggagaagggttaatggaataaacaagggatattgaggcacctagagactagcaacagttggaagctgttatctctacaaccaaagggacaagggagagaaacagatattgaagcccagtgagaactggaactgtggaggaagggctgcccagtggggcatagccagagaggccgtgtggcaatagggagagagcaggagagaaatcacacaatgcactgtctacccactttccccctgttggtacttcccattgtttggacccggagcctagttcaggggagcccagaagaaacagtctgcaagggccagcctcctgggcacagagcagagcagaaaagtgctgagaatgcatctggggcatggaaaaggaggaaagagaatcacaagcctctcccctcttatccattctacactctgatacccgagtactcttcaaataccccgactatgtctctcctctgactgaatcactttagaaactcctcatttcactcaagatagaaaatcacagctcctcaagctagcattgaatctccccactgccactgacctctctagtcccgcctatcactactcctggtgcttacctgaccccccgcccccagttctacttccaggcccctgaatataccatgctgttctaaatcttcatggcttagtgaatgttcatttcttttcctgaaatagcctctccctccccacccaaacctttccaacaccacctgcctggtgagctgcaagtcttcctttcaagcctagttcagatgtcaccttctctgggaagtctcctctaaccattccactcctcgacctgaattaatcacccctgcctctgaacaatcttcatcatacacatttacattttcactattgacacactttatgactttctcttgatcatgtctgtaccccccagctagactggtaggtccctgaaggtgaaggctgtgtattattcatcttggcctactagctaattgtcatagttcctggaacattaaatctgttcagtaaacatttaaggaataaaggaaaaaagagagggagg

SEQ ID NO: 1060 - DNA, 1792 bp, Homo sapiens
gatttttctagctcatagccctattctgggtctccttttcaagttttttaatatattcataatttaatacattaccttttaaatattattttattttagatttaggggatacatgtatatgtttgttacatggatatattgagtattggtagtgattggacttctaatgtacccatcacccaaatagtgaacattgtgctcaataggttatttttcaaccctcacccttttcctctcattagtaatttttttgcagtaggtatttttgttaggctatcagacgttgaattagtggaactcttcttaaaatgacccataggtgactcagttcatttctgtgcagtactcttaaaatagagatttttctgactttctagttgagaaagatcatgtaattaattgtcaaaacttttaaatcaaaatgctagccttaatataaatttccaacactgcagtggagtcagggtaccatataaacctgattactgtggcaaaaagcttgaagctttcataaatgcagaacaatgctggtaaagaggaacctgattttaaaattattgcttaaacctaggttttcaataaagagcggaaattgatgagcgtttgagggaataataaccaatggttacagtcaaaatggtaacttctgtgacatttctaagtatgcaagtgtgagatggaagtatttggagggactgagagctcttcactacctctaatttaggcagctttcactagattgggagagttccaatatatatacctagttgcaggtgtccatccttgaagaaagtgaaaaaggtcaatgaatgaacagattccacaagtcttgtctgctactaaaccaactggtcagtgttgttgtggaaataatgtgtgaaaagcatagagcacaggtcctggcacatagtaaataccaaatacatggtggatattactaaaggaggtagcaatgcttattagctaaaagcatagattctgaaatttaaccatctgtgtttttgtcttgcttccacaataacagctgggtaaacttgggaatgttatttaacttctctgaggcttgtgagataaaaatagtactacctcatatggttgtcaaggaaataaacgagaatatatataatgcgattaaaccaactcctagtatgtagtaagcactcaatgtaaatatcagttatttctactacaactgcaactatgatgagggtgatgactatgactgctatcaccactgccttctgcaactactgctgtctggcctatcttattaggaattggctgggagcttgtagaaaagctttggaaaagcagaattggataagtcaggacctgactaatctgaccaatttgggcagagctgaagcttactttgtaacgccctggaagcaaatatggaaaaacagattatcatgaggattaaactatctgataaaacaaaacacttttagcaagattatcaaattatttataagtaaatcatgaaatggtgctattttaatcacagatttaaggcacaccaaattcttaccccacatgaaaagacctgaaccccaagatttaagaaaaaacttatatacactttaaaataattttctaacagttattttgtgtgctgcaaaagaactgacatattttcttattgtgtaaaatatatataacaaaatttattgctttaaacatttttaaagagtttggtgacattaagtacattaacactgttgggcacccatcatgaccatccatctccagaatattttcatttttccaaactgaaactctttacccatta

SEQ ID NO: 1061 - DNA, 4214 bp, Homo sapiens
aaaaaaaaaagacatgtcaagatgaaatgactgagcagcacacataatacgtgctcttagcttcaagaagagtatttcacagtgggctggaatattctgagaagttcttcctggagcaggaaggcttaaagcatggaagaggtagtaggcaaggccgaatctctcttatgattccaaataaacctcccattaaacttgtctatctttaatttgagtttttgtttaaactgaaagcagcaacagagatgacactgtatagatgacattatataatcctaagctatatctgttattcatgttttctacaaacctttccccaactataaaaacaacaaaaacaaatgctccagagactccaaggagtcagtgctattattccactgagttggaaggaaataatcatcatccacttataaatccgggattactccaatttcatgctgagccctgaatgagataatacatacatatatgtaatctccatatagagtacagtaagaaagcttgaccagaagacctgtgtgcacccctccacacactttttttaatgtaaaatatctgagtcggaacacttctcaatgaataactaatcctgggaagcatataatcatgttcattttctaactcttttgtggtcaaataataaatacagatgatacagaaaataggaaccatggcaaatttggacaaacgtaatttagagacagtgacagaaagcttagtcaagcttaatgctcacaatccataaagcaaaaatcaggacaaaaaacaccaaacattcccctgaggctcatgattacataagagggtccttcaggtcctttggtttagcacaacctcttcttttcccagcaatcacactcctacagctaaaagatgtctggactacgacactcattatttacagcagttagtgaagctgcaagagtacctacatacatatatgcatacatacacagtgcagaagataatgagtaatgccttagctcatcttatttccccaaacttgtaatttaattatgtttccaatgggagaaaaaggcacacacctccccttaaagaacacttttttatatacaaaaagtaaagtggacgtatttcttttacttgtgccatttctccatttaagctgctatttgctacttatcagcatgaatagaagaatggatgaaatgagcaaaacatagatttttgttgttcctgccatgtaaagttacagcaaataaattgcacagagaaaagaataaatgtagaaataacctaaatctttttatgtagatgaggtaaaaaggcagtctcctttagaattgctcctttagattataatagcaatttatgttaaaagtcacgatgacaaatcagcctgtaatttattttaaaaagtcaaactagcaagatcaagcgtactgtaggtggtatttcatcttatcatattaaaacagtcttcccaaatgtaaaagataatctcaactgctgtgttctgtaagcaagcagaaaattatgtaaatctgatttccttactgtgtgcttactatctctttaaagcttactaaatcatatccagatttgtaaacacaaaagcactggatccaagatatatttgcctttaaacactcagaatgagaaaaggtattttgcagggtgtaattgaaaaattcctatctgttttcaaaagctaacaaatcaacaattatgtgagatttaaaaaaaaatacaaaacatcaccttttaacttattatgggcttaattgcttcctcataatggagtgtgacaatgtgattgcaataagaacagcacctgctttgaaaatcccatatcaaagaaatgccagtaagggagcaggaagctcacacggcagccatgttgaagttcctcttcatctatattttagctttcactgtttcttaccctctgtactttaggtctctttaggctcattgcctgaataactggtgtttgctttgttagctcacctaaaaatgtctgtacctgtatgcatgctcacgttggagatgtcataagcataaaggcacatatatgtagctggatatttctccgagccaaaatttagaaactttcttcttttcaaacacagaaatctcctacatgacccagactgtaatgtgctctgcctgtgtgctagaagacaaacctgtgatccagattgcacagcatgttaaagtcaatagccgtgccaatagcatggactgtcctcatccttcctgtgttctgcagaagtaatactttgatgtcaaagttaaattcactgttattgtgggtttgcatttacctgcatcagtacactccaatctatttggaaatatacatctaatcttaatatatatcttttcacaactaatttcttactttatatattacagcaaggcaggaaatcctttactctttctatgaagagttaaccaagtaataaatcaagttaaaagatatttaaattactagttatgttttagttaagataaatgtatagtatttcctgcacctttaaaaaatgagagtaagaaaaacaaactctcttgttctagttcctggcctatagtaagtagttaaatatttgttaagtgagaatgctattcaatacattcagtaagcaataaaatatacattttggttctttattaaggaattttgccaactgtaaaataacacaatattccattttaattctagcattctagaattttaagtgatagatcgagacaatcacatgagagtaaagaaaggcagtgaatgctgaacttacatatgctatgagccatacaaagagaatgaccagcaaatacagtaggacaaagaataatgagagatgtgctcaaagggagctatgcacctgcacataagacacactgagaggctgataacacactcacacacacacacacatgcatgcacacaaacacacacactgtccttatgcatagcaacatttagaggcacacaaagacacttactgaaagggcagaggaagactgagaattctaattatggcagaaagtgaggtgaatgggaaacagccccagtttatgtgtttataggataataaagactgcaaatgccctcttgtattttcacagcagaaggtaccaacggcagtgccagctctgggtgcttgccttctggctagatgacattaagctgaggtgcatatgtggcctgtgggctgaagatttcacacctgctataaaggcagtctgtgttaagtctcattctaaatagtacctgtgtaatagtagtgttcaaatcaatgtttcacacaaataaaaactcacattcatttatctataaaactgctataatgttaaggcactgagtataagccctaataaattcaaatgctaggcacattatatcaatgtgctgtcagcaaaatgcgtagctgaaagataatgaataatttcatatttcaggacctctggaatctagaacaaaataatcagaatagttgattcttatattcttagacctatcatgtttaagtatgttttaaaaactttgcatatataaatttatttatataaatttattttttattataataaataaatttattttattatataaatttatttactcctcacaacagcctatattattttctccattgtataaatggggaaaactgagatacataaatgttggagcctagatttaacccagtctatgaagttttaaaatctttgttcttaagcactttgcaatgctgcccctcagagataagcaacaaatgtaaaggcttaaaaaatgtttgaataagatccacgattaaaacaatacataaagaaacaaattttaaaactccctttggattttctctaataaaaaggaagaaaagaatactttaaaaatctttatcacctgcaggtagccttttcaaagacttttctttcacaaacaagccagtatgaagttagaagaaaccctggtatgataaatacataattttttagttctttgattaaaaggttacatcttgataactttagagttttttttaatttttttttcataaaccgcattgactagaactgctggtggtactggtacacatacctatatttactttcaatgaacttaaattcctgaaaaagttatttctaaagaaggaacaaactagcatgtagtatttaaatggattattttacatatcaggaacacaaatctctatgtaccatcagcagtttttgttatttttaca

SEQ ID NO: 1062 - DNA, 1658 bp, Homo sapiens
agtataaaacaaaagagctccaaattcctaatggcttcctttgtgactagtgtgcatatattgcttaatactattctgtgtgtcagaaatgaaaacacatccgaaagtaagaaaaaaaaattttggaagctgcatttggtctttagttcctgctggaaatagatgtcttgcctgagcctgctgcttgcctgtaccttttgaatcattaataaagtttggcactgggtaagatctataatgtgcagaagtgctctttgactgttcaacccattgggttaacacaactatcattcaaaaatcctggacaaatttccaggcatacctagggtaagaaagtttgtcacccacagacttgcactgaaagaaactaaaaatatttattaacagaaagaaaagtgaacccagagggaaggtgaaagaaacaatggagaacacagaaagtggtttattttcataaagttaattaaccatggaataaataaagaaaacaggaaaatgtgtgtgtgtgtgtgtgtgtgtgtgtgattaaaacggcaaaatataaatttaaaacagcatgaggaagactgtgtctatgtgtgacaatgagagaagaaattgttcagggccaggaggggtggctcacgcctgtaataccagcacttttgggaggtcgaggtgggtggatcatttgaggtcaggagttcgagatgagcctggccaacatggcaaaaccccatctctactaacaatacacacacacacacacacacacacacacacacacacacacacaattagccaggcgtggtggcaggtgcctataatcccagctacttgggaggctgaggcaggaaaattgcttgaatatggtaggcagaggttgcagtgagccaaattgtaccattgtaccattgcactcaagcctgggtggtggagcgagactctatctcaaaaaaaaaaaaaaaaaaaaacaaaaaaacaaaaccagaataaataaaccatactaggttttccatcttgcttgggaagaggttactgaatatacttatttaaactttgttagaaatatttgtagttaacattgcatgctcaaacgtaagataaaccactaaaagaacagaaatatgaaatctatagcttccacattaacagagaaaatatttgaaattaaaagttaggaattcaacaagggtcaggtaagaaataaacagaaaagaacatgtaaaatttaaaaacacagcatctatcttaaaatacatattctttatgggtacatataaacatggttagaaaaaatacaacctaaattcaggatgggagggtgtaggagactaggataatggggacttaaactctactagaaaaagagactggaagcaaataatagcaaacattaacattcattaagcctgattggtgcagatatgcattttactatattattcatgggcttctctgaataattgaataatatgctttttaaaaaatgaaagtatattattttccatatatggctattgagtatttgaaaaatgtgatttaaaccccattgaataataggcacttcttcaaataagttaaaaggatatttgcaaaatattcaaagtttatgtcacaaaagatatctcttccaaataagaaggaaatataaagaattagttatgttaatctgagat

SEQ ID NO: 1063 - DNA, 3404 bp, Homo sapiens
acagaacaccagaaagacctctccttaaaattctctctcctatatttaaaatctgcactctaagtagaaaggcttttttttttttaaagatcctcagaatatttatttgccttcaagggactaatgttaaaatgtaactaaccctacaagaaatgatgacttattaacttgcatccattttcaaactcactgagagcagcatagtgggtgcagtggggcaccatcctggaagtagaaagatgcaataggcaacattttaccatcgtgttcttttcccttgaaaagctcaggattggttctaaatggtagtgatcaagaagagaagaaagtaagactctgagaagaatgaaccctacaggatatggaattatagagaaactaaagtggaaattactttcttctattttctctttctctccatcttctctggactctctaatgcatggattatgcaaaggcataacaatttgccagttagattttcagtagcaaataaaaacatacacttacacatgaaacacacatgaagtaggtttagtatacatgaaaattaaatgtgataaaatgagcttttaaaaggctgctggttttagagagcttaacatttatgtaatgattttaacatttttggttgcaggcaaatttctcgcatgctgtacaaacattttattttgaagacaaaaacacaacatggttacacaagagtttcaatattttggactgtaaagatttttatttttttgatttgttttggcgagaggatcaatagctagcctctgcacatgagtgtttatacaccagaattcaaatcactgctgtacctcaggcttgcttcagtttcacttacttggataattcaaagatataaaacactgcttaaaatcaggaccttaatagcagctacttcctcaggcaacagcagcagcagccagcaggctggagcacacttattgtcgtgctgtatatcacagggaatctacaatgcctgcataattcagtctcttccttagtagaaaatggtcacaaaatagataggaagaacaccgcaattgaaataccttacagcacactaatgtgggtatcctagtgaagtataattcttaaggcaccaactatataacttcaaaaccttcagtgatggtaacattttattaagaattaataatgaggtttttttttttcctggaaacaatttggcagtatattttaagaacttaaaaaaatttctattccattgagccaatgattccccttccaggaatttatattaaggaaagcaagtaccttctttcagtgtagttactattcccataaacctggtggccagctccatttggaaatgtgccaacaaataccctttggaatggcccaagtgaactgttttcttgcctcatccttggcagtgaactattttccctataaaccagaggaaacagcccagctgtgtcaaactagaacccagctgccttctttgcaaacatttcccatagctaaaagcttgctttagggtttttgaaaacatgagagaacccaatgtctacccttggagtcacagagttataatgtaacacctggctcctggttttataaggtaagcctgctcaggttcaatatacatattccttgttaggctcaggtttctcaaaatgtgttttagcagatttttatatctaaaagctgctctggtgttttatgcatttgcagaggagatgtgtcattttagcaccatttgaaaaataacaccttctttgaagtactctggtttctttgttctttgtaaataatatttatttttctaatcatgaagataatatacattcactgaaaagaatgtagacaaatacataaacattaaggaagaaaaaaaagtagcatattaggttgtaatatctaaaactgccctttagttaaaaacaaatggatattggcaatttcatatgattcaatttaatataatgccaccatttaataattattattaatagtttgatatattttatttttgtctttttattcatatgtttatatagatcctagaaatttccatatgatccaataagctcaccagggaattggtgctgaagccttggctggaaataaatagtgtgcccttctcaacactatttatagtgatcccttctcaacactgtgctctagaaagggagtgagaaggtagttggataagtattcaaaataggacactgtggctttctgccttccttacgggaaacatgtctaaaaaaggttacccacagcaagggttagtatttgttgaacatttactgtgagtaatatactgagagactaatgacttatttggagggagtgagtttgggtccatcttagggcaaagttctacatgtccaggccaattcttccttccatccacccatctgcttttgtgatagttggtttgtgtggtggttctatcaacatggccacaaattttttaatactctttccactaaaaataggatctctccccttccccacctcatattaaattggagtaggctcttggctgcttcatacagtagagttgtggaagaaataatgctatttgacttccaaactgggaaaacaaaacaaaacaaaacaaagcaaaaaatatttgtttccggtactgttctctgagaacactcactcttggagttctagcccactgtggtgtcaccacctcggggctaccatgctggagagaacatgtggaggcaccacatgcggtcgccacatggagagactgtgataacagaaagagagagagagaaagcttgggaagcacttcagctcatctaagccctgactgcctaagtcatcccagtgaggcctcaaatatcctatctaaattgcacaaattgcagtcttctgagtaaaacaaataattgtagttgttaaaagcaaccacgtttgggcacagtttttaaaagaataaagaaaatttgagaacttatcttatgtgacttcacaacttaccataaagctactacaaagccagtgtggtgttggtatcaaatagacaatggaacaaagtaaagcctccagaaatagatgataaaacttcccatgatggccaaggccctgattacttatgttgaaaacaaaaatatctaatgttatggataagtaacatatatgagtaatgtgagtcaggacaaagtatacatacatattgtgattgatggggccaggtagagagcacctgtctaaagagagcagctaccactgataatttccatcctaaaaatagaaaagtctaggcttgctagaacttaagactggaaatattaattttttttttgtagcttacaatctcctcaaaatatctgtgaaattagcctggcactaacccaaatgacacctttataggaattagaaaaacatgaagacacttcatcattacatgt

SEQ ID NO: 1064 - DNA, 1407 bp, Homo sapiens
gaactgaaagagtattaatactgtaataccatatcaaatatacaatatggaaacacattaaaagctttttaatgagtttactgaaagagcaatattgtttaagatttgtcaaatttattgatatggtttggattcctatctccgctcaaacctcatgtcgaattataatccccagtgttggaggagaagcttggtggaaggtgactggatcatgagggtggatttcccccttgctgttctcatgatactcagtgagtactcaggagatctggttgtttaaaagtgtgtagctcctctcccttctctctcttcctcctgctccagccatggaaaatgtgcctgcttcctctttgccttccaccatgatggtaagtttcctgaggcctccccagccatgcttcctgtacagcctgtggaactgtgagccaattaaacctcttttctttataaattacccagtttcaagcatttctttatagcagcgcaagaatggactaatggatctgttaattcttgtttattaaggtatatatttctcaaatttgcttttccataaaacaggtattcttgaaaatttgtcttgacattctggtggtttttaacaatagacataatgccaaaagattctgctgtaggctctgtgaaacatcttcattagaactttaggtgttttaactgaaggagtctgcacaaaaggtggattatatttacctcctaaatccttcggggaactgtaaccatctccatgacgaaatattaaaagcaaatcctattttaatgatttcttactatttcctgggtattgtgccacatattatttatttttatagcaactcttgagggaatattatcataatttattaataaaggaattcaggcacagaaaattcaagttccttatctgagataaaagagctatctgtttgcccctctgactggaattcttcatttgtataggtggttcttccttattcagatccaatgtcacctcctttcctaaccaccttattacatagtagctgtacacccttggcccaagtcagtggctatctcataactcctttcattttcttcatagtacttataatttgaaattacactatttaatttatttacttacttatatttaatttacttataatttacttataagtaagtaattatattacttacttataattatatgtactctttctctcttctctagacatgtaaagcaactagaatataagcctgttttagagaagaagttttcaatttgtttattatttcttctcagccttttgaaaagtgtctggtagatagtagttgctaacttaatgtttactgaataaagaaataaattaatgaaagaaaataatagagccaggattcaaacccaggtcttttgactcaatatccaaagtt

SEQ ID NO: 1065 - DNA, 2641 bp, Homo sapiens
aaataaagaatattacagtgcatcacatgcaaacttgcacatgttttgcttcataaaggtttcttttcctaatacgtacatatgcacattaagaaatgaaaaaaattgatttttttctgttgctatacatcaaatagtttgaaaggaagtaaacaaaagtaagtagaaaacatttgtaggaaatccagaaaatacaacttcctcttagtaggggtatctatgagatcaacattatcactgtaggataagaattatagttgcgtcatatatctgtttctggactgggagccagcggagcctcaaggacagaatatttaccatgagagtagcatgggggagtgtagagaacaagaaacgaacaaaaataacaaaagcaacacaagctcccactgaacattaaactataaattaaaattacaattgtaagagaaaagccaaaactaagaaagataacaagaaaaaactgtaactaagatgtaaactgatttcgatctaataaaaacagtagaagaagataaggatgaccttaaaataaagatgttgtagaagaatggtgcgctgggaacatggcaacccaaacacagttcccagttctaatctgaactccaagctaacagtctttatgagccaagtagcatatagacaataggcatgtaagttcaagagaggtgctatcctctaatgggtttccaatagaggaatataaggaaggttttcttctccagtttttcccctttagccttcctatcctcttattccctacctaactctaccacccccaacccctccgagggagactgcaacccagcttagtgaggtatgagcctgggagaagatcagaaagtatcaagtccttgaagatgtggtatccagagatgtttggagctctggaataatatgtgaatgagcttcacatctccttagccttctaaagtctaagaaatagctagaaggatacattgagtctaccctgctactgaagtttgaaaaatacaaaacaattttggaacacagatgcttgtttcaagggccaggcactatgtcccagtctatgacagcagatattgctttgtttttcatcatttaataacaaatcttgacccaaaaagcagaaagctctgcaatcatagaggagagcaaagaggaaatagagagacagagagagagagagagagattggaaattgtgaaataaagctgcagagggatagaaatgacattgtgaacaaacaataataatatgtgcattttctggtattcaggagaaaaattcacaaaaataattatggaggaattaaaggaagaaaacaattgctattgatactcagttttgtaacttataaaatctctggtgagtgagaatcattttgaaatacaggataacatataaatataagagaatcaaaaggcaaaatataatagattttgaagagtgatcaggagacccattgtataaacaacagctattccagggagaaatgaaacagaaggaaagaggtaatattttaaccataatagaaaatatcttcttgacttggagacaaagtgtgcagagggaaaaaataactaatttatcagctgttataagacataaaactaatgcctacccttgtgtactcacacattggtgaattattgaactcttctggcaaacaaaaaattcttatatgtttccaggcagaaagaacaagttatctttcagattataatcaaattggtattggacttttcatctgtgccactggaagctagaagatggtggaatactttcggcagaacactaaacttaacagcaacacaagaaccatactcagtcaagaattaattccttgctaagaataaggaaaaatatttggggttatttaagagtttagagagtagattatcagttatttatcactatgacaatcactcgggtgcctacataaaagtcattcacaccccattcttattttcctgcctgaaacttagaggctataaaagctaagaactcaattcgtcaatttatctagtaggtaatgatgtccatattacatggttctaacaaataagatttagcagaaatatgctggtgctgtttattaaaagctatttattctttctcttgttccaggcttagaatataaactgacaccttgaagaagtgaccatcttgtaatcaacactttattctaaggataacagagataaatgatataaggatctctgtttcttaatggcattgttgagccctaaactttctactgctagatattttatcgcatgaaataaataagccttagttgcttaaaatatttttcagggatttctattttggtaggcaagtatattgttaacttatacaatgcacagttgtataagttatgtggacatggaattatgcacaaaacagaatctaaatggtggaattggaaatgcaataggtagggtatatcaggaaatgagaatcctgccactataggctagaacgttgatgagtcttgttttgtagtagtggggcatgtattccatttgacatatgctgtgtcttgggatgcaaatcacataccttgtgaggtaagtagtgggatgatttcagaatgttggaatgttctggttactcaagggaatgatcatctgacatagtagtgcctttagattgt

SEQ ID NO: 1066 - DNA, 1637 bp, Homo sapiens
ctctttttccctttaggtttggggaatgtgagtcatacgctttcccaggcatggaaaaggaaaaatattagctaacatttggtggtactttatcattcacatacatttgtcatttggttgttttgtgagataactactgtcagactcagtttattagtgaggaaactgaggactggagaagctgaatgacatctacatgggcattcagatgataaataaataagctggatgggactccaacctggggatctaccttcacatctgtagtcttatacataaaagagcgattactccccagagactcttctgtttattgctataacacagcttatacccacaagacacaaaaaaagtatttggaaagtgaaaaaagaaacggaatatgttactatataaagcccaagcattactacatatacgattaaagcaacattaaatgactcaaaactaatttcataatgcattcactatatgggcataacctatggaagtataatgtaggtatatgagcacacaacacacacacacctcaagtgtaaaacactttatacttaaataactccttaaaaagttgttactctggtgttacgtgctgtagtttctgcagttgccataagtcaaatcagttttctgcagccgttgacaactgtttgagcagtgaacagaaaggcatgcagcaaacatgtaaaccaatgtgtaatgtatagaggttgtggagtggttttcttattacagaaaagtgtactttcatatacaccttgtgaaggtgagcgtattattcatagttgaagttattctatcctaccatatcccattttcaaattgtaaacacttattcaatcactgcttcagaaatgcttcccagttattttggaacttatttctgatttcaaggtaatgcactcagtattgtttcagttcattctttactaaatcatccaaatgtttcagtagagaattttgtttaccaagaagcctcggaccctgtgtaagttattttttaataatcgctttagtttcctctccaaaggcacaaatgacagaatgcttagaattataaaatatggtttctctctctctcttatttttaattttttagagagagggtagtcatgagttttttacctaaacagtagcaagtctgccccaatcttgtgaataggcaatagtcccttgtgaactccatttggaatcagaacaaataatgaaacaaaataatagttaatgctttgaatagataactttgtactgaacatattaattgacttgatcctcagttgagagctctctcactcactgtgctgtactgcttctctcctgatccaaacagtaacctctcagctcacctgaccagaatttaagctttggacatgatacacagaagcttagaatatgtcaggaaaacatgccatatctgcagatctgaaccccctcaaagacttagcacattaagatattctggtgcctttttgtatggtccccattcttttgggctgtataatttttctctaaaatttctgcattacattttaatagctttgttgagataaaattcatataccatataattcatccatttaaaatgtacacttcaatggtttttagtatagttgcagagttgtgtaatcatcaccaaa

SEQ ID NO: 1067 - DNA, 11369 bp, Homo sapiens
tttaagtcattgtatcagaatctcgctttctaagggttttctttcaacataaacataatttttagggttttatttaaatataactaagatatatgttattgctgacactgatgggaaactccctgaatggaattacagaattatcattttgatgttagaagatcgaagcaaataaatgatttactagaggacaaagtgaaaggcagaagagagcctagagagcaatataaaatgcaaagatcttaagcctaaagctttggagctcagagtttagtaaagaccattctcccactaaaatgttgaaataggattgagcagaattattcacaattcctgtcccagtttgtagcttgtacatctatttcattgtatttcgtgcatagacaccagttatgaggcagtacactgactggttaaaagtgtaggtatgctctggaggcaaacaaatttaaatttaaatgccagttttgttgtttgctatctggctagccttgggtggggatgaggtgcttactttatcaaactctacatttctttctctctaacgtaatcataataacaggattgacttgttatgttgttttgggggaaatgtaactaaagagcctagaaccatgactgatactgatctacgaggttctatctccttaattaagcataaatatgtcaataaagtgtgaatgtgcatttctatggagagatatgcaagatttatcttaaggatatgactatgtataaaatacatacacatatttctctcttatatgtgttagttaaaaagggtaaggctgggtgtggtggttcatgcctgtaatcccagcactttgggaggctgagacggcgggatcacctgaggtcaggagtttgagatcatcctggccaacatggtgaaaccctgtctctactaaaaatacaaaacttagccaggcgtggtggtgcacgccaatagtcccagctactagggaggctgaggcaggagaattgctggaacccaggaggcagaggttgcagtgagccgagatcgagccactgcaccctagcctaggcaacagagcaagactccatctcaaaaaaaatgatggggagggggttgatataggaaattaagaatgacccagacaatcctagaaaaggtaaaaacagaaaaaagatcaatagctatcacatcaaatagttacatggagagtaggaataactgaagaatttcaactttatagattagtcacaagtcccctaaaaaagacttgattgcagagaattgatccattgtgtcctgggagatatggcttctcagtgaccctaatgtaacagagcagctaaccaaaatctatgttcttttcttcctcctggacattcaggaagactgaattttcctgtcccactcacagtttgaggtggccttgcaactgaatactcaatgaaggaggggtgcactatttccaggtgtggccttcaataaccatacttgcttttccatgctatttctcctgtggttgactagaataaaactatctgtcagaggaaccttggaaacattttagtaaagacagcagtgacttctaaatgactatgtggaggagagccaacatgccaacctatttaccaagtgcctattggtaaatgtgcaagaaatgaacttccatagcataccttgtttcactgcactttgctgtattgtgctttacagatgttgcatttttataaattgaaggttagtggcagctctgcatcagtccagtctgtcggcatcatatttctaaaagcctgtactcatttcatgtccctgtgtcacattttgataattcccacaatatttcaaactttgtcaatattatatctgtgatggtgatgtgttgcaattgttttggggagccataaacagtgcccagacaaaacggtgaacttaatacaaattttatgtattcagactaatccactgacaggccattttcccatctctctttctctccttgggcctacctattccctgagacacaataatattgcaatcatgttaattaataactctacaatggcttctaagtgttcaagtgaaaggaaaaatcacatgtctctcactttaaatcaaaagctagaataattaaggtcagtgagaaagatatgtcaaaagctgagataggccaaaaggtaggcctcttatgccaaacagccaagttgtgaatgcaaaggaaaaattcttgaggaaaattgaaagtgttattccagtgcacatatgaatgataagaaagccaaacagccttattgctgatacggaggaagttttagcaatatggatagaaagtcgaactagtcacaacattactttaagccaaagtttaatacacagcaaggccctaactcttttcaattctatgaaggatgagagagatgaggaaatgcataagaaaagtttgaagttagctgaggttggttcatgaaatttaaggaaagaagctatttccataacaaaagtgcaaggtgaagcaacaagtgctgatgtaaacactgaagcaaattatattgaagacctggttaagataagtgatgaaggtggctacactaaaaacaatttttaatgtagatgaaacagtcttatattggaataagatgccatccaggactttcaggctagaaaggagcagtcaatgcctggattcaaagcttcagaggacaggctgattctcttgtcagcaactaatgcagcaggtgactttacctagaagtgaatgctcatttactattctgaaaatcttaagtcacttaagaactgtgctaaatccactttgcccatgctctatgaatggaacaacaatgcctggatgacagcccatctgtttacagcatggtatactgaattattattattattattattattttgatatggagtttcactcttctgcccaagctggagtgaagtggcatgatcttggctcactgcaacctccacccccaggttcaagtgattctcctgccacctgccaccatgcccagatattttttttctatttttagtagagacagggtttcgctatgttggccaggctggtctctaactcctgacctcatgtgatctgcccgccttggtctcccaaagtgctgggattacaggcatgagccactgtgctcagccggtatactgaatattttaagcccactgttgagacccactactcagggaaaaaaaattcaattcaaaatattactgctcattggcaacatatctggtcacctaagagctctgatggagatgtacaagaaggagatgaatgttgctttcctgcctgcaaaaacaatatccattctgtagcccatggaccaaggaataatttcaactttcaagtttcattatttaagaaatacattttgtaagattatagctgccatagatagtgattcctctgatggatctgggccaaggaaattgaaaatcttctggaatgggttcaccattctagatgccagtaagatcatttgccattcatgggaggaggtcaaaatacctacagtaacaggagtttggcagaagttgattccagccctcaaggatgactttgagggatttaagacttcagtggaggaagtaactacagatgcagtggaaagagaaaaactaaaattacaaatgaagcctgaaggtatgattgaattgccagactctcatgacaaaacttgattggatgaggaattcttcttatggatgaacaaagaaagtggtttcctaagataaaatctactcctggtgaagatactgtgaacaatgctgaattgacaagagattcaaaacatttcttcaacttagttgataaaatagtggaagtgcttgagagaattgacccaaattttgaaagaagttctactgtgagtaaaatgctattgaacatcgtttgctacagagaaatctttcatgaaagaaagagtcaatcaatgtggcaaaccttaacattgtcttattttaagaagtttccaaagccattccaatcttcagcaacacccacatcagcagccatcaacatcaaggcaggatcttataggcaaaatgactacaactcactgaatactaggatgatggttagcatttttaaattttttagcaataaagtgatgatgattattattactatctttagacacagggtcttgcactgtcacccaggctggagtgcagtggcacaatcatggctcaccgtaatcttgaactaccaggctcacatgaacctcctcactcagcttccagagtagctaggactatgggtttgtgccaccatgcctgtctaatttttattttttttttatagaaatggggtctcactatgtttcccgggcttgtctcaaacttcctgccttaactgatcctcctgctccaatctcccaaaatgctgggatcacatgcatgagccactgaacccagctgacaataaaatattttaaatcaaggtattacattgtgttttgagaaataatactgttcatacttaatgtaatacagaataatgtaagcataactattttgtgcactgggaaactaaaaaatgtgtgtgacttattttattgcaaaattaattttattgctgtgttctggaaccaagcctgaaatatcttttaggtatgcctacgctggatttgagacatgtatttgtgagttcattagttacagtagctagtattaccctattttagttattaattataataatatggtaatgagatataatggaatttaaaataagctaaagtaggatatcagatatctattcttgttggactttgagtaagaaaaagaggcatagggagaggagttacaagtaggaaagggatgtagagaaggtggggaccatattcatgtattgtgttttggtcaaattgacaattttgatgttgattatcaggcaggctgcaagtagtgaggggttctctaagagccaggttgaagtgaccgcactgtagaagcctacttcaggactcatttgaagctgactcacacagacattaggatcaggaggtttttggaacatgctttcaggatcaatacccatgaagaaaaataaggaaccagtactgagctgggaagaatttgggttgtgatgcagcctcaatgaaagcccagtcaatcccatgaagagctcagaaactagaaaacccttgaagcttttccaagctgtaaggagggagctgtgctcttatacttgcaaagcaactagtcgttggtctctttctgccaagtggaaggggcacatgactttgagcaaggcagccgtcttcagccaaggcaaatccccagagtgaggctgacagctaagggctgtgctgtctgctcttggcccaacagtattcccagaagcttggggaataccttcttcagctattacaaagccatctcagttgatcaagacctagattcagttggttaatttttaaaatttgcaaaagaaagaactcattaaaaatacatattatagttcaatattttgttttaatttaatatataaaatacacatttattgtcatacttttaatatggaaccaaagcttattctttcttcttactatttttaaaattttagtttcagggggcacatgtgcaggttacatgaatatattgcataatgcttgggtttgggctactgaatccatcacccaaaaagtgaacgtaggtagttgttcagccattgttcacctcccttattcctcacttttggaaacctcagtgtctatttccatctttatatctgtgtgtcaattgtttagatccctcttataagtgagtacatggagtatttgattttttgtttctgagttaattctaagtgttaattcacttaacacttaattcacttaagatatggcctccagctccatccatgttgctgcagaggacataatctaaactggccatgtaatattccatggtacatatgtaccacattttctttatccaatccatcattgataggcacctagattgattccatgactttgctattgtgaattgtgctatgataaacatatgagtgcaggtgtctcttttgttagaacaatttattttcttttgagtagatacccagtaatgggattgctggatcaaatggtagttctattttcaatttttgcaaaatctccaaactgctttccacaggggctgaactaatttacattcccaccaacagtctataagtgtttccttttctctgcgtccatgccaacatgtgttagtttttgactttttaataatagccattctgactggtgtcagatggcatctcatggtggctttaatttgcatttctctgatgattagtaatgttaggcattttttcatgtttcttggccacttgtatgtcttcttttaagaagtgtctcttcatgtgctttgcctactttttaatggggttattttcttgttggtggtgatttaagttaagatattaatcttttgttggatgcataattttttaacatttttccacattctgtaggttgtctgtttactctgttgatagtttcttttgctgtgtagaagctctttagtttgattaagtcccacttgttaatttttgtttttgttccatttgcctttgaggtcttaatcataaattatttgcctaggtcaattcccgaagagtttttaaccaggtcttctcatagggcttttatagtttaaggtcttacacttgtctttaacccatcttgaattaagttttgtatgcagtgagaggtaaacgtccagttttattcttctgaatatggctagccagtttttccagcaccatttattgattaggatgtcctttctccattgtttatttttggaaatgaaaacacaatacttgctaccacaaaagcacatgtaagtacaaagcccacaaaccctataaagcaactatacaattgagactgtagagcaactagctgcaacactatgacaggaacaaagtcttacatatcaatattaactttgaacataaaggcctaattgcttctcttaaaagacatagagttgcaaattggataaaaatcgagacccaactttatgctatattcaagagacccatcttgcatgtgatgggtttactttgaccccttaggctcaaagtaacaggatggagaaagatctgtcaagcaaatgaaaaatgaaaaaagagcaagggttgctattcttgtatcatataaaacaaattttaaaccaacaacagtaataagggacaaataagggcattatataatgatgaagggttcaaatcaacaataagttttaaccatcctaaatatatattcacctaacattggagggagcatgcttatttgtaaaacaattactactagacctaagaaaagagatagacaaccattcagtaacagtggaggacggccaggcgtggtggcttaagcctgtaatcccagcactttgggaggccgaggtcaggagatcaagaccatcctggccaacatggtgaaacccagtctctactaaaaattcaaaaattagctggccttggtagcacatgcctgtaatcccagctactcggaaggttgaggccggagaatcacttgaacctgggaggcagaggttgcagtgagccgagattgtgccactgcactccagcctgaggacagagcaagactccatgtaaaaatatatatataatagtaataatagtggaggacttcaacatccagcctggagacagagcaagactccatctaaaaatatatatatataatagtaataatagtggaggacttcaacatcccagtaattgcattagacagctcatcaaggcagaaaaccaacaaagaaattctggacttcagtagcacactttaccaaatgaacctaatagacatctacagaataagccgcctatcaaccgcagaatatacattctcctctgcacagggaacatcctctaagattgaccataggcttagtcataaagcaagtcttaataaatttcaaaaaactgaaactataccaagcatcttctcagaccacagaggaacaaaattagaaatcaataccaaggaaaactctgaaaactacacaaatacatgaaaactaaaaaacttactcctgaatgacttttgaataaataatgaattaaggcagaaatcaaaaaattatttgaaacaatgaaaagactcacaccatatcaaaacctctgggcttcagtaaaagcactgttatgaggaaactttatactggtaaatgcctacatcaagaagatagaaggatctcaaattaacagcttaatgtcacaactggaggagctagaaaaacaagaacttaacctaaagatagaagaagaaaagaaacaactaaaatcagagcagaactaaattatattgagaccaaaacaatatacaaataatcaatgaaatgaaaaattggcttttgaaaggataaacaagattgataggccactagccagattaacaaagaaaaaaagagagaagactcaaataagtgaaatcagaagtgacaaaaataacaacaactgattccacagaaatacaaaagattctaagggaccactataaatatctctgtgtacacaaactagaaaaccttgaggaaatggataaattctcagaaacacaccacctcctaagactgaaccaggaagaaattgaaacctcaaaccaaacaataaaaaattatgaaactgaatcagtgatagaaaaactaccaaccataaaaagcactggaccagacagattcacagctgaattcttccaggtgtaaaaagaagagataggccgggcgcggtggctcacgcctgtaatcccagcactttgggaggccgaggtgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactctgtctcaaaaaaaaaaaaaaagaagagataatatcaatcttactgaaactattccaaaaaaatcaaggaggagtaattcctccctaactcattttagaaaactagtatcaccttggataccaaaatctggcaagtacacaacaaaaaagtaaaaccacaggcaaatattcctaattaacatatatataaaagtcttcaacaatatactagaaaactggatccagcagcacatcaaaaggataaatcaccacaacaaaatggactttattcctgggatgcaaggatggttcaacatatggaaaccaataaatatgatccaccacctaaacagaattgacaaccaagaacaaattatcatctcaatagacacagaaaaggcacttgataaaatcaaacatcccttcatgataaaaatcctcaacaaatgaggcattgaagaaacttacttcaaaatagtaagagccatctatgacaaactattacccaacatcatactgaaagggcaaaagttggaaacattttccccaagaactagtacaaaacaagaatgtctattctcaccactcctattcaacataatactggaagttgtagacagagcaattaggcaagagaaagaaataaaaggcatctaaatgggaaaagaggaagtcaaattatctctgttcactgaccatatgatttcatatctagaaaaccctaaagattcctccaaaagactcctagacctgataaatggcttcagtaaagtttcaggatacaaaactaacatacaaaaatcagtagcacttcttaatactaataatgttcgagctgagaatcaaatcaagaatgcaatcccacttacaagagccacacacaaaataaatacataaataaaacacctaggagtacatctaaccaagaaggtgaaagatatctacaaggataactacaaaacactgatgaaataagttatagatgacacaaacaaatggaaaaatattccatgctcatggattggagaaatcaattactaacatgtccatactgctccaagcaatctgcagattcagtgcaattcctttcaaattaccaatgtcatttttcacagaagtagaaaaaaattctaaaactcacatggaaccaaaaaataccctgaatagccagagaagcctaagcaaaaaagaacaaagccagaggcatcacatgacccaactccaaactatactacaagcctacagtaactaaaatagtttggtactggtacaaagataggcatatagattaacagaacacaatagaaaacctagaaataaagaataaaaccatacacttacaattaagcttttttctttaaatgcaagttgtcaggtgggtattcctctttgttgattaaacaacacttgtaatggattattgttttaatgttttttaatgaactaagaacttaaagatacatgcaaaggtatctgaatttagaatcttggtaaatttttttataactatgtcttctatcttttagatacttcttgttcacttaacttcagtgaaagaccacctcgttctatacagaggatggccaagtgctataacctctactacctcactgtactttcctctcagtacttacagacaaaacagagctaaccttaagaaagccctaagtcagttggtccccagttaaacattatttctcttaaagatatatgtttcaaattgtaaatcagcttgttgttgaatagattcattttttgtttttattgtttttgcagttaacctccggctgcaaggatcattacttttgaactatgtattgaactatgtatggtacatggcaaatttggagatatttgatatttgaaaacataacttttaatcattattcttctttcagaaatgtgagcaattaggagttagagtgagttatactaatacgttttcagttgtcataatcatataaattaattcagaacttgtaggcttctagctgtcaagaaaaaaaatctgtcatatacagtgaagatttttaaaaattattatctctaattagttccctccttattgaaaaaagtcattattccaattataagtccccttggttctaatgaactagggctaggattccatatgtaacatcttgtatttttctatgaaaatagcttaaaatatattaacacagaagaatatgaaacatgaaatatgacaaaaatagattcaagcctttcttctcaggatacattcccagggcacatttcatgaaggtatcaagaacagtaaattgtttttagtgtgcttaggaaatgtctgttatctggtccgaatctgaagtctctttgttcttggtgacattttatcatg

SEQ ID NO: 1068 - DNA, 2263 bp, Homo sapiens
tctgaaattggaagaccattatttcttaaaactctatttactctacattttctcttcactttcttcacttctgattttcttttgcactctctggattggcttttaatacccaatttgtttccagccttctctctcctccacatgtctctctgctcctcattcctctctcttcgctgtctccctccatcttccttcctttccctctcctgccaagacattccatttctctggaatgcccctcaagccactttcgagtccaactaaactatggtctgttgggaagtccagagctgctgtttctgcttggatgtctaagctttccataatccacccacctcctagtctacttctgggcaagaaacactgcagcggccaggccgacttcatcattgctctgcaaataccatgtttgttgggcctttgctcttgttaatatctcatctggaagctgtcttcttctgttacacctttctaaagtccatgtatcaattgactgtctgctctttgaaattgctcttatttacttccttgatctttacctcttctaagctcccagtgcccacagtttagcaaccccttttgttgcatctcataatttagtagcttctcatataggccccaggcttcttctatctagaagctacagtgttccttattatgtgccaggctctgattaaggtgcattgcattattatttcatttaatctccatgacaaccctatgaggtagacatttttgtcatttccattttacagatcaggaaactaaggcccagagaatatgactgacttgcccaaggtcataaagttagtaagagctagagctaggttctatggaagtcactatttgctaccacccagatcccccttcaggattgaagccttactcctccagctgctgagagtaccattggctgacagccctcagctgtctccctctctgctcattgccctctatgtaagtgagcctcttcactcaaggtaacaacccctttcctgggttagcctgtgtccaaaatcttatattgcagggctataaaggtctctccacttcaccacaacttcagaaaactcctaagtgcaaatcagcttctgagctctctgtgaggttaactgatgccttctttgtgactgtatcacagcccaacttctcccttgacccagtcctgtttctttccctgtgctttcacttctatgaatggtgatttccaagggcaggcactgataaactttctatgcaaatccctgattcaaagtctgcttctcaaggaacccagcctaaacagttggtacaaggagtggtccgagaaaggcaatgctaagatgggattctggagctagatcacctgctggctactgatagtgaggacctcatctctgggagcgggagtgggtggagcagagtagatcctggcacagggttgcagtgatgatgtggaatggtatgctggtgaaaggggatgcactagtaggtgaatgtaccaggcactggagaaatacggggaaatagtaatgataagagcaatgacaacggttggatattactggaggcaattaatgcattggataagaaggcaattcataagcaattagtatgtaaaccacagggcgtcactactggatatcaagtaagtctcatatcctgtagttagaagccagaaaaagttgatatcagggctaggacttaaacataagattgagagaattcctgggaaggttgaattctcaacctaggcatgtgcgctgtgccaggcaaggttctgattgggaaagaacaagcccttgagatattagatggtgacatctgacttgatgcacttaaatatcttgagtctccagattcccttaaactctctgggcctgcagaagtggcctactcctgtctgctaaaggctagcattactcctctcttgcttgaagaatatgcaggggcctctgccttagaagacaaatgtgtccttcccactttaagatctgcccccacggtccctttcttggcagccagactaataaatagggttaaatcacagcattgcctggctggggaagtgctgggcccactagcaaaggaaaggtactgcaggaactgcaggatgtagctaacaggcactggcagaatatcaaacattatttaaggactgggttctgagagtactggatcaaggtagatggaatgtaaagttatataagggaaaatttatcaatatgggatcactctcttgggctacaggatttagcatctggcaaagatcctgggatcctgc

SEQ ID NO: 1069 - DNA, 2769 bp, Homo sapiens
caaagtttaaattgtttccaatttgggtcagcagaaaggaatgcctcacatagagctaggaggcattgaccttgaaattccagcaactgcacccatagatgtggcaagatggtccaggacaaggccacggttggcacaaatggagctgtgaactaaattaaggaagcagaaagacacattacgaaaggaagataagaacctaatcgcatctttctgggaagagagagaaagatattgttaatagaatagattggggagaaaggacaaaagcacaaagaaatatcctgaagagtagtcaagttacctttaaatataaacttaagaaatctagccgtatgggataaatttggccaactgggctaagagttcatttactttgctgccatattagctttatcctctctgacctataaaacaatccattaaacaggatgaggctctttattttttttaaagcataagaaaaattttatctgaagaaagtgtatttttaatgatccaaactattctaactctttctttatattaaaatggtaaatgaaataaatgaattctgaactgaaactcaaggttcttctctcattgttagtgaaccaatgccattttcagaatgagggaaagtaaggatagagaggtgaggacaaaaatcagatcttccccatgtttccatctaattgtaaattccaaagcactgttgcctggatttcattctgagtggtcagaggaagagtgtaactgtaaccagagttccggggaggcctgaatgatattatttcatttaggatgacagtggccacccgagcaaacagacaaccaaaaattgggcctggtttgaaacagcacagcttctctgcagacacttagcctcctggtaagccaactgcttattagacagaatctcacagctctggcatctattttcaaagatttcatcaattcaaaaacaggagaaagcacaaattcccagacccacaaaataaactttaacacattgaagagcatcgatttccttctacctggaatgcttatgcttttgagtaaagcattctgagcatgaaagggaggtacatcatagaaacagtggggtagaatgattttcaccacagtagagtgaagtttatatcatactgaagagcattcaaaagagaacgggctatacatgtgcggaacgggcacatttactaggtttctccttctcctcaattttaccttcccaagcttgaatttataggcttaagcttcatagtgtaattaccgggtttaatatcagagaggagggcagctttggtttttagagtgtgtttggtgtttattcaagggaagcaatctccaatgcagtttcgttttcttttcattttctctggggagggaagagggggatgaatactgatatttatggagtttaagggtctggcagcactgggaactgcagcactttgtttatccagagtccagtttcaacccagagggtgccaatgcaaacttctccagaccaccatgccaaaaatgtctgccctgtcttggaggagctgccttcccaagcaaggagagctactcagagccagctcagtttgaagctgaaccaagaagaaagcccaagcattaaaccatgctgtctcaagcacagcagttcaaaaatatgctttttatcagattttcctcatattttgcctcatattttttatcacagcaggagcttgccatcaccagccaagctgattgactgtgtcctataccagcatccgcctttgatattcatgttttcaggaaagctgcatccctttcacttatactcttgctggggtctctttatgcacccactattactaccgttacagcatctgtcctccaactgtgaaggaagctcatcaggatcacctgcgtatctactaaccgtgggtgccatcagaaatgcaatgtcgtcagcaccttctctccactcttaagacattacatctccacagcccttgcagcccttctagcagctggaaattcctgattttcaatacaatttgcttcttcctcttcatattgcttagtatcagggccaactttttaaggcaatcttaatgaacctataaccagtgtgttaaatatatttgttgagtttttccataaagctaagttaatataacatgattgttttcttatgcaccctgtggggagtaaggaaggtagggggtaggaaaagtgggggtgtgtaattgacatagttggtatattgccaaatttactcacctttcaggaccccccacccaacagtgagccgatggccttcaggttagctgagctttctaaaataagcagttcgtctatggactgaagtcaagagctcaagcatcaagtacacgtctttgagaaaagctgccatgcttggaaaagttaacttttcagatgctgatagaaatgaactcttaaccactagcatgggcaaacttcaaagttgaactgtgtgcttgctgctttctttcctagaattcttgtcattacaaaactatgtaagatcaacgcaaaactatctgtgatgttgatcaaatgcaataaaaagaatgatacagccatatttaagtttctataacttgtattgtctgtggaactttatatagtgcctagtttgcaggagattctcaagtattggagattgtttctgggcatttctttgtgatctccctgtttagttctgtgagagctggcaaatattgtcggtagctttagcagtcaattaaaactcaaacctttaaaactgcaaagtgggaagacagtatcaaa

SEQ ID NO: 1070 - DNA, 3258 bp, Homo sapiens
ggagactaagaaatactgaactacagccaacaagaaatgactgaagtttttctccatcagtaatacagctctggaagaagattgatccctgatcaatttggcactatgaggaaactgcatttctttggctctgggtatagatttactacagtcagctggccagaggcaaagtggtgtttgagtgagccattctgataccctttaagactgcaggctggagaaaaagaccattcatttgatggcaacccagatgcagagtgggaacttaccagataactggatttcaggtagtggcatggacatgacccatgcccctttctaggatggcagcttaactacataggttctgatggctgttctggatttaaaatacttttctctcaaggtgcacacacaaatctgctatatatttagatttttttggcaagttttaaaaaactcctcagagatgtcaaaacaagtgaaaaatttatatccaagataaaatgttcagtagctagtttaaaaaggaactttgatcaaactgaggggaccagaatagcatttggaggtttattgcaaggcaccccctacttaacacattctttcaagattgcttaaagatggctaatcttgcccctataacagccaggactttcttattttgtatatgcatttgtgaagaatgtgaacatagtaggaattcaaaaaacagcagctgcaccttagttctttcacctctgccatgatctcttttctatcctaaaaaaaaaaaaaaaaaaaaaaaaatgaaaaatcctttttgtggggacatgtgctgacccaggaaaacagtggtggcagaagcagctacagcatgttttaggggtggaaggaagaggaagaggtagggaataaagaacaaggcaaagcaagcaggaggagcagacttctagagtgagacaaaaatggtcacagtaaggcttcctatcacttgatgggcatctttgtcgtcacacagactggattcaaatccatctctccatcatttaccatctctgtaacttgggtgatgacttctctctgagcaatagtttccacgtcagtaaagtgagaataatgactggcctcaggctgggcatggtggctcacacctgtaatcctagcactttggaagatcaaggtgggaggactgtttgaggccagaagttcaagatcagataggcaatataatgagacccccgtatctagaaaacattagaaaaattagctgggcatggtggtgggtgcctgtagcaccagctacttgggaggctgaggcaggacgatcttttgagtctaggtgattgaggccgcagtgagccgagattgctccactgcattccaatttggtcaacagagcgagatcctatctcttaaaaacaaacaacaaaacaaaacaaaactggcctcatgagattgttgagagaattagcatatagtgtgctgcacttggtgtctagtacatacatggtaagaattgttatttgtcatgatttatctgtgttagtccattctcacactgctatgaagaaatacccgagactgggtaatttataaaggaaagagatttaatcgactcacagttctgcattgctggggaggcctcaggacacttacaatcatggcagaaagcaaaggagaagcaggcaccttcttcacagggtggcaggacggagtgagtgccagcaggggaaatgccagatacttataaaatcatcagatctcgtgagaactccctcactatcatgaaaacagaatggggaaaattagccccatgatccaattacttccacttggtcccacccttgacacgtggtgatcatgaggattacaatttgaggtgagatttgggtggggacacagagccaaaccatatcatatctgtggttctgacatccttgccttctgactgcctatcttctctgtccccatattggtacccagtttttttgtttgctttttttgtttgcttttattattattattattattattattatttgagatagagtctcactctgttgtccaggctggagtgcagtggcatggtcttggctcactgtgaactccacctcctgggttcaagcaattattctgcctcaacctcctgagtagctgggacaacaggtgtgcaccacgacacctggctgatttttgtatttttagaagagacggcgttttgccatgttggccaggatggtctcgaactcctgacttcaagtgatatgctcacctcggcctccctaaatgctaggattacaggcttgagccactgtgcctgtccctggtactcttcttaatcactatgttaatacctctattttaccagcttccatattaagccattttccttaaattatttcatttttatcaagggctgtccactgttgtgcctcagccactgtcagatgcaccagcctcagctctcagacctccctcccacctccaaacattgtcttgttctgaatttcattgtccccctgatgacaatgggtaatgaacattttagtaaattaattcaaataaactgatttctgctatggtgtctaggataaaatagaaaatttcatatccaagttgaaccctgcctctccaagagacttaggataatgctgataatgctgtgtgccttgcacctagtaagtgcacaataaatcttggcttcttttattaccataattattgttgataggaatattattatactgttctctgtgcttttacttatgcctctctcaactctattttccactctacagtcaaagttctcttttccaaacttaaatctactacttttgtgcttaatatcctcccatggcttttaaatgcatttcagataacatccaaactctacctcctgattctagtgccctccatagtgagcccttgcctctctctgacttcctctgggattactactccattggtccctcagctctagccacagagccttcttctgttcctcagttgccaagcttgttcctgcttcaggacctcttcatgagcttctaatttctctacctggaatgctgtttgcctgacatttcatggattccttcgcattaatcagatatcataccaaaagccacttctgagaatcattttctctccaacagcaaccccaccctgattatattaccctgttgttgttgttcgtagcactgagctctgtataaaataataatctattttttaatttattttaaattttttttctatgcatatatgtaatttaagttatatgcataaaatcctttt

SEQ ID NO: 1071 - DNA, 4132 bp, Homo sapiens
tcaggcactgtgctaagtgctttatacacaacatctccctctgctgggggccgtgccccaccaacgtgctggcagtctccctgagctttttacacaatttgctgaatgcatcagtcactgatcaaatgaagaggagttatgatgtgctgggccccaggaaaggtcttcaggtgcaaatataaataacggaaatggtcttgccagcaggaagcccacaatccaagacagatctgtgactgtctgacatgaatagatgtttattcacatatgctacgtgccgggcattgcgtcagacaccgggtccagaaaggtgaaacactgatcgtggtgcttatcctaggagcaggctcgtggaggagcccaacaaataaacggagaaatcacaaggcagcacggggagctctgtaacatgcacagcaacctagcatggggcctggaggaggcggctgccaatcttggggacatctgtgaaagcactgtggattctacgccgtgagaagaggaaacagcgtatattgagaatccactataagtaacacacctgtgaacaagacctgggtgtatcctgaggcctgaactgtgtcgacataacttagcacgagctctgcgtataccttgctgggtgctcggtagatacatgcactgccagggattaactgagcgatgagtaactgatgtgcctctgtcatcttattttcttattcagattaatctggttttaacaaatgcttaaagcagagaccttattaccaaagaaacccctattgctggtataaagatctgctttaggagcctgaaagttattgccagaaaactgatactgacataagttccctgtttcttcagatgtctggcttgtgcaggggacacaggcccagcagcccagctgcccagatcccatcccgacggctatctccacagcccacagctctgctgttctaggcacgtgcttatctattttatccaccagagtccctaggatgtgtctgctcagccatattaaggaggcccacccagtgccctaatatttttatcaaatggcagaatacctggctatatttgtaccttgactcatgtggtacctttgttacaaagaacacaaagcaatgggcccttgctctgtttaggctgctcctgcctcagagaggaacaaccggctctctctctttggcagaggaggccgatgaggcccagggaaacaaggtggtctgtctgaatcctcagagccttggtggtagaacctggactagaatctatggggcatccaggcaaactgagtcctgacttctgtgtgccatctcagctctcggagggctgagaccaatccctttgcctctttgtaagtttcattgcaattagcacagtgatgttcccctctcttcttttcctttctctccttctttcctcttctccttcttcatcagtcacttcccttcatgtgacagagtctctccttgaccaaactctggtcaggcttctctgaatcctcttcccaactaggcctccatggttggacttccatgtctgtctttggattgccttattttagtaagaatcctgctaaatgggtatctgatcagccttggtatctgctggcttcctcatcccctgccatcccccagttgatatctagttgccctggcctgactttagcaagactcctgttaggttggtttagccagaatcccccttacctgtgatgttttctcttagtaattttccaaccaccaacacctctgaccctgctccttggctataaattcgcacttcttgttacattgagaactgagcccagttctatattgaagtctcttttcccccgttgcaatagtcccgaataacatatatttttactgctttagctattatctagttgtggttttctttgacatatcatacctgcagtccataagcactgctccttagagaggctaagatagaaagaaggtaagcaggaatttctgggccttcctggatgttccccccccacacaaaaattcctccttggaaagctgcccagcccctacctccactgccagcagtgactcctaggaccccggggaggaaataaggggaaaagggaggcagggtggggccaacctgagcgctaatgctgtgcccggcagcaagagcttcatatgaatcatctcgtttaatccttgcaacagtcaacgaggtaggtgctattgatacttccatgttacagatgaagaaacaaaggcatagggcatttctgtgacttagcccaggcccaaagctcggccgggtgtggccaggaggcaaacccctaccacatggcctcttgggaaggggtggggtccgagcactggagcctctcactccctaaggaggcctggccacatctctccaggagctggaaatgtcagacttcaaagggtcaccccagacctggtaggctgtcaagtccacagagaagagaagcctgagtggagtgaactgactcagactcccttgtttcctccaggaaagctttgcgtgcattcgcacggagcttccttcattcattccacaaacatctgcagaacctgaagaataaacctggttctttcctagtgactggagaacagagcagaggattgtgtggctctcaaggagtggctgtccaatgagtcttcactgatgcccaaacatacctgccttcacaccccgaactgggaaagatgggggaattcctactgtgggtgggcgcttctactgtgtcttcattcctcatgtaatgttctccacaattctaggtcataggtattattgccaactgttttacaggtggagaaacaaaaacctaaagagaaagggaagtcatttgtctcaactcatacaactattaacttggtaaccctggacttgagtctgaatgattaaggagcttatatttttctcttttcacctcccttgctcccacaagaaagtgaaataactacatgccacatcccaactacatgcactcacacctactgacacacacttggaagcaactgagctctgagacgcgcctgtgtctggtgcagtccacaagcacagggtgcatctgcctacacacctggatgtgcacatacatgcacacatcaatgtttttaaaaattcaatattttgggggtacaggtggtttttggttacatggatgagtagtttagtggtgaattctgagactttagtcaccaaagcagtgtacactgtaccaaatatgcagtctcgatgttttttcccttaacttttgaatgttgtgaacacatggaaaaatatctaatttcactagttactaaaaaaaaaaaaaatgaagtggggtagcaagaaagtgctgtcattttagctcatcaaaataccaaaaattagggagaaaataaatgagaaaatagtcctggtggggatgcattgagatgggcacttttgtacactgctgattggtacaactctttgggaaagtgacttggcaatattcatcaagaggtttaaaaatgtccaagaccaaaagtggcccaataatttcacctgagtgtcactcagtagtaaatgcataacaatgtttaacatagcattgtttattatagcacagacccgacaccgacccaaatgacttacactggggggttagctaattaaattctgtcaaggaaaaatgactgaaaaaagacaaacagtaacatgacaatgttaacagtggttgggtttgagtgatcagactatggttaatttgttcctagcaccctacccatcttctttcttcggttttctgcatttttcttgaaaaagatcatgcctcacatttctaacaaagctaaactttatggaaaaagttgggagcagatcaccacactgcatgagtgatagaaagctgagtatatggatacagaatttagtgttgtaatcaagcgaaacccacaacagaaatgatctattgcgtcaatatgtgcaaagcagccactgtgcacatgtgattggacttaaatagtgaagagcatgctcataagaagctgtaattagtttgccttttataccacaaaatcagtgtttagtttctctctttgttgttagttcttcagcatctgtcaactgcatcagggctgacaggttagcctaataccaggtgtgagctgttcccataggcacacgc

SEQ ID NO: 1072 - DNA, 3075 bp, Homo sapiens
ttgtaagggggagatgtctttaaacaccaaagcagaagccaaatctgatcctgggacttagactcatatttactgccctttctgctgagaagagcttgaaaaacaaaacacaagagcttgaaaaaccaaccccaagacttgctaaacttaaggattttctccccattctccatatttgtctcagttccttctggctaagctccaatccttagtgtctgctctctgtacttactgagaacacagaaacatatataatctgaaacttggaaaggagtttagagatcttctaattcaatctttcattcaaagtggaactcctcaacaccagtcttgacaagaggtcacccaggctttgaacttttgcaataatgaagaactaattacttttccatgcaatcagactatcagagacaccaactgtgaaaaagtctgcctcagaattaagcccaaatctttaactcccatacctgggtcctcattttgccttctgaagaaacacagaaatttattacatctttttataagggatgatcctgcagatagttgaagacaaccagcaagcccctcttcaactttcccagtaggacatgggccaggccctccatcagccaggatgcccagctgtggacatgcttcagtctgtcaatatccttcttaaaatgtgggccctgttatgagtgcagagaagccaacccattgcatccaatgggttcagaccaacttggaagaacaggaggcaacctggatccctggggcttggagggtgctcagtgcctctaagagttaagctgagagctgtttctcagagaaacgccaggcagatcatcctccaaagcaacctacagagattgaggcagcgctgggggccagggatctgggagggagtcagccacatctagctgagggtctaattcctgacctttggaagctctgcattcagatctttgtgctggcccctgcggggagcctccgtggcttgacaatgggtgggtaggcggttggagggcagggagaggatcatttttagttgttgattttaccaacagatattcagaaaatcagtatttgtgtcattttatgtaaatccagatccatctgtcagaggtgtttgaaccagagcaagtccatctttaacaggggttgcgtaaaataaggctgagacctactggactgcattcccagggggttaggcattctaagtcacagaataagataggaggttggcacaagaaacaggtcacaaagaccctgctgataaaacaggatgcggtaaagaagctggccaaaaccaagatggcaatgaaagtgacctctggtcatcctcactgctcattatattctaattataatcattagcatactaaaagacactcccaccaatgccatgacagttaagaaatgccatggcaacatccggaagttaccttatatagtctaagaagggtaggaacccttagttctgggacatccctgcccttttcccagaaaacttatgaataatccaccacttgtttagcatataatcaagatataactacaagcatatttagtcgagcagtccatgctgctgctctgcctatggaggagccattcttttattcctttactttcttaataaacttgctttcactttataggctcacctcaaattctttctcgtgtgaagtctaagaaccctctcttggggtctggatcagaacccctttctggtaacacatctgtgatcatctagtgtacctgcaggctctgtaaaattttttgattaccttgctgttgcttttttctccaaaggcatgtggtaacatcttcagaaatctctagggaatgaaaatttgggcataatgcatggctttatgtcctgaaggatgttgaagttcacatgggtggatcctggacaagagacttttggtcatctgaggtttgtgacaagtcaacatgaatcctgaagaaccaagtcatgggtactgtctctgccacatccctgtctggaactgggcactgccagtttgggccgcctgccttcttggggctccccatgtttccttgtaagccacagtccctgcgggcagcttggcaatgactccccgtctctcgcaccagcccgatcgcactccctcccagtaatctgattttctctgggctccgactttacaaagaatcttctcaactggcaagattttgatagaaagtgtttgttaaagagtctgggatgggttatgattctcagtctgtactctgttggactctgttagttgctctcttagttgcttccctgcaccttctaggtttgtttcctgtgagggtgggctttttctcttctgacctccagaagcctccaagggcagtgaccatctcacctgacagaccctgtgggtagcggtattaggatcaccaccatttcctcatagcttccagaggggcagattataaggagcttgctgagtgctaacctgttcatgcaaatagacccccagcgacccctgagccattttatggctcagaaacaggttgacagatgttgggtaaatttcccaagatcccacctctgagtctaaggcctgtggattctctccagtctggccttgacttctctatgagttcaggattccaaactccatccccggtacccttcacttgtccctggtggctttccagtttaaataaagtaagcatttctagtaagagtgtcttgtacttttccccaccccctgtgaattgacacaaaaggaaatcaacatttaagttagttttaataccaacatatgtttattaaccacagtgtctttcattcagtgcatttccatatgtattaagtcattttatcctctcagtcaccctataaaactgaccaaaaagtgtccttatctgtattttgaagataaaggagcaaagatccagacaggcttagggacatacttagggtctcagtgaattaatgaccaagactgtcactcccctgctagccctcactctgccctctgatgtaacagttcccaggcccagtcttttctctgcagtatcatcatgagcccctcaacattcccacacctgatgctactctctgagataccagat

SEQ ID NO: 1073 - DNA, 3026 bp, Homo sapiens
gtagtcctggttactcaggaggctgaggcagtaggatcgcttgaggtcaggagtttgagaccaacttgggcaacatagtgagacccccaactctgagaaaaacaaaacaaaacaaagtatgactctaatgtattaaagctgactttcctctttgatttctaaatcaggtctaatggcaatttctagagggatattctacaactaatcaccagtgccagcaccattggattaaatatgcagcttcccaaggaagccatttgaagggcactgtgatcttttaaatgcacatcatgaaaaaatcctatgtaggctaataaaaatattttttattgcttttaagtcctcgctctgccagttagtcacctgtgtgatcttggataagttacctaacttctctgggcctctgttccttcatctgtagaaaggagacagcagtagtcgctaatgagttgataccagtaaaatgtgcttagaacaatgcccaccccacagtaagcccttaattgatggtcccaccatataagctcttgcccgtcattttctaggcacatcctagggtagaaaacccagtgagttgaggcctattaggtaccttggcatgcctgatgcctggcatcaggtaggtgctcaatgtgtgtttgtggatgcaaatagaactaaacatagcccctttagaagctgaagggcttgcatcaggatttactgaaaacaggaatctctcttggattgatttctataatcaacatgttttagatattttctgaatatgcagagcaccccaatcctgggttataaccaaggtgaggctgactttggaagggaaacccgccttaggatgcttttagagcatccctttccctatgggaacacctgtatttccatgcagtggggtgttggaaggctggggtctgtgctctcaacaggagctcttttggtcacactggggagcagttcttgctaaagtgttgatttatgagtcttcttccctctctcctagggtagtatgcacatctaagagggagaagctttaaaaactctacagattttccaaggaaagcatggcaggcaccttgatagaggtgaagagtagaatttttgattatttggaaggaacttggaagaaacccttctgagcacagtgaaaatcctagcaatgtataagacatagtgtcttcataggtaagagcacaggctatgggggcagacagacctggtttccaattctggtcttacatacacaaacaaggtgacatggaggaagtcgctctaagccacagagcctcattggtcagatgggaataatcctaacatctacctcattaggctgttagaagatttcaatgaaagaggcccataaagcacttagcagagtgcctggcaaactaaacataataagtggttgctattacagtagtccccacttatctgcagtttcagttacttgtggtcaaccatggtctgaaaatattaaatgacaaaaatccagaaatagacaattcataagttttaagtcgtgggctgctctgagtggtgtgatgaaacctcatgctgtcctgctcatgctgtctggctccaacctgcccgggatgagaaccttcctccagcacatccgctgtccacgctacctgccagttagtcatttagcagccatctggttatcagataactgctgcatttcccagtgctcgtgtttaggtaactcttattttacttaataaaggccccaaaacacccaaaacacaagagtacagtgcctagtttataaattaaaatttatcataggtatgtatgcataggaaaatcatagtatatgtagggctcagtactacccgtggtctcaggtggcctctgggggtcttggaatgtatcccccatgggcatgggggggactaccatatttttgtaagcagctgactataataatagctaccatttattaagcatttactatatgccaacattttgttatactgcttcatgcatagattttatctaaactccataataacactttgaattatcatttctattttataattgaagagaccgaggcctgggaatttaactgtttcttttttttgagacagggccttgctttgtcacccaggctggagtgcagtggcaaaatcatggctcactgcaaccttgaactcctgggctcacgtgatcctcccatcttagccttctctgtctcccgagtagccggattacaggcatgtgccaccacatccagttaactttttatttttggtagagatggggtctcactatgttgcctaggctaacgtaactggtttcatcccagagtcatacaaatagtaagtgatgagtcaggatttgagcctgggattccttgactccaaggcctgtccccttaagctccacaccatacttccttccacacgctgcccatcctgcccacgggccctctcactgcaggaagtcaagtaccagcagtacttggctaaaatcagaatgcttctttctccctttccttctccttattataatgtttcctctcaaaaagtttgctttatcgatttcagactttttaaaaaatgagctcatgagacagggctatacaagctgtcagaattatcagacagaaacagagctcctagaggctcctcctgccacctctaggaccccccaggaatcctagatatgagcttcctcctcaccttcatccaaatttgtccatcagcctgagctctttctgtcacagcatcacttcaccttcttccatccccagtgccactatgggatcttgaatgagttggggttatggccacattgcatatactggcccacatattcttccagggattggcctaactggacaataaatagggacagtcacagggtattcaaagctccaagccacccattgcccaatgtgctcagttgggaaggaagagagaattgagaccaacacagagaacatgcactatgttctctcattgccagaccctgtgctagtcagttccatgtgtatcacctcatttaataacactgcaaggagtatt

SEQ ID NO: 1074 - DNA, 5369 bp, Homo sapiens
gagaggagcagtcccccaaatctggggactctccccatgagactggagagttttaattcaatcagaagatgttttcattcaatcagaggattttcccttgccaaaaaagaattgcatgttaatgtaactgttgaaaagtggtagtttttagaaccagcatggattcattaagactaggtgacaccaaattcatcttttaacttaaaaaaattttttggtaaggttctaaagcagggtttctctatcttggcactattgacattgggcctgataattctttgttgggggtgagtatggcgatgggggcggtcctgtgcattgtgaaatgttcagcagcaccctggcctctacccactagatgccagtagcatctcaccactcagtcaaatgtgacaaccaaaaatgtctccagacatggccgaatgtcccctatggtaaaaatcttccctagttgagaaccattgttctagtctgataaatcaggaagcttctctacacctagttctgtagtgagatatttgatagatttggatttgacattatctttgtgactaaggaggaggaaggtgggctgagaatgagcctagttagttgtcccagtaaccagcaggacactgtgtacccgcatgctgatttatgacgggcatcagcctgggcacgtccacgttcacaaacctccagcctctactaacagaactcttatcaacaactcgaataaagacaatgatggcatgcttatcataggtacaaatgtcataagactggtagacatgaaactatgtcagatgaaatactaaggattcacaaggattccagactttgttagtgaaaacaacaagcttcagggcagtgtgcactacacattcccatttgtgtaaaaagtgagtcaaatataaaaatgaattttgatacttgcttagagctgcataagggagccccagaagggtgcatgagaaactaagaacaacattgtcattacttatgtggagggaaggccaactgggcagatgagaaacaagtgtggtacgggaacgtttccatttaccctgttacattttgtgattttttttttttttagacagagtttcactcttgtcacccaggctggagtagagtggcgtgattttggctcactgcaacctccgccttctggtttcaagcgattctcctgcctcagcctcctgagtagctgggattacaggcgcctgccaccatgcccagctaatttttatatttttagtagagatggggtttcaccatgttggccaggctggtctcgaactcctgacctcgtgatccacctgcctcggcctcctaaagtgctgggattacaggcgtgagccaccgtacccagctgcatgtttcgatcgctagacatgatagtgtgttatctactcaagtaatgtaattaaaaacagaactcaacctatagtgtggctgaaatcaaatgcaatgcaattgaacagatgcaaataaatcctgtattagtttaaaaagttaatttggcaatgatgagtataatatcaggcttgagaggttcatgtgaaaatcaggtaggaggttttagatggtcacaggccattaagtcaaacaacaagcagacccaccaacatacacaatgaaagcctggactgtttatggtatctggatcaagggaaatggcccattgtactctgggcaggtcagaccaaattcagccttaccttcatttctgtctgctatatttttggaaaggcattgacaagtgtgtacaaagaacagtgacctagatggcaaaggcctggaaaccatgaaaaatatggggaagaggtgatgaaacttgggacatttaaattggaaaagatttagaaggatatgaaacctgtcttcaaacatttgaaggcttgtcctgtgcgaggagggttaggggctttttgtatagctctagactgcagaaccaggccctcttcaatttattgggaggccaatttcagtttagaaccatgcaaaggctgctttgtgagataataataaaatagcaacacttactgagcacttacaaagcatcaggccctgtgataagcactttctctgcattatttccctgacttttcacaacatcctggccaaggcacttacttcattgtcattttaaccaaaaggagaaaggaggcttacagaggttaagcaaacatgcctgaggtgacatggccagtagacggtggatttgtgtgaccccaacacatatatgcttgaccactaagcctccttcctgaaggcagtgagcactgtattgtggccagtattaacagaggggtaaacactgcctggtcaccatgctctgaggaaattcttggagcaggtgggagaagcctgtttcatgcttaccacactgtagtcctctaagaaaataagccctgtgtgtgtgactctgccagggaaaggagtgaggcatacggagagagagaggcaagcaggctcctgctcacagctatctaggggctaaagtggagtttttggtggaggtggtggtctgtaaagaagtcaaagaggtgagtgccgaggagaaacgctgccccagtgctgaagagttgtctgttctgtccacggaggcttgtggcagcacttacaagtcattgggtattatgcttcctgactcacaaagcccctttgaagacatatctcatttaagtaatcataccttgtgagaaaatacaactctggcagggtgcgggtggagagggatggggagaagtttctccagagacagaagggggagaaccacaaaagtaagagaacaatttggtggtggtcataccagagaaggacaaagaggggaaggtgagagaggagagaaaaaatatctaaggcttctcaacctcctctggggcccagctgggccagctcagctgcctcaaggacttaacaatatttccaaactaaacaagctccaaaaggcaaatgacccccggtcactgcctggttcctctatcacacagtagcaggggtaaacatttaccgagtggagaaaggaagagccagcaggtaagccacatttaaagcaggctgaatcagagcagataaaccaaggggccagcatatagctttatcaagttatctgatgtgctggctggaaaagagaaagacctgcggcacttaaatatgagagggaatcacttcaaagcatccaggaatgggaaattcatgctcagtgggaaggacctgggagaaggacttgtcatttggagagggctctcccagggaacccatgtacacaggagactcagaaaattaacatgatatcttgaacaataatcttacaccttagacccaactacagggacagccctggaaaaggagaaaagtcccaggtcctggcaaaggctgtgagccagcccacaagccaacacagtggacctagcacaaggtacccctggctgggtgtaccagagtgatgggcagagcaaggtccagagagggcagaggagctgggagggcagggattggaggcaggctctgctcagaccagctggagccctaactgtggggtgggagggaagagggatgggacttacgcagtggatgcctggcaggggcagcagagcattgccctccaagggccagaggccaagagaagaagctggaggtggtggggattgtggtaattacaagagagggagagaaatgggagggaaaggaagatggcaagaggctgtcaaaaagagctgcaaaggaggatgagggcaaagattacagagagacagaggcagatgacacacagagggtggcagaagagaacaaagacagtgaggccgggtatggtggctcacgcctgtgatcccagcactttgggaggccaaggcgggtggatcacctgaggtcaggcgttcccagcctggccaacatggagaaacccagtctctactaaaaacacaaaaattagcagggcacggtggtgggcgcctgtaatcccagctactcgggaggctgaggaaggagaatcgcttgaacccaggaggcagaggttgcagtgagccaagatcacaccactgcactccagcctggatgacagagtgacactccatctcaaaaaaaaaaaaaaaaaagaaataaagaaaacaaagacagtgacatgaagacccaggtacagagaaacccaaagacagacagaaacctctgcaggggctaccgagagaaggaacaatggagaaggagcagcacagagaggcaagcatgcattaagaaagggaagagaagaaagaaccctgggctttggtgaggagaggctgcagaggagaggaaggaagcccctcctgctgtctgaagtccctttggagcttatcctcttggcactcaccgggagcagctttgctaatgagggacttttctctggttgtgtgtgcgagggcagcaggaggaggggcaggggttggttcatcactgggacttctttagatcagggttttgtgtttatcttgatgtaatgagttcgtttgggtaaatggaggcgatgtggctgcagggctggggttcactgtattgttttcagcaacctgctgctcttccccggaccagccacaaaccacagacataaccaccataagtgaacagaggcctgccccaaaaattcaggggacagacaccgcagccttgccaatgggtctgccccatggactgagtgacggcccctggccctgctaaagcagggaggagaccaagatgggaccctggcacctgctagtcccactgcctgcaatgccttcacccagataatcactcaataggcatttatggagcactggctctgtcctagatgcttagaatatcactgcacaaaacaaagatatctgttcctgtagagatcaggaagttgagcttctagtaaaggaaggttctagtaaaggaagattcacttaaataggtaaaccacaccatctgtgggaaggtaagaaatcttttttttttaaatcattttaggagaattttttgccaaagttaaggatgcacccaggagacaggtctatgcctgtctctgtgattttgagggctccaaatgtaaaggtgaaggggcaggatattgagaagcacacagttttcacataaacaaaaggagcagaggaaaaatgtagggaatctgcattttacataagataacacagacaaaatggggtaggggaacaataagctggaaggtaagaaatcttatggaggaaaacaacagagcagaagacggggagcaggaggcctggggaagtcagggtagcttccttcaggggtgacatctgagggggacagccctgaggatctctgagatgtgtgaatttcaggcagtgggaacagccaatgaaaatgtcctgaggtggaagcattcctggaacattgagggacaa

SEQ ID NO: 1075 - DNA, 2700 bp, Homo sapiens
cttagctgtgatgggctgggctggactaagaagacacatttctaaaacatcaaaaggaatgtaccagtaacagctcacagccctcagacccaccttctctaggaatttctttccaggcggtatttctagggtctcatgcatgggaaagccagggttggagattcacttggtcaacctccctagttacctcaataactaatcatcatcacccttgagggaggtaggaaggattgagagcctcagaggagagaggttttaattagccagctacatgtttttgcacatagacaatgatgatatgtccaatccttcaactaaaatttattaattactctgtaccagacattgtgctatacttctgtgtgggtgagaggtggttaatacatggtccctgttccccaggaattcttgactagtagaagagaccgacacatggacaactagccactagtgcacatgatgctgagtgcagtcatggagagatgaagaaactgctagaggaacatagaggcaggacccaaggagtcttcacagaagatgtgacacttgatctggttatcaaaggatgagtaagaattctccaaggagacaagaggcatgagaatcttctagcagagagaacagctgcagccaatgcaaaatcatataaacaagtatgagtgatttggtttgacaggaatgtggaatacacagggcctggtgtggtaggtgatgaccaagcatcatgaacaaacatttactgggcactgggcatggggcagaaggaccactatgctctgtccctagggacaaaaaaaagtccctaatcacagcccttccagagggtagtcatgttggaaagagtactcagtgttttactggattcctaaaaggatcattgggttattttagcaaagttcccatttccttcatgaagctattctaaaatcagagagattttactagcatttgagcaaagaaagatcctggactctccttccccaacccttgaactgaggctgtgctagtactgcacatgtttaccctcagatacattcttcaccctttctttgctctattctgtgttatggtgaggacaggggaaactgggccatgcaagttgcatctcccagatttctggctggattcagccagtgggaggtactttcagaggactagaggtgaggaggaatggagaagtcaggatatttctccctctccctctttgtttcaactactgcctcttcagcagctgtgactcctccatgtcccactagacacatctaccctggttcaagttcacactgaacacttccgccatggtcccagtttccacctaatgacctcaacctctgggctctggtaacatctcaccctccctttgtctccccaacctaaggtggtagtgtcttccaagggttgctgatttctgcattcccatacagtttcctgtttggcttcccaactcttctattactagtttcttgtattaaattctcactgttataaatacttaaagtgatctctgtcttctgatttgtaccctgactaacatagagactgcattttagtggtctttgagtctcccacagcacctaatacagtgattttatgtgctaatttgttagatgaatggatgggcagatgggtggatggatggatggatggataaacagatggttaattaaatagatgagcagtggtatgattggatggatgagagttgaatggatgttcataatttaatgaggatgttttaatttcataagtataaaggagtaaattctaaaagaactatgcagaaagtgattctaagacatacaaaaatggccagaaatttagaacagctgtgctgccacaagtcaagcccaaaaagaatccagctgctagaaaagcacaagaagagaaggagactttgtgaaatttatttcttgttgcatctgaattgagtcactcatttcttcattctctttctggatctcttcctatattggcagagagtggtgggggaaagacgtgtttatggcaaatagtcctaattttcatctggcagacatttccatcccatttattatgcctgagcctctgcaaaatgaaggagatataatggaaagaacctcatcaccattgattcttagtcatgtacacttgaagaagatgccaaatggctacagtcctgggctggaaagaacctgattggccagatacctatagtctgtagggttcttaaggacttttaacaattacattctcagaatcctgcatcctttttctaagtatattgccttgaataattaacaacatagagaccaagcccttccaaagccactttgttcattcccctcattagcagggttgtactgaaagatattcaataaaagatgtttccatcttagccactgacactggcatatgagagcattgagcatccaagttcctggatctgccacttatctgctgagtaccacagcaaagtcagcacccttccatgagcttaagattctttgccctctccttcaccaaatttttatgaataccagatgagatgactgtgacagatagttgaaaaccatacagctcaacaccatgatgtcatctgttttatggtcaatcagttgcctacacagatctaacctattaataaaagcctctagttgaactgtaatcttgttctgtcatctagaatggatcctcctaccgacaaatcagaaagcaataggt

SEQ ID NO: 1076 - DNA, 2578 bp, Homo sapiens
acatgtacacatatattcacatacatactcatcagaggcacatccttctacctgtacattgtggagataaaaatgactccatcttggatgccaatccagcatgttaccttctgattaccacagtcccatggatgcctcctgattcctgctttatttactgtccctagtgtaagaacaagtcaaccttgttgttattacacaaatcataggctatgacgcatggggccttcttgcctgttctggagggttgcctttgattgtcttgctggagcagcaacacctttccctgtggtacgtaagtcttgggtctggggagtaacagtgcagagatctacctgtcttactgctccccaggaccacacttccatcctattctcacaaactggatttatctgccttgctctttggtttcttggctccttctgtgtttgggggttgttttgcatatacagccctttcatgtaacatacatgcatgcacccacacacatgcatactctcactaactcatacacacaatcctgttaaactcttctctttattaaaagaaaaaaattattcccattctttggcatcaagaaatgatatctccaaggctgggcatggtggcttacacctgtaatcccagcactttgggaggccaaggagggcaaatcacttgaggtcaggagttcaagaccagcctggccaacatggtgaaaccctgtctctacttaaaaatacaaaaattagcctggcatggctaattttacaggtggtgggcgcctgtaatctcagatactcaggaggctgagacaggagaatcgcttgaacccaggaggcagaggttgcagtgagccaagatcatgccactgcactccagcctgggagacagagtgagacactgtctaaaaaaaaaaaaaagaaagaaagaaagaaagaaagaaagaaagaaagaaagaaagaaaggaatggtatgtccagagccataaaaatactctgcaatgtcatcttatttgttataacagtggcctgcaaagtagccaatcaaatttaaatgcagggacagccaactccagaggtcaaaagaaaccagtctgggtgagaagacgagagtaaccgcattcatcctttcttaccaaagtaactaaaactacagtctactgaaaatatttgaataagtacaaagccaaatcccaaattttttatttcagctttgcaaatctcaaaaattatctttttctcagctagtggaagctaagttcactaaaaatgcttgttaacctaattaggtgactgagctaagtacacattctaagttggagtactgtgagtgagcacacaggtggggtaggtggcttatttccctgagatctgccgctggtggtgatttattttagaaagctgcatctttaattaagtatgagtagcatatgatttattatgtgtgcataacatgttgtaaccaagtatcaccatgttcaaagagcccttaaattctgtgaactacatgaacaatgagtccatgtcacttggcagacacagtatgtgtcgccttcttactccatgtattagtccattttcatgctgctgataaagacatacctgagactgggtcatttataaagaaaaagaggtttaatggcctcacagttccatgtggctggggaggccttacaatcatggtggaaggcaaaaggcacgtcttacatggcagctggcaagagagaatgaaagcctgtgcaaggacactcccgtttataaaaacattagatctcatgagacttattcacttcacaagaacagcaagggaaagacccacccccatgattcaattacctcccactgcatccctcacacaatacatgggaattgtaattcaagatgagatttgggtggggacacagccaaaccatatcactccataatgtcttccacttcatttagttgctttttagagtggtgcctgtgctgtgtgaccacatgctcttggaatttcaggagggatgctgcttaagctagtagatatgtagcaatcctggctgagcccagttgggttgctattgcagacttgtgggctgatggccctgtgggtgtctttcgcacaagctgatatgcatggtggggtgggggttcctgggggccagaggtactaatagagcagagaaaaggaaggtaaggggcagtttctgtccctgccacagtcacctctccttggctggctctgcccactgtgcaggctaattgattacatttgacctcctatggataggggattggaaagaaagccaaaggagcagctttcatgaaagtccaagggagattctgggtaccactgtgactgaggcaaccaagcaaagccaagttggaggagaggggtcattgctcttattttggtgccacaacatagcagcagggtccgacagggtctgaaaaaccacaaagagcagctgaagtatgactggtatgattttcgtggaatagtgacagaggaccttgtctcatgaaggtcaccagcagcagcagcagaggtcagtggcctccctcaagggcttgtgtgccgtggatttccacaagaatatcaagcaaaagaacttgag

SEQ ID NO: 1077 - DNA, 1271 bp, Homo sapiens
cttttattttttgtagagatggagtctcactatgttgcccaagctggtctcgaactccggggctcaagcaatcctcacacctcagcctccctaagtgctgcgacaacaggcgtgagccaccatgcctggcccaaatttgacattttaagtaatagctttagtctcatttaactaagtttgagagtatataagaaagctatctttaactttctatttgaaacaggaatccatagcagaaccaccctaaatgacttaactatccaaacatgtttttcttataacttacagtttgatatcaagataggaatataaagaaaaattgagaagcatacctgttctgatttttcatcagaactgctaggagcttcagatgtgtctttcacaaaataattatccacaaggtctatctgtctgcattcttggcggcatactgggcaccgtattacaccaactacaacataaaataacaacattttaaaatattcttcaggaataaagaaattgtgcatgatgtccatatagaaacattaattcatcacagagaagaccaaagaaatgagcatcaagagctcagtaaaataacccagcgagttattccatttgggtaaaagtgatactctatttaggaaaagaaaaaacaagcattatgatgcctcccaagaagtgcttcctcattataatatgtggttagctgaataattgccccaaaagaaatccagatcctgatcttcggaaactatgaatattaatttacatggtaaaagggactttacagatgcgattaaggctctggagatggtttgtccagcgggtcctaaacgtgatcaagtgaccttatcagggggaggaagaggaaggtaagactacagaagagtggaaggcaattataataacaatggacgcagggagtagagtgatgcactttatagatgaaggaagaagccggagaaaagaaagacaggcaaccactagaagctgaaagagacaaggaaatggattttctcccagagccaccagaaggaccagtcctgccaccacttttgactttagcccagtgaaagggatttcaaactgctggcctccataatggtaaaacagtaagacaggtgctgttttaagacactaagtttgtggtaattttgttacagcagcaacagaaaactaatatacaatctatcatcttataaattctgacttggttagagatacttgaatacatgctaatatgagaagaaagatcatctgtcccttcacctgctagtgttccagga

SEQ ID NO: 1078 - DNA, 1445 bp, Homo sapiens
cagtctaaccaggcacagagctgacttgcttcctctcagaccctgtggctatctctggtccagagaatccagtagaagcctttgtgcttgtccagaggcccagtggcccccaggtcttcctcttcactccccagtccccctccatcagcacttctctgcctaaggagctccaatagtctgataccaaagggccagaagatgcaggtcctcaatgccaggcaaggggtgcgacttctcaacagtagtgcttgaagctccagcatggatatgtgcagattggtaggaggtcatggagactcggaggtgcatgcaagtcgttgctgtggaaacagctcaagtgtgaggcgctgggggccaagggggaaagcagcgggtggaggaagggtcagcttctagttctgtgagaggctgggagactgtttgagcctggagacaggcggcaggcagagccagtgttaggcaccattgcagcaccatcaggtctcctaggacagaagaagggattgcttctgtcctctctgaagataccctgactgggaacggtggtggtctgggatgtggggggacccctggcctcttacagctctgcccctgactcggtcttgggaaatccacaccattacttcccaagactgcctgctggatcactgtggctcaaaatgggtggctttgcagagaattctccttatttacgctctgccaataactggagcctcttccaggcagaccattgtgggggtgactgatagtgccagtgactacagtttagtcagcctgctagctctgtatttcactccccttgaggaggtgctggcagaaatcccaggagccccatgaggcttccttttctatgctggctgaggaagccacagcactggaaaattactgtaaatgtgcgtctggcgccacctagtgatcgaggccctcctgcaccctgtcagacagctctctcaggaaagcagtttgccttcttgcagtgcacacttcctcaggctttggtgtgtgtgacggtcacctaggatgcttgtcaaaaatgaggactcctggccgggcgcagtgactcatggctgtaatctcagtactttgggaggccgaaacaggaggatcgtttgaacccaggagttcaagaccaccctgggtgacatggtgagatcccccacaaaaattcctgggctccagaccctgaggttttaacttagtttgtctggggaggaatctaataatgtgttttcctaactagtatctcaggaatttgtaaggcaagtctctggactacattttgagaaccagtctcttgaaggaccatgcctcttaagtgtctgctttgcacagatcattatgtgcactcactgagttttgagaactgtactgaacactcctaaatctgtatctttaggcaaagtctcttgagtttcagctgctattttttgactggttgctttctg

SEQ ID NO: 1079 - DNA, 2155 bp, Homo sapiens
aaatattttgaattttccatgaagacctcttaatttaaaaaatgccacataagattatatatgccatataacattttaccaatgttatttaaatttatttatgtatttatttagagatggagtctcgcactgttgcccaggctggagtgcagtggcgcaatcttggctcactgcaacctctgccgagttcaagcaattctcttgtctcagcctcccaagtagctggaactacaggcgcacaccaccacacctggctaatttttgcgtttttagtagagacagggttttgccatgttggtcaggctgctctcgaattcctgacctcaggtgatccacctgcctcaacctcccaaagtgctgggattacaggcctgagccaccatgcccagccctaatttttaaatatttaatgtttcctcctttgttccaaaggactcacgggggagttaggcaataataattttgtgactataaattaaacttaaacgtgcattccacctcatgccatgcagttttctctgcagaattctgtgagactgtgtctgtttttattttatagtccgtccactttttatctttctttcccttcttttggaagagctgttgaaaatggtaagcaaataaatgccattttttcctcacttctctgagtgataaaacctgaaaatgatgaatatataagggcagactatgatttaatgtagtgccttttctaattcaaatgacaactaacttttctgagctaaagtgtgcccatgtcgtgataataatatttagaggatgagtaggttataatatatcatggcatacagagaggtctatacattagttccaggaatgttgctaggaaatattaaaaaaaaaaatgttcctagatgcaaggaaatataaataatccccaccaactagggcaaagcctaggtatttatttctatattgacagcaactatttttttcttaagtacctattttctagatggcatttaaatctgcactgcattttagtaaatttttcacttttttgcacagtgttcaggacctgaaagctccttctcctattattaatgaggagtatatgatgtcttcaggaaattctgaagtaataaaagcccttctattcttcagtgttccgtgcccctcttttaggcagaatcccgtcaagaaaatctttggaacagtactgtctggagcactggactggggagggccgggtgaatctctgtgtttgaggagctgagaagcaacactctgggtggaaaaaaggctcagagacttgtttggaagctgcatttgcagagtaaagcactttttgatatatgcatctagtgtggcctggagcaatgctgatagagattgtgaggtaggaagagtctaggtgggtaaagtccctccaagccacctttggtactgccattgctctagacctgtgttgtccaatatgaggacttcaaatgtgtttggtccaaattaagacaatgctgtaagtggaaaatgcacactggttttggaagattcattatggaaaaaaagaatgtaaaatatctcgttaataatgttttatatgaattgcatgttgaaatgataatatatatgatatatttttatttttatagcttttaaggtatagactatttttagagcagttttaggttcacagcaaaatcaagcagttttccattagaaaatttacaacttatcttacgtgtatatgttattactatattaatattctttctaaaaactaattgtaataggagttcattctattatattctgatttattccttctttatgttagatctgtttatctcagacattctaagtgggagcaatattgcccctaaatggacagaacttggttcttggattgttaaaaaaaatcctacttttaaaaaacattttttattttagatgggaggttactgtgtcactcaggctggagtgcagtggcacaattatagctcactgcagccttgaactcctgggctcaagcaattctcctgcctcagcctcccaagtagctgggactacaggtgcacaccactatccccagctctttctcttttagtgtacaaagcacagatatatatgtagtacaaaaccagagatagatagatagatagatagatagataggtagatagatagacagacag

SEQ ID NO: 1080 - DNA, 4597 bp, Homo sapiens
cggaggttggaggttttctggccaaatagcatcaaccggcataaaaagagcaaatctctggaaggggctcccagaagagctgttacatgatgcacagcccctaaccttctgttaatggctcaccccaacccaaccttggttcatagtggagttatttcatttaccaggtgtgaaaattggattttaccacagaggaggggagttattacctatcaggtctgctctttaggggagcggagattgtggtgggatttattaaaagagatttgctatgcatggaacatataattagagatgtgttcctttaaaactggatttataatctttgtcattttagaaatgcagttttttgccttctgtttttctgacagccttcttttccatgtaggttgcacacaacctacctaggatctgaatattttatatggcaccattctgccaagagacggacctcaggggtgtgacatgtgacaaagagtacagcttggggggattgtggggagtgcctgtagtatggatgctgatattagtcacacaagatgctaacgatggggaggggatgataaagtaattttcatgttaattaattgctatgtagtccaggcctcggtttcatggaggtattagggtcattctgagaccctctgatgagagtactcttgaaaatcgagttcagatttaattacctgttgttagaggctatataagacaacctcaaagttagtaccggttaactacacctgcttttaaaaaagacaccttgtttattattatggtgaactgggggtggctgaatttattattgtttagcatttctagcacactttgttcttgctgagtgctttaagcgtttttatgtatttatattggttgctcttcgcagcactcccaagggatgagtgggtgataagttttattatcacctgcttttccaaggaggaaacagaagctcctaagaggagaagggacttgcctgggtttatagctcagagctcctgccactttgttaggggatcctcaacaaaatggtgataaattcagcccttgctctgcctgctctcagcccacgagtaccacctgtgctccatcctgtatcccactaactacagtgggatgcaaaataaaaatcatcactattattggcctctctgtgcttggcactttatctctcaactgatcaccttcctaaactcaccttattaactctgcttttcttttaaaagctctgccgttttccccacagcccagcttagctccctaaagtcatgtgtgactcagcctttccacccacttcagttgcccagggagccatgtagattctgccacccaaatgtcttacatctgtcccttccctattcttccccctcccactaccaaaattcagtcctcattaccccctacctggactactgtaatagccgtttaactgggtccccacactttccatcctaagttcttctgtctggtaaaccttcctgaagtaaggctctgataaataccactctcccactgggtccgttctcaggagccttcccatttaagtgcagattcttatcctgcactcagaggtcaccttcctttttggccttctcgcctactaagccactgaacaactttactgcgcatcaagagcttggctagcaggcgcctgccgtgagcaattctgatttggcgggtctgctccggggccaggggacccgcccttaataggcctccatgtgatcccagtgctcgggaccctatggaccacacactgctctcgcaggcttttcccaagcccgtagtcttcagcccctgtgcccggctatgctgttcttttaccctgaaacgctctcagccccctctccacctgttgaaatttttctcatgctttaaggcccagctcaaatatctccttcgtgaagcattttctgattgttccaaatggataagatgcaaactccttagccttaaatttaagatgctctgttttacaattccaggcccatctcctgccttcctgcctggttcctccgctatccctaagcccaccacaccgaaatggttctcagcataggccctttacacatacctccgccaggaatgtggttcgttttctctctctttctctctctctctctctctatatgtatatacatatctcctctctccccacccaaccccgtctctcctaaacttaccctgctagacccggctcatatgtcacttactccgtgccacattcatcacaacgacagtctttctagactcttccccgcccccatagccgctaagtcactccctcccctgtgcttctccagactttatacgcccgagagaacccaacgacagtagcttacttgtggtttatctgttaatttgaacactaggcagtgaacttggctcaggctgtgttctgaggacctagccgggagtccacaggcagtcagtccttctagaatgcacgcatgaatgaatctcttgcttcccagccgcccctcccccggaacaggctttgctctttgcacctctgccgttgcatttctcttcctgtcttttttgtacttgttttactcaccgtactagattgcaagcccccttgaggggagaaacctcgtgggattttgctccctattcccaagtctggctccttaaccatggcaggaggtcaataaacgtttgtttaattgagttgtaggatgttgtgcccggctagctgctaaacaacctcatttaaggggttaactaataacactcagagaagttcttctccttagggggcatttgcattttaatgggaatcttaaaaacccaaaggaaatgttctctaatggtgggatttcaggccttgtagtgaggcctgtgtgtgtgtgtgtgtgtgtgtgtgtgtgtgtggtgtttgatggggattagggaagagttcctccagcccaggggtatttcaacttttctgtgtcatgggcccccatgagcagtctcgtgaagcctatgaacagaataatgatttaagacacataaaataaattacgtaggtttacaaaaataggttataatgaaatataatgatctgaatattaaaaacgtcaagtttgtgatatagtaatatgtgcttctttattagaacgttaattaaaaagtctactggcaggtcttataattattgtaatgtcatagtgatgactataagcggtatttgggatatctgtgattctgctggttaaaaagtcatgagctgctcataccaccttgatctgttgcctggatccataattgaaggaaatgataattttcaactagaagttagtggaagcaaagatgtattttttttctgcatccaagttctagccctagtttccgttgcggacccagggttaagaggcctgacttggccgaaccctcaatatgatgtgggtggtcttgaagccagtgccattttggatcctaggcttcctttcctactctccactactttgaccttaaactctcagattcttattttttaccctttatttaacaaaaaacgacagtatacatttacttcatttacagaaatatgaaataaggtgaaacaaaaaggattgtttgggttctccctccatcagccaaggcatcaagatgtcagactatgggagaaagagaggctcactagtttcctagcctgggagcaccccctcccagaagtgctatccatggggcggggtggggcgaggccaggaggaagaggaggatttgtcccaaattcagaggtgggaaagcagttgcagaatttacctgagagtctctgctggctctttctaaattcagaagtcaatactgggaccaaagagcgtgattctaggggtggtccagcatcatatccatcttggtagttagtgactaagtgaaatattgcttttgagaccctgcactccctaatgctgatgtgatttctaatttaggttaaagtgtttgtgcagttctctttttaaacccaaaatacagggaacatattcaatcctttcccagttatctttgtgtattttagtcatttagaggcaattttcctccaggcagatttaccctactgtttgccatgccttggggcttatacctctgctctcagtggatgcatgcttggaggatatcagtgaattttaatattagctggacatgttgttaccagggtgagcaccatattagcccaggcaaaccatcatccctgtccctaatggtagtgacactgaaagctttacccttgacatcttccttttctcttgcatatgttttcctttggtgagctcattcattttcctggcttcagctctcacctctgcacctccagcctgtcctctcacctggcaagacatctccgttttggtgttcagtcacccataattctaaaactcgacctcttttgtcttctacaaatcagcttcacttttccaaaacacagctttattgaggtataatttacaaaccataaaatttacccattttaagtgtatgatctattgatttcttgtaaattgacagtgttgtgcaaccaacactaaaatccacttttaaaacatttactttaccccaaaaagatccctatactatttgcagtcgatccccattcccaccccaactaatctgc

SEQ ID NO: 1081 - DNA, 5794 bp, Homo sapiens
aaaagtacataataaatgtatattataaaaatattatattagcaaaggtatattaaaattgatatctaaattttgctaaaccttcaaacagttacctctaaaaggcagtagataaaaatcaagggtcatttaataaattttaataagtttaagggtcatttgctaagtcttgataaactgttattaacataattccaaaaaaatcaaaacttggaaaacatctttttgcaagtcaggtggctttttatttctttgttttcagcaaatgtagagaatctgtccctgacagaacattatatgtaacttttatggtagagaatttgtgatttggggcatataacttggaaggatttcaaagaattaagcaaaggaactagcataattgttctgatcccatctacttattcacatgaacaagatttctcagaaattacattttttagagaggggaggaaaataaaactgatgtagaatgcaactcatcactgctataagtaatatccatgtacagacatatcaactacagttgacccttgaacagcagggggttgtactgtgtaggtacaattataaacagattttcttccacctctgtcacccctgagacaagaccaatgcctccccttcctccccttcctcagtctattcaacatgaagatggtgaggatgaagacctttacaatgatccacctactcttaataaatagtaaatatattttctctttattattgtctttttttttctttttttctttttttttttttttttttttttttttttttttttgagacagaatcttgctctgtcacccaggctgaagtgcaatggcacgatctcagctcactgcaacctccacctccctggttcacgccattctcctgcctcagccttcggagtagctgggactacaggtgcccaccaccacgccctggctcatttttgtatttttagtagagatggggtttcaccgtgttagccaggatggtctcgatctcttgacctcgtgatccacctgcctcagcctcccaaagtgctgggattacaggcatgagccaccgtgcccggccctctttattaatttcttaataacattttcttttctctaacttactttattgtagggatacagtatataataaatataacatacaaaatacatgttaagcaattatttacattattgaaagccttctggtcaatagtaggctgtcaatagttaagtttctgtgaagtcaaaagttacatgcaaatttttgactgtaggggtatggggtggggacctaactcccacgttgttcaaggtcacctgtaattggaaatgaataaaactagtcaaagtttgatgaggaaaagatttgcatagtcttaaggtatcttcccacaaattccttgttaattacaaagcggaaatgtgtaactttatagtggtgaaacctagcagataccacattagttaagtaagtgatcaaatttagtattgtcaataacacaaccaggcagcttaacttcaaaatgcattttaaaaactttttttttcaaggttgcaagatgcaaccttgaagcttacagcagaaaccttgtttttcttctccttagtcttttttcaaggttgcaagatgcaaccttgaagctttcagcagaaaccttgtttttcttctccttagtcttaacacacagctttgaactgtactttctttaaaacaccaggttgctccctttctcaccatacactcttacaccatgcacatttatctaactgtatgcttgtatctaattatatgcttacttagaagttccaggggctaatcttgagacagacaaagcctggaaatccagctgcagaattccagcgattaactcaaggcaactagtcaacaacatggccattgttgagatgatgccagctcacgctccaggtggactgaaatccaacatagccatcgaaacaagacacacagacctgagctcagcacaactcctgcatgtctcccctgttaagtcccttctttttgaaaccttgccttctccccagtagttcaaagtggttgctttggttgggaatctggccacctccccagtactagttttggttaataaaaccactttccttcttccagacctcactcttgttaattggattctgcaagcagcaagcatccagacatgcattcatttataataatgggacagattcaaattgtgtaccactgactagatgtaatgaggagaaaaatgcaactattctgtgatattactgccaaaaaataactgacctgattctaatcacaagggagcacccaacaaactccaaaagaggaacattctccaaagcaattggcctgtaatctgcagaagtgccaatgtcatgaacattaagacaatttgaagaactctttcagaataaaggggtctaaagagacatgataactaaatgcaatgtgtgatctatattgggtacttttgctttaaaaaggacatatttggaagaattagtgaatttgcagagggtctggggataagatggtactaatatattggtgctgatttttttattttgattgttgttatgtacttgtaaaggaaaatatccttgcttgtagaaattatacattaaagtgtttaacggtgtcttagacacgcagtgccatgagcagtctgggtatccattcctgttggaatggaaataccacaaactaggtaatttataaataatagaaatgtatttatctcagctctagaggctgggaaggaagtacaagatcaaggtggcagaaggtttagtatctggtgagggcccagtctctacctccaagatggtgccccaaacacggtgtcctcacatggcagcagaaatggaagagggaacaggcctagataattctcttgaccccttttataaggtcagtaatctcattcctgaggatggagcccttatgacttaatcacctcctaaaagcccaaccccttaatactatcacatggcagcttagatgccaacatatgaatttgggggggacacatacattcaaaccttagcacaggtaatagggtatcacattggcaacttatccttaaatgcttcataaaacagaaagttctttgtattattcttaggggaaaaaataattaccttcaatgacttccatgtcactcagccaaagtcttctacagtggccttcaattccctccatgactttcctctattgtcatcttgtgccccatttctctggattttccccgtaatctgctctagtgacacagattttcttgcttttcctcaaacccatcaggcacactcccaccttaaggcctttgcactagctattccccctgcctggaatgttcttccccaagaaatctacctggtcaactccctcatctccatcaagttttacccaaatgtcattgtttcagtggggcctacaaggaccaccttactttttttaattttactttaagttctgggatacttgtgcagaacctgcaggtttgttacataggtatacatgtgccatggtggtttgctgcacctgtcaacccatcatctaggttttaagccccacacgcattaggtatttgtcctaatgctctccctccccttgccccccaccccccgacaggccccagtgtgtgatattccccttgctgtgtccatgtgttctcattgttctgaatgagaacatgcagtgtttggttttctgttcctgtgttagtttgatgagaatgatgacttccagcttcatccatgtccctgcaaaggacatgaactcattcttttttatgactgtatagtattccatggtgtatatcagttacattttctttatccagtctatcattgatgagcatttgggttggctccaagcctttgctattgtaaatagtgctacagtaaacatacatgtgcatgtgtctttatagtagaatgatttataatccttcaggtatatacccagtaatggggttgctgggtcaaatggtatttctggttctagatcattgaggaatcgccacactgtcttccacaatggttgaactaatttacagtcccaccaatagtgtaaaagtgtttctatttctccacatcctctccagcatctgttgtttcctgactttttaataatcgccattctaactggcatgagatggtatctcattgtggttttgatgtgcatttctctaatgaccagcaatgatgagcttttattcatatgtttgttggtggcataaatgacttcttttgagaagtgtctgttcatatccttcgcccactttttgatggggttgtttgtttttttcttgtaaatttgtttaagttctttgtagattctggatattagacctttgtcagatgggtagcttgcaaaaattttctcccattctgtaggttgcctatttactctgatgatagtttattttgttgtgcagaagatctttagtttgattagatcccatttgtcaattttggcttttgttgcaattgctttcggtattttagtcatgaagtctttgcccatcccgatgtcctgaatggtattacctaggttttcttctaggatttttatggttttgagctttacatttaagtctttaatccatcttgaattattttttgtaaaaggtataaggaagagatccaatttcagttttctgcatatggctagccagttttcccagtactatttattaaatagggaatcctttacccattgcttgtttttgtcagatttgtcaaagatcagatagttgtagatgtgtggtgttatttctgaggtctctgttctctttcccttggtctatatctctgttttggtgccagtaccatgctgttttggttactgtagccttgtagtataatttgaagtcaggtagcatgatgcctccagctttgttctttttgcataggactgtcttggctatatgggctcttttttggttccatatgaaatttaaagtagtttttttctaattctgcgaagaaagtcactggtagcctgatgggaatagcatcgaatctataaattacgttgggcagtatggccattttcacaatattgattcttcctatccatgagcatgggaagtttttccatttgtttgtgtcctctcttatttccttgagcagtggtttgttgttctccttgaagaggttcttcacatctgttataagttttattcctagatattttattctctttgtagcaattgtgaatggtagttcactcatgatttggctctctgcttgtctattgttggggatcaccttattttaaaaggaaaaaaaaagtcagtcttcttttcacactcttcattcccaaatcctgctctagttgttttgtttttatttctccagagcatttatccccttttacagaccacataatataattttatattacgtttattattcattgtgtttttcttatgctagaatataagctttatggaaagagagatttttgttttttttgttttcttcgctgatttttcccaagtttctagaacagtatatggcacataaatattcatggaataaatcaaagagtttccagttctgggtgtaggatcaaatgtatttgaaataatattttgtagtttttatttttttatttctcaaaataaaaaattggatttttaaaaaggaagcaaagaacaggactttcatttctgtcaatataatagactggaaaaattcaaactatagaaggtttacaagtactggtaaaaaataacaaacataattttaaacgcatagttaatctacaaaacggcaaaggaaagccccaagaaaca

SEQ ID NO: 1082 - DNA, 1815 bp, Homo sapiens
tcttagacagtcttcaggctcttattggccaatggctcattatctgtgaaacattccttctggcacaggccacagcgtgggcagtaggagaatcctaggtgagcactatttcccatcctggcctcccgtgtctgtggctcagcaccattctttccctttggtgatgcagagccccaacctgagaatgaggaggactatatttctgtagaaaatagccttccccaaaaaacctcaagtgggttatgcatggaagccatctcctacctcttaaactcttcaatgggtccctaagccttgccactctctctcctgacactgtggctacgggcaccaacgtcacctgcctgacagtgtctggtctggactgctcctgagtgtcttggcttcccagccaaaggtcatcatcatcacagcctctgaccagaggtcccctatagcatgaactgaccccacagagaagggccactaaggccagatcacctggccacatggagctcatcatgagcacatttatctggataaggaaaaaaaaacctgcaaaaccaaaatgaaaatacagaatttccccaaactccgaaacctctcctagtagacctgactgaagagtctaaaactggcctggggaaagcactgggaaaaaacaccctggggtccaccctgctgggtaagatgaggaagcccacagggcagatggctgatatggaggctgagcagactagtcaaccagatagccctgttgtggcgctggggctgttagggttgaggggagagtggaaagaaaactgggctttgaagtggctctagcccagatccaggcccaggctctactcagctcctttatgctgaatgttcatgcctgccatcagctccctggccagatggatgagctgagtgatcaggcctggggaggagggctgaaaatcccactggcagtgccttcttccccgtatccagtctgtggtgctgggagtgcccactgcaaggccctcaccaggtgtctcacatcagtacctcctccagcagttcagacctgctttagggaactggaatctggaagtggagagacatctgagggtctttgccatctgaggacttcctctcaaactgctgtcatttccactgatgctcctccatccttccagaccccagacccaatatgtggggatccctgccttcctggggcctgcgctgaactgactctgaattcttcatgtcccttaaggggtgactgtgaccgagaaagagtcactgcttcacagactctctccacagcatttttagaagcattcatggtaggaatggggtgcttcctactacctttcaaatgacctcatgcggcagtcatgtaatttgctagcctgctttttactggcatacattgttaaagaaagggaaatgcccatgccactctactcctctaggaaggaatagggttcaggaactggtgacagtggctattaagtcaccagcctcagatcttttctgtgctccaaaaactgcctcccataaccctggtctgcgttcttagacagagtggtagatagaagataatttgcaaagtaccctggaaaccctggataaccactatcggaagcagaattcatttctgtctctgaatagttctggtccttaactaaccaatgacctccctgagaaacagagacagctggggaaatgggggctgtgtgctccatgaagtcatctaatgaccctctgagatactcatgggccatttatgcagtccagagcagcgattcctgcaccgtcacaccaaagaggtgggctgacctgaagtgagtccaggaaagaggggag

SEQ ID NO: 1083 - DNA, 2605 bp, Homo sapiens
cagtggtccaggaggagaacaagcaggtgctcggattcatctagggttgaggattaatggggtaatgcggcagaaaaagaggaacaaaggacctgaaggcccttgtgacaatgaatgataacttctttttcaataaaagaaaaaaaggccgggggcggtgcctcatgcatgtaatcccagcactttgggaggcccaggtgggtggatcacctgaggtcaggagttcgagaccagtgtgaccaacgtggtgaaatcctgtctctactaaatacaaaaaattagccagatgtggtggcacatgcctgtaatcccagctacttgggaggctgaggcaggagaatcatttgaacccgggaggtggaggttgcagtgagccgagattgtgccactgcacgccagcctgggcaacaagagcaaaactccatctcaaaaagaaagaaaaagagaagaatggggaaaagttaaggttgtggaagcatctaagatatgtgtgttcaaagagatttctctgttcagtatttcagagctttaggtggtgattacattaattcatgggaatgaattgttggagtgaagtggaggggaagtctgctgcagtaaaggatgtctaggaattgcaaagctagttaacaaggtatatgatgagcaatggctacttttaaatcttggctctgtcccttaacaacaaatgaatttgaacaagttgcttaaccttctcagtgtctgttttcttatttttttttttaaaaggagaaaattataactaacggtaggagcaatgtaagaagacaacatatgtaggccgggcatggtggctcatgcttgttatccaagcactttgggaggctgaggcagatggatcacttgaggtcaggagtttgagaccagcctggccaacatggtgaaaccctggctctactaaaaatacaaaaattagctgggggtggtggcgggtgcctgtaatcccagctaccccagaggccgaggcaggagaattgattgaacctggaaggtggtggttgcagtgagccaagattgcctcactgtactccagcccaggtgacagagcaagactccatctcaaaaaaaaaaaaaaaaaaaaaaaagacaacataagtaaaatatctgccacagtgggctcaataagtagaagctgctactactggattggtcaactataaggatgtcatagacacctggaattatggcagaaaagagaatagaaaggagctgggcatggttacatgcaccagtaatcccagctgctcagggggctaaggcaggaggatcaccagagcccaggagtttgatgccagccttggcaacatagtgaggccctgtctcaaaaaaaaataaataatttttttaaaagaaaaaaggatataaaggaaaagattaagctgtgtgtttaagtcctcaacaaatctgagggtgtgacttgtaagttgctaaaggagagtatcgagatttgagaaaacccagatgatgttaagtccctggcagtgccttctgggaggtattctcttctctgtcctccatatgctcatcttaagtggatattgaaacttctgcttccaaccatgatgaaataactggaaccagactttccttcctgccttaaacaactagaaaactggacaaaatataggaaacaatgatttataaacattggacaacaggtagcataggcggtcatctctgagagaagggaaacaaagtcagctcttccaagtttcccagctctccacctaaaaacaggaaaaacaaatagaacacaggtgtttccctaaactgagaattcagagtttaggaagataaaagcagctagaatttgtggggcagtgccagaaagaagggaactattaaaaagagaattatggatatttgaagagattcctccctctatttccccccagctttattgaagtataactgacaagtaaaaactgtatgtatgtaaggtgtacattgtgatgttttgatatacatatatataatgtaaaatgattaccatgatcaagctaattaacatatcgattacctcacatggttaccattttcttgtgtgtgtggtaagaacatttaagatctactctcctagcaaatgtcaagtatacaatactgtattattaactatgggaaccatactatacaattagatctccagaatttattcatcctgcataactggaactttgttctttatgaccaacatctccccatttctctccctctcagctcctggaaacatcattctacttgcagagtccccttgatttgaaggctgagtactgatctgcagtattcagcaatgaggaaactacccagggccaggggaaaaaccaccagaaaggaggaggcaggaaaaatcccttgacctcatataggactgggaatagtttgggttcccagcagccagcgtggaaagatcttatagggcattgtgtagggtcctcagaaggctattgcctcaataatgggctcaaattagccctaggctagtggctgttctgggcctgccataacaaagcttaaaaggaagcctctcacgcctctgcgctccagcctgggcgacagaggggaactccgtctcaaaataaataaa

SEQ ID NO: 1084 - DNA, 2815 bp, Homo sapiens
atctaagcatttggaagatagaatgtgtattagtctgttctcatgctgctaataaagatgtgcccaagactgggtaacttataaaggaaagaggtttaattgactcacaattccacatggctggggaggcctcacaaccatgatggaagacgaaggaagagtaaatggagtcttacatggcagcaggcaagaaagtgtgtgcagggaaactcccctttataaaaccatcagatctcgtgagacttactcactatcatgagaacagcactggaaaggcccgccctcatgattcagttacctcccaccaggttcctctcacaacatgtgagaattatgggagctacaattcaagatgagatctgggtgggggacacagccaaaccatatcagaaccattaagaatttccatctctggagctaaaaacaataagagaaaaattggactggaatatcaggttgtccttacctgactgcgtaaccttggacaagttgcttaacttctcgtagcctcagtttcttctgttgtgaagaggctatttatagcagctactttgcaaaagtcaaagattaaaagagttacagtgttaaagtgctgagcacagtgaccagcacatagtaagcactcaatcaatgtataagtaatcaatgaatgtatgagtaagcactcaatcaatcataacagctattatgattattaactctcccgatatcaatgtcttctcgttgtatgttggtactgggtatataccatagttgtctttcatggactggaagactgacagttattgagcaggaagtagcacatcactggtcagtgtgggccttgggaacctaaaacaaattatactaccttaaaactgcgctagatttggtgcccattcattttgtttgctgtttattcccctatggaatgtggaacagacatgtgcatggatgacgttggttgcagaagctggaaggttaataatcaatcagtaatcgagtattctctaagtctgtgcctatttcatcactaagcatggctccagggctaaattagctaaactacttatggaaaagagattcagaggaatgaataaaaggcaaggtgtgtcaggaaaagaaagaagatgtagggaaacaagagaaagtaaagaaagatttcttggacacggttgatcaatcactgtgtcccggtttcctggaaagaccctagagaaactcaaatgatgaatttgctaacgtggatgatcacagatgtttaggataaaccagtttcaaaaccattttatgtaaaccaatttaatattcttctgtggtagattgataagctgctctatagctaaaataagtaataaatattgcctatcttatcatcaatatgacatatgactgtattgcagcaaacttgctagcaagctaggaaaacacagtcccagaggccactgtactgtgaggtggatgcaccatgaatcacgctccgggagtagtcctggccacccagctcacaggtatctgcagtaacagtttgaaacatgttattaagagggtgtctctctctggttaatcctgcagtataagaaatgactaacgccttgcagagtaaaattagaattctgaataatcttgacaagttggagaaataattagtcataaactgatgaagtcacagtcaagtaaggtcccaatagtttatttagagagaacaccttcacaaatacatcaatggtgaatgaatgcctgaaataatacgttaagaaagaactgtgtgcccttttatggggagctatagaaggaattttcattataagctgtttaaataccacagtcttgggaagcagacagactcgagttgaatcatggttcttccacatctgagatgtgccttcttgaacaggttcttacctctgcttcccctggttttctcatctgtaaaagaggaggtaataatctctaccttgcacaaccattgcgaggatacacgtgaagaaaaacatttgtagcagacactatttgttgcctatccaacattcatttcctcctttctactggttaagaaaaacttaaaatttttataggtggctggataccctcctggatggtgaccctagcccagctcaggagtaaatcctaatcagccctagtgtactatcatgggagtcttctctccacagacttcttgatatatgaaacaatagaagttcttatgattaaaatcagaatttttattgtagttattgcccccaaattcctcactgaaagagttgtgaagtgcttgatacctaacttctactcaaaaaagagattatccataactctctattatcgtttacttttctgtagctttgggatctcctgatcacctcttttttatgaaagtttctccccttttccattagatgccattgccttctgcttttcttctcaaatcttaggttgctgtttctctgtcttggaggacagcttccctttctcagcctgtaccttgaatatgattatctattaggggtccatccttcactttcttctctcttgttgatctcagctactctctgggcttggtgactcttaaataattatctccagctcacacctctcttttcagcttctagccatcattccagtggactattggacatgcccacatgggtgtcctgtccaactcaactcatatttgtatcatttcctcactcattcccactgctcttcctgcattccatttattggggaatattaccacatctccccattgtgtcaagccagaaacctccagtcaccaattgttcctccttctcccttacaccctgcatgcaatcaacttattgccttaatattc

SEQ ID NO: 1085 - DNA, 1828 bp, Homo sapiens
aaggaagggctttcttagactgacatgtgcattgtccaggcacatgccaaccaatcttctaagggcttcatatattacctcatttcatcctcacagcagtcatatcacatcattactatcccattttacagatgcagcaattgaagaaattgaggtacagagtggttaagtgacttgtctaaaagtcacaaagcctttaggtgagggcaccaggattcaaagttaagcagcctgattccatagtctttgaatgtcaagagctgtatgcagttgattgggaagtcttcttataagaatttgtgacaatcatctccctctctgagctccagcagaacttgtttttacacttatcacaatagttatctgcagagctgtttgttttccccctggagggtccctagagggcagagtctataatctagttatcttttatcgcagcattcagcatagagcccaaagtctaataggtcctctctctctctttcaatacatatacacacacgtgatgtggttccagccatccttacctacccaggtgtcctgcatatttccacaaattggtctttcctgcttcccaagcttctggaatttttctctctgcagtgctatctgggagaactgctgctgggagtgtgtggggtggccccgagagggctgggacccactgtcatgctagccattggcccagtttattgtttgggtaacaaatttcctgcctacccactttgcagcctctctcactgatagctccaggattgtaggtctcccccctaaccccagtttctcttgattacagctgcctgtcacattgtttcttattattgaccttggtacctgtcagaccatccacactccccaattgtctttccctgccacatgtccatcttcactgagaaactggtttcctggattacacaggccctatttgtctctcataggtgcacctgcttctcagaaatggagtgatctttggccttctttgtccttggacttgatgaggtggttggctgtgagctaggtcataggtactcctctccaggggtctccatcagggagattctagagaagggtcattgcctggtgaacaggtcacctgctttggagacacaatgcctatctgtctctcgtgccacttccattctcgggctttatgagcttgagcaagtcgtgtgactgctccaagtttcaattttcagatctgtgaagtgaggactatttatagtgagaatgaaatatatgcaatagcatttcataagctacaaagtggcacataattgatgggaaggtatcagtattgttaatacatcaaatataaagaagcacctggtgttcatttcctcatgggccagaggttcattatgggccatccagctgtggggtcttctttcctcctccatcttcctcagcctcagccttagcaggggtgcaagtgggagggtgggtcatcactgggtgctaaattaattgttgaactgagcagaattgaggatgcttgggtgactctgagtgacaaatcccatggtggcatttgtggtgcatcttcttgacccagggtatagatgagtacaattgcttcatgcagatgatcagtgactcccagggaatggtcaaccctgctttccagagtggggctgactaggatgtgaatcgagatctcaatcccctaggatccatgaggattcctaaaatatttcttggtttttcctgtgttgtgtggtccctgaaactagaccctaagaaaccagaggggattcaggggttggaacaatccacctggatacagcagctggacctgaagcttcagaggcaagcatcacagtccaaggtc

SEQ ID NO: 1086 - DNA, 2010 bp, Homo sapiens
ctgggagttcaaacctgagaaatctgattttttgtttttgagatgaagtctcactctattgcccaggctggagtgcagtagcacagtctcagctcactgcaacctccacctcctgggttcaagcgattcccctgcctcagcctcctgagtagctgtgattacaggtgcacaccaccacactcagctcatgttttgtattttcggtagagatggggtttcaccatgttgcccaggctggtctcagactcctgaccccaggtgatccacccagctcggcctcccaaagtgctggaattacaggtgtaagccactgcgcccagccagaaatctgatttttaaaattgttttctataaattcatgagatgattctgattactatactgattacatctgttcctttcatctctgataatttttgacatctctgataataatattttagctatttgttatttagtttatgtatgtattttttgcagttagcatctttttgggggacttatgcactgggttcctgaaaattacattgcatttctcacaattttcagatgtttgtgggaggagtataaatccttgtttgtgaaactaatccccaagagcattttctagtgcaagctaatagccatttagtattttgattaaaaaattaaagatgcaggccaggcgcagtggctcacgcctgtaatcccagcactttgggaggctgaggtgggcggatcacgaggtcaggtgatcgagaccatcctgcctaagacactgaaaccccatctctactaaaaatacaaaaaaaaaaaaattatctgggcatggtggcgggcgcctgtagtcccagctactcgggaggctgaggcacgagaatggcgtgaacccggaggcggagcttgcagtgagccaagatcgcgccactgcactccagcctgggtgacagagtgagactctgtctcaaaaaaaaacaaaaacaaaaacaaagaattaaagatgcgtaactaaatattaagtgcttaactttagaggtcactcttgaatgatatatgcaaatgctctgtgttgtggacagtctgtgattcatgtgtcattgtttaaataatggatatttggaacacacaaccaatatcctagttttcctgcagttagactctttaagtaaacatattcctagttgtgggtgttatggagttagatggaggaagtgggctagagatcctactatttagtatgtagacatattttcaatctgtgtttctcatctctgccttctgctgagtctggagtggtatccctgagtccttcctccatcctttaattaactgcaggctcctggatatagtatagcgaggatggaggtggtagaggtgggagttgagtggacctgttaactacttcttcggccagtcctcctatatttagccatgtccccttaactctaccttctcaagtacctgatacttccacttcctcaacacttctggggtttaggggctagaatggtttgcttcctgttggtatccctttttgtgtttcaggttttccattttgtgtgctgtcagtttactctctctctgctgtcttctaaaaatttgttaaaacctcttatctgctgctgtcaccttcccattatttttattcttagagttttatacttaaaaaaaaattcctcgattgtcattttagtggggttttgggaaggaaagaagatgtatatagtcagtctgtcattttttactggaatatttaccgccgtccccccaacttttttttttctttcttagagatgggttttgctttgttgccctggctggaatgcagtggcacgatcatagcttactgcagtcttgaactcctgagctgtagggatcctcctgcctcagcttcctgagtagctgagactacaggtgcacagcactatgcctggctccccacacaattttgattgaacagagttattcgatcacctgtattagtactgtcactagctaaatttctcaaatgaaaagtacacatttgttgtc

SEQ ID NO: 1087 - DNA, 2617 bp, Homo sapiens
tgaagtctccttttttggcttgcagatggctgccttctcactatgtcctcacgtggctgcaaaagagagggagcgagggagggaagaaggttggggagaaagagagagaatgagaaacagcgagtgagcaagagctctctggtgtcttttcttaaaagggcaccaatcctgtcatgaggactccaccgtcatgactttatctgaacctgattatctcccaaagatcacatctttaaaaatcatcacattgggcattagggcttcaatacatgaattttggggggacacaattcagcccatagcgtacattcatcagaaatatctcattacttactttttcaactggtgttagccactcttctaagatgtgctttagtatctaaacgacaaaactctcactttctactctgttagggctgctcagtttgaatgttactgcaggcaatagggagccctgacgtaaaggtttttgagcagggagttgacatgatgaaatggcgatttaggtgttggaggtggagagaactatgtatgggagggtgacagggacagcaagctatttcatggtcattatgataaccagttgatgaactctttcagggttaagggtcagcaaaatttgtcctaagtcacttgcttagctggttgtgcctaaccttatcatcaatctcttcaccagaaccctggacagcttcaacagtgaggctgactcacatgctgaaatgtattcattcatttttttatcgcatttatttaactgttttatcttgctttttaaagaaatacaaaataagtaaagactactgctccagcccttgggaaggcaagacaaatataagttgaaaaataatcataataattcactattttggtaatttttcaccactgaaaagtgaccttcagtaaaaaagataagcaacgtactctctcgaagattgtttatatgttatctggaaaaaaggatagtcaatgtgggatggtattaggtagagaagactttacagaagaggttttttgagtgttgtcttgaaagataggctgagtggagcctgctcaagaagacgtgtaagatcttttggactacagaaacctctcgggcaatatcataggtgttcaggctaacccaaacagggtggaagttcgactttgggagctattatgggataaagggaggacccccaataataaatgtctttaagcctgggtgggggcatgtggatttgctgctgcaattgaagagggagctgtaggaggttcttctgcagcaaagtgacagaaatttttgctctgttttctattcctctcctccactttcatgtgagcttattttaaaatttgtttttgatagtgatacaatttttaaatcagttttatgcttacattttatttttctaacaagctatatagttgatcctctccacaaaaacctgtaataatattttaggactataaccactgagttaacatgttaaactagtaattgaacatcttttctctcccagacataatttgagacactgagagagatacaaagttttagcatttgttcattcactcattcagtcaatatcttaggatgcttaataggacatggtccatgccttccatgtcttaaagtctagtgaccacacaggactgaaataaatgactgattgaatgcaggtttcctctcctgtccttttgttaccagagaagttcactcatcctgcagggcctctccccagggcattctgattggcttagtggtacaagaagggaggatgcaggatggaaatcaggaacagtgttggggtcctctggggctgctgcagcctttattctcatatcacagaattccacgttgacattctcaacatctttccatggagatttcttggtcagaaacagtgtttcttttcttagatttttgagacagtcatttgaatctataattggggctcaagtagaaaggatgaaaagatcgtgaaagatgtcactttcttacatagtttctgggataatgcccagctgtgtgaggcaggtataataaatgaaaatcaactatttcatcagtaggtgggaagccctttcagcaaaaagtttttagtctacagtaagcacatgccatgccacgtgaccacacatagagttgaatgcagccttagactgtgttaataaaagtatagtgtctaagtatcagaaatgaagaatttctgttttactttacattggtcagtttatgtctagagtcttctattcatcttttattcatctgtagagatcaggttttaagagagatgtagacaaattgatatcttaaagcactaagagataaaatgggaaaatgaaagatttgaaaccaagcgatatctgaaatggccgaaggaagtctgtatgttgctgtcacagaagtgaggactcaaaaaggacttgagaactgtatttattagattggatctgggcagaccccagagttataattaagagcaactcaaggaagtatcagggaaatacaagtgaaggaacagttttcaacaatgagaacagtttcaagatggaatagcttgtctgttggggcagtgagctctccatcactgggtaaatttgatgaacatttggggaaaatgttgtggaagga

SEQ ID NO: 1088 - DNA, 1188 bp, Homo sapiens
aagggaatattattatcctgttcaaaactcatattgattctctacagcctacgagattaagaacaaaccctgtccaatattcaagaccttccttggtccagtcctggattcccttctcagctacctttcccatgatgctgcatctctcgctagtcactgaacatgatctgcacttgctgacctttatgcttttctcatacctttctctctacttgcaccagtctctctaaattttgcctaaatcttatctaccagtttagtctcagaatgtgggaattctatataaatcaaatttcaggaatagttatgggtaatagtgtttcattccatcaatgtaacttatcatttgctgtgggcgaaactccagtttaagaatgtttcttaatgttatcaaaccatctgtgtataacttgatggatttctacaaggtacacatgctcatataactatctcccagatcgagaaatagagttttagaaatacccaagaagcctcccttgtgcccctttctaatctgtacccccttcttcaaaggtaggtgttgtagtgatatatcataggttggcttttgtatttttaaaaattttatataaatggaatcatacaacatatattcttttgtgtatggatgattttgactagtgtttatgatatgtattcatatttttacatatagcagttcattatttatcatggcttcatagcattcagtcacataaaaatactactaccattttatagtgttaacaggcattttggttgtttccaatttggagttataatgaacaatgtgatatgaacatttttatattgatatttttgtctacatgtgtacatgtttttgtgagctatatataggagtgaaattgctaggcatagggtatgcctaatttaaatttagtgaatactgctagttttccaaagtggttgtatctgtttacacccccacagaatatagaatttcaagtgttttctgtcttcaccaacactcattattgtatgtctttttcattacagtcattttagcagatgtacagtggtgctttattatggttttttcattttctggatgactaatgattttgagctccttttcatgtttactggatatttagtattctcttctgtgaactgcctattcaaattccttgccccttttgctattgggttaagactgtatagctttta

SEQ ID NO: 1089 - DNA, 4210 bp, Homo sapiens
ctgtgtctataataggattaaaatggtataaaaatgtcatgcatatggacaaagattgaaatgaaatttgaagactgattgggaagagatgctgttggagatgaatttttccatttaattttgattttcaatgttttcatgtttgtaaaataagaacagtttttgcagaagagctctggagagatgtctctcaaggtggaaattatccctgctgtttgagctctaaagagggcaaaacccttgaacagtgttagcctctgatgctactggtggttaattctgttctctggggcagggcaggcaaactatggcccataggccacatccagcctgcgagacaaaaatggtttttacacatttaaatggttgggagaaaatgaaagaagactattttgtgacatgtgaaaaacagcatgaaattcaaatttcagtgtccataaataaagttttattggaactcagccatactcattcatttacttttatctatggccgctttcaagcttacaatggcagagttgaagcgcagtgagaccatatggaatggaaggcctaaaatatttactgtggcccttcccagaggaagtttgccaaggcctgctctcggacatcagttcagtatggccaagagaacgtggtcgtctgcattatctctccatgtctttatcctcactcctgctcacctccttgtggggaaagaacatcattgaagtcatccaagtgccagcctcagataaagcttgaaaagtacgtggcttaaagcttctaggccaggcgcggtggctcacgcctgtaatcccagcactttgggaggccgaggcaggcggatcacgaggtcaagagatcgagaccatcctggctaacacgatgaaatcctgtctctactaaaaatacaaaaaaatttagatgggcatggtggcaggcgcctgtagtcccaggtactcgggaggctgaggcaggagaatggcgtgaacctgggaggcggagcttgtagtgagccgagatcgcccactgcactccagcctgagcaacagagcgagactctgactcaaaaaaaaaaaaaaaaaggcttctaaaatatcctccttactgttggtgaaatggggattcgggtataataaacacttcatgggggtttcgaagctgtttagttaatacttactctctcttggaaatgaaaagcccaatatccggggattgttgtcactgctgttattatcacggtgatcattcctatatatggtcaaagaaacagtcagaggctgtcacactccactgctcattacaaacgagacctttttccagctgaaacaataacacgtgagtctaattagaataaagctcattagagacggagaaagccattaatgcctcgattgatttttctaatgaagtaatccaggggaggagactttaacagcacagctaattattttttgcttttcttcagtatgtctttggcatttaaaactgttcttatgacttgttgtttgactataaacgaaaatgctgctgaaaagtgctctgtgattaaagaggctctgacacatccagccctgagaaagggatggaaggcacctgcttcctacaggaggagggccctgcagccctgcaggcggtggtttaagcccagcagcccctggggatagccttcctttcacttttccagcctcctcttcctgtgtattctggattctagctagtcgtgcacagatgctcaagctgcagaacgtggttatctgctcctgcagtcctggttcaaggacagagctgaaacatacagattcttatggaaacttggatctgaggttgcctctggatggtaaaacatggaggaaggggttaggggataaagggtgttaggtggacagaggagggagatgcctattaaatttatgcaccagaatgcaggtggggcaattgtgcttcattaatcaggatgctgtttgccactcagaaagcagttaagtcccacagtacaggataaaggctgtcaaggaaggataacaataagtcaagaaactgagactcaggatataatagacttgggagactcagaacagagaggatgggaggaggatgtggagtaaaaaactgcatattggtacaatatacactgcttgggtgatgggtgcactaaaatctcagaattcaccactgtgtcatttatcatgtaaccaaaaaccacttgtaccccaaaagctactgaaataaaaaaatttataattttttaaaagccttactgaatgaggaaattattcaacaaaaggcattatctcagtgactgtgttattagaaatatagtttagtgataatgcacagtccagcaactaacagagattcccagtgtcatccagacaggtaaaggagcggaggaaaaattcttcaggtgatccttcagctagtcaccaagccaacaagagcctgctttatcacaagcataacagcttacacttccagacagaaagaagcctcattaaaatgaacttctgtcatgagcctttattacaaaacttcatgtttgctttgtacaaacccaagagtcttgaccggacttgtttgctgactccattgccctacccatgaggttctttaactcagaactttatgatgaaagcaaaagacagagtttaagatgcctggctgaggccgggtgtggtgactcacacctgtaatcccagcactttgggaggccaaagcaggtggatcagctgaggtcaggagtttgagactagcctggccaacatgatgaaaccttgtctctgctaaaaatacaaaaattagccaggcgtggtggtgcatgctactcgggaggcgaaggttgcagtgagccaagattgtgccactgcactccagcctgggcaacagagccaggctccatctcaaaaaacaaaaaaaagcccactgaacattatggaaagagaactggacctgattccacatgtgatttatgtgggtattagtagtcccctttatccactgtttcagttacccagagtcaacaagaagaagggtgagtatagtacactaagatattttgagagagagagaacacattcacataacttttattatagtatattattagaattgttctattattagttgttactgttgttactctcttgctgtgcctaattctttttccttttccttcctttttttttcttttgagacagagtttcactctgtcacccagtctggtgtgcagtggcacgatcttgactcactgcaacctccacctcctgagttcaagtgatctgcagtctcagcctcccgagtagctgggattacaggcgcacgccaccacgcccagctaatttttgtatttttagtagagatggggtttcaccatgttggtcaggctggtctcgaactcttgacctcaagtgatccacccacctcggcctcccaaagtgctgggcttacaggtgtgagcctaatttatatagttaggtacgtatgtgtaggaaaaatatagtatatgtagagttcagtactctctgaggtttcaggcatccactggtgattttggaacaaatcccccatggataagcagagacaactgtacttaaataaatacaaataatgaataatggacagtgggattctagtatcaactttggttgcctctctttgcagtcctgttgcccctctcctaagttccaagctattcatgtaacagggcctatgccctattctgtgtgcatagttttgctcaaaacttattatcagttgtgttgtttaaaaaggctgcatcttccattatgatgtgcaaaacgttgatggttttcttcccttactaaagtaccaggacactttctgtgtaataccatttaacagcctccaccctgctacccccacaccccagcactgcttccctccaaagccagagtgttcacaacccttggatatgggccacacgaggactccattaggtacccaaaatacaaagatggacaagaaacatgttttccccctcagtaagggaggcaaacattttgcctaaaattctatacaacatgatggtgcgatggaaggaccactgagaagggaagagactgtttctccctagggcaactacagggaaatcccagctacttgggaggctgaggaaggaaaattgcttgaacctgggaggtggaggttgcagtgagctgagatcatgccactgcactccagcctgggtggcagagcaagactctctctg

SEQ ID NO: 1090 - DNA, 1673 bp, Homo sapiens
attggcctatcaaaggttccaactatggagaatcatggaatcttgccctgtttactaactgcccttcctgttctctccttgtaaatttgctttatggcatagttttcatgcagcagaagttggcgaggcaccctctcaaaaattttattatcatgtgtagtattcaataaattataaagagatgtttttctccacaactctttatctatgccactattcctattcatcttgcctgcaattaattttcagctgctgttgctcttagtggtggtattctaagtatctagtggaaaagaaactattcctgtgaggattatataagattaaaatgttatagtctatctttaaaacgtttgatttccttattaaattatttttgcattttttatgttaaagaataattatattttaatttaatcttatttaatattattgttaaaatgtagtaaaatatagtttctgatttaaggtcatagaacagtatctaatatcctctatggaacttatctcctacctgtctcatgagagagagatgaaagatgacttatcttgaataaattataattttcaatttgatcttttacaagtgattaaaactataaagaaattactatgatttatatttagtcagacaaaaacactagatacaaattatggatgattaaaaagaagtaacaatttaattaagacatccatagaatgcttgtttttacaagccagaattattagaggcaatgcatatttattaatttattcctttgacaaatattcataaagtaccataatttgctaaaatctgattgttgtaggtttttagaatattttcaagagagatgatccctggcttctcgaagccaatattctaattgaggattttggaaacaaacagaaaatatataataagatttgagaaagtcatagattctaaggggagaaatgagtcacggtaaggaaataaaaagtcatatggtgtagaggtgggagatttctattttagaaaagggactcagagaacacttagcctgacatttgaggagagacttggataaagtgagagtgacatgtttagacagtctgaggaaagaggcctcctgtctgagaaagcagcaagtaaaagtgtcctgaagatgctctgagtttggtattatgaggaaataacaggaaaacaagttgtggctaggtggcagtgagccagacataatatgtcagattaggtcctagatgaggaggggtcagaacaggtaaggccttatagatggtggtaaagcattggtctgtgctgagagagatggggagccacaggggggcttgagcaggtgaaggacatgacctggtttatactttgaaagcatctccctggttactgtggggtgtcgggggcaggtggggaaggtattgactattgtgggagaagaatagaagtcaaattacaattaggaagtttttgccttagtcctaggacatgaaggcacttagattaggtttgaggtggtggtggtggtagtaagaattgagcagattcagaatatattttaaagggagaacctataggacttacttaccaatgttttggatgtggagtataacgggaaataagtcagggaagactcctaggtttaaggtttaagcagttggacagatgatggtgccatttactgagatgaggaagctag

SEQ ID NO: 1091 - DNA, 1164 bp, Homo sapiens
gggataggattagaaggtacaccctggaatgtggtttgctcccagtaatttgaaacatttaaagaatggttagatgatcacttgacagttatgctataaatgggaattagaaagcatgagttaaagatcattactttgagtagatacattttaatgtcattttcaatctttagaatcttttgttttatttgggaaaaaaaacaaaaccctaaatcctgaaacgatcactgcaaaaaaggattatagtctgttactttttaaattgataaacatggagatgtattccaatgagtgttaaacttactgttgtattttaaaaatttgctttcatataatggttaagttttgaaagattacatttcgtgagaaaatactttatgaattttaatgaggtatgtttatttaaatctaattttctattctgttttgggaaatagttgtgtgtgtctttaagataagaccgtcagcaaataaggccacagcaaaacagagattttgctaattttttaagcctttgttaatttctggctgacaagagaggtagtttaattagttagctactaatatctgtttaaatgagcagccagggaactgtccatcacaataaggatatgcaaagcccaggccattctctttgactcttttcaactatttcaaaagagaaaagaataggtagattccacctatgtgtaaatgaagggagaatactcaaaaagtaatcacacacacgtaaatacgtaacatactttcgagacaaattaagaaaattggatttaaataaaacaagtaaggtacttacgtgtgtgtgtgtgattacgtgtgtgtgtgtattttcttcaaatgtgtgtggttactttgtgtgtattttcttcatgcctgtgcgtgtgtgtgtgtattttcttcaaatgtgtgtggttactttgtgtgtattttcttcatgcctgtgcgtgtgtgtgtgtgtgtgtgtgtgtgtgtaattttgggtttgaggtataggtgccttaacaataaaatagtgaaatactttcaaatattgtggaagtctctgtatctttttttttttttttttttttggcgacggagtttcgcttttgttgcccaaggctggagtgcaatggcacaatctcggctcgctgcaaactctgcctcccgggttcaagtgat

SEQ ID NO: 1092 - DNA, 2507 bp, Homo sapiens
ttctattcatattcatatttgcatactattcaaataacaatatgaatagtattctattcatattcatattcgaatagaatactattcatatttgtatagaatactattcaaattgttattctggaaaactggtctgggacttcaaacatgccaatgtcatatgtcttgtcatcctgctagcctgcatgcctgctggcctattcatagcatagatattttatggtaaggggtgatatttgaattgatactatactccctcaagttgcatcatatctccctcttcaaacgtcttttagttttttaaatacactattatggactgagttaggtcccctcaaaattcacatgttgaagttataaaactcagaatgtgaatgcatttagaaatagagtctgtaaagcgatgataattaaaaataaataagcaaagtgggccctaatatgactaatgtccaatcagaagagaaaattagggcataaacatgtatagagggaggaccatgtgaatacacaaggtgaagacaaggagagaggcctcttaagaaatcaaccttgctaacaccctcatctaaggcttctagcctccagaattgtgagaaaataaatttctattgtgtaagccatccagtctgtggtatactttgttacagcagccctatcaagcaaacacatgcactcagtgctttaatctaatgaatgacttggtagttacacgtgtatagatactaatgttataattaccatatgcctagtgatcctgctggcctgccatcccactgagagcagcaactatggacctagaattccccacatctgggtttcatttcccacagagctcatcaggatcctgtgcactcagtaaacaataatttgatggtccttgatggatgactaaatttaaattaccttaggaaaaaaatcaatcctataattaattgccccattgtttataagaattcatccatgacacatgtttttaatttaccccttaccctctgagtgtcatgtaactctccagagattttctcttcctctctataaaactacttcttaaaagtttttaattcttaaggaaatttttagaatttaagaaagaaaaaaaaaaatccagtttactaagtgcctattctttcttcaaaacagttttctctattttctaaaaatatgtcaagttgacttaaaataatcataataaaaatgacaaaaattaagacaataaagaatatcatgttatttcaagtaaatgtagtatttatttgtattagtttgtacataaatttccagagaaatcaaggctttatagctgcactcggtttgcattgatacttacctctgcttttagtgtaggagacattttccagtggtaaacactgctttatatcttcaggctcattaatccccagcatcagtgtgcctcatcacagatgagaaaatgcaggaggttcctgtttggggccttgctgtcatggtttcttgttgctagcaacacacagaagcatgaccagctgctgctgctgctgctgttcctgttagtctgctaactaaatatgggtgaatttttctatgagtcagtatttctacactgtcaataacaatgtgtgtgtgtgtttcaattaaggcctgattgttaagtcactaaggatcgactgaatccaattctaacatgaataatcttcaaaatttggcttatggtgtgccatagatgtccagctaaactgaatataatcctcaggcatgaattatgttaagaaaattactgctgattgaagctatcgttcatggattaactcacacttaataaaaagctatgttcctttgatatcttttcaggtttagtccagatttggcgggagtaggtagagggatgttctgtggtcttgtaaaattgggaagcattaagaaatacaaaattaaacatattccaataatacataaagttttagagactaattaatgtcaatttgtatcatgactctcctaaaagggaatagagaattttataattctaacactcatttggagtaacttatggcaactacagaaaatatggtttaagacacacaggagttccatatgtatttgcaagtaatttgagatgcagtatcatatgatgcagagttagaggcagaagacctgaattcttctcttacctctgtcaagaattagctgtgtgaacttgggaaggcctggggaaagtcatttttatcccatgtctcatttttaaatttgtaaaatggagataaacttataaggctattgtgaaaattaaattaataaatgcatagtgaaattactgtgtaaaatgaaaatcactatatgaatatgagttgatattccatttataagatgccgcttacatttccttcaggatttatagtacttgctgtctctgattaaaagttgtcctactctctggctctaaaatactgcaaaatgaagcaatcttctatctgatatagtcatctaattacaagtccaggtcaagcaaaataagacaatgtttgaaa

SEQ ID NO: 1093 - DNA, 1427 bp, Homo sapiens
tagaattgaaccatgcctctagaggcagtagtggttactattctctaattctccaaaatcatttcaaaaaaaaatttggcaaaatatgctcatatcttgtcataactatttgtgaccatagttgcaacactcaaattaaaatgagaatgggacattgccacttgatttaaatgtctgtgcatttacttaaacctgcacatccacataattttaatggtaagcaaaataaatttataattggagaaggcctgtagttgaataatactattcagtccattccaaagtcagtaaattatctttattttgtatgaccacccttgaccactactagaaggaatgttggctgcttctttgtattctgtttgagctttccagtccggggcactgggctcagttctggggataaaatgatgagagtacatggtctcttcccaagggaaaatgaaagaacaagaggaaaatgatgcgcaaagtgtaagacaatatgataactgtcacagtggagccataaaaaggcaccattagataaatcaataaagaggaacttttgtgctgtttatgccagatagaagttagtggaaattataagaacccaaacagcttgataaattcacattttgaagtacaaatcaacgttactactgaaacttttacaaggatctcatgacctgtgtgcttacccttgaaccatcctgttctaaccagccaagtgaaattggaaacaattgatatgtctttcacgtgaacatttcatttctatttatcaaactatactcatgataatacccttaacaagtttccaaaccatctcatccaagtccaattttcatttctaactttccctcaccaactccaattagcatgtactccaactcagaggaacaccctccctggtctctggaacgctacattgttgcctctgaggctgggattttattctacttcacccatctgctctctgtatggaaagaactgagtgcagcaggggatcctatgaagtcctggcttcaaacctcgggcaaaaatatcgggtttcttaacaataaacaccccgatgagagccacctggcaaagtgactgcacacagggctttcgttctcaagttcatccgcttcaagcacaatgttgctaaaaatgaagcgttcacttttccttaaaagtcaaatcctgtcactttacctaaatccaactaaaatagccatagagggccaagcatatatcattcaaagcttcatatagtcatgaaggaattaggcaatggtacagtcaatatctcctgctggaagagaaattttcaatagaattttttcatttgctgacttcacatttcaggagcattgttcctagaaatgcacttttttttcttacttacaatttcaaatttgagaatataaatcctaggactctcaaacagatatttgatatgc

SEQ ID NO: 1094 - DNA, 3641 bp, Homo sapiens
agcattccctcttgtccacctaacttcaagagaagagtcacatggaaataatcaatgggcctcgtatgtgtccctacagttaaatggggttggagtacctgcagtgggctgatgtcttattgccattctggaaatctagaaaacaaaagataagctggcagctgcattggtggtaaaacaaagaagggtttcttctatgttgacatgctcaaagtttgactgatcaaaggataccaaacagagtcagaattaggagatttaaaatgctttttaaaatagttcacctaaatggcactaagaccttaacaaagagaatctggaagtagactgttgatttttaaggactgaagaagaacaaagtcagatagagaagcatatatccagattaaggaaattccagatgagagactatctatgatgagaagtttccaaagagcatacaaaagagtctcatgatagagacagacagacgtaaacatctctcaggccaacatctctcatctcctgtaacagtgcctgtaagctaaaaacttctccactcctcttatgtctccttacatccataccacctcccatattccatagtccagtttaacctgggagggtcagatagaaaaagagaagaaaccaaccacatcatctttccccaaggcaggaatctcatctgcaacatgccactagcagaaaagaaagtgaaagagtaaaatgtgaccttttgatgaagctgaagtcttttgttattaatatacaggaatggacatttttaatttccaaactgagtctgtgtttgcaattttaagtaaacatagattttttctttcctgaaactgaccagaaaagtcaagctgtttatcctagtttgtatccatggaaaggcagagccactaccactgagcaagtgtgaaagaacagtagaagataaatataaaagtgctttatgatcaaatcccatgaggcctgactattcatagttacagcaacatctataatgctgtgagtaaataacgcttttgaagaaataagagacattttgtacttttgataggttcacgatatttgaagtatgttaggctactatagcaaagaaaccttcaaaatgtataatacaaatgcacacacaaaattatttcttgctggttggatgaacagttggcaattattcaaggacccagactaatggaggctatgccattgtcaagatgtgggtgttattctttatatattctcatttctgccaccttgaaaacacaatgaagaagacatgcatgggaattttcagaggccaagcctggaagtggcacacgtcattgctgtgtcaccctccactggcaggacttctatcacataaatgcacctaccaacaagagaggctagacccacagtctttcttcccaggaagtagaaagcatagacttcagtgagaacctagcagtttctgctgcatggagcattataaaactgtaattatatgttgcactgatgctctctggcctcatcaacccatggatataaatgagattacattaatatttatgtccaaatttgcaaagacatgtatatcaactgattgaccatagaccctcaatgccccctgtaaaagcctgtgcagtttgtttgtgggagctccagcaaggtatttaatgagctcaaaaataattccattaatgttattctattatgacttccttatagcaacaacaaaaataacaccaataatagcaaacactttctgagacctttccacctgctagtcactactttaagcctttacatatatttgttaatttaatctttaaatattagacccatttttcagatgaggaaatcaaggcacagagaggtcaagtaacttactgaaggttgaggagctggtgagtggcagcgcaggatacaaatccactcagtccagctctagaactccctgctgggtctctatattctctctcctcccacacctgggtcaccaatatactctaaaaaaacaataatgtctatgataagggtgttgtcttggtctgctatcgtaacaaaataccattgcctgggtgccttaaactgaaatttattttctcacagttttggaggataggaagttcaagatcaaggttctgataggatttgctttctactgagggccctcttcctggtttgcagacagctgccttctcactgtgccctcgcatggcagagagaacaagatctccgaggtctcttcctttcatgaagataccagctccatcagatgagggccccacctcatgacctgacataaccttaatcacttcctgaaaggccctgtctccaattcagtcacatggagggcttaaggcttcaacctgcaaattagggggagacacaattcactccataacatgtattatcttctagtcctccccacaccataaatcctagaggtacctgaactccagaaataggaagaaagcccctctcctaaattcagctctctcctttacctactagatcctgagcaacaatattcatgcttggaatttcataaagcttcccaagaaaactatcctgcagctctctctatcatgaagatcaattccagctctttctctcagtatagcacaggaaaagaaagcttccctttcactttccccatgttttcccaagtgttcatgtacaaaattccttcctttcctttatctcccaaatagagaccgtatccacactccacaaatattaactcatgcacacaggctgaaggagagctttccagacgacccccacagtctgatgttcagtgtggttaggctggttccttccgttaccagagatcctggaggatgcttccttcacatatagtcaagttgacctgtcagagtgggtggagttgggcacacagcttgtcagtcatccctgtgttgtaaataagctgaacgcaggattcatccctccaagaggaaatgaggatatactaactgggtgacccaaaacagaaagagacaggctatctcagaccatcaaatgaagctgtcatgatgcagacaggcttcagggaaaatggtgcgtgttatctaggccgtgttgccattatgtatgacagctgcatgtcctgaattttctaggtcagtcccgatttcaaatattctatcaccttgtcagaccatgtattccgaatttgcatttggaaaatgtggccactaaatccttgggacactggatcagcatattagtttaggggggtagaatcagcctgaatagtattgatgaatatgttttagaaaaatcaatctttcctcaggggcaaaattagagcttataaactgaagtcaccagacctctagaaggaggaaaataatgactctaaagccagtatgagagtttctgcggccctgggaggcatgtgtgaaaccaaatagggtaggactctcttcttcggctgatggggcagagaaactctgagggagagtggcctcagtgcctgcgtgtgggtacccccttacctccaagagcctccccctgacaagacagaatgacctgagatgctgggcaaggaattggccttagatgcaggtattgggagagaaacctaaggctccattattaatgtagaattgcactaacaaaatctaagacagatcagaaatgtgaacacaccatgatttagtatccat

SEQ ID NO: 1095 - DNA, 1557 bp, Homo sapiens
tttggagaactcccctaaaactgctgtcacctataataatacagcatgccaacttagcattcacattctgagatgaattagcaggaataaggaaagtctttattaggatacctatcataataccagctttacctctcctgctttccttacctctgcaggctaagtagacatctgagaagggataaattccctctggatatgtgtaagttccctgcccatgacataaattttcttcaaatgggactacagaggcaggggaatgagagttgaggttgatctaatcaattcagcctaaattacaggttcttctcactatatatcagcaagttttatcaatggataaaaataggtattgctacaatgtgtatacatgatgttatgatgatgcacatcagaaggagttttggcataagtgaagcaagacagaagatcaactgcaggagagtaacgggtaagagccacagcacataatcaagcaggcaccaaagaaagatcacatatttacagcaaagtgtaagaacatggtcgcatgggtatttaagaaaacacgagtatagccaggacaagaaccaactcagctcaaaagtaacccagtgctgaagaacaaccaggtgaatagggttggaactacagcgactgaatagacactgggagactctgctgtactctagcaatctttgctttgctcgcttgtttagtgttcaattctgtatcttgagcacaataaaaaactgagaacaatggctagtctaatatttgcactgttctgctaatatatttgggtagataaaatacatctttagatttctaactctgtatttaatcatcaacactaagtattattaaacttccataattgaaaataatctctattattagagtgaccatgcatcctactttgcttggaatactcctagtttatatctattatcccagatccagcacagtttaacattcatcctagaattttcatttttttggcaaagcctgaaaatatactaagatgagtttggtaattcccactttgtatgtctagcttctgctagggtcttgtctcatagtacgtagtggacagtgttctgattaacacatggtttaatctgacagatgataagtggtagcttaacttatttttcctttccctttcaagacacgtggtgccaacaccttcttttcaaggacagcatacactccctgataaaaaaggaggcttgtaataggtggcgaaggaccactaactcccctgatctcaggcagcaatgggagaagtattcactgttgctgccccttctggccacttggtgtatcagcagctagctgtgctgtgaccaggacaatgcccaaagccacagcctgtgagttccagaagtcatcaagccactgctcagtaggatagtaggaattgtcagaaatcttacttttggaatatgtaaactatgtacaagcaatatagaccttactgtcataacatagaccacagagagagtcgtttgaacactttttttcaggggtgtggtatttatagtatgtatgatctaaatctacaattatgtatgt

SEQ ID NO: 1096 - DNA, 1640 bp, Homo sapiens
cagggccacaagtgccctgtgctgtctgatgccctccatgcccctgctagggtctgtggaatgactcacttaattctctccttatggcagccctttctgcctaggagtcaggcaggtgcccttagcaccatctgggtttctctgctcctctctcatggacccagatttgtgcagctctaccctttgctccttcaggtgaactctcctgggggactcatgagaaaggccccttagggggccccatggcccatttggccatgattctccaaatatgctcaggggtgtctggatccaaagtaaataaagttgaggttcaagttgagacactgtcaccctttaaaatggacatagatgggacaatagaacatcacccaccagctctgaaaggaagttcacagatatttccttagctaagcacagaaacatggggacactttcctagccccctctgaatcacatcttcaacgtgaacatttgtcattccagggaagaaacaggaatattcaaaaagagaaactggaaagtgagacctagagtatagtctcagttgtaccattaatgagtctgagaaagtcatttcctctccctggcctcaatttccttttatgtcaaatgagagtagtactctaaactgggggtcagcaaactttctgagtaaaaggccagatagtaaatgcgtagtctctattagtaatacagtttctgtcacaactactcaattctgcagttgtagtacaaaagcagccataggcaatgtgtggccgtgttccaataaaactttatttacaaaaacaggcagtgggctgggtttgacccacaggccatattttgccaaccctaggtgtagatgatcttcagcatctttttaaataacaataattcctttaggtgagaagtggattttttgatactacacatacaattcatttaaatgtaagacccccaatataataactccaaccatttttttgttgctttggataacatgttttcttctctccttcagtgataaatcaaacctcaacagaatttatttagaggctagaataacaggtcaggtgatgctctcactgaggaatttgacaatatacatgactaatcctagacctcaaagtgttcacaatgtaatgaaagagacatacacataaaggcataattataaagcattacagtaattgctataatcatgctattatccattatcaagacttaagttctactacatccaaatttgagatgctagagcagaccaagttcaaggacattgcaatataatacatgtaggatatgcagaaaattggtgggccatctgaaatgcattcttgtgaaaattgagggtgtgagttttcagggaagtcttgactcagaataggactggtccacagagcaaggctgtgtcagattacacttgagacctaaagagtggccatctgtgataaaagtcagacctttgttcaactacaaagaagtaaggcgtagttatgatacagaacatgtgaagagaactttttgttctggaaggtgcacatgacattccatttgaatgagaaacatcagagagaggcgtgctttcactctcacaaggcacgatccccagctgcacaaagctttgtatttcttgttatatttcctttttcagg

SEQ ID NO: 1097 - DNA, 1178 bp, Homo sapiens
tctaacattattgaaaagaaagctttctctttcttcttttttttttgattttttttaatattatggttcagagatctccactaatcagttaaccagagcctggtaaacagtaggaacttagtaaatattagtagaatgaataaatgaaatgaagacagtcattattactgttatagttttagtcatgctatattcatttcaattaatactaatatttagctattaaaattattaatctgttatgttttaatggaagctagagtgcttggtgtgctgataaataccagaagatagaattcttttataagtgacacatgagtctatttaatctgcatacattttctattagttctagtatatgtagaatttcacattacccagtttgtgtctacattaagaaatgttttgacttttgaaatacaaacacacacacataaacacaaacacatgaacacacacacatatacaaacacacacatacacaactagccctctcattatcctttccaaggagatataggagattccactcagtttagaataatttatatttggcactggactatattaaataatttattttacaaaatttctttaaaagatttttttcttaggttcctggaattggtttgcctacccttgaacatgtatttgaaagtggagggcagcctgactcagagaagttttagtacagcagaaaccaacctggagttatacatgaacttcaaatgatccacaaaatacaaattcagctctatgtttcctttattttgtacctatcattagagcatttggtgtcttctttgtcttaagtattttttccccctgctttggcctagattgtatttgtctggttaattcttatttattctatagatattctcttaaaggctccattctccaggatgccttccctgaatccttgttcactaagtaaaatttaggtgcttctgcttcttatttccccacagcaaactcaacactttccctccagcagtactgagtaagctcagtgggagcaggggccatgtctactttgtgaaaccctcgcacctgtccagagcctgccacgaagcaggtgctcagaatctcaaaatgcaggaacgactggaggaataagtcatccgtgatctttgccttcaaccccattttttaccccatcccaccttaccttgctc

SEQ ID NO: 1098 - DNA, 1364 bp, Homo sapiens
cagcactttgggaggccaaggcaggtggatcacctgaggtcaggagtttgagaccatcctggccaatatggtgaaacctggtctctactaaaaatacaaaaattagccaggcatggtggtgcatgcctgtagtcccagctgctcaggaggctgaatcaggataattgcttgaacccgggaggcagatgttgtagtgagctgagattgcaccactgcactccagcctgggtgacagagagagactccatcccaaaacaaaaacaaacaaacaaacaaaaaacaatgaaaatattgaaaggatcttatttctgtcattgtccagagatttaaatttcaacatcaggaccattagtctggtaaatgtattcctgagcctatgatagaggtgtctcatttcttttgacattatggttttgtgcatacagtatattgcatgactctgcataaaacatactgatatatcttgtatatcaggcctatgatatggtccttcaccatctgcttaagagattagatttctttcttgcaggaccctgggtatatttggaggaaactgaattcaaatattgctcagttttctctgtgtagatgactcaaagatttatgaaacaaaagagaagataacacagatgctgctcatgttatgttattaccacagcactatggctaagtacttagcatttgctacaaatgatggagctggctcaatatagtggaggtctcagggcctgtgttatatggcatgtccagcaccaggagtgacagcaaggtacatgtagaccattcctcccagggtgagctgataatagttaaatcattatttgcagctaatctagagtctacagccatctaaggaaacattatctgagtctctcatggcatcagtgaaaaacaaagcaataatttatctctgactactgagaaggtggaaatgcaatataacaataactagtcctacataggacatagttacatattacaaaagagtttactctccatgaataaggttactttctttctctttctttctctctctacttccttccttccttccttctttctttctgtttctttcttcttcttttttttttttttttgacagagtctcactctgtcgcccaggctggagtgcagtggcacagtctcagctcactgcaatctctggctcccaggttcaagcgattctgcagcctcggcctcctaagtagctgggattacaggcacttgccaccacacccagctaatttttgtattttttagtagaaatggggtttcgccatcttggccaggctggcctcgaactcctgacctcaggtgatccgcccgccttggcctcctagagtgttgggaatacaggcatgagc

SEQ ID NO: 1099 - DNA, 3916 bp, Homo sapiens
ttttttttaaaaaaaatttcagaataaaagatgattgtccttgttactagttagttttaataataaaggataagactgagattccatggctcaggatgcttcttaggagaaaattatgtaggaaattgtctaagggtaggaggaataaagaaggaataattagtggatttcatttgttttacttttaaaaggaaatcatcctggaattatagattgattaattaaacacagcctctaaattctaaaaattattaataaattatacaacagtttgaagtaatttgtaatataataatagatgctaacaatcttcaacacaacattatgattataatggtaacactctccctttctgctctaaccaatacatggctttcattaaacaccagacaggtctctgacagagttaattgtctaagcctgttcaaaaggccgaaaattgctctctgggaataaaaaacattatactggaaaccaaagacaagataagagtctgggctttaatttaaagagaggagatgaatgctgggcagcaaacaaaggcagtcagtactggtttgaattttttgttttactgtactactttggatcagtttaaaccatttcagatatgaagaaggcatgtgctcagctcatgagctaaacttgttgaatcctatggctagtaccatagctagtctacaacatcagatatttacacacaggtggaacacactgggaaaataaatatcgaatcagacttcaaaaaagggcaacctctaaggggaaggtgggatgaacatggaaacaagaactctacacctgatatgatttagatagtgagtgatttagatactatctaaatcatttcaggtgtagagttcttgttttaggcttagagttttatttatgataattagatgtgggatgggctaaagttaatttcatcactattgagagagagttggctacagaactgtgcaaataagaccacagaagttttgtttaaattaaaggcctgcttttaaatttctttggtatttttaatttttgctgattccaaactcatttattcactctttaaacatgtattacaacaccaactcaactatgtgttgggtgccggtcagaaattttgaaatacaagaaggaaaagatagagaccctgattttataggagaatgaacacaccagaaaaccaatgaggacatacaatacaatgggataagaatgaaaaggataaacttgggtctagaagaaggattccagaaaggttcctgtgagagaaggaaaaacagggaaagcaatgctcaatcttggaaagaattttgaaggttgagtggaagttagcctgatggatttgggtcaaggagtgagagaatgaagaatgggagagtggtctgtttgtgggaacggtaagcaataaacaataataaagctgggaactagggtactgcagcagcaagacagaatacaaagctggagaaacatgcaattgaagaacattctatttcttgccagtagcttgaattttatccctaaggctgtgagaagccactggcaggttttcagctggattgtactattgtcagagctgtagtctgaccacagcaaggagaaaagattagaaacagatacggtggtggcaggagcaccaacttggagactgctgcagtcacccaggtgaacaggatgaggtaacaggtccatcttgctcacctgtccccatcctcatctccatgaatgcttgcattttggactttctactcaacatatcatgattacctgaaagctactttctcctgctttttcagggaggaactgtgctaacagtaataataccattaaattctctgaggaagacctccttgaaatgcacctatattgtctgaaagaagcaatgatcgtaaattaatataccacgttagctactcctctctcgctcagactcctctgagagaatggcatgagagcaggtctcttgtgattgggacgagaatagaagagaggcataatacacggtacattagccttcttttccttaaggaagtgtcatactgagggtcctggcaagcattagaaccggagggatagggtgccaaatggaaatggagaaagaaagcaaagaaacagagctcccttcacaatattttcaaagggaaaccaaaattaacagctggttagatttgtaaaggtcacagataaagtgtcaccagaggggcaagaggcatacggagcatgtctgggaagattttatggatgaaatcgcttgagtagagtttaaacgtaggaaaagtactgtgatgtgtgtatgaggggaatgtgtgtgtgacaagactgaggaaaaataaatcactgttatctatcaagtttttagcatttttttgatcgtaatagaaggaagctatgttgattcacttgtggtagtgcaaagaaaattagagaaaggagattccgtgtgaaacatttatgctaaagtactgcttttacctgtaacatctaaaatatcttgaaaactgggacaaaagtgtgcaatttttcattttcaacaattttttgtgctataatgcctcgggggtgtgtgtgtgtacgtgtttttgtttgtgtgtgtgtgtacgtgtttttgtttgtgtgtgtgtgtaatatgaatccaaccaaaaaaatttaaacaactggatttcatgtagttcagaaaatttagaaactgcccaagtcctagacaggatgtttgactgcatcacctcggtgatgagactgcagtatccactgcctagattttgcacgaggcaccattggcttccctgggtgattccaaccggcctggacttgttcagtattttccagggagctcactactcagacatagagctgatccttaaagaaatgcaggtaacacagaaaaccatggcttgctggcacctgggtcagggaagaagaggatgataccatctaagagtatcgtcttcagggagctgagaaacaggggccactctgtttttctttaacgtcaaggccaagcttcattgacagcacagttgttttgtattgacatgtccactctgaagtccctatcttgtaattatattatattattacattcctttgccattccaaacagaaaagattctaacttcctcttcctcccaatttcttgcccttatatgccctctttatttcttgtgtttgtgggatgtcacagtattgtgttaaagtgtttaaatattaactgtgttttgtcaaacaggttcatttgttatttgatttggggaatctttgaaagtaatacaggatttaaacgttttaggtatttcaatatagtgtttatttaaagtagttctaagctgggaaattagacgttatataatcaaggctttgttttcttacttttacatatctatctaaatactttcagaaagtattttaaaagtttcttctaaacagaactctgaaaatggaacaagatttttaggggcactcctaatttgtagaagccctgagataaatcttacaaagccagcggctgtcatctattttatctggtttcaaagtttgattttgtacatttgttctttaaatatgtacacctgtgaaccagaagttacagagaaatttatatgctctttaaatttccacaaatgacttagacttgatctttagccttacccaaatattcagaaaaaaaaaagaaaaggaagaagtgaagttaagcatcaaattcatgaattgagatatgaaatatatttattggagcatttaggacctcaaaaccaagttctttccttagccctgatgtcttgttactgactagaggtaaattatgacttcttaatgcctcagtttcatgttaaatgagaattaggtgcccaggaaccacatggtaaaagggatttgtgaaggcaaacgattttaggaacttgttcatgtaattaactaccaa

SEQ ID NO: 1100 - DNA, 1308 bp, Homo sapiens
attttttttaagtgcatcggggtgaatatctctgcgtgattctttgcagggtttcacttctgctaccaagaataatctctgcaggtaaacctagtttacttagttctgttatccaatttcaataaaagaaatatttaccttccagatcccaaggaactagattattaggtaagaaaaaacattaaacgtatcaggactgaccaaaaggcaaggaagtctctggcatagcctacggctgatgctgaacataaagcaaaggtacagggaatcttccattatgctttaaactaatctatatgtttaatgtctccaaaactagattagatgcaatcatctcaaataagttggtataattacagcatattcaattacatctattcagaagccatacttctttctttgatcaattaaagttagtaaagggagatgttaattagtgccagccctctgagaatgaagaatatgaagattgatacagcctagaatattagtggtttcaaatgtctcatttgccccaaagtatttttcccattggtctcctaaaggacctgtcttttgaaaatcccattagaagtaaaatgtattttttaaagacacataaatattactccagtgtttacaaagtcatctcacttctgggatattatcccaaggaaatgattttaagaaggaaaaaaatcttcaaatacaaaaatgttttaggagtgtagatatgtaaccatattctccagtcatcattagagaagaagaactaatgaggtcaccatgattagtaagaacttgaagttgttggggtcttttccttatcctctggcaaatgttcacctcacaggtatttcttggcatcttcagaggtgtctctaatttttcccacaaatagtaggtgttgcactccctaggcactgctgtctcccttttcccattagatgctactgctgttatgaaacacatcagatctgtgaatcttcattgcttaagccgtgccactgttggttgcaaaatgatggtaaatatcccagagcaattttgctttgtgaccttaatactttactgagaaattgagtaaaaacaaaattatattcatttttacttgcagccctttgcctctcatatacagaaatgagtctatgtgctggactgggtatatacagattttaaatggcaaccaccatgctgaactgaaagttaatgtttctggtcctggaattttgttgctgtgctaaaatctaaaatcatcacgctgtgcttcccttccagcactccctttccagacaggcttctgttgggcacagaacatcagttagcaag

SEQ ID NO: 1101 - DNA, 1797 bp, Homo sapiens
agtcttatgactgtcacatatatatcataataggaaacagctatatttgatttgttttccatttcctttcaatgaatttaaatatgtaattaaaattacatattttaatctaaaaaaatgagaagtgcaaatggaatttcttgaaaaattcctagggcgagcgaagtattactttctaagtggaaaatctttcaagtcaaatgcttatcatttttaattattaagaaccagcttctcaatattaactttaaaatcagtggcaaatttgtctgtttgatttttaaatcatgtctcactggcttccttctctttttttgatcattttgctgcacttgcaatttgatatctcattcatggctctgctgtctgtaaactctggttagtgcaaagctctgcaaaaaaaaaaaaaaaaaaaaaagaaaaaatctcttatttgaccatgaactttcgatgatctagttagcgttactgtcaagcttcccgcggtctttttgaaaagcaggacttgtccattctgccctctggccagcttcagtgggactaaagcgctagcaagagccatcaaactgcctgacggcttgtcatcagcgaggatccattaatttacacagattttccactgtttggcatctaccatgataactcttttctcttccaagcagctcctgtttgcatttaacacttgggttaattttcatcagagtttaaatttagccatcagttatttcaggggagctgtcagccaacatatggagagagggagaaaaaaatccttctgaatttataataaagtggaatctgttgaatgtgaaacaaaaaccaactgcaatatagtgaggccccggtggggagagcggggtcagcaaagaattgcagagtggattagctgttctattcaccagagccgcatctgggcacctcaggagcttcttgatatatcaaaaaatgatggaaagacacagttcaatttgtcccccttttataaaggataattaacctgtcagtcttgctactttaacaacttcattaaattggaggtgaaatgggtgctgagaagtcttgtctttatccaaaaggaacacagggcacttgtgtaaatggtggaaaaagaaagaaaacacatacacgcaataccccagtaatactgtctggttcctgaaaaatggaacatgcttcttccaattatgtaataatcctgcccttactatgacctgctaaaagtaattttcttaactcagaaggcagaggaaataatgtcacagcccaactaggccaggaaagcacaccacttaaaaattgaggttatagggtttcaaatgctgttgggccaaactatttaagacctagagtgatggctactaacgatgaacagcatttcacaggtaataaaaagaaatgaaaacagagctccctcagtcctccacctctccctctgccacccccaacattggcttccatggtttgtttcttggcgataaatcatctttttactactacaaagatctgaaaccttaaatatattcattcaagagaaaaagagcacttcaacaattttagtgtctaaaaccttaaataatttttctttcttaaagggaacttattgaatattttaagcaactgaaatagtagttcagttaagattatagtcctcttctcactagaaattctactctgaaaataagcataaagcaccgtaaaaaaattaattataaaatatttttaaaatcttcttaaaatcaaaattatgttatttccagttgaaatggaaatgattttatgagattggtaattctgtcc

SEQ ID NO: 1102 - DNA, 4339 bp, Homo sapiens
tgatttgaatccaatttaatcttgatgttgttcataacctaagtgagattcattgatgataagaattacgtaagtaggctgggcgcggtggctcacgcctgtaatcccagcactttgggaggccgaggcgggtggatcacgtggtcaggagatggagaccatcctggctaacagggtgaaaccccgtctctactagaaatacaaaaaaaattaggcgggagtggtggcaggcgcctgtagtcccagctactcgggaggctgaggcaggagaatggcgtgaacctgggaggcggagcttgcagtgagacgagattgagccactgcactccagcctgggcgacagagcgagactccgtcacaaaaacaaacaaacaaacaaacaaacaaacaaacaaacaaaagattacttaagcagtaagattctttaacaagagaaaaattttttatagcctcaattgaagactaactttcttaatcagctgtacattagactgtgactataaatataaattacattagttcctttggttaaaatgactttcatatatgtgagaaaaactcaaggactagctttagttaaacactatttattttcccatctccaaaatgacaatcactagcagttaaattgtaacttttaaatgaattattttgactttacaaatacacaggtttatgcatagaaatctggcttttcaaatgactgaatcaagttgactggtgatcattaatgatgatgcttgaaaaaaaaaaacaactggctatccaaatgataaatccagtaaattaagcatggaattatgaaaaatgctatgctatagtttaatggggtattatggcataaaaagtgtgaaatgtggcttttgacatcaatcaatttataatctacttaagaaggacttgtacacacacatacacacacaaacacacacacaagatagtttctaaatgccaagtaaatgttgcagtcagaagtgcagagaagttcgaaagaaggagcagtcccagagggctaaggtgaccagaaacttgaattgaagtttaaaggataaaacaattaatataattgaagagggagaaggaaatgctaaaggaaaaaaatcataaaataagcctttattccccttacagtgcaattgtagcaatattagaaatgtaaggaagcacacggttttaataaaaagttagaaaaatgacctgatgtctctgattgaatctacattatttataatatttttctgtgcatattctgtaaaacaaattaacaagctattcaattagattaacaggtcagtggctactctgattatttatttatttatttatttgagatggagtctcgctctgtcgcccaggctggagggcagtggtgcgatctcggctcactgcaagctctgcctccagggttcccaccattctcctgcctcagtttcccaagtagctgggactacaggtgcctgccaccacgcccggctaatattttttgtatttttagtagagacggggtttcaccatgttagccaggttggtctcgatctcctgacctcgtgatccgcccgcctcggcgtcccaaagtgctgggattacaggagtgagccaccgtgcttggcctctgattatttattgatatataataaatttcccccaaatttagtggcttaaagcaacaatagatatttatgatctctgatggtatctgtgggtcaggaatgtgggaaagacttggctaggtggctgtgcctcaaggtgtctcatgtggcagctggcagatgttggctggagttggaagagcagtggtgaagaaagctgaagatgctggaggtttgccaggcacttctcctggattcgcagagcctctccatgtggtctttccacagaggttccattgggcttcctcaaagcatagtggtctcaggacagtcagactatagatgtggctgccaaaggctacaggagtgagtatcaagcagtataaaagcttcctcacatgccttttatgacctagcactggaagtcacatggcagctctaccaccactcagtcacattgtgtccagtctctagggaaagggacatagaccccatctctccacatcaaagtccagttgtaagaagaggatgcagaatggaatatatttatggtggccataattttggaaaaatataatctgccacaatcattttgggcatttgtctgattaggccccatccttgatgagcacaaactcgtaggaaattttgaacaactagtgcttgtgcttattggctgaaatgcttaggtaataggcacttgaaaggtgaacagaattcatttgtacgctggtataatcacacatatattagtgatttaaataccccatctcccatccccaattcatggctactggcccataaaagtaatacaacatttggagactggccctattaaaaacagaaatgaaaagtaatcttccaaacacctcgcagggtgttaacgtttggttttcttacttatccttcatctgactccaagcccaatctggtagtgtttcatagtagttttctttaggctggatttaattgcttgagagatgtctttttctaatgagattgagcaatctaaactgtaacctgcattcctgagacttgggctcatgtatttcaaaacatagctaagggttaaaaagacttgaaacagaatagcctttttattattgttgttattgttcttattttaaacatgcagcttcatgtccccaaaatatatttgatgttcttttataagaaagggcaatcctttaaattctcaaacatgagccagaaaaagatattactctctcacctaaagagaaatagagctttttttattccctggtgttatttttttaagagagatattttattatttcggatttgggtttccttgccttgctttccattcttttatagatgaaacatcaacacagaaacatcagctacactgcatatggttaacttgcattcaccccatttttacaaggcactttggactgaaccagattactcctccaaatgcttctcaactgtctaaaatggctgtaaaactaaaatttgtgtttgcacactctcctgagctacctcacccctcctccagcaaggtcgtgcttcacaagggattgttggtgttttaaaagggacagtctacataatacaaactgtttgcactaaagaagccaaagagacttcacagaatgtccatggcattgaccttttcctgttatgatatctcttttgtataccaggttataattctttggtattaatatccagcatctagacagtgaactagaattatggtttagaagatctgctttgtttggggtcaacaatagggagttggaaaacaattttctaagtatgcttaaccgttagcatttcctatcataaggttagacaagtattgcaactagcttaaatatttaactagtaatctgtttaagtattacaatacagaagataagctcatgaaaagatgttcaacgtcattagttattattagagaagtgcaaattaaaaccacaaaatatcattacatgcctatcaatggttaaaataaaaaaatgacaatactaaatgctggcaaggatgcagagaagctagattgctcacacattgctggtggaaaagaaaatagtacagcctctttggaaaacactttggcaatttctttaaaaactcaacatgcacttacatacaatttaacaattgtagtcttgggcatttatcccagagaaatgaaaatgtacgttcacacaaaaacctgtacatgaacgttcatgaaagctttattcttaatagctaaaaactggaaacaaaccaaatgtccttcaacaggtgaatggttaaacaagctatgacatccataccaggaatgctgtgcagcaataactattgatacaggcaaaaacttggatccatcttaagggaattatgctgagtttacaaaaccaattttaaaatgctacattttatgacttcatttatacaatattcttgaaattgtaaaattatagggataaagatagagaagagactggtggttgacaggggttagaaatggggggtgggggtgggggtgtctgtaaagagttaacacaaaggtcctttggagaaagagcagtctgtatcttcatatacagtgatggttatatgaatctacacaggtgataaaattgcatagaataaatagatgtatatgtgcacagatacacatatatacacacatatatacacacataaatgagtgcatgaagtgcctgtaaaaactcatgaaatctgaaaaatctccctagatgatttcactgtcatttccctggttttga

SEQ ID NO: 1103 - DNA, 1925 bp, Homo sapiens
gatatcgccaaaaacgctaataaagaaatgcaattgatcttaacacaaagaagtttttgtaaactgaaaacaaaaattaaaaaattggaagcagagactataccattaaaaactgatcacagaattgaattggcttaaagggatttgtggttggaaaatactctctcaatgctcaatgaaaatgtattagccttggttttctgacttaaacatttgtatttaagtacatatcagatcaaagctacaagatcaaaacatcctaccctctttggctattgccaaatcttatcaaaggcctactatatgccaggcacttgacacatactaggctcttttatattcatttgtctcctttaatttcataacatctctgtggtgtacatattacagtatttcacagataagaaactaaggcttagcagtgaggttgagcaagatttctgatatgctgctgctagtaaattctgatagagctggaatttgagccccaggtttttctgactcccaatgcagtcttcttacattatgtggccttttaacaattaaaaggaagtaggacacaatggttagaacacaagctctgaagccacactgctcatgttaaaatccaagattcattccttaactaatcagtcactttggacaagattcttaacccatccatgcatcagtttctttatccaactaaagggaataaagtactgtatataactcatagggttgtgatgattaaacaaattaatacatgtaaggaatttagaacagtgcctaacacatgataagaactccatgttggtttttattatgtaattttttcttgagtctagtgccggacacaaatttttatttaaaaaaatctgaattgcaagtgcactcagaatttgggaggaatgaatggcaaattaacctaactcttgtcaaatattaaaatatacatgtcttttatggtagaaatttaaagactgactgttggcttagttgcatttaaacttatagacctcagaagttttaaagaaattacttgaattagccgggcgtggtggtacatgcctgtaatcccagctactcaggaggctgaggcagtagaattgcttgaacctgggaggcggaggttgcagtgagccgagatcacgccactgccctccagcctgggtgacagagcaagactctgtctcaaaaaaaaaaaaaagttacttgtgactttaggggatgtaagtgtttctcccccaactgcataactgaattaattctacattggaacagcctttgttaatgttctccctccatcctaatcctatagcagcaattccgcattggttgggggggaaatgctgacccaattgggtgttctcaggcattaatccttcctaggtctggaatgtcattaaaattatctggagctgcattcttctcctttttgtatatcttacataatccaagagtctttcaataataagctttaaaaaattatttttgagacatcaaacacttgccaattgattttgtctttttcagaagtcagaaagttctgggtattttccagttctatgtctagttataactagacccatttcccttctaatagcacttgaaaccagaatagtactatttccagctaattttcctgtgcttcagaaggagttattgtttcattttgatgttgcagatgttctaactcaaaggaacgaggaagtcagattcgctggcaagtttatattttgtggtttaagtagaagtgagctaattctcaaaaaatggggagccactccaaaaggttctaagtcttattttctgcattggcctaattgtcacttgtattgtgtgggtgatggcacttgctacaagtcatgtctcttttactgacttgaaagtggcaaaggggcagaagggttaggtcccagttgtggcacagtgagggagtcctc

SEQ ID NO: 1104 - DNA, 7662 bp, Homo sapiens
tagaaaatgcagatgagaaaaaaatgtactataggctcagcccttcaccctccaagagttgaaatcacataagccacaccctcatcagtgtattgcacaaggagagtgccttctgttacaatcattttaatcgggaagccatcaggctggggaagctacaccactgtaagtttttacctaagcaagccaaagcccaatgcaaacagtaaaatgaaactagaaactttactgatcagaaaccacaaactaacctctaaaaccagtctttccactgtaatcaatcaaatgtgttgtatttgtcttacttccatattcagcctctaaaagcccacgctgctgcagtggagctctctgaacctcttctggttttgagggctgcccaaatcatgaatccttctttgctcaaataaactttgtcacatttattttgtctaaagtttttcctttaacatttcctgtatttgaatctgcctgtgctttgcacaagacaaagtggctatttaatgcccatttgccagacaagtaaagctgaggccctgagttcaagtgaccccccaaggccaggcagtgtcagagccaggactagttctagcaagatgatgagttttctgccttcctaaatcttgcagtgccatgtggaagctgaagtaaatacattcacatcatttgaaatacatgccttagatctctgtacaaaggtagcaagaaatttcgggaagagtccctcctcctgtcaacctacacatagcttctcatcagccccttttcatcctcactttccaattgccacaaaccaccctctctccccaccccttgctagcattttttcaccctctgacctacctcataagatagcatctccttacattgcaataacataaaacagcctgacttcttaagagttcttataaagataaaaatgagataagatacgcaaggtgcctagcttagggcctgccacatagaaagccctcaataaacctccttattattcactgttatcccccaacatacaattaacccaaacaccagggaacccaaacaagtgaatcaacaaatgtttattgagcgtctactgcctataggaaaacaaaaactgaaatgataccaggaagttgctggtgtccttccctatccacccctctgtttggtataggactcaggactgctatctcactcccaccacctgccttcttgtccaggtttcccatctcaggcatcagagccactagtttgtcagttgctgaagcccagaagccattctgattccttttcctcactccattcatatcgaattgcttcccaagtgcttttgattttattcctaaatagctctcaaatcccatcctcctccctaacattgctgccatcgcctccactcccagtaagactataaaggaccctctttctccaaatagtcatcatccaggagcagtaattaggaggttgcaaaaagaagcaaaattgtcatgatgtggaaatattcatgagttttcacccaaccatccctccccacctaacactagaaacattaaaactaccaaccatgccaacctcacatgcagatacaatgcaaggtggttgcaaagtaacactgaacattttgctcaattcgatggatttcatgaagttgatgaaagtaatactggagatctgcttcagtaccactgaccaagaagaagttggcagagctaaagcatttgcagctgaggaaggaaaactgctgaggttcaaggcaggactggtccttgaaaagggaatggtttgagcgtcaaagtattgaaggacggccttggagaaactaatgaactctttgaaagttttcatgattcttcctcaaaactcaagcaggaagcaaaaagtgttgcttcctgctgtcttgtcatcttttcagcatgagttctccctcaaaaagtcaacaactgattcattccttgttcaaagagctagcgcaaaactgcaactattacataagtatcatgaaatacaaagtcacatgaaaactttttcataattttttgtattatctttcaaagtaagatactgatcaagcctttttttaaaaaaaaaaaaactgtttactaagaaatgtggacctccattttactttcagtggtccctttccaataccagttatctgcaaataatgagggtttcctatcttgcaattgtctcttcctggtgtctgcactctccacactgcagcaaatctggctataagcagccctgctttaaaatcttacatgattccccattgcccttaggaataaagtccagaattcttcacacagtgccagagccctgcgtgatctggccactgcctccctctccactctcagcctttgcactaactgttccctgtttgcaccagtcctaccactactttgcaagtccccgccccagtgctatgcacttcctagccaaaggacctttattcatctccttcctgcagcctggaaccctcttccccgccttctttcccacaagaggaaggagtgcctatttgttctccgctgtttcctggcatgaagaagacatttgataaatatttaaatgagtaaataggctgtgaaagttcttcctgattctgacaaatgagtatgtcagataagccacgtgttccctcactcctgtaagcatccacaaccaacggtacttcaatccaccaccattcaacaccgtgggcccacctcctactgtacttgtaaattaagaacctggcacaccttactagaacatcgtcctccttttagagtggatgatggcaagctaccagtgttctagaagcaagattatagagaacatcaatccagggcatgacagatacccagaaaactcaaaaggccccaggtactgtgttctcagcagacggtggggtattggggtcacccaagaaagaaagtcactaagagtttcaaagattagccccaagtctggtatttttctgaaacaaagagtttcgaagattagccccaagcactggtgtttttctgaacaatggtaacgtgactcatttatggcaactataatttttatagcctcaaaataacactttggagtcatgctacatataataaggcacactaatccacttctgctgccccccataggtttcccggcacctccactcctggttcccatgacgacccagaaggggcctctcagacctgatagcagcgtagaggcagctcctcagggaggggcagctatcacacatcactacatttggcatttggccgaggactattctgggccaggggggtcttcggcttccaggagctacagagcaccccagagagttaatgtacttcaaaacagaggaaagaacaggaaaggctgacgggtcatctttgaatcagaagccatttttgccttaccttctaagttttcagtggagaggaaaaggaaaaagaaaaagaaaaaaaagcaagcaaactcttcacagctgaagaaacttgttcagattatttcagagttcctcctagttgcttctgaagcccaccaggccaattctcatccatctcgtttctgtgattgtggaaggaataagactcaatggcatgaaacagcttcaggactttctgcctcacctccagctttaaatcagacctttaatgctacttagagggaaacatttttcttagtaaattataaaagtggaattgattcaccagagggagaaaaacccactgagtaaatatatttgaggcttatgtaaacacatctcagagcgtgtttcaagggaaagcggcttgcttactgagtttaattataatgctctttggtttcaaaaataagacaaaaatgctagaagccaggtgtaatggggaaagaaatgaaaagatgagcactgagatgcaattgttagctccagccatggctgaaatacacgggatgagatacaaaaatggcacatcaccgttattgctagggacagccctgacacactgtcaagtgtcccctccgaaaatgatcctaaatggcccggcagttccaactccgggctaggtatcctgaggtttccaaatatacatagatctttaaagtgcatcaaatattcaacagaggataatggcatctcctagcaagatgagggtggtcttccaggctcaaatatactgacatgaggtgaactgaactcaaatgttaaaatgccaaggaacccagtggggtgttgtgagcagaaaacgagatactttgaggctgggaaaatatcctgagtacaatgcccaagagcaaaaatatgtgaaaagagatagaaaggaagcaaaactcttaaagggagtagtagaggggacactggccaggctggtgggcagggcaactgcagagaaagcctttcaatcagaagccactgagtgcacagaagcctggagcacatctacagaagcacagagtttctccaaacagtttgtccaaagtgaggacagctagcagaagctcaacgcacatcacaggtgaaagccgactggcatgcagaaagtccccagggtccgcaccataattcaggcccggtgggggcttgatgtagactgaagacggtaaacccgtcctaacctgcttgccgatctagtctgtccagcgcgtacagtactggccagcataatgatttctagaaaatctagacttctgatttccttttaaaaaaaatttttttaatacaaacaatcccacagtacttattgtcatcttgtaataacataagggtaatcaaaacaatatgaataaatgttcgtattggacaaaggacacctaaaaacaaactatatccttctcaacaatttctcacttcattgatcatttctagttggagacactatgtacccgagtaatattatctccttttagcatgatccaacccagttgttttaactctgttttagaataaatctcttctgcatcaactaatacaaggttcatatactcatcaaaaccaatgatacagccttctatccacatattctctgcttatagagccatacctgaatctgggatctattttgtaagaatctgtaggtgaggttgatgggctccatcatagctttttgcactttctggccctgaccacggtataccatgatggaaattcctagatttctgatttcttataaaaactgcaaaatctggccaaaatttctctctctacttattctacagatatttactgagcattcattctgtgccaagtattccagaccctaaggatacaacagtggggaaaaacagagtcctcgatgttatggagtatacatgctagtgagaaagacaaacaataaataaacgcatgtgacaggtggtggtaaatcctgtaaagaaaccagagcagggtgaggggagtgagagtttctaggggagcgctaggaaacgcaaggcagtctgggaaggtctcccggctcctgcatggcaacatccagctcgagctaggtgatggcttcctcctcacacagggcaggttctctggtttgccacagtccctgctactctctcttgttacctcctcctggcctactttactcatttatgtggcctctgtaggcatcagagttgtggcccccagagttaatccttccctagatccctctgtattagtcagggttctctagagggacaggactaatagagatgtatatatgaaagggagtttattaaggagtattgattcacacggtcacaaggtaaaattccacaataagccgtctgcaagctgaggagcaaggaagccagtccgagtcccaaaaccccaaaagcagggaagccaacagcgcagccttcagtctgtggccaaaggcccgagagaccctggcaaaccacgggtgtaagtccaagagtccaaaagctgaagaacttggtgtctgatgttcaagggcaggaagcatccagcgcagaagaaagatgaaggccggaagactcggcaagtctagtccttccatattcctcagcctgcttttatcctggccacgctggcagctgattagatggtgcccacccagattgagggtgggtctgcctctcccagcccactgactcaaatgttaatctcctttggcaacacccacacagacacacccaggaacagtactttgtatccttcaatccaatcaagttgacactcggtattaaccatcaggccctccaactctggatacccaagatccagcagagaaaggagacactgctcccaagcagacacgcaaaacaagtcagagaaaatgggatttgaggaaatacgagcctaagccaagtctgaagggggtggggggaccactccaggcattgccctgttaaatgatggagaaacagtttttgagtcctgaacacatgtacagaaggggctccagatgcaactgggaaaggatccccagatctctctcccactatagggcacaaggctgggggccacaggtggcagagcatcagggaccaaggttgagcaagaatgcagaccaaagtaacaaggtactgggtcatgaagcctgggaacacatcccagggctgcttagctaccctatgggacccctgagggaggcacaaagagtcctcctggagcagaagggagagggtaaactgaagtgcaaagtaaagggagagggtaaaccaaagtgctccactttctaggagcaggtttggggcaaggtatggagtggcttcattccattccctaagccagcaagaaatgccacctgtaactttacgaggtgactatgggggagcactgtggggaaaatagactgcactctgtacagggaagatccaatccacttctgccagctggtgagggattgcccagccagaaatcagcaagaacagctgagacaacaagagggcggtgacacagcaaccacagggccaagagaaagcactagagaaagaacagtgtctgcaaaggacttgttagatgggacttgtttccattcctcaggttcatggcctcttagaagaagggtatcacctgtcctttctctcgtgagtaggtggtgtggatttgcttccagaaggaccagccttttctgggatcatcctgctctattccttggatggcgggagccagcctactgaagaactgagggtgtacatctcccagccagtcccagatgctgatgccagggcttccagtaaatgcccagagctgccctgaaggtgacagaggccttaacacagcctgtaacctcacccttcctgcttctgcgccagcctgcctccacctttttctcttcaaccacatccccaagagagcatgcataggctcccttgagccttggggactgggacattgcattactgatgcttgagcaaccgcgttgtcttcagatctcttttagttatgccctttaagaaccatccacatgtgctggaactaatggctgaggcgggacagcagggtacccctcgtaagtcagagagagctgaagaagcccaagactcacagccagtctgtgatagagaaattgtccttaggccctgggacgatgtctgcaaaactgaagccacaggcagagagcagagctggtaggtgtgaagtcaagtcctaacactggggtctgtgaaaggtgttaaaataattatcgcctagaacgcagaacagattcattttaacaagcaacactctaaataggaatcagcaacactctaggacttgatcttcagacccaaacctcaggcagc

SEQ ID NO: 1105 - DNA, 1459 bp, Homo sapiens
gtggctcatgcctgtaatcccagcactttgggagaccgaggtgtgagacgagcctgggcaacatggcaaaactccacctctacaaaaaatacaaaagttagccagttgtggtgacacatgcctgtggtaccagctactcaggaagctgaggtatgaggatcaactgagctcaagaggtcgaggctacagtgagctgtaattgtgccactgcactccagcctcgatgacagaatgagacccggtctccacaaaaaaaaaaaaaaaaaaaaagcgtctcatatgtattctttcctatgttgcttcatgtcaggttttagaatcaaggtcattctagtctcataaaatgacttgggcaatggtccttcttcttctattatctggggaagtttaagtttagaattacttcttccttaaatgattcatggaacttgcatgaattcagctcaatctggaaaagttattacatggtatcttaaaatgagtaatacatttacatgctttaaaaaatcagaacaaaaataaaaaggctcccacttataagtgtcactcccactcctgtctaccccattccctcgactacctattattgttactgtataaaaatacaagtgtaaacaatatttctacctacctctgtttaacaaaaaaaagacacacttaaatactattctgcatcttattttattcactttacaatacattctggagatcgcgctacataggtacagtgaactttcttgactgcagctacacggtattctattctatcactataccaatagtttattcaaccggttgcctaatgtcagatatttgggttgtgtttctcttattttttacacttgaattttgatccatctgtggtttgtcctggaatatgtaagagttttaacttgttccacaaatggacttttccaaatggttatccagttgtctcaggaccatttattaaaagttttattggccaggcgcgggggctcatgcctgtaatcccagcactttgggaggccgaggcgggcggatcacctgaggtcggagttagagaccagcctgaccaacatggagaaaccctgtctctactaagaatacaaaattagccaggcgtggtggtgcatgcctgtaatcccaactactcgggaggctaagacaggagaattgcttgaacccaggggtggaggttgcagtgggctgagatcgtgccattgcactctagcctgggaaagaagagcaaaactctgtctcaaaaaaaaaaaaaaaaaaaaagttttatttctagcggaatacagtggctcatgtctgtaatcccaacactttgggaggcataggcaggaggatcacttgaggccaggagttcaagaccagcctgggcaacaaagtgagacccccatctctatttttttttttaatttttaattagccggacatggtggggcacacctgtagtcccagctacttatga

SEQ ID NO: 1106 - DNA, 12152 bp, Homo sapiens
cataaatgtgaaagaacttttgggagactatggcagccccagtatgtgagatcaggcagttggtaagaagaggcagagattaaatgaatttacaagtacaacagctactaagcaaagaactcttctaaacagaaagtgggaaattgcctccttcagacttgagaaaatcttctgtagggctcttggcaaatatccagtttgaaacgaactaacttctttaacttcaaacagcctctcaccaagcttgtttttctttcttcttctattctcccaaacagaatgacttccttcactcttaaactgttcccctctggcactcctaattaatttaatctaagcttctcttaaaggctactcacctctgttctcctgcagccattccctttcctcttgccaacactctccttctatgcttcttgggttcattattatctttcctgtcactgaaaaacatttacaaggaggtactttttgtatcaatagacttaagagatccatcagttggagaccgtgttattcaaaacaaaaccatcacaaaagtctggcaagagaaaaacctatcctctctcagcgctggtgccattccttgaggagccactgggtcagaactgagcgtcttccgatgactcaacctcagctggagaagagtagctagaaaccaatccaaggacaagcccaaggtttgttaacagatgcaaatcctttaccttccttgtagctcttctctgatctcccaatacgagctcaaacagatgaaatgtgggtacaactcagggatgttgccaacaacaaccattgcaacacaaaggcaaatgctccgtgacactttcttcatgccctccttgctggcaatacaagactggtcatgagcttccttcatttctttgtcagaggccgccagctgcgggctatgggctgtggcatcctaaagaacagggtctgacaaaagacatgattttttttacttgtaaaatgaagaggagtactaagccaattctgcagataattcagccaacttctcctctcacaacccacacccaggtgctttggcccacctctcctaaagcaaaatggctaaagtctatgaagtatgacagaataattcttgaaaaacaatgcagagagctacctaaaacaaacaaacaaaaaaaaccacatcgtggcttgaaaggtaactttcttctcagttgattggttatcttccttgggatatgcctaggccagtttaccaactgccacctataaaccacttccctcctgacttgttaccaaatgagaagactctaccatcttcctgttctaagaaccaccattggttcctcagtgaatattttcctgcccctcttgtccccgcctcattcctttttgattacacctatatttacaattttctttgcctgtcattccttcttatatttcgaatttcctgtttggtatacatcttttagaattttatttagtaaatgtctattggtggaaaacttttagtttatctgtctttatcttgccctcatttttgatatattttaaaaataatttcaactttcattttagattcaaggggtacatatgcaggtttgttacatgggtatactgtgtcatgctgaggtttgggatacgaattattctgtcacccagataatgagcatggtacccaacagttagtttttcaacattgcccccctccctgcctttcccctatagttgcccccagtatctgtggttgccatcttcatgtccatgagacccaatatttagctcccacttataagtgagaacatgcagtatttggttttctgtttctcagttaattcacttaggataatggcatctagctgcatccatgttgctccaaagaacatgatgccattctttttatggctgcatagtattctgtgatgtatatgttccatattttttttttattgaatccactgcagatgagcatgtgggttgattcaatgtctttgctattgtgaataacgctgccatgaacatatgaatgcatgtgttctttttggtagaatgagctatttttctttgggtatatacccagtagtaggattgcagggtcatatggtagttctgttttaagttctttgagaaatctccaaactgctttccacagtgactgaacgaatctcattcccaccaggagtgtatactcattccctttttttccacagcctcaccaacgtctgttgtttttcactgtttttgactttttattttttttttggagatagagtctcactctgttttccaggctgcagtgcagtgacgtaatctcggctcactgcaacctccacctcctggttcaagtgattgattctcctgcctcagcctcccgagtagctgggattacaggcatgcaccacaatgcctggctaatttggtatttttagtagagacagggtttcaccatgttggccaggctggtcttgaactcctgacctcaagtcatctgcctgactcagcctcccagagtgctgggattacagatgtgatctactgtgcccaacctttactctttaacagtagccattctgactggtgtaagattgtatgtcgttgtggttttaatttgcacttttcaaatgattagtgatattgagcattttttcatgtttttttggccacttacatgtcttcttttgaagaatacctgttcatgtcctttgcccactttttaatggggttgtttttggcttgtttatctatttaagtttcttacagattctgagtattagacctttatcagatgtatagtttgtgaatattttctcctattctgtaggctgtttactctgttgatagtttcttttgctgtgcagacactttttagtttaaataggctccacttttcaatttttgttttcattgcaattactttcgagaacttagtcataaattctttagcaaggccaacgtccagaatggtgttttctagcttttttttttttttaacatccttatagtttgaggtcttacatttaaatctttaatccatcttgagttaatgtttgtatatggtgaaagatatgggtccagtttccttcttctgcatatggctagccaggtatcccggcaccatttattgaatagggagttctttccccattgaacagtatattttctgtatagaattataagatgcgcgttgttttcttgcagctaattgaagacattatttctattgccttccggctctcattgcaactgttaagaagtcattgataaatcaggtattagtctctcactcctttgaagataatgattttgggtgtggatttttttggctgcttttaagatcttctatattttcagtttctgcaatttcaacaaaatgggtctaaaactggatttattattatttgtcatacatagaattagtctacttcaatctgtggactggcatctttaatcagttctagaacatcctcaggcattatttttataaatattgcctttgcctcattgtctgtctcctctttttccgaaaccttgattctatatatggtagaccttcttggtctattctccacatctctgagcttctcattttataaatctcttatgtttgtgtgcttcattctggttaatttgttttgtctttcagtataccaactgtctcttcatctgggtttaatatgttgttatacatatccattacattttaaatttattgaaaactttccagaagttctactttttagacctcaacagccttaaaatatgtttttccatttctaacatacatgttagagcttgacttttattgtgttaaatgtgattgctacatggtcaataaagtttgcatatgataattctaatattcctgatgctatgattagttctccagggcctctttcccaccctgaagctccctgtagtcagagctgcctctgctctcttttcttcgtttctataactctagggtctagcatagtctccagaacatgttcagccccaagtaatatgttattgaattgaattgaattgttgcctttttcaggagaatcaggagtgatctctgccacctccagtaagtttattcctgatgttaccctgacacccaatagtcagactgtcctaccttcaactctgtcatggctcacaaatgactatcacacttctaggggatccacagagtgaggctgagagctgtcaggacctcaaagaactctaaaaacctggctggagtattggctgtcttgttaggagctgggtcaccttggactctttgaggagaaaatgaatgtaaggagctttataaactgaattgcaggcacttgttcaattatttaccacacagcactttttgaatatcagttctatgcagagctctatgctaatgctggacaagctgaaatgcagtcactgtatgccattcgcaaatggctttgagactaggtagggaaataggctatccaaagaagatcatcaacatcctaagacggtgtttctaagtaccagataaggaggctaaatgattggagtcatttctccgggctcagattgctggagaaggtttacggagctgctaagttttgggatgtaccttaagaaagaacttaaactgccagaattggaccaatctgactaaatggggctgtggatgatggtcacaaacgcaaaaacttgcaggacagaaagacaaagtagtgatgcaggccagtaatacaataagaagtggttgggactgtggcaaaagaaaagagaatgttctgtctaaaggtggcaaaagtgactcaactccttcataatattgagacgtgagaacatggcctatgatgccagagcttctgctttcaaaacaagtgctgaaaattgggtttctatctgatgtttctcggtttttaaaacacgattccagtatcactccttttaaaatcatgtctgtgtgatgaatttggtctacaggccacaagtttcctacctctgctttagatgaaaacacaagtgtagtaaattgcttcatttcacacttgcatgttcgtatctttctgcttcactactctgaaaagctgatgattcccaaatctgtatcttcaatgccagtctatatcttgagtttcacgtccgtatgtttagttgcctatttggtgtcttcatcaggaaaggcacttcaaatttgacatgtccaacgtcacatttttctgctctgacccccaatctattcctatttcctatttcacactgggcctcagttttcaatctgtaaatagggataatagtaataacctgcccctcctaacttttaaggttgttcaaagaaaataattgtgtatagaacaagagaaatgaggtgagagagattgcgtattgtatgtgaactgaaaagctaactctgagataactacttattctgcaacatgcttgtccatcttcctactgatagagatgagaaagacagagacaattttgatatatctatccaactgttgccctagacaaggaaaggcaatgaaacacgaaatttgtaataagcttttgttactcagaccagactcatccagaggaaaatagatagggttgccagtcaagtagcatctcactgttgagttcaagtagcatgaacttaccaaactttttttttttttttttagaattatacaatctggaaaacagtctgttggcttcccattgtattggcctcattgcgtccagtaaaggatgcctgaatcctctaaaattcaggaaactttaggacccattgttgggggttttgagagatggaaagcgagttgtgcagccttggctgggctgcagctgcggaacatgcctatggcaatggtgacttccatagaaggtaggagtcaaacaagttcatacagtagagaaaagtcctttctaagagtaggtaagaatattggaaattattcttcttccatattttagggcattaatattcagtgaatattgagcctgagtcatagagccaatcaaggcacatatctcaggtatatgacattgatgcaccctgccatgggtaatgtctcaattctcaccttattaaatatccacataaaacaaacaaaactctaatgatcaatgacagtatgtggatataagaggtactagtaaaattggttttagagaacctatgttaacttatctgagttttacttggtattaattgttactaatataaactctgaacttctttccatcctgttttgcattatatctataaatataattttgtcacttattatttctatttctgacctaagtcctcttccttcctcatcccatctcttttcatctcctcttcccctcactgattagacagcacattctccctggatggttttagtcattgccactttttcaattactgtatttgagggaaagtttcccaagtctctagctcagtcttctctgctgatttcaaaactattaaccatgtacttgaaatttctgcttagatgtctcattagctgtctcaaactgaacagttctctctctaatgtcccttatctcagtaaaggcatcactatcttcaactctgatgccttgttcctttacctcccacttccgttcagtcacagaattatgatgattctaccacctaaatataacccatcaatttctttctctcctactgtgggtagtttagttcaggccgcagtgatctccagcctaaattattataccagtctccactgggtcctaatcctcctaatattgtcccttcccattcccctctctgatctgctgctggaataatcattctaaagtgaaaatttttccatgtcattccccactttacaattattgtcccaagcccaagaataatgctttagatggagcaagtactccacaaatacatataaagacacaaatacattaaatgcaaataaatggaaaaatatataccttgttcccacaaatcaaaagaaaactggagtgtctatattattattatcaaagtagatttcatggtaaagaataacaccaaggataaagaagtcatttcataagataaagaggaaaatctccaacattgcatagcagtcctaaaaacatacacacctaataacataactacaaaatacccaaatatatgacacataaagcaaaaacttctcggagaattacaaagagaaatagacaaattcagaattatggttgaaactttattgcccctctttcaataactgatttaataagtacacagaaaatcagcaacaatatgaagaatttgaacaacaggagagccaggtagcaagtttggagaactactacttagtcttgcggatcttaggcccaaatcacttgcttgttggctttttcaagtaaagagcctttgtttctattgccaggatacagtgctcatatttgatgtgtgtgttggttaatgtcctgggtgcacttccctgaaatcataacctggccaatgtcattttccatgaaactctaggcctctacagccctagactcctgggtccccttgtcttcttcctaactggaaaaatgttaaacaacatcgctacacttacccttctttcttcttctcttgtccttcagcaggagcttttggggcactaaaagccaagtttctcataactaactttttttagtggtatgttataaagatctttccagttgatgcaaaaaagttcagtgaacttttttattagagctattttctctcttggttatcttccataattataataacaataatcacgaacccttatagagcacttaccatttactgtgtgccaggcagagttttaacatgctttacatttgattttcacaataacctgtgaggtaggtaatattattatctcattttacaggttaagaaactgagtcatagtgaggtcaagtaatttgcccaagaaataacagagaacagcacccaacctaacagtatggcctccagggggtatttgacccacatgttatatgtgccctaaaaaatagattccataaaagggcatacctttttctttctgaaattttaaaataattatttgaaaaatgcttgaacaagtaagctttaaatagtttaattctgtggcttctgctgaagtttaaggactgcaaaagactgcctcttcctccagctagtcctttagacagatttaaattataatcaatgaaacatattgatgctatgtttcctttagtcaaaaggataatttagctgtcacagaaatgaggaaaaatgatcatattagagaaaaagattgagtgatctctgtactttcatgagaatgtttttcttctgccacctgggagaggatagtccttcctttgcaactggttgcaaaatctcaagaagtcaagcatagtagcgtagctgcttataaaactgtccaaatttcacagagcatggctgtggcttatagaactgctcatatttcacgtagcatagctgtggcttatagaattgcccacatttcacatagcatggctgtggcttagtcttaaaaagaaaaagagaagaaagaaaagactggtgatcaatcagaggaaaaactcctccctttcctacctgcttcctaggtctatgcttccccaaggaaagggcctgagggcaggacctgagctcccgtgaggcactacatggcaaaataaagccaaggtggacagagaaccttgtgttggaaaaacgtcaaggaggaaaaaaaagtgaaactgcaccaggtcaccttactgcagtccccccatcaaaggtcccaagagggaaagctgcctacaacctggatttggcaggtactagtgcttggaattaaattcattcctgtagggatggggcagccagggagcaagaaagggttggaatgcttatgagggattaaaataaaaaatattaaaatattaaacttcaaataaaaaataaaatcaaaaatgaattaagaaactgccctgccaacaactttgtcttataacatcaataaggataaattaaaggggaaaagagggtaataatgatctgattcacgccttctgcaaagtccttgacgacgctgtagaactggaaggatggcaatccaccctttcatctggtttaatgtggtggcagcacagtattttttcattgccatgaaccacgcaacggtcgacctgtaaccaccctgctccccagcaggctcacacaccttctgagagttgtccttctgtgtctgccaagccctgatgataaggtgtgttcctccacattagtcatagaggagacttatggggaaggtagaaaaatcactttcagatcaacgtcaaaaccaacgcttgctgtgcaggtctctgcaaatgcccatattcaatctctaccactcattcctttgttattgttaacaattatataagtttattattaaaaattcaaacaagtacactaaacagcatctcatatccagtgatggcactttggttagcctccttccaggcacctctttccccatccagagagtcaagtatacatttattccctttatggaaatgctttttctctacagtctacaaccatgttttgttcattcagcaattgtaatgtgccacatgccagcaatattattcacagtcaaatgatgcaaacagccaaaagaaatttgtaacctaatatttttcagctgtctttttatacatatatatctaatgaacacattgtaattgtacgtattaatgaggtacaaactgatgttttgatacatatctacgttgtatgatgacccaatctgctgtgttcttatagtggcaggtatgtcgaagacctgaatgaagaccgtacatgacttacctcctcagaagaggaaagcagtgcgcatttctaccaagggcagcttcatgtagagggtttagaggagggaagtacccattcagaacaattactgccaggcactttgcatttgttatctcactaaattatctgaacaattggaaaagccaggtttcatcacacagaaagaaggaaacagaagccaaggaaattacgtagctatatcccaaagctaatttgcagagggtcaggattgtaacccaggtctctctggcctcaggggctatgaatgctcccatagcaggtgtgcacacgcccagcacccagccctccatccatgctcagtgtgagaagcagaacgtcacacaccataggtgagttcatggactgcagtgtcacttgtgtttcttgcaacatgatctgggcctggttatttctccattctctgatggttccatgcatatgtgccagaaagctgaaaaaaacatgctctctgactagcaggctcaccctacctagaacagatggaccaacatgtggaaggcaagtatgggggaggaagggagaggaaacaggaaaaacagaaatggggccaagccacaagtggaatacatttttcattattacctgattttgaccgagggtagatgcattagaaaccatcctaaattgttcatacagtgtttacctgaaaagaacatacacttaacttcaaagggaaataggtttagaattgcagtcagcaagtcccatttgaggctctgttctttgagacagctgctgtctggggctcttgtctggcccctgctggggcctcaatttcacagcttctcagggaagtcggcttggagtgacaatggtgagacaatggctatgacagtttcatcaccatcctcataatcatgcctcttataagagcttataagatgttttcacatatatgacatcacctgatctttataatcatctctgacttatctcctcagaagaggaaagcagtggtcattcctaccaagatagaaatgacctgatctttataataatctctgacttatctcctcagaagagtaaagcagtgggcattcataccaagatagaaattattattattaggcaataatatgacacatttaatagcgtgatgtaataattactacatcagtcttatccaagaagaaaccagtgtttggcaaagtgatacaacttagctgtgttcacacggttagtcggtgtcaaagccgggactctagtcagatctgctccctggtctggcacatttttgctgtagtatatcatgacaaggtaaaatgacaaacttcctaggttcactacaagacttgtattttatcattcagggagtatcagagattgagaagtatggtgactcatgatccttttatttgtaactagcgctgtctgttcatgctaatttttctctttgtacatgtggcattaaaggctaatgcatgatcagcaaatctttacagactaggtatgtgtcatttggactatgatgacaaagtgtgtctcgagtgatacatttccatctgaaatgacctttcatgcattaagggtagtgactgagagttttggaggcaggaccctccagagcaggaatggaagcccttgaacttgtcaagttacttcactaatggaagccttgatttttttaatctttaaaatggggatagcaatgtctaccttgtagggacatcatgagtattaatgagataatgcagataaagttcttggtcccagcaagatcctccatgaatggcatctcttatccttattccggagttctttcccattatatttaagcttctagtattgacatcttcttccttatcaaaagttgctcaacatacagaacctagaaggaaaagactctttccaaatagcagatggccaaccattgctttaaattgttcagttgtggagctgactttagaatcagatctgagttcaaatttcagctgtaccaggtgccctgggaaagtcatcttccctatcccaacttcagttccctcatctgcaaaatggggatcatgatgtctattgcacagtgctgttgtgagaatgacatggaagtgcctgacccagaggcaaagctagacaaatgctactgctgttctggatgttgctggtttcagaggccgagcctgtgtgaggagatggcccagtgtggggctgtagagcctggggctgctggcattttggtgggggttgccctgtttgctatccatctctgatcgctgcaggggcctcttcctgctgttcctttctgcttggctgtgctgttctttagagtcccctgggggaagacaaaggtgaatagagctgtttagtttggaaaaaaagcatctcaagggcaacctagtcatggattccaccaaggactcttatgaagaggagctgt

SEQ ID NO: 1107 - DNA, 1871 bp, Homo sapiens
accccagcacttgggaggcagaggcgggtggatcacctgaagtcaggagttcaagaccagcctgaccaacatggcaaaaccccatttctactaaaaatacaaaattagctgggcatggtagcacatgcctgtaatcccagctacttgtgaggctgaggcaggagaattgcttgaatccggaaggtggaggttgcagtgagctgagattgtaccattgcactccagcctgggcaacaagagtgacactctgtctcaaaaaaaaaaaaaaaaaaaaatggagacaataatgcctgtttacacggtgggctacaaggtttggggtgcaaatcagctcgcctggaacatggccctgggtcagtgctgcagtaacagtggtcactggtacccctgctgctggtcaatgattacccgagtggtgattattattgctgttcatcatccagtcttccttgatggcctttctgcacatgccatatttctttgggtaataatccatttctaattgagccacagggtaaaggctttttggcactggcattctctcccatattattttgtgatatcacattccacataagctttgcttggctaatgaaacaggagccagtgggaacaggaatcgtgggaaattgctatgctggatttttaaaccaaaatcaaatcacatgcttttggatagccagtgtctgtgctaagtgctccataagtcagcctccagttcaccagaatgcagctgtgtctacttcaagcatgaaccagaacagatggggccacatgcctaccccatcttgggccaggcctcccttccacccgcttcccagcctgctctagatctggtcctgaaagagaagggggctccacaaggagggtccctaggaaacttcctctgatgcgttttccagcctgggtcatcccattcaaagagaggttccagctgtgagtgggttcactgtgtctttcagctggtgaacttgttctcggaaagctcttaattatttaaagtgcgtattggtttttgtggccacacctcatactgtctagctgagttcgttaaaaaagacaaaaaatccaattggccagaggaatctcccttttctgatatttgggcaagttctattcatatgcttcctggatcatttaaaatacaactatactaattacatacacctcctaggctggattctttgttgagcagagagaaaacaaagatgatttatgtacttaatgtaacattcaggagtgcatcagaagcatttcacgcttttcttacctaagtgccttattttatgacacttacatttaatgagttactctcaatcatatatactttattaatttatgacaaaataaattaaaagcactggatattaaagctcccttgttgcaggaacacatcattagaaacactagatagcattattttgctacatgtttctcagggaaaaacagaagagaactttgtcaaagaaagactttaagtgtttcaccaacaaaatggagacaggcttatcagtattttactatgaattagtgggggagtagggggaatgggtcttccaaatgcttattggttaaaagtgttttgttttggccgggtgtggtagctcatgcctgtaatcccagcactttgagaggccaaggcaggcagatcatttgaggtcaggagttcaagaccagcctgtccaacatggtgaaaccctgtctctactaacaatacaaaaaaattagctgggcgtggtggtgcacacctgtaattccagctactcgggaggttgaggcacgagaatcacttgaacctgggagacagaggttgcagagatcacgccactgcactctagcctgggcgacagagtgagactccgcctcaaaaa

SEQ ID NO: 1108 - DNA, 3504 bp, Homo sapiens
gcatcagagccaactatcatttgccttattgtttatcaaatatgtctcattgtaaattcttattgagcttaaaattcaattaaaacccctcatggcacgcatctgctgacctacaactgggtggtgaatatagacatttgcatttacctgtctggaacttggtcattttcgtttgggcctgtcgtgtcagcttgtccgagctctcttggatcctcttttcaacatattgccataataaattcttcctctgaggtttgtgtcacagacacatttgatcagcacatcggtggcatcctcattaaagtcagtggtctaaatagtatagcacagagagcatcacagagcctatgacctgcagcttccttgtaatttgatatttgctgttctgtcttccatgtgatttgttctaattgatgtttaagaaccagatcatgtttatttttctgtttaagaaccagaccattgccttcttcaaaataattctagtcaaataaaaaaattatttttatgcctactgtgtgtaagtagcttgcctagataccgatgaaccatgtgacagaagcttgccttgatggtgggcaatgaggaaatcgggcatggatggctaagaaatcaaagtgccgttgtaaatatggagcagatttgtagtttggcaggatataaacccgtgttgggaaactcccaatgagaggtcaaaattgaaatggggctgtctgaaattccattttgttcatctagataacctggataaatgggctaaattggaaatttgagtcttaaaatcatttttttgagatttctcctattcattctattgacttactctccattttaaagtcttttgtcctaatcatttaccctatatctctctgttctatgcctattttatttttctttatgaaaatgggtgaaagcaggaattttgctagttttctaattatcacagcatataaattcagtaatgtatgtgaaagtgttttctaaactatgaaaagctgtatacatacataggaatagaatggattgtcaataaattgaagagatgagtttactcctttgtatgtggaagctgttaatttaaaataacacactcaaaatattagctaaaaatctacttcacattttggtgctgcttgctaaaattagttagaaaatataggttatttttgagttaaaaccaagttcaataaattcttaagttcctcaaatagaattttacagaaatatttacataacccacagctaaagtgagttttctaagaactccccataaggtgagatcacgtacaccatgtctcagtacagaaggatttttttttcaatcagttatgtctctataaataaacctagttttgttgttaaaattgctgtttcctcttcacataagaacatgtcattaattttggtgaaaaccttccaacaaaataaggttaaattgtccagttttccagtggaagaggaattattttgtgtcaccaacaagcagagtaacagcttaaaggtaagttgaacacagacatgctgtttgggtggtcagaatattttgcatccaagcataaatgttagtaagagcctataggtgagaatgctttaggtatgtttttagtaatgctttacctctgctactctccttaggatttgggaaccagagcattcatactgatgttctctgtaattaggtacaccaaggagtaacagaaactgggtaggtaggtaggtagagagaggtgacctcagccagagccggtgtgtttgtataggcaagaagaggagctgtattccatggtctgaactattaagtgatccagactacaagaatatgacttccttttctcagttgtttgaagttcatttagcgaaaaattaaaatacagtttcctataaaacaaaatcatttagtttgaactggaaaaacatttgaggttttcttggtttgagagaaaataaacattttcttttgtcctagcacctataccaaacagtaatattgacaaaaaccaaacctaagaaaatgcattttttttcctctaaattaagaaatagtatgtatggctttaagatgctgcttaaaaaaaaagaataagtcttacatttgttctagttgtcagagattgacagaactaataagagaataaaagagcaaaacgaaaaagttcttgctgattaacagttgtctgaggagaaacagacgatatgttttctttattgcattgaaaagttaattattaccaatagaagcttatttatgcttgtaactgagttagcgttgtggcttggcattattccacatttgaagggaaatgggtatcggcgaagagtctggagcttgagttctagtacagttgagtgggcttagcgagtggtttaacttcactggatcccacgttcccacctgtaaagtgaggcgatagattaagatgatgactgaggtgtcttgtgtccctaactgcatgtttttttcctaaaggcctattttgttttttatgaaacaaaatattttatcttcacagggaagtttactcccaaatgtttttgggaccatttagataggagtacactttagaaaaaaatataagcagcacagtatttaaagaacagaaattgtatttgctaagtaaatactgtacatcgaagtcttggaagttagatacaaaataagccaaaagtttcattttatattccctttagcaatcagaatatttgattattttctagacagtttctgtaagagtaccatttggtataagagttttaatttgtgatagtagaaaagtaataaaaatgtgtacaccatctaagagacaaaataattttgccaaaaattgccttttgttctggttaagaataaatgggccaatttcttttacacaataatttttagtagcagataccatatctaaaaaactatatttactatggcaatagtagcagactaattatccagctttctttggaaattgtgacttttgtagttgtcaatacttttatatctacactgaaaaatttttggctttgaagagtatgcctgcatgtatgttgattttcctgtaattttagtatctgggaaaatattccatctgaagcatatgtagaagtatagaaaattgttgaaattccattttgaaatgacctttaggctgctcttcatttaaggtaatagtgtcaattttgaacaaactgtttcaaaaactttatttaatttaggattatgaatggcatccttgttggtttttaagtatttttaacctcatgatgagaatctgagagcattgtaaatacatttaataatgaaaaagatattttctaaacttgaagtcaataataaacttcttgtatttaaattgacttatgaagttttcttaaggcaaaatcagttataactttatgaatagcaatattttcagttcatttaaatttattttatttttatagatagtgaaagcatctgtatcttatttgaaagtgcctgtcattctcttatttattaaaattgctttagtgtgg

SEQ ID NO: 1109 - DNA, 3535 bp, Homo sapiens
agtagggcacatggccacatagactgtttaaatcatgaaatctcttggaaatacccatccaagggatggatgtgaactctcggtgttcccgtgagagccagcaggggtaggtgccattggctagagagacggctgaaaataacccttcattcagagccttgtgtagaaagttgggttgctgtgctcatgtcctcttgacccaaaattgttaacatggttggatgaaatgctgttcctagaggggaacaaaagtggctatcacaattaacatggccctgtttgacacctgatcctaaaagtgatttttgtaaattagagtttgaagcatgtggtggcattggtggtgctttttctgaatgttgttcacttaggttttccagttacacgaattgttttcggggagcttacacacctgttcccatcctctggggtgggctagttgctatgttatgaaccttaacctttgcatatacctctgttttattcatgggaggtcacaacttggtaattctgtctagtattcaagcagattattacaagtgcttagaagactaatatagttagcatttgatttgaaagggacaaagaccagttaatagttttctgtaactatacttaatatttcatcaggcaagtaaggttgctgccacttagttaactgggatgccaaggaattgctaaaaaaaatcaaattaatacacattattacacatatttacacacattgaactatttcaaaccagtattgctggaataaagacaaaataatactgtgtatttacataacaccataacacctttcatcagaaaaatctcaagccttcgcagactaactaagctgcacaacaccgtgtgaggtgtgtaggaagtaagataggacaataaacaagaagtcgatggagggaaaaggcaggcaggcaggcaagcatgcttgcatagggtgagtgagactccttcctgctggatgacccactggcattcaagtcctggtcaccccatcgtgaggatacctagattgaaagctccagtacatgtcacaggtgattacagacttgagtattcttctgtgtgttgtttttccattctaatgtctgtattttaattgaatcgactggacaaagatacagcattccacctctactggactgtaacagtgactcccagtgtgatcaatcatttgatcattgtttcactttccctagggccaactaaatacagtttcctttatttttccttagctagaatttttttactaaagtgtgacagtttattctctagaaatgcctagagatggctgggtacatgctagtccatggaaaaggcatgggtgagtcatggtctcttttgggagggtcggggctggtgggaacaaattcctgcccaagcctgcttcagtggctgccatgcccaacacctcccatgataggcctggcctggcactgtgagcagagagagctgaccaggccttctgtggagcatctgagacaggcctggagctggaggcagtagcgagccaggagaaccagcgtgaagaacacaggaacagcaacaggccaatgggagtcgtgaatttggcttttcgaattttggaagagcatacattaacatctttaaatcaattttgaatgtactatgttctattggatattcaaaaagtttagtcctgaaacttagtactcattcagttatcccatgcaaaggatttattcacctcatcctttgagaaaaaagaattttctgtatgttagtctttcacacagcctctgtttcggcttaacctttcagattttcagataatttaggtgtcacagatacccatgataggatcgtttttcagacactataatttaaatgtctctgaaatgtaataaacagagctttgtctgggttttggaaatgatgttttcttcccaaacagctgttcatttgtattaacacttttttctgtctctaacagaaaggcagcatttcttttttatgtataatctcatcggccttttcatcatgttaactgtgtccagcgtattgttgtggtattatttttaatatcctggtgtaccacaggcagatgactagcatgacctcagggctttctgaagagaagataccgctcatttttccatagcctattctagggcagactctcactctctatcttagtggggctggctaatttcattacctattcaattcatctgagaccattttggtaaaagcgttgaaatagcaatgcgctatgagctagtctttgctcctgtattcaactggcaaagcaaaggactttggttttcattttgggggccccagttaacacccaaaggatggcaatttatgaggccctgatgaagatggtgagaactggcatttgatatatatcaatatttgatttatttgatatatgtgatcttctaacaaccttgtgatgtatataggagaagtattgttaaaattaaattttactttgaaggaattcaggcctagagaggctaaatgtcacagattcccatggctggtaggctgggcctcataccctttcctacttaatgcctctgagattcactagagagaagagtagttaacagtgcaggttctgaactcagacagtttaagttcaaatcctgtctctactatttctgtgctatgcgattttagggcaagctacttaacatgggagtaaacttcttcatctgtaaaattatgacagtcgtgctacctgtgtcacagtcttctctcaaggattgaatgagttattacacagaaatgttaagaacagtgcagggcacatagtaagtactcaacaaacattagctaggtgaattgtttaaagtgtccagcacaggaagcagcctgtaataggaaatgagcctgtattatgcctgggaggtgatgttacacaggtcctatcgagagtagacaagctgactaaggaaggtgctcaagtccagcagggaaagttcattctgcccgtactgttaccaaagttagaatatgacaatacttctgtttttgcggtacaacccgggactattgcagcctattaaattaatgagaggcagataattgacagtgtctcccactggggaaccaggtctcactctgggtggagcagttaatatgcaggtctccactctggagggataggagtgctgcttcctcatgctgcattccagaatcctttctagatgccttcaagatttatacccttaaagttggaaacctggggggcaccttgtgcccaaacagcgctaaattccaggtaacacatctccattcacaacctattgtgcgtagaccctcctggacactgctattgaccgttgactgattatgtgatcaaagattgatgaatctggaagcactggagggatagcaaaggctttcatttttttgtttgtctttttaaatcctgttccatgttccactttgaactggattgaagtcagcagtgaaatcaggagtgtggaagctgtggtaccagaggagagaaccagtgagagagacttggcttatagcaatcagtccagctccagtcaga

SEQ ID NO: 1110 - DNA, 2090 bp, Homo sapiens
ctataattttccccaagtattgccatagaaatcgcacttcagactctacaccatgcatcaatttgaggagaacaatttacctgtattgtttcccatgtgtcatcagcgtcctctttctcctgtttcagtcagcaggactcatttcatccattttcatctggtactgttgactattcatttctttgcactgattttgctgccaaagtccccttttcaagtcatggacattattaagtataccctttattttacatcacttgccattttcagaactcctttatttcattactttgcattcagaatttccggcctaaatcgatagccttgacataaaggcaggtctctgctttctcttttgggcatgaacagttcctttcctgaatcagaaatttatttttctttctagaagtctagtgtggggaatagtcagcatgcttactaagtcttaatttgttagaaggaaagatgaagataaatattggtgatgggggttccctagaaaataaattctacctactcctaccctcacacgtttacactctgcttttgatgcatctcttgtattctgcttttcctctctaaagaagggaaacttcttcctgggaccagtacattgggctcattagttccagccccagctctgccacacgcttgctgtttagcttttagaaagttagctcatctttctgttttctggcctatgaaatggagactcactgatctcttggatggatgaagtaccaagtaaccactatgggacttgcccccatgcaggagtaatgaatgaatcaatttcaaaacagctggacactaagcccacagcccaggctctcctcagattcattctatttacagcccagctttcacacaacgtgtctgatagccagttccttacgaagcctctgtcatgcttacggagcacgtgaccctcttgaaggagatggggaaggatcatggaatgttaaccactgttcccatgcatggaactgtgctaagaaatgtgctcccaggtagttttggagccatatgtgtctgaaaagaactcataattagctgaagtcaagggaaggggtcttcttatcactccttctgtattgttttaggcactcacactcatcagcagacagagtgcattcactttcttttctttccttttttctttctttttttttttttttttagagaggaggtcttgctttgtcaccccaggctggagtgcagtggtgcaattatagctcactaatgccttaaattcctgggctcaagcaatcctccagcttcagtttgctgagtagctgggactacagacatgcactatcacacggggctaattttgtaaattttttgtagagatgcggttttgccatcttgcccaagctggtcttcaactcctgggctcaagtgatcctcccacctcagcctcccaaaatactgggattacaggcatgagtcaccgtgcccagactacatttactttcttgattgcactttgaggtttaggggctaatgcctgatgctttttttttatctgtatgaagcagcggccacacagatcttcatcaaaagctgactgttctcatttctccccaagtaatcactcttttttttttttagcttgtgctaaatcattttttaaaattgtagctctgaggcattttattatacaaagttagtactcatatacataaactaataggaacttaaaactcattatacctttgcttcattttttttagcttgactccctcgtaaatctttagcttcattgatttggctgctatgtaagcttcattgatttggctgcttaaatcactccgttgagtgatttaagagcataatttagaagaatggtgtgtccatgtgtggctcagtttacagtaccatttggagtttgattgcttctgtgagttgggtgatctctcctcttgaggtccagatcaaccccaggaggagcctagctgctgctccccattgggcgccccatttcagcagaagtagccaggagtcgtcacccagaaccccctaacagcagttagtgtggcatctccacagtggggaatgttgtaggagttattaagaaattattttgg

SEQ ID NO: 1111 - DNA, 1697 bp, Homo sapiens
gctgagctcatgccgattatagaaagcatttgcatcttttgaagggttttcctctgagggttcaaatgtccctcagggatcatgctggtgataatcccagctcacaaactgactggtcttaattgccttcaatcaagtagctccagcaggagacgggaaaaatcaccgctgagtttcctcatacttctggccacctgacagggtgtcaggcgtttttggggacaaaatgaatcctcgcacacctggcccagcaggatgagggcatcccgtgtcccgctgctgccccgctgagaaagaggtgccgttacaggagtggaaagctgacttcgtccacagtttctctcccagcatttcacactgcattgctgtttgcttcttttcatgggcggcacacatctctggcactcagcgtgtccatgtgctgttactggatggccatacctggcaaacatattgacctgtgtcttgcggcctcagtccacagctttatgctcaagcgctcttcaagatggaagtttagaatttcttctttttggaattcagaaatcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgt

SEQ ID NO: 1112 - DNA, 2261 bp, Homo sapiens
acttagccaaaaattctattaaaaatcttaatattcaatatccaaaagaagagaattatgttatatgcagttgatcgggcagcacagtgcgacctgaccaagctcactctgtgccgccctggatatcccacacgtgcacctgttcccacacacgctcctttcctgccctgcgcggcccgctgcggcacagagctatgtgcaccgtggctcctgagccctgcccggccaggggcagtctcctggcggctgtgatcctcttcctgaggctgccacagctgtcttgcagcccagtcccctctggtgccatgccctgggcacgtcactgtcccttgctcacaactttgcaaaaagttaagactctcttcagaaactcctgtgaccatgcagtagccatcatgtcctgccaggcccccgacaaaggatatgatagcaaagcctgacctcagcgaggagagacagttatggtctcagttcatctcctttggtgtgaacaaaaatattcctgtgcctagaaatgtttttgaaatacaaagtaaactggaactatagacaaatattttatattctcttatcagaaaaaatcaccatttgggaaagtataaattgtaaatggtaaataatgtgttttcttctctttttttcctttaatgtttttctaaatgattatacaaagaaaatcatctggctgggcacaatggctcatgcctgcaatcccaacacttttgggaggctgaggtaggagaatcagttgagtctaggagttcaagatcagcccgagcaatatagtgagacccctttatctacagataatttaaaaattagcctgatgtggtggcacgcacctgtagtcccagctactcgggaagctgaggtgggaggattgccagagcccaggccgtggaggctgcagtgagccctgatcgcaccactgcactccagactgggcaacaaagcaagactttgtctttaaaaaaaaaaaaaaaaaaaaaaaaaaaaggggaagaaatgaaaaaatcctgtttctattccctctactgatgcatctgactctcacaccacatctaaattagagatgaaggggctctctcagtcacgtctgccctgaattgcagtgggggctctccccagctgaggtgtgaggctgggtctgggccttgcccctttgctccccactccgtgtcccccagcaggtctgccagcgccgagccctctgcgcctccacctgggagatgcaggtggaaagggctgcccagactctctctgccacgtgctcttttgtgttatcgtctcagggaattgggttgttctgactcctagaaaattggctctcgggttggtgtaagtttgtgtagatatgactgcatgtcatttatagaccaatcgatattaaccagtaaattgctcactctaatagtgcacacttaatcaatagcagcaattatccaagtaaatctttcatattcagtcatctgtggaaaaattatattgggagaaaccgtaacaagagcataaacatttctgctttctattttcagtcaggaaagaagccactttttaaaagatttacatttcccaaagaaatgaataattaagatggtaggcatttgctttatttttaatagttgtgatctagtgtgagacatagaaaataagtcttagaatatgaaatcatggcaaaagctgaaggctttttatatgatatgttttactatttttaatcatttatggagtactttatgtttgcaaagcccttgcaaataattttattacacatgtaaatgtttgattggtggcgagtatctatacatagtgggtataaaatgagatggaagcctttactgtaaaatatgtcttacttgtttaaaaaatacgtaagtatccataatcagatcttcccgttgatatgtttttgtgcccacacaaattcaaattgcctttgaggtccatcaaatagataacaaattgagggccaggcgtggtggctcatgcctgtaatcccagcactttgggaggacgaggcaggcagatcacgaggtcaagagatcaagaccatccaggccaacatggtgaaaccccgtctctagtaaaaatacaaaaattagctgggcgtggtggtgcacgcctgtagtcccagctactcgggaggctgaggcaggagaatggcttgaacccaggaggcggaggttgcagtgagccaagatcacgccactgcacttcagcctggccacagagcgagactccatctcaaaaacaaataaaat

SEQ ID NO: 1113 - DNA, 2615 bp, Homo sapiens
gaaatgagtgtaaagattagaagtatttaaaagtgccttttccttactcagtggtctggggataaatgctgtctactgttgttactggtattctctaatataatcatgactccaatggaggtctaaagtctttgaaagaaggaatgagattttactcacatttgcccttttctcagcatcgggcatgcacaatgccttacttacagtcgacattaactatatttttaaatgaaattttctcctttgatacctcacactagttttaaaattaagaatactttgttaaactataaacaatttatgttggttgtagacttattagaaaatgcagataagaaaaaaatgagaaagtgaaaaccctgaattcctctgctcagagtctgttctcacttttgtgcatgttcttcaggactgttttccattttaaatttactttttgtgtagagtattaagaaggttgaaacttgtcaaataatagaaaattctatcttaagaaatactaggaatcagtattgaggatattttcaacattttaggtttttttctcagtatacttcagaatattggttttatatatttgaaatagatttaaatgtttttgagcagagctgccattcactttaaaaacagcaacaacaaaacaacaggcatcatgtacttacaaggaatttttccagatctatgttgcaagtgttgcttcctggatgtcatctgctctgaatatttgatcacaaatcagaatttaaaaaggaagttttattttttcttctgaacaaatattcaatttgatttctcactggctatttttttgacgatagtgacaaatagatttaagagaagaaaagtaaacagattgaataattatccactaacagattttaaaatgtaaactacaatcttaaatcatgaatctaaatgttgaactatcctacttccatcctgtattggacagatagtaactttctgaaatataacacccacaaagagcattcagaatacaccgggtgtgtagtttgctgttttcattttatgtttttgcaccatagattataatatgaacatatcagtcacttctgacagccaagcagcacgacaggatgccgtagtgacaagttccaggtgcaacgtgtataagaagataattgtgacattttttccccccaaaggcttcagaaatcaagtataattttgatcaacaataaatgtgctattagttaaaaaaaaagtacctaacataagatttttagtatttgtagtcattgatttgtgacatggtctatctgggtgcactttgtaagtttcaggacaatgttatgcgtgatcctatcaaagcaaagtccttttaaatgcatgttggaggcaacattcacagcctgttaacgtcctttgttaaatgtttttcttcctttcttccgtttccctttcttcctcccttccttccctcccttcctcccttcctgccttccctcccttccccaaccctccctctctccccccaaccctccctccctctctctctctttctttttctgagacagggtctccctctgtcacctgcaagctccgcctcccacgttcaaaagatctcatgcttcagctaactgagtagctgggattacaggcatggcacgtgtgccgccatacccagctaatttttttttttgtatttttagtagagaaggatttcaccatgttggccaggctgatcttgaactcctgacctcaagtgatccacccacctcagcctcccaaagtgctgggattacagacgtgagccactctgcctggccaaatgttttcaatgtgatggaaaaatagtgggttttgtctacctttgaaacatttatgttttagcccattggagaaacaagagtgaaaaactgccaagcaccacacaaaactccacgtggcatccagaggcctttttcctgccctatttccagacttcctttgaactgaggactggctcctgtgcttctcttgaagaaatgccttacagtaaatagtaccaattctcatcattgctcaactttatactgtatttatttatatttatgacttgatctttcactctttttctaatgccatgcctctaattgttctgtgagtcacctgtctcaagaaacaattactcattctggtcatctgttaatgctctcatccttcaggaagcatactattataatcatgtcattttcaaatactttgcctttttccaattatcccccaagttattttgtgtttgcattcaagttttcaacaactctccattggatggttaattttttcctactaaatgctccctttatgtgtggagcacatctgcttatatgtctccttctttcctgtccaggggtactgattgctcagaatttcttaactaactaagcctgggcattctagggttaaagaaagagagatttgatcctcttgtggcttttaggctttggtgtttcatgtttttgaaaactaggaaatttttgactttgggtggaatcataatgacaagaacataagaaaatagaacatagtgggtaacttcataacagtggttatagaacaggagttatctatgattgattaacgttgtgtgctgttgcatgcttattttctta

SEQ ID NO: 1114 - DNA, 2131 bp, Homo sapiens
atttcacataaaaagaataatgcagtatgtgtctttttgtgcttggtttctttcacttagcttgatattttcaaggttcatctgccctattgcatgtatcagtattgcacttcatccctttttatgtctgaataatattccattgttggtatatatcaaaatatgtttattcattcatctgttgatggacatttgggctgtttccaccttttggctattgtgaatattgcttctataaacattgtgtacaaatacttgtttcagtacttttccttcagttctggtaggtaggtactaaggagtggaacttctgggtaacttggttattctatgtttacctttttaggaaccatcaaaatgtttcccacagcgactataccattgcgcataactggcagcaaaccttgattattttgcacgttctgcacatgtatcccagaacttaaagtaaaattttaaaaaaatgattaattttatggtaggtgaatttatttttataaaaaataaaggaatattgcaaataaaaactatcaaggagggctttctagaagatgtagaacttaatcagagcctcggatgatgactaggattaggcaggctaggaagaagtgaaatagtaagcaaaaatacagaataattctccattaatcccatacaatagatattcttgcatatcagcaagttcctgcatagcctgccccaagttcacctggctttgccttctccataactctacccagcacccagtgactctataggaattaacaagaaccgcatttacagaaggttttatataaatggtgtgaaacagagtacttgctggagagcaacgtactaatatcagaaaaactggagcaagttccaaataactgagaaagccccacagctccccaaatgtatctagggcttgcaggcagaaaacacgggtgcttgtgcaccaggtgaccctgcccagtccctagaggcacccacagttctgccttgctgcccaccatgacctgcctggcccttttcctccccaccaagtcaccaaggattccgatcaaaagcacaggtcagaggtcccagcaaagtggaaagggcctggggaaggctatccctggagaagataaagctgttccgcctttctctgggccaccacccacacagccttgggggcaaaggagatgtcagtggcctctctgaaggtagaaacccccgactatggtgctgagctagactcacctttcttcagcgagcagaaacacgggagggacccaggaataagcgaggcctgccttcagtgcagccccactagggaaggatctgatgagcagctctgaggaaccctgagaacaacccatgtctcaacccagttctctgactctgggctccaagtcacttctgtgggagtttccccatgctgccatcagtcacaccaggggtctctggctccttcccacaagcctgagccatcactcacagtgggatggaaggctggaggtgggggaagtcatgagatagactctgttctgtttacaaattgcttttagccctgcggagagaagtacttccaaatgtgaaggtgtatgtgactgatagctttgcctgaaacctaccaaggttagtgacaaagccattgcccctgcctgagtccctcattccttaggcagaaacagggatcctggcaatatagtccatcttttctccaggaaaatgcatcacgcatccaggcctcagatctctcctctgaactccttccaccttccatatttgcctactcactggggctggtatgtcacagagagccttgttaccttttcccacgtatgtctttcctctagctccagcctgtcaattcatccagggctagagcttgtcttattcatcctgaagtctctcattgaacttgtcacagtgcctgcacacctacatgctggtcgaacaaatgttgtgcatttatattcttgctcctgtgtcaactgctggcttttatgacctcaagatttatgtagacatgcttttaaaatataagcatttattgcatgcctattgtgtgctaggcacaatgctgtgtgctttatatacactttctccaacccttctaactaccctgcaaagtgagtattctatcctcaagggaaaagttaag

SEQ ID NO: 1115 - DNA, 2968 bp, Homo sapiens
aatacttccagaaaatttccacaaatcggcacatttgcatgtatatgtgttctcaggcgagacccatcgccccccacctgcctttgttcacttactcgctgtgggtgattgttccatatccaccattcagatttatgtcttcgtttttaaatagctgtgtagttttcattgttatgactggaccacagtctatttaaataatctgtcctctaaaacatttagatggttttctgtgttttgttgtcctaaaaactgccgtgatggacaacaaacaagagtttttgggaattgtgattttataagaccaagttaactagacagccaggaagcaaaatttgaaaacaatttatttaaaaatactggctacgtaaggtggctcatgcctgtaatcccaacactttgggaggctgagacaggaggatcacttgagcccaggaatttaagaccagcctgggcaacatagtgagacctcatctctacaaaaaagaaaatactgttagttgaacagtattaaggggttgggaggaaatcatccataatcttacctccccaacacagttatttttatttttgcatattatttttttttttttgagatggtgtcacattatgttacccagactgatcttgaactcctgggctcaagttatcttcctgcctcagcctctggagtgcacaccaccaagcccagcaatttttgcatattacattcaagcccatgtccgcaaacatttttacatagtggccatcttaatgtaattctttttagagctgtaacaactctttctctctgaattgaaacagaatgaaacaccaagacaccacattaaccccctctaatttcttcctccttctttccccacacttgcacccactcagctaccaagaacttccactaaaggaaagctgttggtgtgggaatttgacacaaacatcttcccatgtgtttctgtatttgtaaattctattcactcctaaacggctttaaagcaagccttcagtttatttttatacctgcctccacttcactgtgggcacttgtttttgagcctgcaacctgttgtaatttaacagacaaccaaaaggccttgtaagaaggttgttctggaacagcttttctggaggaggtctgtctacagagggacttgcagaggggggattgtcaagaaagaagcctccttctctaacaaggggcagtctgagagagatgacttttgtttcgcgccacccaaattccatttctttatcctttagttgttaggaccaggtgtcatcaggtacaggcctgccagagaagatcctacccagcctgcctcctcaaccacttctacccattctgaaggcaccaggatttcttcagtccaactttgggcaggtctccctgatgcaaaattggttcactaaaattttgtgaattgcattaaatttgtagcagggttagggctcttacttctgtagggaagatcttgatttagtgagaacgaaaacctagactaaggcttagcactcctggattctcctctgacgggtttctttgttaatttgccacacaatgcatatcaggctatttcaccacttcaagcctgtttacataactataaatgaaaagggtgttttctttctttctttatttttgagacagggtctcattctatcacccaggttaagtgcagtggcatgatgatggctcactgcagcctcgacttcccagcctctagccatccctcctacctcagccccctgagtagctgggaccacaggtgtgcaccactatgcctggctaatttttttgtaattttttgtagagacaagggtctctctatgttgcccaggttgttctccaactcctggactcaaaggatcctcccacctcagcctcccaaaatgccaggattacaggcatgagccactgttcctgaccgaaaagggtgttttaaactgattttttttttcccagagacagggtctcactctgtcacccaggctggagtgcagtggcacgatcatagtccactgtaaccttgaactcctgggctcaaacagtccttctgcctcagcctttcgtgtagctaggattacaggcatgtaccaccacactcagctaattaaaaaaaaaatgtttttgtacagacaaagtcttactatgttgcccaagctggtctcaaactcctggcctcaagcgatcctctcagttcagcctccaaaagctctggggttataggcgtgagccactgcacctggccttaaactgacctttaacatctcttgcaattctaacgatttggtttcacaaagtcgaaaaatatttttgtggatttccattttttgagggctttccattctgtgaccagtgtcctaatttggcccactcttctgcttatcactcctcctttcaagcagtagggcttggtttaccagccccttgggccaagctcttccctaggttctaccgcccatagctagccctctgtttacagtccctcttatacctgcagctcagcttttaccaaaacctggattcttctcaggcgcttcagcttttctccaaatgtctggtcttctgcccaccgttttcccaaggtttttccagcatattctgagtgtctggctcacagaacttggatggtccatcattcatcactggccaggccttcaggttgagggaaatagcctccaaaaagccccattgcatccagagcctgtgtcccaaattagcacctctctggatagccagggaagagggaaaacattctgacataagtatggatttgctagactagctgcatttacagagcatctttctagatggaacatttctattagatgctatggaacattacaaaggaaatagaaggcaccgtaaagcctaaaagagagagagctcatggcatatattccacacaacagccttgaacatagcctagaattaaattccatttatttgttccattccatcttatccttcaca

(The sequence listing continues in the following parts.)

The invention claimed is:

1. A delivery vehicle comprising a nucleic acid construct, wherein the nucleic acid construct comprises:
    (i) an enhancer which specifically drives gene expression in cells of the entorhinal cortex, wherein the enhancer comprises a nucleotide sequence selected from SEQ ID NOs: 1-6, 9, and 10;
    (ii) a promoter; and
    (iii) a therapeutic gene,
    wherein said enhancer, promoter and therapeutic gene are operatively linked, said enhancer and therapeutic gene are heterologous, and said delivery vehicle is suitable for delivery of the nucleic acid construct to the brain of a mammal.

2. The delivery vehicle of claim 1, wherein said promoter is a minimal promoter.

3. The delivery vehicle of claim 1, wherein said promoter is heterologous to said enhancer.

4. The delivery vehicle of claim 1, wherein said enhancer specifically drives gene expression in cells of Layer II of the entorhinal cortex.

5. The delivery vehicle of claim 4, wherein said enhancer specifically drives gene expression in reelin-positive cells.

6. The delivery vehicle of claim 1, wherein said enhancer is human.

7. The delivery vehicle of claim 1, wherein said promoter is selected from an HSP68 minimal promoter, a TRE3G promoter, a TRE3G minimal promoter, a TK minimal promoter, an FGF4 minimal promoter, an Odz3 minimal promoter, or a variant of any one or more of the foregoing promoters.

8. The delivery vehicle of claim 1, wherein said delivery vehicle is a lipoplex, dendrimer, exosome or viral vector.

9. The delivery vehicle of claim 8, wherein said viral vector is an adeno-associated virus (AAV).

10. The delivery vehicle of claim 1, wherein said therapeutic gene encodes a protein or a functional RNA.

11. The delivery vehicle of claim 10, wherein said functional RNA is an shRNA.

12. The delivery vehicle of claim 1, wherein said therapeutic gene encodes an α secretase, neprilysin, PGC-1α, LSD1, an inhibitor of glycogen synthase kinase 3, or a Tau phosphorylation pseudosubstrate.

13. A cell comprising a nucleic acid construct as defined in claim 1.

14. A composition comprising a delivery vehicle as defined in claim 1 and at least one physiologically-acceptable diluent, carrier or excipient.

* * * * *